United States Patent 12,390,499 (BACTERIOPHAGE FOR MODULATING INFLAMMATORY BOWEL DISEASE) - sequence listing, part 3

SEQ ID NO: 57 - DNA, 347234 bp, Unknown
  source: /note="Description of Unknown: KP2-Mcoc1 Bacteria Sequence"
gccgaccctcggcggcgagcgcagcggccggccgccggagcccggcatggaaactcttgtcgccgccgccttcagccagctgctgggctgcgaggtgaacgatatcgacgccgatttcttcgcccttggcggtcattcgctgctggcgatgcgcctggcggcacagctcagccgccagctggcgcggcaggtgaccccggggcaggtgatggtggcctcgacggtgggcaaactgagcgcgctgctggccgccgatctcagcgatgagcaggcccagcgcctggggctggatacgcttctgccgctgcgcgagagcgacggcccgacgctgttctgcttccatcccgcctccggcttcgcctggcagttcagcgtgctggcgcgctatctcagcccgcgctggtcgattaccggtattcagtcgccgcgcccgcaggggccgatggctagcgccgccagcctcgacgaggtgtgcgagcatcatctgcgcacgctgctggcgcagcagccgcacggcccttattacctgttcgggtattcgctgggcggcaccttagcccaggggattgccgcccgcttgcgccagcgcggcgaagcggtggccttcctcggcctgctggatacctggccgccggagacgcaaaactgggcagagaaagaggccaacgggctggatcccgaggtactggcggagatcgaccgcgagcgcgaagcgttcctcgccacccagcaggggcaagcctccggcgagctgttcagcgccatcgaaggcaactatgccgatgcggtgcggctgttaaccaccgcgcatagcgcgaagtttgacggcaaggcgacgctgttcgtggcggagaagacgcggcaggaggggatggatccgcaggtcgtatggggcccgtgggtgggggaactggaggtgttcagccagaactgcgcccacgtcgatatcatctccccgcaggcctttgaggccatcggtccggtggtcagggagattctggggtaacggttgagttcgggctacagcaggtagcccggctcagcgtagcgcaagccggggaaagaggagattaccggcggcccagcgggaccaccagcggcgtatgcgccaccggatcttcaatgatcgtgcagcgcagaccgtaaatccgttcaatcagatcggcggtgacgatctccttcggcgccccctcggcgacgatcctgccgtcgcgcagggcgatcaggtgggtggcgtagcggcaggcctggttaagatcgtgcagcaccgccgccagggtatagcccttctcgcgattcagctcactcaacagttccagcaggtcgatctgatggctgatgtccagccaggtggtcggctcatccagcagcataatcgccgtttcctgggccagcaccatcgcaatccacgcccgctgccgctggccgccggaaagcgtgtcgacgctctgcagcgccagatcgctgatcccggtcgctcgcatcgccttgttcaccgcctcttcatcttctttgcgccagcgggtaaacagcggctggtgcggatagcgcccgcgggccaccagctcctgcaccgtgatatcgccaggggtggtggcattctgcgccagcagcccgatgcggcgggcaacctctttactggcgtactgctggatctgcgcgccgtcgagccagacgtggccgctggcgggcgtcatcaggcgactgagggtgcgcaatagcgtcgacttgccgcagccgttggggccgataatggcggtgaagtgaccgtcagggatggtcacgttcagcgactcggcgatggtcttgttcccgtaggccagggttaactgctcgccgcgcaaacgggaggggacagcactcattttttgcgggactcctgaatcaacaatgcaataaggtaaataccgccgaggctgacggttaacacgccaaccggcagctgccacggcataaacagccgttgggcgccgtaatcggccagcgccagcagcagcgcgccgcacagggccgactgggtcagtccccagcgggccgtgccgctcaggcggcgggcgatatgcggcgccaccagcgcgataaatgagatcggcccggccagcgccgtcgaggcggcggtgagcaccaccgccaccagcatcagcagcaggcgcgaacgctcgacctgcacccccagcgcgcaggcggtatcgtcgcccatctccagcagccgcatccggcgaaccagcagggcgctgcccaccagcatcaacaggatcagcggcgccgacggccaggttttaccccaggtcaggccgttaagcgatccggcgttccacaggcccgcagaaagggcggtctccagcgaggcgcgcagcagcagccaggtgttgaatgccaccagcatggcgcgcacgccgatgccgataatgatcaggcggaaggtttcgatcccgttgcgccaggccagcagccagaccaccagcgaggtcagcaccccgccggccatcgccgccagggcgatcgccgtcaggttctggccgaagaggaccattgccaccagcacgccgctccaggcgccggtgttaaagcccatcacgtccgggctgccgagcgggttacgggtcagcgactggaaaatggcgccgctgacgccgagcgcggcgccgatgagcagcgccattaacacccgcggcagccgccattcgttcaccaccatcgcgacgttgcgcggcgcatcgccgaacagcgccgagaacacctggtcaatcgtcaggggcaccgggccttgcgccagcccgagcagggaaatcagcaggctggcggccattagcagcagacagctggctatcaggcggcgggacggggcaatcacaggccacctccccgcggctggcggcgcaccagccagatcagcaccggcgcgccgagaaaggcgctcaccaccgatacccgcagttcgccgggcaccagcaggcggccaatcacgtcggcaaacagcagcagggccggggtggcgagcagggtgaccggcagcgaccagcgatgatcggcccccaccagccagcgcgccatatgcggcatcatcaggccgataaaggcgatggggccgacgacggcggtggcgctgccgcacaggacggtgatgacgatcaggccgatcagctgggtgcgggcgacgcggctgccgagggcggtggcggtatcgttgcccaggctcaggctgttcagcgcccggctcagcagcagagcggcgatccccgccaccactaccggcagcaggacaattttcagcgtttgcagggtgcggatatccagcgaaccggcctgccagaagcgtagctgatcgtagacgtccgggttgagcagggcgatgccgttggacagcccctcgagtaccgccgcaagggcgaccccggcgagagtgaggcgcaccgggctcagctgaccgccgccctggctgccggtaaaggctaccagcagcgaggcgcagagcgcgccgcagaatgccagcagcagctgctcctgcggggaagtgatcccaaacagcgccgcgccgaggacgatggcgaagctggcgccggagttgaccccccgcaggccggggtcggccagcgggttgcgggtgagcgtctgcatcagcgcgccggcgaggccgagggcgacgccggccagcagaccggccagagtgcgcggcaggcgcgcgtccagcacgatagtgcaatcagcgctttgacaggttccgctgaaggcggtgaataccgtgccgatcggcaacgatttggcgccgatggtcaggctaagcgcggcggctaaggcgagtaatagcaacaatccgggcacggcgacagagcgtaccgcggtcgtagaaaacgacataactgacatccctgatatgataatgatagtaattatcgttatcgattttattcagctatggtagcatgacccacagtaaaaagggtattaaaaataacgacaaggcgctgtaatgaaccgacaatcctggctgctcaatctcagcctgctgaaaactcacccggcgtttcgcgccgtttttatcgctcgctttatctctattctgtcgcttggcctgctgggcgtggccatcccggtgcagatccagatgatgacccattcgacctggcaggtcgggctgtcggtgacgctgaccggggcgtcgatgtttgttggtctgatggtggggggcgtgctggctgaccgctatgaacgtaaacgcctgatcctgctggcgcgcggcacctgcggcgtgggctttgtcggcctgtgtctgaacgccctgttgccggagccgtcgctggcggcgatctacctgctggggatctgggacgggttcttcgcctcgttgggggtgaccgcgctgctggcggcgaccccggcgctggtgggacgggaaaacctgatgcaggccggggccatcactatgttgacggtgcgcctgggctcggtgatttcgccgatgatcggcggcctgctgctggccaccggcggcgtggcgtggaacttcggcctggcggcggcggggacctttatcaccaccttaaccctgctgcgtctgccgcagctgccgccgcctccgcagccgcgcgagcatccgctgcgctccctgctggcggggctgaccttcctctgccggagcccgcttatcggcgggattgcgctgcttggcggtctgctgaccatggccagcgcggtgcgggtgctctatccggcgctggccggtagctggcagatgtcggccggacagattggcctgctgtacgccgctattccgctcggtgcggcgctgggggcgttgaccagcggccagctggcccagacggtgcggccgggcgcgctgatgctggcgaccacggtgggatcgtttgtcgccattgcgctgttcagcctgatgccgcactgggcattgggcgcgctgtgcctggcgctgtttggctggctgagcgctattagctcgctgctgcagtacaccctgattcagacccagacgccggaacatatgctcgggcggattaacggtctgtggaccgcgcaaaacgtcaccggcgacgccatcggcgcggcgctgctcggcggcttaggggcggtaatgacgccggcggcatccgccagcgccagcggctgggcgctggcgcttgtcggtgtgctgctggttgggctgctacgcgagctgcgccgtttccagcgcccggaaattgtcaacgaaagttaagtcggatgcgcttgcccggtggcggctacgccttaccgggcctggggtacggcaggccggtacaagctcagtaggccgggcaagcgcagcgccgcccggcaaagagttcaggttgcgtgccccggcctgatgcccggtggcggctgcgccttaccgggcctacggtctggactgggggacgctggcattgtaggccgggcaagcgcagcgccgcccggcaagatgttcaggctgcgtgcccggcctgatgcccggtggcggctgcgccttaccgggcctggggtacggcaggccggtgcaagctcagcaggccgggcaagcgccgcgccgcccggcaaggtgtgcaggccgggttcccggcctgatggcgcagcccgcgttagccgaacaggctggagagacgctggagcaccagaagagcgctgtagtagtcaaggcggaaggtctcggtgcccagcgggtagacgcgtttgcctgcgaccgccgggagatgcgccagcagcgggttggcgtagatggcatccgcatctttctggtcgccggcgaacaggaacaggctctggccgttcagaccggccgcgaggttctccccgcccagctgcacgatatcgtggcgtttaccctggctatggctggcgggcaggccgcccggcagcgtcgccaggctaaagcccagctgttcgagcatctgcccctgagccgattccggcgtccagatattggcgctgtgcgcggcggcggtatagaccagggcggtcaccggctgcggcggcagtttcattttttcttttaacgaaacgagctgtttattgaagtcggcaatgcgcgcgctggcctgttgttcatgaccggtgatctgccccagctgggtgagcagggtttgccagcttttatcgtcatagttgatgaccagcgtcggggcgatggttttaagctgatcgtacagcggcagtgcggagtcgccaccggtcgcgctcaccaggatcagatccggcatctgggcggccaccgcttcggcgcttggttcgccgatgtacagccgcgccagcttgcgggctttggcaacctcgctccactggcgcagaaagccctggctatcggcgacgcggttgttcggcgtggtcgcgccgctggcgaccaccggagcgtcaatcgccagcagcgaaccggtaagcgtcacgctggtggagacaatgcgcagcggctgactcggcagggtatgcgtcccgtagctgtcggtgacctggcgcggccagtccgccgcctgggctgaggtaattcctaaaagcaacagcatgccggtcagcgcaccgcggcggcagaaagaaaagaagttcacgtcatcgcatcctgatttgaaaggtgataaatgcgtctcattttcaactttgtgtcagcaggatgcaagccaaagtggcggcgccatgacgtaacgcggttgacatggcgggcaataccttttaggttagccaaccaaaatataaatgataattattcttaatatctttatcgtttttggaggatgatatggaaacgtcactggctgaggatgtaaagaaaccgacccggaccctgtcgccggacagcttcttctttatgtcgccgtaccgcagttttaccacttcaggctgcttccgtcgcttctcacagcccgccgttggcggagatgcgctgaacggcgagttccagcagcagatggcggccgcctttgccgaggcccgggcggcggggatccgcaagccggtgatggtcggggctatcccgttcgacacctgtcagccttccgagctctatatccccgagcgctgggaagcgttctctcgcccggaaaagcagcgttccgcccgctatgccgcgccgctggaggcgatggaggtggtggagcgtcgggagatcccggagcaggacgcgtttttagccatggtggaacgcgccgccgcgctgaccgccaccccggaagtcgacaaagtggtgctatcaaggcttatcgatattaccacccgcgaccgcgtcgacagcggcgcgctgatggagcgactgatcgcccagaaccccgccagctttaacttccacgtgccgctctccgacggcggcgtgctgctgggcgccagcccggagctgctgctgcgtaaagaaggacagcacttcagctctctgccgctggccggctccgcccgtcgccagccggacgatgtgctggaccgggaagcaggcaacaggctgttggcctccggcaaagatcgccacgagcacgagctggtgacccaggcgatgaagagcgtgctgggcccgcgcagcagtcagctgtcgctaccggagtcgccgcagctgattaccaccccgacgctctggcatctggcgacgccgatcgcaggcaccgcgctggcggaagaaaacgccatgtcgctggcctgtctgctgcacccgacgccggcgctgagcggtttcccgcatcaggcggcgaagcgcctgattgccgaactggaacccttcgatcgccagctgttcggcggcatcgtcggctggtgcgatgacgaaggcaacggcgagtgggtggtgactatccgctgcgcgcgtctacagcagcgtacgctgcgcctgtttgccggcgcgggcattgttccggcctcctcgccgctgggcgaatggcgcgaaaccggcgtcaaactgaccaccatgcttaacgtatttggcttgaactaagaggcaaggatgattgcatttacccgttggccggaagagtttgcggcccgctatcgtcaaaaaggctactggcaggatctgccgttaaccaatctgatcacccgtcacgcggacaatgacgccgtggcgattatcgatggcgagcggcagattagctaccgccagtttaaccagctggtggacaacctcgcctgctcgctgcagcgccagggactgaagcgcggggagaccgcgctggtgcagttgggcaatgtcgccgagttttacatgaccttctttgcgctgctgcgcatcggcgtcgcgccagtgaacgctttgttcagccaccagcgcagcgaacttaatgcctacgccgcgcagattaaaccggcgctgctgattgccgatcgcgagcacgctctgtttgctgacgatagctttctccacgcgtttatcgcggaacatccttccctgcgcgtcgcactgttgcgtaacgacggcggcgagcgcgatctggcgacggagattaaccgcccggcggataactttatcgccaatccaacccctgccgacgaagtggcctttttccagctctccggcggcagcaccgggacgccgaagcttatcccacgcacccataacgattacgactacagtatccgccgcagcaacgagatctgtgggattaacgctgaaacgcgctacctcaacgcgctgccggcggcgcataactatgcgatgagttccccgggttcgctcggcgtcttcctcgccggcgggcgggtgatcctcgccgccgacccgagcgccacgctctgtttcccgctgattgaacaacatcagatcaacgttgcctcgctggtgccgccggcggtcagcctgtggctgcaggcgattcacgaatggggcagcaacgcccagctgcaatcgctgcagctgttgcaggtcggcggcgcgcgcctgtcagcgaccctcgccgcgcgcattccggcggaaatcggctgccagctgcagcaggtgttcggcatggcggaggggctggtgaattacacccgccttaacgatagcccggagcggatcatcaatacccagggctgtccgatgtgcccggacgatgaagtgtgggtggcggatgccgacggcaacccgctgccgcgcggcgaagtgggccgtctgatgacccgcggcccttataccttccgcggctattacaacagtccgcaacataacgctgaagcctttgatgccgatggattttactgctccggtgatctgatttcgatcgatgaagatggctatatcaccgtccagggccgggaaaaagatcagatcaaccgcggcggcgagaagatcgccgctgaagagatcgaaaacctgctgctgcgccatgaggcggtgatccacgccgcgctggtcagcatcgaagacaatctgctgggcgagaaaagctgcgcttatctggtggtgacctcgccgctgcgcgccgtcgccgtgcgccgcttcctgcgcgagcagggggtggcggaatttaaactgccggaccgcgtggagtgcgttgccgcgctgccgctgacgccggtgggcaaagtcgataaaaaacaattacgtcagtggctggccgaaggcaagctgggctgaaggagaacagagaatggcaatccctaaattacaggcttatgcgctgccggaagccagcgatattccggcgaacaaagttaactgggcctttgagccgtcgcgcgccgcgctgctgatccacgacatgcaggagtatttcctcaacttctggggcgaaaacagcgcgatgatggagaaagtggtggctaatatcgccgccctgcgcgacttctgcaaacagaacggcattccggtgtactacaccgcccagccgaaagagcagagcgatgaagaccgcgccctgctgaatgatatgtgggggccgggtctgacccgctcgccggagcagcagcaggtgattgccgcgctggcgccggatgaagacgataccgtgctggtgaaatggcgctacagcgcgtttcatcgctcgccgctggaggagatgctgaaagagaccggtcgcgaccagctgatcatcaccggcgtttacgcccatatcggctgcatgaccaccgccaccgatgctttcatgcgcgatatcaaaccgttctttgtcgccgacgcgctggcagatttcagccgtgaagagcacctgatggcgctgaaatacgtcgctggccgctccggccgcgtggtgatgaccgaagagctgctaccgctcccagcctccaaagcggcgctgcgcgcgctaattctgccgctgctcgacgaatccgatgaaccgctggatgatgaaaacctgatcgactacggtctggattcggtgcggatgatggccctggccgcccgctggcgcaaagtgcacggcgatatcgacttcgtgatgctggcgaaaaacccgaccatcgacgcctggtgggcgctgctcacccgcgaggtgcaataatggcggcgctggattttcacggccagaccgtgtgggtgaccggcgcaggtaaagggattggctatgccaccgcgctggctttcgtcgaggccggggccaacgtcaccgggttcgacctcgcctttgacggcgaaagctacccgtttgccaccgaaacgctggacgtcgccgatgccgaccaggtacgcgaggcatgcagccggctgttggcgaacaccgagcgtttagatgtgctggtgaacgccgccgggatcctgcgcatgggcgctaccgaccagctgagcgcggaagactggcagcagaccttcgcggtcaacgtcggcggggcgttcaacctgtttcagcagacgatggcccagttccgccgtcagcggggcggggcgatcgtcaccgtcgcctccgatgctgcgcacacgccgcgcatcggcatgagcgcctatggcgcctcgaaggcggcgctgaaaagcctggcgctgaccgtcggccttgagctggcgggcagcggggtgcgctgtaatctggtgtcgccgggctccaccgataccgatatgcagcgcaccctgtgggtcagcgacgatgcagagcagcagcggatccgcggcttcggcgagcagtttaagctcggcatcccgctgggtaaaatcgcccgcccgcaggagatcgccaataccattctgttcctcgcctcttctcacgccagccatatcaccctgcaggatatcgtggttgatggcggctcgacgctgggggcgtaaatggcctggaagcgagagcttacgctggcggcgctgaacgccagcagcgaaaataccatggtggcgcatcttggcatcatctacacccgactggaagaggggctgctggaggcggagatgccggtggatgcgcgcacccatcagccgtttggcctgctgcacggcggcgcctcggcggcgctggcggagacgctgggctcgatggccggttggctgatgaccgaagaggggcagtgcgtcgtcgggactgagcttaacgccagccatcaccgggccgtctccagcgggaaagtgcgcggcgagtgccgtccgctgcatcttggtcgccagagccagagctgggagattgtggtgtatgacgagaaggggcggcgctgttgcacctgtcgtctgggcaccgcggtgctgggctaagaagccgctgtttccccggcttgcgctacgcttagcctggctacggtttctgggccaggaagccgctatttccccggcttgcgctacgcttagccgggctacgtatcggcgcaatggggtagcccggataaggcgcagcgcgccgccatccgggagtgtccctgatcgcgctgcgcttagactggctacggatctgtaggtcgggtaaggcgttagccgccacccgacaaaaaaaacggcaccgttcacggtaaccctttcattcatttacctgccttaagtgatctcgctagcaatgtgagacaaatctctgtgggtgtacggcatctgcgatgtttcggtgttgttaaattctgcgttgtgatctagaaacaaaatgtaacatcctgattaccctaccggtggaccacaacaatgaataattcagggaaataccttatctgggcgctgctctccgtcatcggagccttcgccctcggctatatcgctttaaaccggggtgagcagataaacgcgctgtggattgtcgtcgccgcggtctgcgtttatttgatcgcgtatcgtttctacggcctgtatatcgctaaaaccgtgcttggcgttgacccgacgcggatgacgcccgcggtgcggcataacgatggcctcgactacgttccaaccgacaaaaaagtgctgttcggtcaccattttgccgccattgccggcgcggggccgctggtgggcccggtgctcgccgcgcagatgggctacctgccggggatgatctggatcctcgccggcgtggtgctggctggggcggtacaggactttatggtgctgtttgtttcgacccgccgcgatggccgttcgcttggcgaactggttaaagaggagatgggaccgaccgctggcgtcctggcgctggtggcctgctttatgatcatggtgatcatcctcgcggtcctggcgatgattgtggtgaaagcgctgacccacagtccgtgggggacatacaccgtcgcctttaccattccgctggcgatctttatgggcatctacatccgctatctgcgtccgggacgcatcggcgaggtgtcggtgataggcctggtgatgctggtgttcgccatcatctccggcggctgggtggcggaaagcccgacctgggcgccgtggtttgattacaccggcgtacagctgacctggatactggtgggctacggatttgtggctgcggtactgccggtctggctgctgctggccccgcgcgattatctctccaccttcctgaaaatcggcaccatcgtggggctggcgattggcatcctgattatgcgcccgaccatgacgatgccggcgctgaccaagttcgtcgatggtaccggcccggtatggaccggcaacctgttcccgttcctgtttatcaccatcgcctgcggcgcggtctccggcttccatgcgctgatctcctccggcaccacgccgaaaatgttggccaacgaaagccaggcctgctttatcggctacggcggcatgttgatggaatccttcgtcgctattatggcgctggtggcggcctgtattatcgatccgggcgtctacttcgcgatgaacagcccgatggcggtgctggcgccggcgggtaccaccgaggtggtcgcctcggcagcgcaggtggtgagcggctggggctttagcattacgcctgatacgctgcatcaaatcgccagcgaggtcggcgaacagtcgattatctcccgcgccggcggcgcgccaacgctggcggtggggatggcctacatcctgcacggctcgctgggcggactgatggatgtctcgttctggtaccacttcgccattctgtttgaggcgctgtttatcctgacggcggttgacgccggcacccgcgcggcgcgctttatgctgcaggatctgctgggcgtgattagcccggggctgaaaaaaaccagctcgctaccggccaacctgctggcgaccgcgctgtgcgtcctggcttggggctacttcctgcatcagggggtggtcgatccgctgggcgggattaacaccctatggccgctgttcggtattgccaaccagatgctggcggggatggcgctgatgctctgcgcggtggtcctgttcaagatgaaacgccagcgctatgcgtgggtggcgctgctgccgaccagctggctgctgatctgtacgttgaccgccggctggcagaagtcgtttagcccggacaccaaagtcggtttcctggccatcgccaataaattccaggcgatgatcgacagcggcaacattccgccgcaatataccgaatcacagctggcgcagctggtgtttaacaaccgtctcgatgccgggctgaccatcttctttatgattgtggtggtggtgctggcgctattctcgattaaaaccgcgctggcggcgctgaaagaggataaaccgacggcgaaagagacgccgtatgagccaatgcctgaaaacctggacgcgattgagacccaggcgaaaggggcgcattaaccggtgtgccgggtggcggcttcgccttacccggcctacatttccgatcctccctctccctttgggagaggctcggggtgagggatacaaaagagaaatgacttatgtttgacaccctctccaaagcaggaaaatatttaggccaggccgccaaaatgatgatcggcgtgccggattacgataactacgtcgagcacatgcgaataacccacccggatcagacgccgatgacttatgaagagttctttcgcgaacgccaggacgcgcgctacggcggcaagggcggggcgaagtgctgttaaccctctttcggcagatagaggctgatctgctcctgagtacagccgtaaatcgccgccagcttctcgcgggtgcgcttttgcggacgggagtccagcgcttccagctgtgacaccgcggactggctgatgccaagcttttcggctacctcctgctgggacatcccgcgcaggatgcgccacgcggcctgcaggctgacgttttctttatgcatcacgtcgcatacttcgcccggcagcatgacgtcatcatagatatctgattcataaggaatatcttcccagtcgctttcatcctcgtcgtcgtactccagccgagccaggcgcatacgaaagtaatcgctgtaaggaatgacgacatactggtcttttccttcttcatccttgatgtactgaatagtcatattcggtatgttcctcatgaaggtaggtggtggtggttcggcgtttaaccgccacgacgtagcaggtatcgcccggcggatccccaaaggtgtagatgactctgtaatcacctaatcgcagccggtagtggttttcgggagaggacaattttttgatatccgagataggtgaagctttatcatccatcttctccagcctggatttaatgcggctcttataccgagtatcgattttagaaaattgcttatctgccgtttttgaccagacaattttcatccgtacctccactgtacgcccacacaaaatataaggaaataataagactattagataaattccgaattccttatggggtactgtagagcggagaaaaaacgcaggtaagaggcaaaacgcaacccgtcgaggcggcgcggaaaggcctctgccgggcgacagaggcttgcagaaaatgtgcgatcaggcgttcaatccgccatccacgtccagccccgtaccggagatctgcccggcggccgggctggcgaggaaggtgaccgccgcggcgatgtcttccggctggccgtagtggccgaccgcaatcatctggcgctgggcttccgcctgttctccgtcttccgggttcatatcgctgttggtcggccctggatggacaaggttaacggtgatcccgcgagggcctaaatcacgcgccaggccacgggtcagggcgttgagggcggacttggtcatggcgtacaccgcgatgcccggcatggccacgcggttagccagacagctgccgatgttgatgattcgtccgccatcggccatatgcaccaacgcttcctgggtggcgatgaccaccccacggatattgacgttgataagcgcgtcaatgtccgccagcgtcatggattccagtggaccgccgcgggctattccggcgttgttgaccagaatgtccagcccgccgagggaccgggccgcatgggtgacggcatcctgaatcgcctgcgcgctggcgctgtcggcctgtaccgcttcgccgtaccgacccagggcctttatttcatcggcgaccgcatgggctttatcggccgatttttcatacgtaataaccacatcggcgccggcgcgcgccagcgacagcgcgatggcgcgacccaacccacggctggcgccggtaaccagcgccttcttacctgttaaatcgatctgcatgatgacctcgttgcgagagtggtgagcatcatcattaggtatagacggtcggggtgattaacggctgaagtattccaccttctcaaacgccgcgcgcagaacctcaggggttaacgtcaccggtaaatagtgaatcgactcgcccgggcgcagggtatgggcaatgacccggtccagctctgcgcggttattgatatcgacttccagcgccgccagggtggtcggcaggttaaagcgctgatacgcctgcactaactgcgccagcacatcgtcctgaccaagcagggcgctctgtaccagaatgccgtaggccactttggtaccgtggagaaatttatccgtctgcggcagcaccgtcagtccgttgtgcaccgcatgggcggcggcgacccgggtgtaacgttcccccagcccgccaaccatcccgccgccggcgataatcgcctccaccacatcgcgaaacgcctgggtcagatcgccgcggcgctggtccgccagcgccgtttcgctgctggccagcagcacgtcgcggatcgccagcgcgccgttaatccccagccgcacggtgagcggcagcgccttcggctgcggcgccagcaccacggcctcataccatttggctaaggtgtcgccaatgcccgccagcaggtactccgccggggcgttgagaatgatgcgcggttcgaccagcactaggaagttggcgtcatcgaagatctcaaaattcagggcctgtccggcgtcgctataccacaccgacagcggcgtccacgccgcgcaggtggcggcgatagtcgggatggccaccagcggtacccccaggcggcgggcgagcactttcgcgctgtcgagcagcgcgccgccgccgacgccaatcactaccgcccgatcgtcaccggaggcctgcaccagccccgccacgtcgcgttcgctgcagtggccggtaaagcggatctttttcgcctccggcaggtggaaggccgccggcagaaaaggttcggcgccggccagagcgcgctcgccatagacccacaccgctcgcgagagctggtcggcgttaaaaaaatcgctcagccgctcaaggctgccaggatgggagaaatagttggccgggccgggcacgacgcggatatcgctgttactcatggaagctgtccttatgggtgttgggctaacctgatgttatgtctggacatccagatggctaatattatttcgttgtatcttatgctttttacgcagttgtcagccagcggcggctatgaaaaattcgttaaatcagaagattaattgccgcacgggagcagtgatgagcgcgaatcgccttgagatgcataacattagcctggccttctccggctttcaggcgctgaacaaggtggactttaccctccatggcgggtcggtgcatgccctgaccggggccaacggcgcgggtaagtcgacgctgatggccgtgctgtgcggcacccacgcccactatgagggcgaagtgacgatcaacaaccagccggtcatcattcgttcgccgcgggatgctaaacagctggggatccacctggtgcagcaggaggtggacgtggcgctggtgccgggcctgagcattgcggaaaacattatgctggacaggctggcggagccgggcatgaccttccgctggtcgcgggttcggcagctggcgcgcgaggcgctggcgcagctggatgtggcgctggacgtcaggcgctccattgacagctgcacgctcgccgaaaaacagcaaatcctgttggcccgcgccctgtcgcaccattgccgctttttgatcctcgatgaacccaccgcgccgttggatcagcatgaaagtgagcgtctgtttgcggtagtacgccgtctgcagcatcaggggatcggggtggtgtttatttcgcatcgtatccatgagctgaaggcgatctgcgacaccctgacggtgctgcgcgacgggcggctgattgagagcggcccgatggggccgctgagcggcgaacagatcgtcgaaaagatgctgggccacgagctgagcgatatcttcccgccgccgcgcccgccgcacggcgaagaggtgctgttgcaggttgacggtctgcatgatgaggcgttgctgcaggatatttcgctgcgcctgcggaagggggaaattctgggtatcgccgggctggccggcgcgggcaaaaccgagctgtgcaaagcgctgttcggcgccagcaaaagcagggtgcagcgtggcgagctgaacggccagccgtggcgaccgcgcgatccggccgactcggtggggcgcggcctggcgctggtcccggaggagcgacgcaaagagggcattttcattgaagagccgatcgcgatgaacctggcggtcagcgccgataacagcttttcgcgctggggcctgtttggccatcggcaggcctggcgctgggcggaggaggtgattgcccgcctcggcgtgcgcgctaccggtcccggtcagacgctgcgccgtctttctggcggcaaccagcagaaggtggccattggcaaatggctgcgcggtgatgccaacgttttgatttttgacgaaccgaccaaaggggtcgatgtgaaagcgaaaaccgatctgttcatgctgatcgatggtctggcacgggaaggcaaaggggtgatttatgcctcgggtgaattcgccgagctggtcggtttatgcgaccgcatctgcgtgctatgggacggacggatcgtagcggagatccccggcgcggatgcccgggaagagacactgctttattattcaaccggaggagcggcagcgtgagcaaggccctggcagtaaacgcgacggtatcgggccgtcagcgattttttgattttctctataagtggggcatgttgctgaccgtggtgctgctggtggcggtctttggcctcgcctcggacaacttccttgacccgttcaacatcatcaacattctgcgctcgattgccatcgtgacggtgattgccattggggtgtcgatttccctcaccatcggcggcttcgatctgtccgtcggatcgacggcatcgctggctaacgcgctggtgatttccctgtttgtctggcatggcctggggaccaccgaagcgattctgataaccctcgcgctctgcaccctggtggggctgtttaacgcctttctgatcgtggtgctgcgcattcctgacatgctcgccaccctggccagcctgtttgtgattcagggcgtggcaatgacctacagctacggtgggtcgattaccgaaaacatggtgctgccgagcggcgagatggcggagggtactatcccggcggcctttggcgcgctggggcaggtgccgaccatcgtcattatcatgctggtggtgacgctggtcgcccagctcgcgctgtcgttcaccacccacggacggcggatgtacgccatcggcggcaacccggaggcggcgcggctctccggcctgcggatcacgcgttacaaagtcgcagcatacgtgattgcctcgctgctggccgggctcggcggcattctgctggcctcgcgcatcggctcttcgcaggtcaacgccggcggcggctatctgatggacgcggtggccgcggcctggatcggcttttcgctggcgggctccggcaaaccaaacgccctggggacgctggtgggggcggtgatcctcggcgtgctctccaacgggctggtgatgctctcggtgccgtattacgcgatggacattattaaagggttggtgctggctggcgcgctggcactgacctattttcagcgccgtacttaacattttacagggtaaaccgcatgaaaaagatcgcactctctctgatgacgctgggtctgctgcagtcgacggcggcgctggccaccgccccgacgccggtgccggcggcgattgccgaacacaacggcccgatccgcattgccgtgatccgcaacctcgggtctgacgataacaccacccagtttgtcgccggggcgttgcaggaaggcaaaaagctcggtttcaaaatcagcaccttcctgagcaacggcgatgacgccaaattccaggacttcgtcaaccaggccatcagccagaaatacgatggcattattctctcccaggggcgtgacccgtattccaccgccctggtgaagaaggcggtggacgccgggatcaaagtggcggtgttcgataccgcggtaagcggtgagatccccggggtgacggtcagtcagcaggatgatgcctcactgaccgagctctcttttggccagctggtgaaagatttcaacggcaaggccaacatcgtcaagctgtgggtggcgggcttcccgccgatggagcgccgtcaggcggcttaccagacgctgctgaagcaaaacccggggattaaagagctggagtcgatcggcgccgtgtcatccgatgtgcagggcgacactgccaacaaggtgggggcgatcctcgccaagtatccgaaagggaaaattgacgcgatctggggcacctgggatgcctttagccagggagcctataaagcgctgaaagagaacggccgcaccgagatcaaactctacagcattgatatttccaaccaggatttgcagctgatgcgcgaagccggcagcccgtggaaggtgagcgtggcggtggatccgaagcttatcggcgcgaccaacgtgcggctgatcgccaacaagatcgccggcgagccgacgccagccacctacgacttcaaggcggcagcgattccccaggcgctgctggcggcccagccgggagcggtaaacgtggcgtcgctggggaaaattatccctggctggggccagaccgaagactttatcgcgccgtggttcgcgacgctggaagcgaagaacaaataaaatcaagccgggtggcggtgggcggcggcctggtgccctcgccccggccctctccgcagggagagggggaaaaccatgccaccgggcgaaagggatcccctatgtcagcattaccttcccccgaatacagccgcaatatgcggctgattggccatagcgatcagggcggtcgtccggacggcgtgcagctgatggtgcatcgcggattcgcctatatcggccatatggtgtcgcagggtttttccgtggtcgatgttcgcgatccgacccggcccaccaccgtcaactatattgccgcgccgccgggcacctggaacgtgcacctccaggcgcatgacgatctgctgctggtgatcaacgcccgggatctgtttgccgacgcccgttttgctgatgagaaggtgtactacacccgctcggtgggtgacacggtcagcgatgtgcaggacaggggctggagcgccgggctgcgcatctttgatatttccactcccgcgcagccgcgggaaatcagtttcctgtcgcttaacggcatcggtattcaccgcatctggtacgtcggcgggcgctgggcgtatgtgtccgcgctgatcgacggttttaccgactacatcttcctgaccatcgatctggccgatccgcgtaagcccgaagtagccgggcgctggtggctgccggggatgcaccaggcgggcggtgaaacaccggactggccgcagggcaaacgctatgcgctgcatcacgccattattgccggggataccgcctacggcagctggcgcgacggcggcctgacgctgctggatgtcaaagaccgtacccagccgaggctgattagccatcgcaactggagcccgccgttcggcggcggaacgcataccgcgctgccgctgccggatcgcgatctgctggtggtgctggatgaagcggtgctcgataaccaggaggacggcgagaagctgatctggctgtttgatatccgcgagccaaccaacccggtgagcatcgccaccttcccgccgccggacgaagcggattacgtggcgaaaggggcgcatttcggcccgcacaacctgcatgagaatcgtcccggcagctttgtcagctcaacgctgatttttgccacgtatcagaatgccggcgtgcgggcttacgatatttccaacccgtatcgcccgctggagaccggggcgctggtcccggctgcgcctgagagaatgatggatacccgtcccggccgcccgcgggtgatccagtcctgtgacgtgtttgtcgatgcgcaaggcattatctacagcaccgattacaacggcgggctatcggtgattgagtatctggggtgagggtaaggtaaacgcaaaattgtgctcgcatgtctgccgggtggcggttttcgccttacccggcctacgaaagagtgcaagatcaaaccgttatgcggctatctgtaggcccggcaagcgcagcgccgccgggcaatccccgaaaatagcacttttttagggggtgctccctctccctgttggagagggttggggtgagggaaacaggcgcactcagctgtactggcgtacccgcgccagcagctcgtcgacgctgtcgatacgctcggccagcacgatcagcgctctgcccagggtaatggcgtggcgcaggcactcatgacgcatggcgtcgtcctggatagtgtcgatatccgcgacgtgcgacagtccgacgctgcggcggatcagttcgctgccgcagaagccgaccgcgtccgcccagactttcttcagaaaggcggaggcatagccggggtaagccagcgccgcgtcgcgggttttctccgccgccagcgcctggaagcgctcggcgaaggtggtccacagctggtggatgtcgttcagccgctgctcgcgcgcggcggcggcatcgcgaatgccgagctggcccggcaggccgcagtagttaagcagcaggttgccgatggcggtgccgatatcgaagccaatggggccgaagtagccgaactcggcgtcgatggccttcaggctgccttcggcaacgaagatcgacccgctgtggatatcgccgtgcagcagcgcttccgcatgggcaaagaaacggtgcttcagcgccgccaccgccagcttaagctgggcgtcgtcgcgcagggcggcgacatcggcctccagctccgccgggtagttattgcgctcgtggatctgatacgggtcgttaaagaacagatcctcggtgatctcgcacatcgccgggttaataaactgcgccacctgcgcctttttctcgtggggatggaggtagaaatcgctggtgtgaaacagcacctgcgccagatagtcgccaagctggcgggccgcctggggatagtagacgttagcgataagctctccgcgccagatgcggtggtcggaaagatcttccatcaccatcaccgccagctcgggatcaaagtgatggatttttaccgtgtgctgcgggctgtgctgatagtgggcgaccagggtctgcgcttcgagacgggcgcggtcgagggtcagcggccaggattcgccgacgcagcgcacgtagggcagggcctgtttgacgatcgcccggctgacgccctgacgatcgaacactttaaacaccagattgaggttgccatcgcccacttcctgcgcgctgaccagctcagatgggttgtcgatgccggcgaactgttgcgcgtaagccacggcatcgtgggcggtgaaggtatggtattgcgacattgcctcgatcctcgaattctgattaagccgttcagacgtctatacttctggattccatcctgacacaatgtgatacaacaacgcaacagggatttaacgacatgcagacattacagaccaccagcctgcgggtgagtgaaaatcagctttttattctcgaccagcaggccttgccgcaggaacaacgctggctggcggcggataacgttgcgctgctggtggaccatattcataccctgcgggtgcgcggcgcgccgctgattggcctgtccgccagcctgctgctggccctgctggcccagcgcggcctgaaccgggatgcactccagcaggcgctggagacgctgcgcgcggcgcggccgacggcggtcaacctgatgaataatctggatcgcatgaagcaggcgctggcccgggaggattacccgcaggcgctggaagcggaagccttgcgtctggtcgaagaagataaacagctgtgcgaccgcatcgctgaggcgggcagtgcgctggtgaagcccggcagtcgactgctgacccactgcaacaccggtggcctggcgaccgccggggtagggaccgccctgggcgttatcgcgctggcgcaccggcagggaaaggtgaccaacgtatgggttgatgaaacccggccgctgctgcagggcggtcgtttaaccgcctgggagctgggcgagctgggcgtgccctatcagctgatcgccgattcaatggccgccagcctgatggcgcaggggcaggtggatgcggtgtgggtcggcgccgaccgtatcgccgccaacggcgacgtggcgaataaaatcggcacctattctctggcggttttggcccattatcaccagatcccgttttacgtcgctgccccgcagaccaccctcgatcgctattgcccgaacggggcggccattcccattgagcagcgcgccgcggccgaagtgaccggagtggcgggcagctttggcgcggtacagtgggcgccgacgggggctgccgtttacaatccggcgttcgacgtcacgcctgctgggctgataagcggctgggtgctggacagcggggtggtcaccccggcgcaggtcgccgccggggcgtttgcgccggacaatggataacggacgtcgtgccgggcctggaaaaaaaggttttcccgggcccggacaaacaccgcgccgctacggcaggaccatggctaccgccggggcggatgatcggtcgatacgctgaccgagggcggtaatagccgcctggaagggacacagcgtaccgacgtcggtctgacggcagcccggctgatgccactcctgacgcagcatcgggtgctgcgcgtccggcgtctgcagacgacgcaggtcgtcgaggccctgggcctggaaatagacccgcagatagcgttctccgctcttcgcgttgcgccagcgctccagcaccaggctactgcccggcgggatatttccccggctgtagcccggcagctgccagctaaagttcatcagcgtgcgcaccatggcgatattggtgtcatgggccaccagcagcagccagcgtacgttcggattcgcctccggtttgacgccatcgagcatagcgttgagcagcaccgacccgcgtttttgcgcggtatacaacacatcgttactcagatcgtagttttccgttaacagcggcagcagggcggtgatctgcctggcctgggtgatcttgccccacgccagctggctgagaggcaggttttcactccagccgagacgcagcgtctccaccatattggccatcacgctcagtccgctaatggtggtcttcccacttttgctctgctcgacctgccacggggtatcgaagatcgggcagggcttatcggcctgacaaaccgcctgtttcaatagctggatggtcggcgccagcgcctgccgacgctgcgccagatccccggccttctctttcaccgccgccagctggcgggcggggtcggtttgcgtggcggcgaacttgtcggtctgaaacaggggatcggcatccccgctgacataatggatagcgacgccgcagccggggaaggcgccatccaccagcgcctgggcggtcgctcgcgtccgctgcaacgggctggcgcgcacgtatatcgactccgccgtcgggcatccggcctgcagcaggccgagctggcggtaatgctggccttccgcacgccctttgttgaccacggcggcatagccatggccggtgagctccccgtcatgggtggtccactcggtccacggtcggccggtggcggcctcgatggcttcccggttgccggccgtcggcggacgaataccgtggcggctgagctcgaccactttctccagctgccagtccgcggcggcggcagattgcagcgccagcagcggcagcgcgcaggcgataaacaggcgtaacagcccctgatgtcttgcaggcatcatatcttcttccttattcgttaatcggttatgaggagaacgaggtctgccgttcgacggcatggcgccgggcgacgatggcggcagtggtaaaacagagtagcgcggaacccagaccggtacccacccagaacagcgccaacgtgctgaaatcatacagcgttttgccgttctcaaggatagccgttttatcaataatgatcccggtgagaaactcgcccaggccggcgccggcgtagctggcgatgccgatggtgccgagcgcggcccccgccgctttgcgcgaagagatatcgacggcgatcagcccgccaaggaagcaggtcagagcgccaatagtggccccgaagataatcatcgccagaatatcagtgtagtaattgtgcggcgaccagagcatcagggcgaagccggcggtgttcagcaggctgataaacccggccatcacgctgcggttgcgcgggaaaaagcggtcggagagcatgccggcgatgatggtcccggcgatgccggcgatagcgttaacgccgataatcccggacgcctccagggtggaataagctttatcctgctcgagaaagaagatcccccaggagttgacggcgtagcggtcgatgtacataaaggcggaggcgagggcgagggtccacagcgccgggttgcgcagcgccagcagctggtttttaaacaccgagccgcgggcttcgacctcctcctgcggttcatcgcggatgacgttgatggaagggaagccgctgctctgcggcgaatcgtgcatgaacagcaccagcagcaccacgccggcggcgccgagcgcggcggtggacaggtagcccatctgccagccaaacccggcgatcaccgcggcgatcaccatataggtcaccgcctcgccgatattatccgccgtcgaccagatgccatagaaggtgccgcgctccttaacgccgtaccagcgcgccagcgagaccgcgcaggggccgacgcccatcgactgcgcccaaccgttgatcccccagaagatggccagcagcagggcgttggtggtcatccccatcatcaggttcatcccggcgctgagcaataaaccgaggctcatatagcgcaccacgttggcgtgatcggcgataaaaccattgaccagtttgccgatggcgtagctgaagaacagggtagagccgatcatgccgagctccgtcggggtgatccccagctccaccagcgcgcttttagcgacggtgaaggataaccggcagacgtaaaaggtgacgtaggccagggtcatggcgataaaggtttgccagcgcacccggcgaaaacggtgttcatcaaacgcggcgcccgctttcggcggcgacgcccggaaaaaagcgataattccagacataggtggttctccgcaggtcggaggcctgactgattgatgtggttcgtccgtgaatgaagttatcgttactgtgtagagtacataatcagaaatagcctgacccgtaagggttaatgtaatggttgtgggatcatctttttcagctgcgggtagagcgtctggctggccagcagcagcggattgccgcgctggatcccctcctgcgccagaaaatcgttgctggcgccgcccgcttcgcgcatcagcaccagccccggcagggcgtcccacgggttcatgtgcggctcgtagtagccaatcaaccggcccgccgccgcccaggcgctcatcaacgccccggagccgttgcggataaacatgccgccgtcgctgagcagcgcctgcagaaacggcagaaagtccgccggggtgacgcgatgcgaggtgccgacgcccatcacgccctctttgaccgtcgtcgcggggtgcggacggatcggagcgtcgttgagccaggcgccatggccccgcagggcgtgaaacagctcgcgatggttggggtcgtagaccacgccgatgaccggttcgccgtcggcgacgatcgccagcgacaggcaccaggtgtgcaggccgttgaggaaacagctggtgccatcgatggggtcgaccacccacagcactcgcgcgtcgggcaggcgggcgccgctctcttcgccgagaaaaccatcctccggaaacgcgctctgaatgcgctgtttgacaaaggcctccacccgcttatcggccacgctgaccacatcctgcaggtcgtcgcccttatggtcgacggtcaacgcctcgcgctgttgatagtattcaaacgccagctcagcccccgctttcgccagctcgcaggccagacggtagcgggcctgtagcgcttctgattcctgagattgcatagtgactccccattttgcacacgtgtgcattttgcgtgaaaaaaacagccccgaagggccgaatgagtgtggccgggtttcgcagaagattctgtgatcgctccagcataaaatgattttttcatttggcgctatggcgaataattagtttcaccggcacttcgcgatggcgcgagggcaggctgaagcgggcgatccgcgtcattaacaaatccaccgcgtggtgggccagcagggcggtattctgctgaacggtggtgagctgatagggctgccagtccgcctgcgggatatcgtcaaagccgacgatggccggcagcggggcggcggcgtcccgcaggccgtcctgggcgcccagcgccagcatatcggtggcgcaaaacagcgcctgcatcccggggttttcagcaaccaattctctggcagcctggtagccggcctgatagccgccgccgtcgcagaagcggctgctcaccgccatatccgacgtccgggcgataaaagcctcatagcgctggcgggtgctgaagttctcgcgattttcgccaataaagccaacctgccgccagcctcggcggctgaacagatccgccaccagcttcgctccctgggcgttatcgctgcacacccggtcgcagccggcgaggtccgcatggcggttgatcagggtgacggggatcttgcgcgcgagatactcttccgccagcgacagcggcggcgcgccggaggtgatgatcaccccggcgacgtgatagctcagcagtagtttaagcgagggggcgagctgctgcggatcgtcagcgttcatcagcagcggcataaagccattgagcgccagctgatggaccagcggcgccagcagtttgctgcgaaacgggttgtcgaaaccggcggtgacgatgccgataaaattactgctgccggtgatcatcgtccgggcgatgatattcacctgatagcccagggcttccgcggcgctcagcaccttctgccgggtcttctccgacaccgaggcgccgggggtgaaggtgcgggagaccgccgagcgcgagaccccggccagtctggccacgtcctcggccttaatccattttttatcgctcatcgtcgtttcgcgccgtctgttttccaggaagccgacgcccgggcgggcgtcggtcacgcacactgcctgaaaaggtatcacagaaaggcgtcgtcgcgcagcgccttgcgccctatgccgggtagcggatgtgctccacctcacgctgcaaaatcaccctgccgtggcgaatggaggtcagcacccgtgcctgacggcggacggcctcgtagtcgttttcagcatcgaggatcagcaggttcgccgggcggccttcggcgaggccgtagttatcgcccagacacagcgcccgggcgctgttgtcggtgacgaagtcgaggcagcgctgcagatcgtcatagccgagcatatggcagatgtgcagtccggcatccagaatgcgcaggatattgccgttccccagcggataccacggatcctgaatcgagtcctgggcaaagcagacattgatgccggcgcgatccagctccgccacccgggtgacgccgcgccgtttcggccagctgtcaaaccggccctgcagatgaatgctttcggtcgggcaggagatgaagttgatgcccgaggctttcagcaggcgaaacagctttgagcagtaggcgttatcataagagcccatcgcgcaggtgtggctggcggtgacctgggcccccatgccgcgcacccgcgcctcctccgccagtacttcaaggaaacgcgattgcggatcgtcgatttcatcgcagtggacatccaccaggcggccgtagcgctgggcgaggtccatcaaaaacatcaccgagctgacccctttgtcgcgggtgttctcatagtgcggaatgccgcccaccacgtcggcgcccatctcgatggcgcgcgtcatcagctcccggccgttgggatacgattcgattccctcctgcggaaaggcgacaatctgcagatcgatgagatcggcggcctcttgtttcaccgccagcagcgcctgcagggccgccagcgacgggtcggtgacatccacatgggtgcggacgtgctggaccccgaaatcgcgcagcatgccgatggttttcagcgcccgctggcgggtgtcctccggggtaatactcgctttgcgctggctccagcgggtaatgccttcaaacagggtgccgctgcggttccactccggctcacccgcggtgagggtggcgtcaagatggatatgcggctcgacgaagggcgggatcgctagccggccctgggcgtcgatagccccggcgtcggcagtctgcatcgcggcctgggcggtgatgcggtgaatcatcccgtcctgcaggtcaagagtaaacagcgcctcctggcggcgcaggcgagcgttaataattttcatggtgggtcctgtaaatggttttgcgataaacgccagatcaccagcgcgaccgaggcgttgagatgaaactgagggtggctgaccgggtagccggtcagtttttcaatgcgctggatgcgctgatgcaacgtgttgcggtggagacccagccggtcggcggcccgcaccacgttgccgttctcctgcagcagcgtctcgagggtctccagcagcagccatggcgctttgcggcccggctcgatcaggcagcccagggtgtcgtgcataaaatcgttgagcagcgccgggtcgctgatcgcggacagcaatttgataaaccccagctgctgatagtcgctgatacgctgggtcggccgcagggtatcgcacagatccagcgcctggcgcgcctgcgacagcgcccgcgggtaaccctgcagctgcctgaccggcgcggagaggccgcagagcagcgataaactctcctctccgtccgccagggtttgcagccactgctgtagccattttttctgctgaaagccttccccctcctcatccggcagcaggaaaagaaacatattgctgcgctccagcagcgggaagggattgccctgctggttgagctgctgctgcagctgctgacgtacgctgcggtgggcctgcagcagccaggcttcggcctgctcgggcgggaactggcgaaacaggcgggacagcccctccagacgcagcgccgccagccgcagcggacgggtaaaatcgagctgctggtggagggcgcgctgatggagcatctgcaggtccggatagtcgccggtgaccagctgcatcagaatgtcgcgctgcgactgcaggacgttttcgctgcggaccagcgcggtgccgatgcgctcggtgacaatcaccatcttcagcaggtagggctgctcgatcagcggcatgcccagctcgtcggcaagggcgatcagcgtggcgggaatggcgtggatataggcctcgccggtgaggatcaccatcccggcgatgccgcgctgtttgccctccatcagcaactggatcaggttggcttcatcccggggatggttgatgccggtgataaacaccagctcgccgcccatgatccactcggcgatatgttcattttccgccacatagtaccagcgtacggcccgctgcagcccttgctttcccgcccgcagacgcagggcggagagtccctcaagggccagcagttcgctgaccgtcaggctcatggctcctgctccgcgacggcggcaggctggcgtttgcttagcagagtcagggcgatatagaccagcgcggagacggagatccccaccagcggcgcgatccacggcgaaagataggccaccaccgcgccggcggcgtaggcgccgagtcccagccagttaaaacgcggcaggcgggcgttctgcagcaggggatagcgcccgccgcgggcgaaccagtagtcggcgaggatcaccccgccgatgggtggaataatactgcccagcagcacgaggaaggggatcagcatttcgtacatcccgccaatggccagcacaatgcccaccccggcggcggcgagggtcagcgtccggcgacgttcgctgcgcagcagatggcaggcggcggcggagacgttatagatggtggggccctggatggtcagcaggttgagacagagcatgatcaccgcggccaccgacagcccctgcaggatcagcacttcaacgatatcggcctgttgatagacgatagcgcaccaggcgccggcgacgatcatcagcccgttgccgatgaggaagctgcccatgctggcgagaatggcggtccggctggagttggccagccgggtccagtttgtcgcctgggtggcgccgctggcgaaagtgccgaagaccatggtgatggccgccgaccagctcatggtgtcgctcggcgcaatacgggtcatcgcctgccagccgccggcgtggtgcagcgccagatacatggagaccatcagcagcacaaacatcaatggcaccgacaggcgcgacagcgcgtccagtcccttgtagcccaccagcgcggtgaggcagaacaaaatgccaaacagcaccatcaacggctgggtcagcgcctcgggcagggcgaggatcttcaccagcgagatagcgaccgtggcggtgccccaggcgtaccagcccagctcggcaaaaccaagaataaaatcggccagcttgctgccaatctccccgaagcagaaccggcccatcagcaccgtattcaggccgctgcgcgcggcgatccagcccagcgacgcggcatagagagccagcaaggcgttgccgatgacggctatccacagcagattgacgatggaaaaggagacgccgagtttaccgccggcgaacattgtgccggtgaaaaaggtaaagctgaacaacaccatggcgatggaaaatacgcctttgcgtccggcggcgggcgcttcgacgaggggaaaatcattgctgtttgacatcctggaacctctggctggtagatgggcggtgattgccggaagtagcaagagatgtgccaggaaaaaccgggcacggggaatagcgcgcggtgtgcaacatgcacagttattgaaggatcccggacgggtaatgccattctactgtgcatcctgccaggttttgcaccagtccagggcagaggagggcggtgagcgcatccctggcgccggaggagaattttagccaggacgatccgcctgtttttggccagagagtagtggagaatagcggtgtactgaaaacggttggttaaatcactgtgaataaaggttatttaatatgcttttatgatataaccatttgtcttgtatgtgtttcctgaaatattgtcccctccggttagcggtgttagtatcggataaatagccatttagacggctaaataaatcatcgctaacctaaggaactgctatgtggcaagaaagactcgcgcaactggtcaccacctgtcattggatcggcgcgaaaggctgggcgccggcgaccggcggcaatatgtcggtgcgtcaggatgatacctggtgctggctaagcgagtctggccgcgacaaaggcagcctgacaaccgaggattttctgcaggttgagatcgccaccaaccaggcgccttccggacggaagccgtcggccgagaccggtctgcacaccctggtgtatcgcctgttcccggaagccaacgtggtgctgcatgtgcataccgtcaacgccactgtgctgtcgcgcatcgaaaaaagcgacacgctggcgctgcaggggtatgaaatgcagaaaacccttagcgggcagcatagccatctcgataccgttccgatcgccatcttcgataatgaccaggatattgacgccctggcggcgcggattgccgattatgcgcaaacgcgcccgctgcgctacggctttctgctgcgcggccacggcctgacctgctgggggaaagatattcaggaggcccgccgtcaactggaggggctggagttcctgttcgagtgcgagctgatgcgccgccgctacgagccctgagccggagcaggtatggatttttatcttggtatcgatattggcacctcgcgggtgaaagcggtgctgtttgatcagcatttcaccgcctgcgccagcgccgcggaaaatacctcaccccgcctgtcggccaatggctacgcggaacaggatatgacccagctgtggcattcggtgctggctattctgcgccagattgcccgccatccggcgctacaggcggggcggctgcgggctatcggcctcgccgggcaaggggagggggtctggctcagcgatgagcagggcgaaccggtgggcccggggatcctgtggagcgatacccgcagccacgagctgatgagcgacctgctgcgccgacccggcttcgaccgccgctatttcgccgataccggcacccacctgcagccctgcaataccagcctgcagctgtactggctgaaacagtatcagccggcgcggctggcggccgcgcgctatctgtttttcgccaaggactggatccgctttcgcctgaccggcgtggcggcgctggagctgacggacgccagcagctcgttactcaatcagcagaccggcagctggtcctcggtggtgatgaacgagatggggctgaacgaactgctgccgctgtttcccccgctgctggccccggatgccccggccggcacgctgagcgacgcggtggcggcgctgaccgggctgcccgccgcgacgacggtggccgccggggcgctggatgtctgtagcgccgcgctgggctgcggcgcggtcaacgaaggggatatctacacgatcctcggcaccacctgctgcactgggatcgtctgccgcggcccgcagacggtgaacgaggcgacgcgctttgtcacccataccgaagccggacaggtgatctccctgtttccgatgcaggccggtacgccaaacattgactggctgcagcagcatatttcgctggacgccgatctggggcgcctggagcaggcgatcgcggcggtggagccaggcagcggcggcgtcttctggcagccgtacctcaatggcgaacgtgcgccgttttacagcccggacgcgcgggccggctttttcggcattagcccgcacaccacccgcgccgaactgcagcgcgcggtgtttgaaggcctggccttcgccattgtcgatgcgctgcagggttatccgcagggcggcgagctgtatctgaccggcggcggcgcagcctcggcgacctggctgcagattatcgccgactgtaccggacgcacggtggtctccagcgcctttaacgaactgagcgcgcgcggcgcggcgatcctggcggcccgtagcgtcgcggcgctggccgagacgcctccgctggcgcagacccgctatcagccgcgccctcaggcgcatgcccgctacgcggcgctgtatcccgtttaccgcctgctgcgcgagcagatgctgccggtatggcaggccagacaggccgcccttcaacctctttctcaggacctacaaccatgaaaatcgtttttaccgccgagcatgctggcgaccttagcgccttccaccagctgggcgagctgctggtggaggggtgggcgctgggcaaaccgaaactcagcgccggtcagctgattgagctggcccacgacgccgaggtgctggtgaccagctatgatgaggtgacggacgcggtgatggccgcctgtccgcgcctgcaggtgatcgcctgcacccgcgcgaatccggtgaatattgatacccaggccgcccaggcgcgcggcatccgggtgctctacaccccggggcgcaatgccgatgccgccgcggagctgacgcttggcctgatgctcagcctggcgcgccatattccgcaatcccatgcggcgctgaagcggggggaattcacgcaggctgacaatgccgccgccgccactcagcagggtctgcggcgggatgtggtctgggacgtgagcccggaaagcccctatgaagtgtttaaaggcactgaactgcgcaataaaacgctggggctggtggggtatggcaacattggccgccgggtggcgcgtatcgcccgggcgttcggcatggcggtgttggtggtggatccgttcgtcgccgcagaggatatcaatgagccagggctacagaaaacgaccctggaggcgctgttccgcgaggcggatatcgtcagcctgcacctgagcagcgggccgcacagcgacgggctggtgaatgccgcgctgttaaacagcatgaagcccggcgcgctgctgatcaatacctctcgcgcggcggtggtcgacgaggcagcgctgattgatgccctgcgccacggcccgctgggcggcgcggcgctggatgtctatcaccgcgaaccgctgtggcgcgatcatccttttgtcatcgagttcgataacgtgattatcacgccgcatatcgccggagccacccgggagagtatcgccaaacacacggcgatgattgccgccgatcttcagcgctatgtcgccggggagccgctgctgtaccagtggcgttaagccgcttgcgccgccgcgttctgcagcggcgcgggtccatcgtcaggggcgatgggccgccataaaagcctgggtctgttcccagtccactaccccggcatccgatcccatcccggtcgccaccagcgcggccaccgccgaggcgacgtcacatgctgctttcacgctgagtccgcgcgccagtgcggcaataaacccgccgcagtagctgtcgccgcagccggtggtatccaccgcctcgaccggccacggcgcaatatgctgcggcccgccatcgcggccgataagccaggagccgttctcgccgtctttcagaatgcaggtgcccacgccgagcgccaggaagaagcggccgatggcctccggctgcgtctctccggagagaaaggcggcttcctccagcgaaggcatgaaataatccaccgacggcaacaggggccgcagtagttcgagggtctcttcattcggggcgataaggtcaaagctggtggtgactccgcgcgctttggccgcctgcaacagccgcgcgctctgtccctggtccattgccgccagcagcccggtcccgccgtgatgcaggaaacgacagtcaaggacggcgtcaaattccgcttcactgacaaacagggcgtcagacgcgccccggcagtgcagggccggacgttcgccgttggggcgaatcggcaggatcgtcgccgaggtctccttcagcgcggtgcgctggataagcgagcagtcgatgcccagccgggcatagctggcgaggataaagtcggccttttcatcttcgcccaggcaggccaccgctgcggtgcggatcccgagcttcgcggcgttgatattagccccggcggcggtgccggcggggttgagacgaatttgctcaataaaggcgacgccgccgcgcggcgggatcgccaccaccgggcgcccggcgatatccagaatagtcaggccgacaaatacggcgtcaaaggttgccatcgttctcccgtttagcgatgcgtttggcgcaggcgcgcctgccagaaggatagggcgagggccaccaccagaatcacgccgaccagcgcgtccttcaccagataattgagccccatcaggttcaggccgttatcaataatggcaaggaacagcacgccgccgagggtgccgaggatgctgacccggcccagacgggtaaaggcagtgccgataaatactgccgcaatggcgtccatcaggtaagactgcccggccagcggggtaaactgccgcaggttggcggagaggatcaccccgccgacggcgcagagcgccgaggcggccaccagcacgccgagcatggtcaggcgatcgcggatcccggcgatacgcgccgcttcgctgttctgaccgatggcgcggacatatttgccccacagggtgcgctcggtaaccagccaggccgccagccacagcgccagcacgatcgctaccggcgtggggatcccgccaaggttgcccaccgccaggtcgtgatactccggagccatccgccgataggctatcgcgccgccgccgtcggtatagatgcgctcggcgctgctggcgataaaccaggtgccgagcgtggcgaggaaggaacggatccggcagatgaggatcagaaaggcattgagcaggccaatcagcaccccgccaagcagagcgcagcccaccgcggcctgccacggcagatgccaggttttcagggcgacgagggcgaaggcggcgccgaaatcgagcgcgacgcccaccgacagatcaatcgccccggcgctgacgatcagggtcatcgccatcgccacaatcagcaggatcgcgctgccctgcagcaggttggcccagttatccacggttaaaaataccggattcgcccagccaaacagggcgatggccagcaggatgatgacgccaaatccggcccgcgacagccaggccagcgggctgctggccgtctgttccgccgacgcagaggttttcagagtgatttgactcatgcctcgcctcctttgtgtctgaccgccgaggccgccagcaccaccaggatcaggccgcctttaatggcgcccatccagaagatattgacccccagcaggccgagcccgttagagagggcgttgaccaggattgcccccagcagcgcgccccagatggtgaccacccgacggcgcgagaaggcggcgccgataaaggtcgccagcacggtctccagcagcagcggcgtggccgtcccgctggagctgccggagccctggctgagcagcggcagaatagccagcccggcggcaatgcccgctaacagccagaccagcagggtcaagcggcgcacgttcaggccgctcatctgcgccatatcgcggttgccgcccaccgcctgcacatgctggccgaagcgggagtggtggagcaggaactggaacaggataaacacccccagcaggtagaccagcggccagggcaggcccagcacgctgttgtcgcgaaaggcgaccatcagcggatcgctgaccgcgatgcgccgctggccggtcaacagatctgtcagaccggtaaacgccaccgaggtcgagagggtggccagcagcggcggcaggccggccgccagcaccagcaagccgttgatcgccccgcacagcaggcaaaccgccgccagcagcgccagcagcaggagatatggcgtgtgccattcggccagcccgaggctgagcagcgcgacgccgagcaccgccgtcgccggcagggagaggtcgatgccgccggagaccacatcatccccgcccacggcgataacgcagaccaggccgaaacagaggattgccagcggaacgctctggactagcatcaggctgatattttgccagctgagaaagtagggcgactgtacgctcagccataccagcagcgacagaaacaggatcaggggaaatttttcaatcagcgtcgccaggcccggacggccgcgacgctggatagcagtactcatggtgaaggctcctgtccgccgttgatcgccaccagcagggcgtccagcgttagcccgcgggtgggcagattggccgccagcgcgccgcgccagaggaccaggatccggtcgcatagtccgagcagttcgggggcgtcgctggaggagaccagcaccgcccgtccttgatcggccagctggcgcgtacgttgataaatatcccggcgggcgccgatatcgacccccagggtgggttcatcgagaataaacagccgggcatcggtccccagccagcgggcgaggatcgctttttgctgattaccgccgctcatgtagcgtaccggcagccccggtcgtcccgggcggatcgccagctgttctatccagtcgcgcgctttctgctcggcgataccccgccgctcccagccaaaggtggcggtttccggcagcgaggcgagattaatattgtcggcggtggtgaagggcaggatcagcccctgatggcggcggtcgcgtggcaccagcgccatgccggcgcggatcgcctgctttggcgtacgaatgcgccgcggccggccttcgaggtggatggtgccgcgttccgccgggcgtaagccgtagagtaggtcgaccagcacatcgcgtccggcgcccagcaggccggcgacgccgacgatttcgcccggctgaatatcaaaagaaagatcctgcagctgccgcccgtcgctcagctggcgcaccgagagcagcggggttgccccattgtctgccgccgggcgctggcgcggagtatacagctggtcgatttcccggccgaccatcatggcgatcagcgcctcggtattctgcagcaggtcgcggtccgggtaaccgaccgcttccccgttgcgcagcacggtgccgcggtcgcagagggtggctatctcattgaggtagtgggaaatatacagaatggcaatgccctggtcgcgcaggcgcaggatggcggaggagaccagactggcctcctgcgcctccaggggggcggtgggttcgtcgaacaccaccagccgcgctgcgccgtcgatcagcgcgcgggcaatttgtaccagcttgcgctcggccaggctcaggtcgcgcaccagccgttcggggtcgatcgccagctgccagttttgctggaaaaattgcgccgtggcggccttcatccgtcggcgatccagcgccccccagcgggtgcgatactcctggcccagaaacaccgattccgcgacggtaaagtgcgggatcaggttcagctcctggtggataacgcggatgcccgcggcttcgatggctgccggattgccgaggggcagcgggtgaccgtcgagggtggcgctgccgctgtcggcctgatacacaccggcgaggatcttgatcagcgtcgatttaccggcgccgttctcgccaatcaggccatgaatctcccccggattgaggcgcagggtaaccgcattaagcgcggtgacgctggcaaaacgtttaccgatctgctccatgaccagaccagcggcggggcgttccccgccaggatgttgattaatcactgcagctcgccgtatcccaactgtttatacaccgctttcgcttcctgcggacctttcaccggaaccaccggaataaaggtttgcaccggtagtttctggccggcaaagtagcgggccacgttgtcagccgaggtctggccgatcagatgcggctgctgcgcgacgttagccacgaacgggctgccgggctccgccatgatctccagggtctccggaccggcgtcgatggccgtcactttcacgtctttatcgcgaccggtctcttccagcgcctggacgatgccgatggccggttgatcccagcaggcgacatggatggcgtccagtttgcctttcggatactggctgagtaattcgagggttttcttgcgcgcgtcttccggcgagttggcgaactgttccgcgagctcgggctggataatatgaatatccggataatccttaaggacatatttccactgatcgtagcgaattccgcaaatacgcagcgcgctggagaaggcgttaaatacggcgacgttgcctttgccgcctaattcatccgccatgtagcggccgatggttgagcctaaggtgtagttatcggaagtagtattgttgaccgaatattgagaaacatgatctacggtaaataccgggataccggcatcacgcaatgctttaaattttggttcgacggcgctatcgccgagaatactaattaccgcgtccaccttgcgtgacagtaaaatatcgtggttattggcatgcacctgattatcgcggccgccatcgacgccaatgactttgccccccagcttctccacctcctctgtcgcgcctttaaaggcctcgcgatcccagaaatgctgagtgccgaccacggcaacgccaatggtttttccctgtaaggagagggcgtctgcggcagcgacgctcagcgaggcaagggaaagcagtcccagcgcggcaggcaataattttcttttctgcgacattgttattatgatcctgtgatgaaggtggttgcggaccggtagcatgacaagaagcacctcgccacctcaaatacaaaataagtctaagttatgccaggaatgttatatcgcagaaacgtcagagaaaaagtttattttgtcatgagaaacctgaaaatatttcatgatggcggatagacctttttattttgtggttttatttttgacttattccgtgtttatttagcggataaagacaattttcttaatattgtgagtgcatgggaaatacggcgtctacaaagaaaaaaagaagattgcgcgggctaaagctttttttagcagagcaatgtctggccgggtaaggattattaccctatttccccgctttattgtaatgaaccttaagctgagaagaacgcgggcgctatgaagaaacagcataattatacggtgatgcactggggaacctggcaggtggagagcagtgagggcgagatcgtggcggttaagccggtgccctgggataaaaatccctcacgcatcggccagtcacttcccgacgcggtgaccagccaaacgcgcattcgccgtccggcggtgcgcgccggctatctccagcacgggccggcgtcacgagaagggcgaggtaaagagccctttgtcgaagtcagctgggaggtggccctggacctgctggcgcgcgagctgcgctcggtcaaggcgcgctgcggcaatgaggcgatctacggcggctcctacggctgggccagcgctggacgctttcaccatgcgcagagccagctgcaccggtttctcaagggctttggcgggtacaccgccagcaccaatacctatagcagcgccgcgggcgagcgtattctgccgcatattctcgggccgctgagcccgctgcaccggcagcatacccatttttccgagctggcccgggagtgtcagctgtttgtcgccattggtggtctgccgctgcgcaatgcccaggtcaacggcggcggcgccaatgaccatatgctccagtactggctggataagatgcaggccaacggcacgcggtttatcaatatcagtccggtgcgcaatgacctcagcgcggtgcccgacgccgagtggctggccattcggccgggcaccgataccgcactgctgctggccctgagctatgtgctgatcgctgagtccctttacgaccaggcgtttgttgccagccataccgtcgggtttgccccctatcgcgcttatctgttgggcgagcacgatggcgtggcgaaaaccccggcgtgggcggcggcgattaccggcctggacgcccagcgcatcgccgacctggcgcgggagatgacccgccaccggacgatggtgaatatctcatggtctatccagcgcgcccgtcaaggggagcaggcctactgggcgacggtggccctgactgcgctgctgggacagatcggcacgccgggcggcggtctcgggtttggctacgcctgcactaacctggcgggcgcggtacgaaaagcgttttccggcccgcgcttacccgccggggagaatgcggtggacagcgttatcccggtggcgcggctgtccgatatgctgctgcacccgggagaaacctatgagttcgacggtcagcagcggcgctatcccgatatccgtttagtctactgggcgggaggcaatgcgtttcatcatcatcaggatctcaaccgactgtgcgaggcctggcgccgcccggagacggtggtggtgcatgagcagtactggaccgcgcaggccaaattctccgatatcgttctgccggccaccacctcgctggagcgagaggatatcggcagcggcggtcacgacgggtttatgatcgccatgagcgcgcagatcccgccggtgggcgaggcgcgggatgattacgctattttctgcgatctcgccgatcggctgggattcggggaagcgttcagcgaagggcgggacgccgggcagtggctgcgtcatctctatgaggagtcaagaccgcgggcgcaggaggagggtattgcgctgccctcgttcgatgacttctggcagcaaggggtgctggagtacagcgcgccggagcggccgcaaatttttctcgccgattttcgcgccgatcctgagcgctatccgctctccaccccctccggcaaaattgaactcttttccgccaccgtcgccgggtttggctatcgcgaatgccctggccatccgtggtgggatgaacaggaggccgcccggcagcgacaggaggcggcgcggtggccgcttcatctgctctccagccagccgcgcgcccgcctgcacagtcagtacgaccacggcagcgtcagccgggcgacgaaagttcagggacgcgagccgctgtggatgcatccgagcgatgcgcagggaagggatatccgcgaaggcagcgtggtgaaagtctataacgaccgcggggcgattctggcgggggtgcacctgagcgagcagattttgcccggcgtggtacagatgtccaccggcgcctggtatgacccgctggatccgaaggaagaacggtcgctcgataagcacggtaatcccaacgtattaaccgaggatcgcggcagttcgcgcctgggacagggctgtagcgcccagagctgctgggtggagatcgccccgtggcgagaggagctgccgccgatcaccgcctttgatccgccgaagtttattgaagtttaggcgttggcgctcgccggcggcggggcgggtagcccggagaaggcgcggtatgcgccgcctccggcaaagcccgcgcctggcggtttaagactgacgacagtttgacgttacgccagccgcgggtaggcgctggcgatatcgtcgccggtaaactgggcgatccagccttccgggttatcaaaaatgcgaatggcggtgaagttcggttctgatcccatatcaaaccagtgcggagtgtgggcgggaaccgaaatcagatcgttcttttcgcacagcacctggaacacctcgtcgccaatgtgcaggcaaaacaggccagcgccctcgacaaaaaaccgcacctcgtcttcgccatgggtgtgctcgttcaggaacttttcccgcagcgcctctttttgcgggttatcggcgcgcaggctgatgacgtcccagctctgatagcccttttcggcgaccagtttatcaatcgcatgctgataggcggcaatcaccgtttccgggctgggatttgcgccgaggtcgcggtcggcctgccagcgctcgaaacggacgcctttggcgttaagctgcgcctgaatcgcgctggcgtcggtgctgtgccagaccggcgtttgcggatcggtcacggaaaaaagagttaatgcgctcatgctgggatctgctccggatgaatgtcgtcaaaacgctgaacctgagggtgatggctcgccgggtcgcggtcgccgcgaaccagctgcacagtgcgcaaacccgcggcctcggcggcatcaagttcctgatggatatccgacaggaacaggatggtgccaggggcatggcccaggtgttcagcaatgttacggtaggactgcacctcgcgtttggcgcctaccagggtatcgaaatagcccgtgaacagatgagtaatatcaccttcatcgctgtagccaaataacaatttctgcgcagccacggaacctgaggaatatacatacagatcaataccctgcgctttccatttctccagcgccggcagtacgtccgggtagagatggccggtaaagtcgccgttgagatagccgtcgcgccagatgatcccctgcagcgccttcagcgccgtggatttacggtcttcatccataaaggtgaagagggtagtgataaggtcggcggtgctggcggcgggggcgtctgtttcgctgcgcaggttgtcgagaatggttttgaccggttcagcgtgctgctgagcggtcacaaagccggccagtcgttcgcgggcgtaggggaacagcacgttatgcacgaagcggatatcgctggtggtgccttctatgtcggtcacgatggcgcggatcatggtttctccagagtgggcgtagcgtggaataacattagcatttagacgtctaagcgtcttgattgccaaatattaacatcgtgttatagtggcttcaacaacagcattacaatcggtataaaaagaatgaacaataaccccttgattccagagagtaaacttcctgcgctcggcaccacgatttttacccagatgagcgccctggcccagcagcatcaggccataaacctgtcccagggctttcccgattttgacggcccgcgctatctgcaggagcgtctgacgtaccacgtggcgcagggggcgaatcagtacgccccgatgaccggcgtgccggcgctgcgcgaggcgatcgccgggaagacggcggagctgtatggttaccagcccgacgttaacagcgagatcacggtcaccgccggcgcgacggaggccctgtatgcggcgatcaccgccctggtgcgccgcggcgacgaggtgatctgtttcgatcccagctatgacagctacgcccccgcggtggcgctggccggcggcgagttacgtcgtattgcgctgcagccgccgcattttcgcgtcgactggcggcaatttgccgccgccctgagcgagaaaacccggctggtgatcctcaacaccccgcacaacccttcggccaccgtctggcagcgcgaggattttgccgccctgtggcaggcgatcgccgaacgcgagatctatgtcctgagcgatgaagtctatgagcatatctgctttgctgagggcggccacgccagcgtgctggcgcatccccagcttcgcgagcgggcggtggcggtctcctcgtttggcaaaacgtttcatatgaccggctggaaggtcggctactgcgtggccccggcggccatcagcgccgaactgcgcaaggtgcaccagtatctgaccttctcggtgaataccccggcgcagctggcgatcgccgacatgctgcgcgaagcgccggagcattatcgtgagctgccggcgttttatcgggaacgtcgcgatctgtttattgaagcgctgcgcccaagccggctggaaatcctgccctgtgaagggacctatttcctgctggcggactacagcgccatctccgatctagacgatgtcagcttctgccgctggctgacgaccgaagtcggggtagcggcgatcccgctctccgtcttctgcgccgatccgttcccgcacaagctgatccgcttgtgcttcgccaaacagccggcgactctgctggctgcggcggcgcgtttgtgccagctgtagttacttaatcgtccacgcctgggagaactggcggccggcgaacatctctgtcaggccgctaatttgcttcagacgcagcacttcatcggcatccatccccagctctttgccgattttctgcggcgtccagccgagccgggtcagctcgcggacgatctctgacatggcgtggatttggtggcggccgcgcgcccggttatggcgtatggtcgctgccatcagcccgtcacgcgaggcagcttcactcgtcaggcaggtcaccggcaaatagccttttagcgtttttttcagcgcggctttgctgcaggccagctcatggcggtgaaaaccatcgacaatcgtatacgcctgtgggccttgctggatgacgacgaccggctgggtaaagccgtcggcctccagcgacgtttgcagcagacgcttctccggcggcgccacgttattcgggttgtagtcgttgggggcgatcagatcctgtttgacccacagcacgcagtcgacgggctgcgagcggaaggggctgtagtggtggagcacctggcgaaacgcgttgatagcctcaatgcgcgcctcgtcatccagcttttgcaggtaagcttccagcgcctgcgtcagttgttgttgcataaaatcccccattgttggcgatgtttttccatgcgtttacggtagcgctgatagtggctgcttttggttgggctaaacgaaagctgacggcaccagtaatcgttattgagcagtactttgcagactcgccgccaggatgggatatctttggtgccaatgtccgcaggttgggtatccggaatatcctccataccttttttctggtaccagcgcaggtagacggcgattttattgcggtagtgctcggcggtggtttccggcatgctgtcgagcaggaacagggcgtagcttttccacgtcaggtggtcgggcttgtcgattttccgatgaccgtagaactgattatcatgcccggcatagaccccgccgctgtgcgcgccgctcactcgctggcacatcgcggcccagcgctcaggttccagcacgtgatacagccacagcccctggcgctgctcgggaccaaacggttcgcaaatgcgcatatagcgcagcggcaccccggcctgatacatcagatcgtacaacgggttatagggctcgccgcttttggcaaaccaggtccagatatcggcggttttccagtcatagagcgggtagatgtaccaggcatggccgcccggcgctgaagtggtccatggtttatcgtcggcgaagcgctgtttacgctgtgaagaaatcgtcataaagcgatttagcgattcgtcggcgcgaatgcccaccagcacggcggcgggacgacgctgcgaaaaccactcggcgaagtggctgacgaaggcttcaaagctcattccgggttgataaaatgaaaaatagcccgggtgggtaatggcccagggcggcggctggcgtacccactcggttccgggctcccagcattgccattgcggcttatactgcgtcagggcattttgggtggtgagcggcagggcgacccagtaaaaggtttcgatgacatccgcatacagcgcacgcagtttttcacagtgggcgatggtgcaggagaactgcgcttcccagtcaataaacaacacgcagatttttttcccctgtaaccgcgccgcctgggcggttaaatgcagcataacggtggagtcttttcccccggaaaaagagacacagatgcgcgaaaaattatccatgacccactggatccgctgctcagttgcttgcagcaccgattccggtaagggatatttaataaacgacatgaccattaatcctttaatagtagaaaattcccgttagctcagtataaacgatgaggggtaggaaattaagggtcgattattgtttctggcagcgggggaacagaagggcgttattcgctgtgattaaatttgggccgtgatgcctctcgatcattcattaatatggtgattaattcagttaaaaaatgattttgcgaagatgcatggtggtaattaatgtagatcgtgatatccggaaaaagattatctatgttgatggcgtgaagctgcatagtgggtgagataaagtcatataaataggaaggcaaaaagccaattaagtcggttttattaatcatgttaagaatggtcataaaagagtcgctgcgaaaggcaatattgcgcggattcagccaggcgatgctgctttgctgcacgcgctgaataacgggatcgttggtaatatagtgagtgaaaaactcctgcgccagtgactctaccgaggtaagcgtttcgcgtcgcggatggcccgcccggcaaaccgccagcgtctgcaccgtctgatagggctgacagatcgtggcgcggttggtaatgggcatgcgggtgaacaccaggtccgcctggcgatacgccagcagctcctcagccgattcggtggtggtcaggttatggtgctcaatttgcaagttcgcctgatgacagagctggttaatcatagcgtggctattgactgaacagaacagcggggggccatatatcacaatacgtttacgcagttctgagcgattattaagattgatggttttttccagctgctccagattttgctgtagatgataatgaagattgacgcaggcggtggtgggcgtcattcctttgccaacacgaacaaatagcggatcgtttaactgctggcgcagacgctgcaacgactgactcaccgctgagggggtgataaataacatcgccgccgctttgctgatgctcaaatgttgatagatacattcgaaaataaccaataaattcaaatcgaactttttcagatcgtaaagatttgccattaatgcagtcctgtttattaccggtgcggattataatattcttaatgataatgttttgtggcttaatatttgcggtgtgaatttaattattggcaaatacagttaagttctgcttaatatatcttatcgtcgacggtggcgccagcggtcgcttccgccaggcgccattgcgggatggaattactctttttcacccatcataatatgcagtttctctttatccggtaggccgaccacctgctgcagcatattatctttattcatataataaatcgccggcgtcacgttggctcccagatcgtccatcagctgctggttgacgttgagcattttcattttctccggcggaattgctttcgggatcgtcagagccattttcccattcgattgctcgtaatcatgccaggttttcgccggatcgctgctggcgagaatcgccgcggcggtggccgggctctccggcttaatcacccccaccagcagagtgcggatctgcactttaccggcctctacccaggggcgggattgctgccagaactgcttgcagtagggacagaagggatcggcaaagacatacagcacgataggggcgtccttgcgaccatcctgcagccagtgggcgctggccatcttcttccacatctcttgtcccgccggggtatagagttctttctgaaacagctgctcgctgaggttgctgccgttctcatcatacatatagccggagatcgcgtgtttaccatccggcgttaggtagatggcgacccccatgtcctggtatttgcccagccagcctttcattccccccggcgcctcaaagggttttataatggtaatgccctgtttttcaatcgcttttaccggagcggggagttcctccgcatggctgcataacggcaaaaggctgagtaacagaagacgctttaacataagtattccttgtaaaatcagcaggaaagggcaaaacgattgtcgaacctatcacagtcataggcaagatcagcagaatgacggattgccctttgctggcgtgggtgatgtaatcctagatgctgttacattaaggtaatgtagagcgcaacacatagccagtctgactggcgctgaacctaccctcgggtatttcaggtaacggggccgcctgaaaaggtggcctttttacttttgtcgcggcaaatgatgcgaaaaacagcgattagcgctgaacgcgtcgacaggttcacagagttgtcttgttccggttgttagataacgcttattgattcgataatgtaaacgcattggtcgggtcaggaaaaattcgttaacttagacctcaacgaaaacacggaggaagtatagatgtccttaattaacaccaaaatcaaaccgttcaaaaaccaggcattcaaaaatggtgaattcatcgaagtcaccgagaaagacaccgaaggccgctggagcgtcttcttcttctatccggctgacttcaccttcgtctgcccgaccgaactgggcgacgtggctgaccattacgaagaactgcagaagctgggcgtagacgtttactctgtgtctaccgatacccacttcacccacaaagcgtggcacagcagctctgaaaccatcgccaaaatcaaatatgcgatgatcggcgacccgactggcgccctgacccgtaacttcgacaacatgcgtgaagatgaaggtctggctgaccgcgctaccttcgtcgttgacccgcagggtatcatccaggcgatcgaagttaccgctgaaggtatcggccgtgatgcgtctgacctgctgcgtaaaatcaaagcggcgcagtacgttgcttctcacccaggcgaagtctgcccggcgaaatggaaagaaggcgaagcgacgctggctccttctttagatctggttggtaagatctaagtctgtttgtgcccggcggcgctacgcttgcacgggcctacaacatcgtaggccgggtaaacggcgtgccacccggcaatcaatgggcgctttcgcgcccattttattccaacaccatgatgcaagcgcattcaggcagcctgacgaggccgcttgcatgatgatgttttaagcccaggagataacaatgctcgacaccaacatgaaaacccagctcaaggcctaccttgagaagctgaccaagcctgttgagctgattgccacgctggatgacagcgctaaatcggcagaaatcaaggaactgttggctgaaatcgctgaactgtcagacaaagtcacctttatagaagacaacacgctcgcggtacgtaagccctcgttcctgattactaacccaggttccgaccagggcccgcgttttgcaggctccccgctgggccacgagtttacctcgctggtgctggcgctgctgtggaccggcggtcatccgtcgaaagaggcccagtcgctgctggagcagatccgcgatattgatggcgatttcgaattcgaaacctactattcgctctcctgtcataactgcccggacgtggtccaggccctgaacctgatggcggtgctcaacccgcgcatcaaacacacggcgattgacggcgggaccttccagaatgagatcaccgagcgtaacgtcatgggcgtgccagcggtgttcatgaacggtcaggagtttggtcagggacggatgacgctgactgaaatcgtcgccaaagtggataccggtgcggaaaaacgcgcagcggaagagctgaatcagcgtgacgcttacgatgtactgatcgttggctccggcccgtccggcgcggcggcggcggtctactctgcacgtaaagggattcgtaccggcctgatgggcgaacgcttcggcggtcaggtgctggataccgtggatatcgaaaactatatttcggtgccgaaaactgaaggccagaagctggcaggcgcgctgaaagcgcacgtcaatgactataacgtcgacgtgatcgactcccagagtgcgaccaaactgacgccggcggcgacagagggcggcctgcatcagatcgaaaccgcctccggcgcggtgctcaaggcgcgtagcgtcatcatcgccaccggggcgaaatggcgcaatatgaacgtgccgggcgaagatcagtatcgcaccaagggcgtgacctactgccctcactgcgatggtccgctgtttaagggcaaacgcgtagcggtaatcggcggcgggaactccggcgtggaagccgccattgacctggcgggcgtcgtagagcatgtgaccctgctggagtttgccccagagatgaaagccgaccaggtgttgcaggataaagtccgcagcctgaagaatgtcgacatcattcttaatgcgcagaccacggaagtgaaaggcgatggcagcaaagtcaccggcctgcagtatcgtgaccgggtgagcggcgatgagcatcatatcgcgctggcggggatcttcgtccagattggcctgctgcctaacaccacctggctggaaggcgccgttgagcgcaaccgcatgggcgagatcatcatcgatgcgaagtgcgaaaccaacgtcaaaggcgtgttcgccgcgggcgattgcaccaccgtgccgtacaaacagattattatcgcggcaggggaaggggcaaaagcgtcgctgagcgctttcgactacctgatccgcacgaaaaccgcataacaagtcagacaatagacctgcataacaaagaggctacccaggggtagcctctttttttatactcttttcgtcattcttacctgacgaccattaccgggatatgggcatggcggatcacgctcgaggcattggagccgagcaggtgggtactgatggagggattgcgtgagccaataactaccacgtcggcgttaatttcgctggccagctcgttgaccatatcgcgaacgctgccaaaacggacatgtagcttgatacgagacgggtcaatgctgaagtggctgaccatcgtctgcaggcgagtctccgcctcatgctgcagatgttcctcaaaccgccgcaggtcggcggtaaaacggctcatggtaaagctcgcggaacccggtaagacgtggagcagatggatcaccccgtcctgctgggccagaaactccgcgtgccggacggctttatcgctcagcgccatctcaaagacatcaaccggcataatgatagtcttatacatatgcaatcctccttgttcgtttgcgtctatatcaacatattatatgcggatattgtgtcattcaggtcgcaaaactgtcagccaggcaggcgcaaagcgtaaaaaagggtaagcggcgggaaaacagcagaaagaggatgtgcggacatcctctgaataaagcgcgaaacgcctcaggcagcggaattagcggtggaattcgccagcggcttccggctggtacaatagctccagcacttccaggtgcgtcgatgcgccgcccggcagctcccagtgaatggtgctgccgactttcaggcccagcagcgcggcgcccaccggcgcgaggacggagagctggctggcgctgtcggtgacctgtgacggaaacaccagcgtccgcacgcgctcttcgccgctggttaaatcgcggaattttaccctgctattcatggtgacgacatcatgcggcatcgcttccggggccagcatttgcgcgcggtcgagttcctcattcagggcatcggcaaccggtgagttggcgaaagccggctgctccagcagcctgtcgatacgttcggcatccagttcattaatgatgattgcgggtctggtcattgcatactccatgttatccaggaacctgtccgtaaaagaaaaccctcgccgaaaggggcaagggttaaggtcctaccatcatactgagagttgccggcagtttgaagtgatgaaacgcacattcagcgtgcaacaccatccggcggacggtgttttccaatcagcatcccgctttgcgctagtggccaaccttatcgaggataaactgtgcgccgcagttacccgggtgaggctggggcagaaaagcggaagtggccagcggggcgttgatggtcgcggcgttgagcgagatttgcatctccgtcagataggccggattaccgttgcaggttagcttaaacgccttcacgctctgcggaccccaggcgcgggccacggcggcgtcgaagtcggcgcggctgaccgtttggccatagtgcttcgcgagaaaatcccccaccgggctgcgcttaatttcaccgtttagtcgcaccatggcgccaaagtagctgtcgggatcgaagccgaagcagacgccatgtttggcatattcgtagcgttccagacaggaggtgccgcccgatcccggcatcacattattaagtttattggccatctccagcgacagcccggtctccgccgcctggcatttgcggttcgcttttacctccggcatgttaggcaccggacgcgtggcgcaaccgtagcgcatccagcgacgttcatccactccgcgcgcggcaatggactttggcagcccgggccacaggccatgcacggtcagaaagtcggctttattcgcggtgtcctgctgcaggcgacactcttccggttcgttgcgattgcggtcatacatgctctgacagaatccggtttgccaggagagggcaaggacgtagcggtcaaaatcagcgtatcgcatcgcggtgagcggttcagcaccggcctgagtggcggtaagcacaagggcaatcgcggcgaaatccttcctgaacatttttattcctgattatggatggcaaaagataacggggagttattaaagcataaaaaaggcgcccgctggcgccttttcgcgtggttagaccattagtggagcgcgctgccgggcaccaggatttcagtagcaacgatcaccaccagcaggccaacgagcaccggcactgaggtgcgcttgaccacttcgaatggggaaatcttcgccatcccggcaacggcgaccaccaccccggagacgggcgatatcgtgcggccgaggttagaagcctgcagcatcggaatcgacaggtaggccggattaatgccggaggagtgcgccagcttggggatcatctcaacgaaggcgtagaacggggcattaccggaaccggtggtcatcgccgccagcatggtcaggatcaccagcaccagcatcagaataatactggccgagccgaaggaggtggcgattgagatcagaccgttgataaagccgatagtgcttaacccctgggcaaagacgccggcggcaaccaacagcatcactacgccggcgaaggcgtcggccattccacggtaggcgacttccagcccgctaaagacgtttttggtgttgaaaccgcgcaggaactcgagtatcgccgccagcagcatgcagccaacgaggatggtgataatgtgcagctccggcccccatttaccgtcaaagatcagcacgccgatgatcggggtaaacggcagaatggcatacagcgccggggcggtggtggtgatgtcgttgacatcgagcatctcgtgagaaatgtgttcttttttatcaagatagcgctgccagaaaaaatgggcgattgccatgcagataatggccgcgatggagatcggcagcgtggttttaaaagcaaagtcgatcagcggcatttcagcggctttggccgccaggacgacgtcacccgaggtcggcgagaggataatcgccgccggtgaggcgcagatggcggcggcggccccgcggctgataccgacattcaccattaccgggaacagcgtcgccatcagcagtacgccaaggccggtcgcggaggagacggccagcgacatcaggcaggcgacaaaataggcggcaatcatcagcagatagggcgaattaatatagcgcaacggcttcgacgctaatttgaccaccatatcattggcgccaatatgggtcatataggtggcgaagccgcacagcatcatgatcatcatgcccagatcgccgccgcggctcatgagtagaatcttaatgtattcaataatatcggtagcggaataaccggtgctcgcggtattacccggtaacactttatgtcccagcagggcgctgacgatcagtaagattaagcctccgacgaacagcaccccggtggccgagtagcctttaatgatatagcgggctacgcccacaatgaccacaatccctatcaggatctcaataaacgtcagcatttattacccctaaacccaaagaatatgtagataaaaagcaccacaccaaattttaatgtgcgaatgtgccgaaaaaacggacaaaactcgctgatgcaaatcaataaagcgataagaactacacgtcccccatcacgcctggatataatcaccagatggatagttaagccgttctgatggacagcgggcgaaaatcaggagtttgccttatttcgttcaacctgcattgagattatctttgctattttaggtggtttttaaatcaaagtggtaatagaaaagtgttgatgttacgtcgtttttcattgttttctcttggttttttaggatggttattggtgtccggaaacgccagcgcgtcgttttcatcgacccttagcgaaggttaccataccttaagtaataacgtagcgcagacctggaatgagccggagcactatgatttgtacgttccagccatcacctggcatgcgcgctttgcctatgacaaggaaaaaaccgataagtataacgaacgtccgtggggggcaggtttcggcgtctcgcgctgggatgagaaagggaactggcatggcctgtacctgatggcgtttaaagactcttttaataagtgggagcccatcggcggctacgggtgggagaaaacctggcgcccgctgacggaccagaatttccacctcggccttggctataccctcggcgtcacggcgcgcgataactggaactacatcccgattccggtgatcttgccattggcgtcaataggttacggtccggcaactttccagatgacctatattcccggcacctacaataacggtaacgtttacttcgcctgggcgcgcttccagttttaattcgctaaatcttagcaataaatgagataagcggaaggtcttgtgcaaaaacaaggactaaagcgttacccactaaaaaagatagcgacttttatcactttttagcaaagttgcactggacaaaaggtaccacaattggtgtactgatacccgacacagcattagtgtcgatttttcatataaaggtaattttgatgtctaagattaaaggtaacgttaagtggtttaatgagtccaaaggattcggtttcattactccggaagatggcagcaaagatgtattcgtacacttctctgcaatccagtccaacggtttcaaaactctggctgaaggtcagcgcgtagagttcgaaatcactaacggtgccaaaggcccttctgctgcaaacgtcatcgctctgtaagcaacgcgtcagtagaatataaaaacccgctaataagcgggtttttttttgcctgtctccttcgcttttagcggctggccgcctgcgagaaaagccagaaggcgagcgccgtcatcgcaaacgaacccagcaaattcaccgcgacgttgagcagcgcccagcttacccggccctgctgcaggagaaacaccacttccgcagaaaaggtggagaacgtggtcaggccgccgcagaaaccggtggtaatcagcagtttccacatcgggtcaataccggtcagacgattaaaccacgccagcccggcgccaatcacaaaggcgcctaacaggttggccgttagagtcccaatcgggatagcatgatgcacaggattgagcttcatgccgagccaccagcgcaatacgctgccggtgccgccgccaataaaaacggcgcaaagaagttgaaacacggtcgtttcctgctatttgatgtaagagagtgtcaagtgtagcgcgcatcgggcgcgattggctatccataacctgacgggagaagaacatgcgggtagcggcaggacaatttgccgtcacgccagtatggcggacgaatgcgcaaacctgtgtggcgatgatgcagcaggcggagcgagaaggggcggcgctgctggtgctgccggaggcgttgctggcgcgggatgacaacgacccggatctgtcagttaaatcggcccagccgctggatggcgcatttttgcagccgctgttggctgagagcaggcgtaacagcctgaccacggtcctgacgctccatgtgccgtcaggggaggggagagcgaccaacacgttggtggtattgcgggaaggcgcagtgattgcccattatcataaacttcatctatatgacgccttcgcgatgcaggagtcccggcgggtggatcccggtcagcagatcccgccggtgattgaggtggcgggattacgcgttggcctgatgacctgctacgatcttcgctttccggaactggcgctttcgttggccctgaatggggcacagctgctggtgctgcccgctgcatgggtgaaagggccgcagaaagagcatcactgggcgacgctgctggcggcacgcgctctcgatactacctgctatatcgtggcggcaggcgaatgcggaacgcgcaatatcgggctgagccgcatcgtcgatccgctggggaccactctggcgggggccgggagcgagccgcagctgatctttgccgatctctcagcggatgaccttgcgcgcgttcgcgagcgtttgccagtgctgcggaaccgacgatttgcgccaccgcaattattatgacgtttttttaaacaaggcttgattcaccttgttacagattgctattgtgtccgcgcgtcaaatacccgtattgtttatcccaataattcgctgtgcacgtcaggatggacatctcagcgctcactcccggaggggaggctatgggccgaaacacgcagcccacgcacaggtggattacaataggacggataaatgcgtgtatgatggcgtattcgcagcttgtatagagaagaaggttagctatgggtgagattagtattaccaaactgctggtagtcgcagcactgattatcttagtgtttggtaccaagaaattacgtacgctgggcggcgacctggggtcggctatcaagggctttaaaaaagccatgaacgaagatgacgatagcgcgaagaaaaccaccgcagaagaagaagcgccggcgcagaagctctctcataaagagtaattctccggctgcgtctcctgacgggatgctggcggtacggcgaagaggccgcgacgtttatcgttgcggcctttgtcgtttttgtcgacgccgcggagaaaagatgcaactaactgttacggacaggcgaaacggatgaagcggagagagccgctgcgccgaaaaggcgcgcagcggcggaagcggtgggttatttaacttccatccctttagcctgcaggtcggcatgataggaagagcggacgaagggaccgcaggcggcgtgggtgaagcccatcgccatcgcttccgctttcatctcttcaaactcttccgggctgacgtagcgctgcaccggcaggtggtgacggctcggctgcagatactggcctaacgtcagcatggtgacgccatggcgacgcaggtcgcgcatcacttcgatgatctcgtcgttggtttcgcccagacctaccatcaggccggatttcgtcgggatctccgggtgcgcttctttaaaacgctccagcagcttcagcgaccagttgtaatccgcgcccggacgtacctgacgataaagacggggcacgttttcgaggttatggttgaagacatccggcggggtcaccgtcagaatatcaagtgcgcgatccatgcggccgcggaaatccggaaccagcgtttcgatcttaatcgacgggtttttctcgcgaatggcgctgatgcagtcggcaaaatgctgtgcgccgccatcacgcaggtcgtcacggtctaccgaggtgactacgacatagcgcagacccatatcggcgatagtttgcgccagcttttgtggctcgtttgcatctggcgcgaccgggcgtccatgcgcgacgtcgcagaacgggcaacggcgggtacagatcgcgccgaggatcataaaggtcgcggtaccgtggttgaagcattctgcaaggttcgggcaggaggcctcttcgcacacagagtgcaggccgttcttacgcatcgctgctttgattccctggatacgggacgagtctgccggaagtttgattttcatccattccggttttctgagcagagcttcacgctcagttgccacgtttttcaccgggataagggccattttatcggcgtcgcggtacttaacaccgcgttccatcacaatgggtttactcatagcgtgcgtgttccagttgcgagtcacgaaggaaagcgaattaattcaatgaaatgttgcaattatcaactatttttgaatcaagagcaggcagtataccattgaaaaggggcagaaagcagcctgcctgcccggcaaattgtaaaatagttgttgttttatccttttcccttccgtgcgctacgccttaaacgagcggatcaccgtctcgatgatctctttcagcaatggctctttcccgctcagcttattaaagtgcagcgcaacgtcaatctgctctccacccagggaagggaaatccagggtctgcagcggccagagacgggacaccatggcgaacaggcgttcggtggtcagacccagcatatcgctcccggcgatcatcgccgcctgggtcatcaggttaaaggtgctaaagccgcagcggcgctcgcccatctcttcctgtagtcggcgatggagggtggggtagcgctggccttccggcagcagcagcgcaaattcgtactccgcgagggtcgtttcatcctgcggaccgtccagggcgggatgccctgcgcggcagtacatctgtacccgatcctgatacagcacatgatggcttatcgcctggccgctgtgcaggtgggtatcaatgagcagatccacctggcgctggtcaagctgccgcgcggcgtcgacgatggcgatattgtgcaacaggatctgcgggaaggtcggcttcagcgcgctggccaggccaggcatcagcagcgctcccatcgctggcgtagtggcgatagtgatcacgcgctgctggtgcgggctaccggtgatatccagcgcgctgaggaaagcttccatgccgcggctgatgtattgatgaagatgggtggcataggcggtgggggtgacgccctgtcctttgcggataaatagcggatcggggaacaacgcccgcagtttgttaattgactggctaatcgccgagggtgtgatattgagtatcttcgcggcgttgacgatacctttatgtacgtataccgcttcaaagatcgtcaacagattgaggtcaatattacgcaggatgcgaaacatttgacgatcgtaacgttcatcctgtctgtcaggagattctgacggaggcgtattctctggcacgcgatgagtccggttgggaatgataggccaagtatagcggcccaccgcgttgccgtgcgtgacaattgattgcaaaaataacgtgttactcgtttagcgccccgctgacagcgggacgttggcctgccgcttaatcccggggaagatattcgtgtggtggatgatttagcagcgccagcagattggcgaccagtcgcggagcgaccgtctccggggaggctgccggctgccactggcgcatttgcgtcatctccataccggcatagccgcaggggttgatacgcaaaaacggtgtgagatccatggcgatattaagcgccagaccgtggaaagaacaacctttacggatccgcaatcccagagagcagattttgcgttcgccgacatagacgccaggggcgtcggcgcgggggtgcgactcgatactatattcagccagggtattgacgaccgtttgctccagtagcgtcaccagctcccgcacgcccagcttacggcgcttgaggtccaacaggacgtacatcacctgctgtcccggaccgtgataggtgacctggccgccgcgatcgctctggatcaccggaatatcgccgggcaccagcacgtgttccgctttgccggcctgaccctgggtgaatacggggtgatgttccaccagccagatctcgtcgagggtatcttcatcacgggcgtcggtaaattcatgcatcgcctgcgagacgggttcgtaaggttgcaggccaagctgccggataagaattttattgtgctgcaaaacaacatctccgccgggaagagagaattcaggttggggagtatatcacagccgtgcagaagggaatgagaagacccggcacggcggccgggtcagggaaaaggttacagcaccatccgaacgatatcgatattgcctaactcttcgtacagcgtttccacttgttcaatgtgggtggcgttgatggtgatggagaccgagtggtagttacctttgctgctcggttttactgacggcgagtaatcaccaggcgcatggcgctgtaccacttccaccacctgatcaaccagctccggcaacgcctgccccattactttgtaagtaaatggcgtagggaattcaagcagttcgttaagtttggttttcatgtcagctccggtgttacgacaaaataataactcccaccaagggcgggagttatcaggttacttggatgaatagtatatggggatggaaatcacactttcaagtgttcgatttttaaccaaaccagtggtggaacattaatttaatgtaatcaataattttgccgaagaaattaccttccggaatttcctgcaggaccaccagcggacgctggtcgatggttttaccatccaactggaagttaatggtgccgacaacctggtttttctgcagcggggcgtgcagctcagtgttattcagcacgtagctggctttcagatctttcattcggccgcgcggaatggtcaggtagacgtctttatccacccccagcgaagcgcgatcgctgtcgccgaaccaagccggttcagaggcaaactctttgccagctttaatcgggttgacggtttcgaagaagcggaagccccaggtaagcagttttttgctttctgactcacggcctttgaacgtccggccgcccattaccgcggagatcaggcgcatctggccttcggtggcagaagcgacgaggttgtaacccgctttgtcggtatggccggttttgatgccgtcgacgttcaggctgttatcccacagcaggccgttacggttcagctggcggatgccgttgaaggtgaactctttctcacgatagatggagtactcgttcggtacgtcgcggatcagcgcctggccaatcagcgccatgtcgcgcgcggagctgtactgtccgtcagcatcaagaccgtgaacggtctggaaatgggtgtttttcaggcccagagcgtttacgtagttgttcatcaggctgacgaaggcgtcctggctgccggcgacgtagtcggccatcgccacgcaggcatcgttaccggactgtaggttaataccacggatcagctgagaaaccggcacctgcatgcccggcttgaggaacatcagagaagagcctttgaaaaccgggttgccggtggcccaggcatcgttgccgacggtgaccagatcggactctttgaatttgcccgctttcatcgcctgaccgataacatagctggtcatcattttggtcagactggccgggtcgcggcgggagtcggcattgttttcagccagtaccttgccagagttgtaatcgataaggatccaggattcggcgtcaatctgcggggcgcctgggatcatcgttttgatattcaggtcatcggcgcgggcagcggaggagagcgctgcaacggagagcgccgtaatgagtaaacgagcggtgaaagaggtcttcatggtcagaacaacggcatccgtgatggagttaaaaaagtgccttactatagcaaatgctctgcgggccagcatccgacattgcgcatgagtttgttaatgacttttacatgcgcgaggtgaacgggcggcccacggcgtttagttggcgcgagtaataaaggactgcagctgcgcttcgctttgcaggcgctgctgcacggcgctggcctgtgctttatcagcaaagggacccagctgaatacgccagaccgcgccgttttgcatgacccggcctggcacagaaaactgctggctcaggcgctgctgatactgctgcgcccgcgactggtcgcttactgcgcccacctggacaacaaaattaccgctggcgctggaggtcgcggaggacgaggccgccacggcgccagcggctgcggcgatggccgcagcgggcgccacattaccctgaatggagccaggcgcggtcactggcgctgttggcgtggcgccggcggcaggagccgtcgcggcggctgccgctggttcgctactctccagcacgccgttgttcaggggcgtcggcgcgccgaggaaaccgccgctgttcaccggcgcgcccacgctgtctgccggcgtcagcgtgctgttgctgatcgggcgaacgtcagtgggcgcgggctggctcatgccagcggcgtccccaccgtccagattcggacgggcgggcagggcgtaagtctgtttggcgacggtggtacaggccatccccgggccggaaagcgaaccgtcaggcgcgacgatgatggggtcgatgcgcactttggtgttgttggaggtgttcaggcggtcagcggatgcgcgggaaagcgagatgacccgatcgttgccatagggaccgcgatcgttaatccgcacgacgatcatccgtccgttggcaaggttagtgatccgcgcgtagctcgggatcggcagcgtcgggtgcgctgcggtcaactgagtcggatcgaaggcttcgccgctggcggtcaggttgctgttgggttcagcgtcatagatcgccgcgaaaccggtctgagtaaagttggccggatcctgaacgattttgtagcttttaccgtcgcgctcataatcctgattcgccgtggcgttcggcgtttcatactgcggatcggcgccgctgatctcaaccgtcgggccattacagacggccggctgtggagtactgacagttttttgttgcacgtcatcactcgaacatgccgccagcagccccgctgctatgcagatccccagccattgcttacgcattgctaacccctttaaacgcttttcgacaacatttttctgtgggtatggatcgacattacgataccaaacccggccatcagtacgatcagggcggagcccccgtagctcaccagcggcaacggtacgcccaccaccggtaaaataccactcaccataccaatatttacgaagacataaacgaataaaatcaacattaaaccaccggccatgacccggccaaaggtggtttgcgcctgggcggcgatccacagtccgcgcataatcagcagaatataaagcgctagcaggatcagtacgccaatcaggcccagctcttcggcgaggacggcgaagataaagtcggtgtggcgttccggcagaaactccagctgcgactgggtgccgtgcagccagcctttgccgcgcagaccgccggagccaatggcaattttagactgaataatgtgatagccggcgcccagcgggtcggtttccggatcgaggagcatcatcacgcgctgacgctgatagtcgtgcatcaggaagaaccacaggatcggaataaaggcggcgaccagcaccacggcgataccaatcaggcgccagctgaggccggagaggaacagcacaaacagcccggatagggcgatcaggatcgaggtcccgaggtcaggctgcgccgccaccagcagcgtcggcaggaagattagcaccagggcaatgccggtgttcttcagcgacggtggacagacatcgcggttaataaaccgcgccaccatcagcggcacggctattttggcgatctccgacggctgaaagcgcacaataccgagatccagccagcgctgcgcccctttggagatggcgccgaaggcgtcaacggctaccagcaggatgatacagaaaatatagaggtagggcgcccagccttcatagacccgcggcgggatctgcgccatgacgatcatgatcaccacgcccatggcgatctggccgattttacgctccatcatgccgacatcctgaccgctggcgctccagataaccagcgcgctgtaggtcagcagcgccagcaggataagcagcatggtggggtcaagatggattttatcccatagcgattttttgttcggattatccgtcattattgatcctcccctgcggtaaccgccgggttttcgcttggcagcgtagtgttgttatcgcccagcatgatgtgatcgaggatctggcgcataatcgtaccgaccgccgggccggcgccgccgttttccagaatcatcgccacggcaacctgcgggttgttataaggcgcaaacgctgtcatcagtttatggtcgcgcaagcgctcggagatccggtgcgcgttataggtttcgttggccttcaggccgaacacctgagcggtacctgacttggccgcgattttatacggcgcgctggcgaagtatttgtgcgcggtgccgttgccgcggttggccacgccgtacatgccgtctttggcgatttcccaatagccggaatggatatcgcctaccggcggctcatggggctggacccagggtacgggcttgccgtcttccacggtgctctgcagcagatgaggcaccttcaccacgccgtcgttaatcaggatcatcagcgctttgttcatctggatcggcgtggcggtccagtaaccctggccgatgcccaccggaatggtgtccccctggtaccagggtttcttaaagcgcttgagcttccattcgcgggtcggcatgttgccagagcgctcctcggagaggtcgataccggtgtagtggccgtagccaaacttgctcatccactctgagagacggtcgatgcccatgtcataggcgacctggtagaaataggtatctgcagactcctcgagcgctttggtgacgttcagatggccgtggccccactttttccagtcacgatagcgtttctctgagccaggcaactgccaccagccggggtcgaagaggctggtgttgcgggtgatcaccccggcgctcagcgccgagacggcgacgtacggtttgaccgtcgacgccggcggatagaccccctgcgttgctcggttgaccagcggtgtgttcgggtcgttgagcagcgcggagtaatctttgctggagatgccgtcgacgaacaggttcgggtcatagctcggggttgaaaccagcgccagaatagcgccggtacgcgggtcggtcaccaccacggcggcgcggctgccggccagcagcgtttcaatatactgctgcagcttgaggtcgagggtgaggtagatgtcgcgtccggcctgcggaggcacctctttcagctgacgaatgacgcggccgcggttgttcacttcaacctcttcgtagccggtctgaccgtgcagaacgtcctcgtaataacgctctatacccagcttaccaatgtcgtgcgtcgaggcgtagttggccagcttgccctctttatccaggcggtcgacgtctttatcgttaatttttgagacatagccaatgacgtgagtcagcgccgaattataggggtaataacgacgcttgtagcctttgacttccacgccgggaaagcggtactggttgacggcaaagcgggccacctgcacttcgctgaggttgacctttaccggaatcgaggtaaaacgatgggagcgggcgcgctcctttttgaaaccggcgatgtcatcgtcagttaaatcgacgacgtcgcgtagcgcatccagcgtctgctgtacgttatcgactttctccggcatcatctccagctggtaaatggtgcggttaagcgccagcggggtgccgttgcgatcgtaaataatgccgcggctcggcgggatcggcaccagcttgatgcggttttcgttcgagcgcgtctgatagtcgtcgaagcgaacgatttgcacattgtacaggttggcgatcagaacgccggtaagcagcaaaatccccaaaaaagcgaccagcgcccggcgcacgaacagcgaggattcagccgtatagtcgcggaaagaattctgtaatttcattcgctgcttagtctaccctgatcatcattactcacggtggtacgggtggttggtggtgatgctccacgcccggtacagactctcggccaccagtacgcgcaccagcgggtgaggtaaggtgagggtggagagcgaccaactctgttccgccgctgctttacaggcgggagagagaccttccggaccgcctaccagtaaactgacgtcgcgcccgtcctgtttccagcgttccagttcgcgcgccagctgcggtgtatcccatggtttacccggaatatccagggtcacgatgcggttcttaccggcagcggctaacatcatctcgccctctttttcgaggatgcgtttgatatcagcgttcttaccgcgcttaccggcagggatctccaccagctcgaacggcatatctttgggaaaacggcgcagatactcgctaaagccggtctgtacccagtccggcattttggtgccaacggccaccagctgcaacttcacgcattaactccagagtttttccagctcgtacagacgacggctctcttcctgcatgacgtggaccatcacgtcgccgaggtcgacgacgatccagtcggcggcggcttccccttcaacgcccagcggcagcatgccggcggcgcgggactcctgaaccacgtggtcggcgatagacatcacatgacgcgtggaggtgccggtgcagataatcatgcaatcggtgatgctggatttgccatgtacatcaatggcaacgatgtcctgacctttcaggtcatcaattttgtcgataacaaaatcctggagtgctttaccctgcaagtgttccccctgggtgcgtgaagattgataatcataaagagcctgacagtatacctgaactgatgaaaaagtcgggtgaaatgtctgtcggcaggcgttcgtggcgggctatcatcccatccctcgccgcggattgcatcgccatttttgtaaaacaatttctgcaaaccggctttggcggatgctgcctggcagcggagaataacagcctgctctggcctgtcaatggtctggcgggaattcttcttgcggccgccagacggcctggctatttaatacccgcagggtggtgaaatcgtcgcggatttcgaggaggctccaggcgccatgggcaatgggaaagtgccacatcgccgccgcaggcatctgcaacagcagggcggtcagcaggctcaggacgccctgatggccgacgatcagcagatggtcaagatggcggcagtcggtcagcgttgggataaactcgctgacgcggcgggcaaaattctgaaagctttcgccgttggtgggggccgcatgctgccagtcggcacaccaggcggcatagttttccgcatcttctcgctggaggtcgcgatgatgacgcatctcccagtcgccgaaaaacatctcattgagcgcgggatggcgctcacgcggaatagcgcggtcgccaagcagcagatcggccgttgtcccggtccgcgccagctcgctacagaatactttatcgaaaggcgccaggcgcagtcgttcgccgagcgcgcgcgcctgagcgacgccgcgcggcgtcaggggcgttggggcatggccgctgtataacccggcaacgttggcttcggtttcgccatggcgaactaaccacaatttcatgaacaggctctgacaggcgatgaagagatggcgttacgatagcgcttttttcgcgccaggcccagcctggggtcagcaatagagtccctgctcgcggatgtaatccagcacggcggcgggcagcatctcggcgcaggactcgccgcgctcaaggcgctggcggatgatcgtcgcggaaatatcgaaccacggcgtctcagccaggtagatcacgccggaagggcggttatgcagagactccacgtcgtgggttaaatggcgatccagccagcgctgatccgcttcctgcgccatggtcagcgggtaacccgggcggcggcaaacaatcaggtggacattgtcgagaatggtttcatagttgtgccaggtgggaaaggtcagtagcgaatcctggccaatgataaacgccagcggtttgcgcggtccctgctcctggcgccactcctgcagcgtttgcgccgtccaggagggggtatcgcgccgtagttcgcgttcatcgagcgtgaacagcggtttatcggcaatcgccagcttcagcatgtgcacgcgctgggcgctggtggcttccggctgcggccggtgcggcgggacgttgttaggcatgatgatgaccttgctcaggccaatctgattcgccaggatctcaaccggcttgaggtgaccgtaatgcaccggatcgaaggtgccgccatagattgcctgtaactgagtcatatcaaccatcaataaaaacgtccgccagggctttgtggcagagcaacaacgaaagactttccagttcgggccagacgtcgtgcccgtaatcctgtttaaaggtgagctccgcgcgggtcagaagggtcaccgcctggcgtagctgttccccgctcaggcgcgtgagagcgtcgctgagcagctgacggcggttttgccagacccgatgtttatcaaacagcgagcgcagcggcgtgtgcgtcgcctggcgcttgagggtaaccagcagcagcagctcccgctgcagagtacgcagcaggatcgccggctcgcagccttcaaggcgtaactgctgcaggacgtgcagcacgcgcttacttttgcctgccagtagggcatcgacccaatggtaaggcgtaaagtgcgcggcatcgtttaccgcttgctcaacgcggggcagggttagcttaccgtccggccagagcagcgccagacgctccagcgcctgcgccagcgccagcagattgccttcgtaacagtagcacagcagctgactggccgcgtcgtcgagctgcagctgatgctgtttggcacgggcggccagccagcgcggcagctgcgcgtattccggcgtctggcaactgacctggacggcgcgctgagccagggcggtgagccatgcggcattctcctgggctttggtcagcttatttccgcgaactatcagcagcaggtcgtcgtgcagcaggccaaccagcgtggcgagctgttcattgatcgccgcgttggggccgttttccggtaggatcaacagcagggtttgccggctggcaaacaggctcatcgcctggcttaaggcgaaaatcgcctgccagtcggtgctgttgtcgattgaaaaagtatggtgctcggtaaagccctgcgcggcagcagcttcgcgaatggcgtcctggctttcctgcaacagcaggggatcgttgccaagcagcagataggccgcgcgcagcccttcagtgagctgcgcgcggagctgttccgggtacaaccgaatcatcattgacccagcgtggtggagacgcggttacccgaggaagccggcgccgcgctgctggcgaccggtttctcttcctgctgggttgcttcaacatccgctacctgaacgcttggcagcttacgaatcagctgttccgccgctttgtcgtacatttcctggataatcatatcctgctcggcgtctttcgctaatgccgcctgcgggttatcaaagaacgaccgatagaccttggtggtaatcggatagatatcgtgacccgggatcaggacgctggcatgaacggtcatgaccatctgatactccgccgtacgaccatcctggaacaccgatgcggtatctttctgaatcgacgagccatcgaggcgcagagaagggacatctttacgcagcgtgctggcgtcgatcagttccacgccgttaagacgcagctgattacgtaccgcgcggcttaacgggccgttcggatcgctcgactggaaaatcatggttttcatggtggcgggcaccttggtagtgctacgcaaatgccagccacagccggcggtgacgagcaccgccagagataacaacattgttaccagatatcgcacgcttcctcccgcgcttagccaacgaccagattgagcagtttacccggaacgtaaatcactttacgcacggttttaccgtcgagatatttcgccaccagatgttcctggccggcgcgctcgcgaacctgctcttcagttgcatctaccgcaacggtaattttaccacgaactttgccattgacctggacgacgacgagggtgctgtcttccaccatcgcgctctcatccgctaccggccacggcgcgttgtcgatatcgccttcgccgttcagctcacgccacagggtgaagctggcgtgcggagtgaacgggttgagcatacgcaccaccgccagcagagcttcctgcatcagcgcacgatcctgctcatcttcctgcggcgctttcgccagcttgttcatcagctccatgattgccgcgatggcggtgttgaaggtctgacgacggccgatgtcatcggtcactttggcgatggttttgtggatatcgcgacgcagcgctttctgatcttcgctcagagccgccacgttcagtgccgcaacctctcctttggtggtgtgctcgtagaccagtttccagacgcgtttcaggaagcggttcgccccttcaacgccagattcctgccactcgagggtcatatccgccggggacgcaaacatcatgaacagacgcacggtatccgcgccgtagcgctcaaccatcacctgcgggtcgatgccgttgtttttcgacttggacatcttgctcatgccggtgtacaccagctcgtggcccgccgcgtctttggccttcacgatgcggcctttttcgtcgcgctcaacgatggcgtcaaccggggaaacccagttacgttcgccgttttcgcccacatagtagaacgcgtcagccagcaccatgccctggcacagcagctgtttcgccggctcatcggagttcaccatgcccgcgtcgcgcatcagcttatggaagaagcggaagtagagcaggtgcatgatggcgtgttcgataccgccgatgtagatatctaccggcagccagtagttggccgctttcgaatccagcatcccttcctgatactgcgggcaggtgtagcgcgcatagtaccaggaggattccataaaggtgtcaaaggtgtcggtttcgcgcagcgccggctggccgttgacggtggtcttggcccattcaggatcggctttgatcgggctggtgatgccgtccatgaccacgtcttccggcaggatcaccggcagctgatcttccggggtcggcagcacggtgccatcttccagggtcaccatcgggatcggcgcgccccagtagcgctgacgggatacgccccagtcgcgcagacggtagttaactttacgctcgcccacgcccatggcagccagtttgtcggcaatggcgttgaagcccgcttcataatcaagaccgctgaactcgccggagttaaacaggacgcctttctcggtcagcgcctgctcggagagatccggctcggagccgtcggcagcgaggataaccggcttaatgttcagaccgtacttgctggcgaactcgtagtcgcgctggtcgtgacccggaacggccattaccgcgccggtgccgtattccatcagcacaaagtttgccgcccagaccggaatttcttcaccggtcagcggatgaatggctttaaagccggtatcgacgccttttttctccatcgtcgccatgtcggcttcggccactttggtattgcggcactcgtcgataaaggtggccagcgccggattgttcgccgcagcctgctgcgccagcgggtgacccgccgcgacggccaggtaggtacaacccataaaggtgtccggacgggtggtgtagacagtcagtttgtcagcgtagtcgttgacgtcaaaggagatttctaccccttccgaacggccgatccagttgcgctgcatggtcttcacggtgtccggccagtggtccagcttatccagatcgttcagcagttcatcggcgtaggcggtgattttaataaaccactgcgggatctctttacgctcgaccttggtatcgcagcgccagcagcagccgtcgataacctgttcgttggccagcacggtctggtcattcgggcaccagttcactgcggaggtttttttgtacaccaggccttttttgtacagctcggtgaagaacttctgctcccagcggtagtattccggggtgcaggtcgccagctcgcggctccagtcatagccgaagcccagcattttgagctggtttttcatgtaggcgatgttgtcgtaggtccacggcgctggcgcggtgttgtttttcaccgccgccccttctgccggcagaccgaacgcatcccagccgatcggctgcaggacgtttttgcccagcatgcgctggtagcgggcaatcacgtcgccgatggtgtagttacgcacgtgacccatgtgtagtcgaccagaaggataaggaagcatcgacaggcagtaatacttctctttgctctcgtcttcagttacttcaaatgtacgattttcgtcccagtgaagctggactttcgattctatctcttccgggcggtattgctcttgcatggcagccagtggtcctgttttcaatacagctacaaagtgtagccaatggatgtgttatttcagatcggcatagcatagcccaaacgcccacgtcaaaacagcttttcgcacatcaacatcggcaaaagctgcgcagattatttcgcgactctgtggcttgtcagacacagcgggagaggaataaggtctattatcagaagacgttaaccccaccggaggcgaaatgatgaacaaggttgctcaatattaccgtgaactggtctcctcgctcagcgaacggctccgccatggagagcgcgatatcgacgcgctggtgacgcaggcgcgggaaaaaatcgtccgcgccggcgatctgacgcagagcgagatcgagtcggtgattgcggcggtcaagcgcgacctcgaggagtttgcccgcagctacgaagagagtcacgaagacgagagcgacagcgtgtttatgcgggtgatcaaagagagcctgtggcaggagctggctgatatcaccgacaaaacccagctcgagtggcgggaagtctttcaggatctgaatcaccacggcgtgtaccacagcggcgaagtggtcggtctgggcaacctggtctgcgagaagtgccactatcacctggcggtatacaccccggacgtgctgccgcgctgtccaaaatgtggccacgatcagttccagcgtcggcccttcgagccctaagcgtgcgaaaaacgatgcgcgaggcttcgcgcatcgtggtttgtcttatttcaccgtgttgacttcggtgctcttgaaatactgttttccacccatgtcgctaacatatttctgcgatgagttcagtaccagcttgtcagcagttaacgtcccgactccgcatttcgccaggcccagtatgccgcaacttttaccaccattgaccactttggtggcggttaacgtcatgttgccgcccgcgctgagggttgaataattgtagatcgcgcctttatttttggtatttaaggtcaggtcgccggtgctgctgatctgcccttcgttggtgatatctgagtaggtcgtgattgaaatatttttggcagtaatattgccataattattcactacgccgtgatcggtggtgatatcggcggcattcatataaccattttggttcagccagtagctgtgggcggtaatggcgttggttgcctcaatacgaccactgctgctttgcgccagcgtgccattggtctgcagattgatattttcgccggtgatattgccgaggttatagatctcgcccgtattggcgctgccgtcctgtgtaagcgactgaatggtggtttggccagtagagttaatattgccggtgtttttaaagctgtcgccgacaaacgtcaggctggtgtgtttggcgctgattttgccttcattgaggaaatcaccgattgccgtggcggcaatctggttatttgacagcagggaggctttttcttcgttgcggattttcccgccgctggtcaggcttaatccactggtgccggtcatcgtgcctgagtcgccgttggtgatgttgccgttagcggtggcaatcagctggccgccggagagagaaccggtgttaacgatataatcgccactggagagcattaaataataggcgccggcgatgctaccgtcattggtgatgcccgtgacggtggaaacctggctcagcaaacctttgcccgttattgaccctttgttcagtaaattaccgttgctggtgagcatcagcgtgccgttggagataatagaacccttattacgtacgccaaagccgatgttattgccgaccatgctgatgctgttggcctcaatgccgccaaggctgctgacgtcgatgctgtactgcgggttaaccgtcatctggatcagggtggcctttttaccggcggaggtcaccgagccagagctgttatccatggtgaagttgcccgcgctgaccagggcgttgttggcctgcactttaccgttaatcttaatcgcgtcggcgagcagaaccgcgtagccgttggcggcgttcatgccattttcgccgatggtgagggtgccgcccgttacggtatagctgccgatggcgccatcgtcggtcatattaaccttgccggtggtcaggatagccttgttggtattaacaaagctacagccggaacaggtgatgccgttcgggttggcgattaccacatccgctttctgaccgttgacttcgataaagcccttcaggctactggcgtttttggaggtcacctcgttcaaaatcaccgaagcgctgccggcggtcagattattgttgcgggcgatattgccaaatgtgctgtggctgacatcatcgccgctgttattgaggatggtgccattggtgccgacgttgaagtcgcggtacaggttatgggagacaccggcggcgttcggcttttcaatatcgataaccgtggcgccggaagagtgcgtatagcttgtggggtcggcataaactaccgacgaggttaatactgccgccagtgcgacataagaagccttaaacttaaacattttctttattcctttaaataatgattaataaataatgtaaatatgacgagtcaataatgtgcgaattaatacctccactgtaatgaaaagcccatattcagggcgtcgctatgaaacttatccggtttactcagcggggtactaataaacagatcgtactgcgttgaccatagctgaccgcgcagcccgctgacggcgccggagagcactttgcctttttgatatagatcggcgccgataagacggcctatatccgcgcccaaatagaattgccgctcgtgggtggccagatcccagataaaatcgttgcgccagtaccatccctgattgccggacaggctgttttcaccgtcaaaaccgcgcacgctccagcgactgccaatattgaatttattatcggaagcgagtttgtccgggctgaactgggcgctgaggcggggagcccaggtaaatttgtcgccggtggcgtcaaatttcatcattgcctgcagattaccatgcacaatccgcgacagcgggctatacagcccggcctgctcttccggcgttgctgtcgagctgagccacggcaggctgcgctggatgccgatgctggcatcaacaatcttgttgttaaagtagtgctggtggttgagggtgaattcccatgaggggttctgcttgcgcatcaccagtagctcactgccgccgaagtaataatgcgaggtactcttggcgatccgcaggtcggcggtggttttttgctgccgggtgtgggagagcagacgactcagcgtggcgctgtagtagcgatttttactcttataatccatcgtcgaccagttgccgttaaactgctgacgatactggctgtatgccccgtaggcgcttagtgtccagtagccaaagggaatggagtaatacaggctgccgttgtggttgccgtcgttatgctgattgaattcaatatcgcctccgccggaaaggtacaggatatcgttgagggtggtcaggtcatagagatagagggccccgccggcctggtagcgtccgctggctttgctgccggcgtcgtcaagccaggcgccaagctgccattttttcgccaggctgcgggcgatctggatatcgctttctccctcgtgctggcccggcagcagtttcatgtgcgcggtggcgccgggcagacgctgcaggttggccatcccttgctcaaggtcgcttaagcgcaggatagtaccggaagaggtgggtagggaattccacaggcgggtggtgtccgagccgtcggcatagtcgatagcgcccactttgccatagtgcagcgtgagcctgagtatgccgtgctccagcgactgggagggcacatcaatcagcgaggtgatgtagccttgcgcgatcagctcattttgcaaggtataggccagcaggcgaatgccttcgctacccagacagcgtccctgcgcctgccgtgcggttttcgccagtaatttccgggtgagcgcctggttatcggagtcgatatcgacccggttgatcaatttgcaatgcgtttcctcaggaaaagggatcccctgcggcgccacgcgctgttgtgaagactgaaaatcctgttgctgcggcgccagcgcctcctggcgggctttatcctgctccgtctggtgagtagaagaggccaatggcgcggccccggcggctgaggtgcccgccagcgtgataaacagcagcccggtgagcgtgcgagatcgaattaacatgaagcaatatccatttgtttcattggtttggtggcgcatccattattctgcgagcggcagagaatattgatggcctttatttcggcgcaggcgaggtcaggcaagaatattatattcaattaataaaataatcgtgcgacgaacctgttacgaggcgttatatgctagcggcggtggcaaggccggtccacgaattcattattgaattctttatgaattgatcgatttaataaataagttcagcttttatcgcccaggtttattgggtacgtaaatgatagtagcgataatccgccgcataaataacattggcgaataatatggcggaaaagattaactgcgcataccgggcggtatgcgcagagaaaaaccattaatggagtattttggcgaggaaatctttggcacgctcggattgcggattggcaaagaaggcctctttatcggcatcctcgacaatcttcccttcatccataaagatcacccggttcgccaccttgcgggcaaagcccatctcatgggtcacgaccatcatggtcatcccctcgttggccagttcaaccataacgtccagcacctcgttaatcatctccgggtcaagcgctgaggtgggctcatcaaacagcatggcgattgggtccatacacagggcacgggcaatggccacgcgctgctgctggccgccggagagttgcgccgggtatttttccgcatgcgccgccaggccaacgcgctccagcaacttgaggcctttcttgcgcgctgaggctttatcgcggttaagcactttgacctgcgccagcgtcaggttgtcgataatcgacagatgcgggaacagttcaaaatgctgaaacaccatgccgacgtgcgagcgcagtttagccaggttggtctttttatcgttaaccacggtgccatcgacaataatctgcccctgctgtaccggctcaaggccgttcacagtcttaatcagcgtggatttaccggagcctgacggcccgcagaccaccacgacttcgccttttttcacttccgtggagcaatcggtcagcacctgaaagtgaccataccattttgaaacgtttttcagggtaatcattacacagtccttttcttcaaccagctgaccaacagcgaggcgctgaggctaatcacaaaatagacgccgcccgcgaacaggatcatttcgacctgggttccgtcacgctcgccaatggtggaggcggtacggaagaagtcggcgagactcaatacatacaccagcgaggtatcctggaacaggacgatcccctgggttagcagcagcggcaccatggcgcggaaggcctgcggcaggatcaccagccgcattgactgccagtgggtcatccccaacgccagcgcggcgctggactggccgcgggagatgctctgaatgccggcgcggataatctctgaatagtaggcggcttcgaacatcgaaaacgccaccatcgccgagatcaggcgaatatccgttttcggcgacagtcccagcacgttctgcaggaagcccgggacaatcaggtagaaccacagcaggaccatcaccagtgggattgaacggaatacgttgacgtaggatttagcaaaccaggccagcggcataaagctggacaggcgcataaccgccagcagggtgccccagacgatgccgaccacgatggcgatcaccgtaatcttaagggtgatcaccagccctgccagcagatagggcatggagggaacgatcgaactccagtcaaaatcgtacattatttgcctcccatattgccaggcaggcgaaccttacgctcgaccacatacataatcagcataatcaccgcgttgatgaaaacataggccagggtgatggcggtaaaagactcccaggcatgagcggagtagtccagcagtttgcccgcctgcgcggccatatcggccagaccgatggtggaggcgatggccgagtttttcaccaggttcatcatctccgaggtcatcggcggcacgataacgcggtaggcgttcggcagcagcacgtagcggtaggtttgcggcagggtcaggcccatcgccaggccggcgttcttctgcccgcgcggcagcgactggatggcggcgcgtacctgctcgcagacgcgagcggcggtaaacagccccaggcacagcatggaggagacaaagaattgaatgtttgggtccagctccgatttaaaccacatgccgatattttccggcaggaactccggcaccaccaggtaccaggtaaagaactgcacgatcagcggcacgttgcgaaacagttcgacatagcaggtgccaatgcccgagaggaagcgattgggtaccgtgcgtaaaatgccgaacagtgagccgacgagaaaagcgatgatccaggccgagatggagagggcgacggtgatttgaaaaccgctccacagccagcccaggtaggtagtgttgccgaagggggcctgttgcaggaatatcccccagttccagtctattgacatacatgactcctggaaaaaaaagggtagccagtgctaccctcgaagacggttgtccagcttgtttcggtattcgcggcggctggggaacgaccagccgccgtatagtctgtccgtgctgtgacaatcatcgggagggcaggatatcccgcccctggttgttataattagttcagtgctttgtcgttaggtgatttgaacagcgctttcatgtcgtccgacagctcgaagttgaggttaagattttttggcggaatcgggtttttgaaccatttgtcaaaccacttctccgcttcgccagaggtctgagcctgggcgacggtttcatcaaccagcgccttgaacgtcggatcgtccttccgcagcatgcagccataggcttccttcgactgcggggtgccgacgatttcccagttatccggtttcttcgccttggcgcgttcgccagccagcagggcatcatccatcataaaggccacggcgcgtccgctctccagggtgcggaaagagtcgccatgatctttggcgctgataatgcgcatattcatttttttctcatcgttcagcttatgcagcaggatctctgaggtggttccggaggtgacgacgaccgctttatccttcaggtccgggaaatctttgatcgggccgcctttcttcaccagcagacgggtaccgaccacgaagatggtatcggagaaggccgcctgtttctggcgctcaaggttgttggtggttgagccgcactcgaaatcaaaggtgccattctgcagcaacgggatacggttctgcgaggtgaccgggatcagtttgacctgcagatcgggtttgttcagttttttcttgatggcatcgacgatggcgttggaataatcctgagagtagcccacaaccttctgctggttatcgtagtaagagaacgggaccgaagattcacgatggccgacaacgataaccccgtttttggcgatcttatccagggtgttctggccagccgccggggcagcatcttccgcctgcgccagaccagcggtcattcccattaccagcattgccgtggccagtttacgtaattgcatatccaactccttatccgcagcgtcagcgacgctattgatacccattgtgattgtgtgtgttgttattgggggcacgcatccacgtgccgcatttgtatgtgtttgttagcatttagtttggcttaatgtaaagattttgctgctttattgtttatttttgcgaagcgctccgcaccaatcggaggcaaatatcttccattgcaccaaaatagcgcgaccaccgatcgtttctggtgcaacccggttgcactgggtcggacgatgccgctaccaggttaaataaagcaatgactgtgccagagtggcagatgatgggaagaaaaagccggcgacgggcgtcgccggcggagaaacttatcggcgacgctggcgcaggctcatcagcagcgcggcgaaaccaaacagcgccgtcagcgcccatagcggccagttgccggtgcgggcgtaaggggttaagccgctggtgggggtcacggtggtggtcaacacctcgcgggtaaactgcgggatcatcttctggatctcgccgcgcgggccgatcaccgcagtaatgccgttgttggtgctgcgcagcagcgggcgggccagctccagggcgcgcattcgcgccatctggaagtgttgccacgggccgatggacttgccgaaccaggcgtcgttggagatggtcagcaggaagtcggtgtccggccggaagttatcccgcacctgttccccgaggattatctcgtagcagatggccgcggtcagcttcaggttatgcgccatcagctgcggctgcacgtaggggccgcggctgaaggaggacatcggcaggtcaaagaacggcgccagcggacgcagaatcgactccagcggtacaaactcgccgaacggcaccagatggttcttgttgtagcggttggtcgagtcgtagcggtacgggttatctttgccgagagtaatgatggtgttgtaggtatcgtaacggttctgcttgttgagacgcgcatcgacaatgccggtgatcagcgagctgtcttttgcgcgcagcagatcgtccatcatgctgaggaactgctgctggttgatctccagatccgggatcgccgattcaggccagataatcagctgcgagtggccgatatgcggctgggtcagcgccaggtaggttttcagggtattgaccagctgcttttcgtcccatttcatggcctgtgggatatcgccttgcaccagcgagacctgggtcgcgcgcgccggcagcagctgataccactggatatagcgcagcgggaacggcagggcgaacagcagcgcggcaatcgccagcggcttccagttgcgctggacgagagccagggccagcaggccgctgactaccatcagcaggaagttaatcgcctcgacgcccatcaccggcgcgaggcctttcagcgggccgtcaatctggctgtagccgaactgtagccacggaaagccggtcagcacccagccgcgcaggaactcggtgatttgccagacgacaggggcagcgatagccatccgtatccagttagttttaggccacagacgggcgagcaggccggcaaacaggccggtgtagagcgagagataggccgccagcagaacgacgaggaagacgttaaccgggccgggcattccgccaaactgcgcgatgctgacatagacccagttgatacccgtgccgaacagcccgagtccccagaaatagccgatcccggcgctttgcagcgggcgtcggttgagggttaacgcctgcagaccgatcagcgaaacgatagccgctggccagaagtcataaggtgaaaaagccagcgttccgctggctccaaacaacagcgccagcaacagacgtatgcgctggcgttcaagaagagaggcaaataccatttaggttaatcgtcccgttaattaacgcctgctgctacaggctattctttttgccagccggacgcggggcacctacaaccgtgtatgactcgcggtctcccggctggccatttcagcgctaccgcttactcttccagcttcggctggggagcgtcatcgggcagctttacatgcacctgaatgatacgacgactatctgccattgctaccttgaattggtaaccatcaatgtcgatagattcgccgcgggccggcagatggccgaaggcctgcatcaccagcccgccaatggtatccacttcttcatcgctaaagtgcgtgtcgaaggcgtcgttgaagtcttcgatggaggccagggcgcgcaccgtccaggtgtggcggctcagctggcggaaatcgatatcttcttcttcgtcgtactcgtcttcaatttccccgacgatgagctcaaggatatcctcgatggtcaccaggccagagacgccgccgaattcgtcaataacgatcgccatatgatagcgctgtgagcgaaactctttcagcatgcggtcgacccgcttgctttccgggacgacaaccgccggccgtaacactttttccatgctgaaggcttcggcgtcgctgcgcataaacggcagcagatccttggccatcagaatcccttcgatgtgatctttatcttcactgatgaccgggaaacgcgagtgggcggattcgatgatgacatccaggcactcgtccagcgtctggttgcgtttcagggttatcatttgtgaacgggggatcataatgtcgcggacccgctggtcggcgatatccattaccccttcgagcatgtcacgcgtatcttcatcgataaggtcgttttgcccggaatcacggatcagcgccagcagttcatcgcggtttttcggttccccgtgaaaaagctggctgagtaacagggagaaaaatccctttttgctgtttactgtgtcactactgtgtgaattgtcgtcgctcatggcgtcgtttgggttctcatgttgatttaactgtcgctcgtcgcgcgtaaactcagcgccggacggcatgggttgcctgactttctggcaggtaaaacgcagaaacagcggccggatgaggcgcaagcaccgccatccggctgggcgctattccgcaatcttctcggaaatgtacgggtcctcatagcccagagcaagcattatctctgtttcaaggccttccatctcttccgcttcgtcgtcttcgatatgatcgtagcccagcagatgcaggctaccgtgcaccaccatatgcgcccagtgcgcctccagcggcttaccttgctcgctggcttcctgctctaccacctgacggcagatgatcagatcgccgagcagcggcatttcaattcccggcggcgcttcaaacgggaaggagaggacgttggtcggcttatccttgccgcgataggtcaggttcagctcatggctttctgcaacgtcgaccagacgaatcgttaactctgactcctcctgaaacggcggaatgacggcgtcgacccagcgttggaaaagggcttcgtccggcaggccgctggtctcttcgcaggccagctgtaaatcgaggatcacctgactcatttttgctcctgttcctgggcttcgcgtttgcgctcggcggccagctctgctttacgtttctggtctgcggcttcccatgcctcataggcgttcacgatgcgggcgaccaccggatggcgcaccacgtcttcgctatggaagaagttaaagctgatctcatcgacttccgccagtacttcgatggcatggcgcagaccggatttggtgctgcgtggcaggtcaatctgcgtgatgtcgccggtgatcaccgccttggagttaaagccgatgcgggtcaggaacatcttcatctgttcgatggtggtgttctggctttcatcaagaatgataaaggcgtcattcagcgtccgtccgcgcatataggccagcggggccacttcgatgacgttacgctcaatcagcttctccactttctcaaagccgagcatctcaaacagcgcgtcatacagcgggcgcagatacgggtcgaccttctggctcagatcgccgggcaggaagccgagcttttcgcctgcctcgacggccggacgggtcagcagaatacggcggatctcctggcgctccagcgcatcgaccgccgccgccactgccagataggttttacccgtacccgccggacccacgccgaaagtgatgtcgtgatcgaggatattggcgatgtactgcgcctggttcggcgtacgcggtttgattaccccgcgcttggtcttgatattgacggctttaccgtactcaggcacgctttcggcgctctgctccagtacgcgcgcttccttgatcgccaggtggatctgctctggttcaatatcctgaatctgaccgcgcattggcgctgtgtcgacatacaggctgcgcagaatatcggcggcagcgtgcacgcacagggcgcgaccggtcagcttaaagtgattgtcacggcggttgatctcaatgcctaaccgacgctccagctgtttaatgttgtcgtcaaacgggccgcacagggctaacaggcgtgcgttatccgctggctccagggtaatctcacgagtgtctatgttcaaactattcctctttacgcaggtggccggacgcggcgcgtggccggctaatcaggaaattatttacgtcacaggaaaatggcgcaagcattgctgtagatatagggacggagagaggaattacaaggcctgccggaaccgacaggcctgaagggatcatggctggtaaattcccacgccaagatcgttctctttacgggtgcgggcaatcactgattcgggtgattcagcgatacgcagacccatctccgcttcggtgcgcacgattttaccgcgcagcgagttggtatatacatcgacgatttcgacatcgacaaacttaccgacgaggtccggggtaccttcgaagttgaccacccggttattctccgtacgtccggagagctccatgatgttcttacgcgaggtgccttccaccaggatgcgctgtaccgtgccgagcatgcgacggctccaggccatcgcctgctggttaatgcgttcctgcaggatatacagacgctgttttttgtccgcctccggcacgtcgtcgaccatatcggccgccggggtgcccgggcgagcggagaagataaagctgtagctcatatcgaaattgacgtcggcgataagcttcatggtcttttcgaaatcttccgtggtttcgcccgggaagccgacgataaagtcggagcttatctgaatatccgggcgcgcttcacgcagcttgcgaataatcgctttatactccagcgcggtatgggtgcgtcccatcaggttcagcacacggtcggagccactctgcaccggcaggtgcaggaagctcaccagctccggcgtatcgcgataaacgtcgatgatatcgtcggtaaattcgatcgggtggctggtggtgaagcgaatgcggtcgatgccgtcgatggcggcgaccaggcgcagcaggtcggcaaagctgccggtggtgccgtcgtaattctcaccgcgccaggcgttaacgttctgccccagcagattgacctcacgcacgccctgcgccgccagctgggcgatttcaaacaggatatcgtcgcacggacggctaacttcttctccgcgggtatacggcaccacgcagtaggtgcagtatttattgcaaccttccataatcgagacaaaggcggtcggcccttcggcgcgcggctctggcaggcgatcgaatttttcaatttccgggaagctgatatcaactaccggactgcggttgccgcgcacggagttaatcatctccggcaggcggtgcagggtttgcggcccgaaaataatatcgacatagtgcgcgcgctggcgaatatggtcgccttcctgggaagccacgcagccgccgacgccaataatcaggtccgggttcttctctttcagcagcttccagcggccaagctgatggaaaactttttcctgggccttctcacgaattgagcaggtattgagcaacagcacatctgcttcttccgccacttcggtcagttgatacccatgtgtcgcatccagcagatcggccatctttgatgaatcatactcgttcatctgacagccccaggttttaatatggagtttttttgtcattgacttgctcatgctcagtaatagatatccaaaacgcggggatatatacagggtgaatttcgcattccagggcgcgtattgtaatgctttggtcgccccctgaccagtgcgagcgttatcgccgcaagagggcgaaaaatccggtaaacttaacggattctgctttaaggataatagccatgacaattcacgtaacagatgtcgccatcgtgggcggcggcatggtcggcggcgccctggcgttagggctggcgcaacagggatttaccgtgacggtgcttgagaaagcggcgccaccggcgttcgatccggcatccgccccggatgtgcggatctcggcgatcagcgcggcttcggtcggcctgctgaagagtctcggcgtctgggatgccatacgggcgatgcgcgtccatgcttatcgccgtctggagacctgggagtgggagagcgcgcacgtcgccttcgacgccgcggagctcaagctgccggagctgggctatatggtcgagaacaaggttctgcaatggggcctgtggcaagcgctggcggcgcatgaggcggttaccctgcgcgtcggtagcgaactgaaaacgatgcagcgcggcgagatgcagacggcgttgcatttgcgcgagggggagacgatccacgcccggctggttatcggcgccgacggcgctaactcccaggtgcgggagatggccggcatcggcgtgcacgcctggcaatatcagcagtcctgtatgctgatcagcgtcgaatgcgccgacgatcccggcgacagcacctggcagcagtttactcccagcggcccacgcgccttcctgccgctgttcgaccactgggcttcgctggtctggtacgacgccccggcgcggatccgtcagctgcagagcatgaccatggcgcagctccagcaggagatcgccagtcactttccggcgcggctggggcaggtgacgccgcaggcggccggcgccttcccgcttacccggcgtcatgcgctgcagtatgttcagcccggcctggcgctggtgggcgatgcggcgcacaccattcatccactggcggggcagggggttaaccttggctatcgtgatgtcgatgccctgctggagatcctggcggaagcgcgcggccgcggcgaagactgggccagcctgccggtgctgaagcgctaccaggcgcggcggcgagcggataattttatcatgcagtcggggatggatctgttttatgccggtttcagcaatgacctggcgccggtgcggatgctgcgtaatattggcctgatggcggctgaacgcgccggggtgctgaagcgtcaggcgctgaagtatgccttaggcttgtaaaaccggcttcccgggcaggggcgtagcggagagcgcctgcccggcagtcaggacggagtaagcatgtcaggacgccaatagcaaaaaagcccaccgaagtgagcttttttgcattgaagtggctggggtacgaggattcgaacctcggaatgccggaatcagaatccggtgccttaccgcttggcgataccccaattgtctgttgcgcttgaccgtaactacaccggttgagggcaacagtgcgttcactgctgaacgacttttaaatttggctggggtacgaggattcgaacctcggaatgccggaatcagaatccggtgccttaccgcttggcgataccccaacaaattgtttgcggatttatcgatgcatatcgatacgtccagaatttggtggctacgacgggattcgaacctgtgaccccatcattatgagtgatgtgctctaaccagctgagctacgtagcctaattgtcttactgcttcttcgatggctggggtacctggattcgaaccagggaatgccggtatcaaaaaccggtgccttaccgcttggcgataccccaataccgtcgcggtgaaccgcaaatatcgaagaaatatggctggggtacctggattcgaaccagggaatgccggtatcaaaaaccggtgccttaccgcttggcgataccccatccgtacaacgctaactggtgaatggtgcgggaggcgagacttgaactcgcacaccttgcggcgccagaacctaaatctggtgcgtctaccaatttcgccactcccgcaaaaaagatggtggctacgacgggattcgaacctgtgaccccatcattatgagtgatgtgctctaaccagctgagctacgtagccatctttttttcgcgtaaccttatcggcgttgcggggcgcattatgcgtattgggcctgcgagcgtcaacctctttttcaaggaaaatcgttgtaatgtgactgtttggttaggttgcgaacagctcgctggaatattcggcaattattggttatttatcgtttttcagcggtataaatccggcaaaaagaaaacggaccccggagggtccgttttgcgtttcaccgcccgtctgggcttatttgtaggccgactggtggacaccgaccgcgcggcctgatggatcgttcatggttttgaacgcttcatcccactcaatggctttcgctgaagagcaggccaccgacggaccgccagggacgcactccgccgcgctcggcagcgggaacagctcttcgaagatctcgcggtacaaatagccttctttggaggtcggcgtgttgtacgggaagcggaagcttgcggtttccagttgctggtcgctgatctgtttggcggccacttctttcagggtatcgatccagctgtagccgacgccgtcagagaactgctccttctggcgccaggcgacgctggccggcaggtaggattcaaagcattcgcgcagaatgtgtttttccattttgccgttgccgcacatcttatcctgcgggttaatgcgcatcgcgacgtcgaggaacttcttgtcgaggaacggcacgcgggcctccacgccccaggcggacatcgctttgttggcgcgggcgcagtcaaacatatgcagcgcctgcagcttacgcaccgtctcttcgtgcagttctttggcgttcggcgccttatggaagtagaggtagccgccgaacacttcgtccgaaccttcgccggaaagcaccattttgatgcccatggctttaattttccgcgacatcaggtacatcggcgtcgaggcgcgaatagtggtcacatcgtaggtttcgatgtgatagataacgtcgcggatggcatccagcccttcctggacggtaaagtgaatttcgtggtgcacggtgccgaggtggttggccacctcctgcgccgctttcaggtcaggagagccttccagaccgaccgcgaaagagtgcagctgcggccaccaggcttcgctacgctcctgatcttcgacgcgacgggcggcgaatttcttggtgatagccgagatgaccgatgaatcaagaccgccggagagcagcacgccgtaaggcacgtcggacatcaggtggcttttcaccgactcttccagcgcctggcgcagctcgttcttatcggtaacgttgtctttcaccgcgtcgtaatcaaaccagtcgcgctgataatactggcggatttcgccgtctttgctccacaggtagctgcccgccgggaactctttaatggtgcggcataccggcaccagcgctttcatttcggaggcgacatagaagttgccgtgttcgtcatggcccatatacagcgggataatgccgatatggtcgcggccaattaagtacgcgtctttttcgctgtcgtacagggcgaaggcgaacattccctgcagatcgtcgaggaactccgggcctttttcctgatacagcgcgaggatcacttcgcagtcggaaccggtctggaactggtagcgatcgccatactccgcgcgcagcgcctggtggttgtagatctcgccgttaacggccagcgcatgggttttttcggcgttgtacagcggctgggccccggcgttgacgtcgacaatcgacaggcgctcgtgcgccagaatcgctttgtcgctggcatatacgccagaccagtccggaccgcggtggcgcatcaggcgggaaagctccagcgcctttttacgcagctcgcctgcgtcagttttaatatccagtacgccaaaaatagaacacatagccttctccattaccctgtcgtgtttgatgttgtgctggcttcgtctcgtggcgaagcctgagtgcgtgcttaagaaaatgccgtaaagggggagcaggcgcaagggttttgcggccggaaaaagaaaaaacgcaaccgtgattgttgaacagtgaaaaaagagtatcttttgaacggctttattgaggaattcgtatttataggccgtttttattagatggggtaattctgatgggcgctagaaatgaaaaaccacgtcctgcgacgtggttggcatcagaaaatatcgatttccgcgacggaagggtaaatccacgacgggcggaacggcatgctgtcgatgtcgtcgagggtggagacgccggagagcaccagaatagtctccagccccgcctggaaaccggccagtatatcggtgcgcaggttatcgccgacgatcaccgtctgctcggagtgagcctgcattttattcagcgctgaacggatgatccacgggctgggtttgccgacgtaaaacggcttacggccggagatcttctcgatcccggcgcacaacgcgccgcaggcagggtagaagccgcgaccgtgcgtatccgggttagtggcaatgaagcgggcgccgttggcgacgaagaaggcggccttatgcatcatttcccagttaaaggagcgagtttccccgacgatgacaaaatccgggttcacatcggtaatggtaaagccggctttgtacagctcgtggatcagcgccccttctcccaccacgtaggcttttttgccttcctggcgacgcagaaaatcggcggtggccatcgctgaggtgtaaaaggcgctatccggaacatcaattccagcggtggcgaaacggttcgccagatcctggccggtttgcgacgggtagttggtcagcattaccagcggcatgcctttatcgaggatgcgcttgataaactcggctgcgccgggaacggcgacgttatcgtgcatcagtacgccgtcaatatcacaaattatgttttgaatggtcatggtgggtccagaatcattaacaaagacgaaactatacgcgtcatcgatgaggtttcacacctctgacgggcgaggcccgcccgtattaaggtgacgcgctatgagaaaaggggcgattagctctcaagcaaacgctgcagcagcgtgccattgagcatggcgcgtttgaccagcgcgaaggcgccgattgcagagcggtgatcgagggtggagcgcaccaccggcaggttcttacgaaacgccttaagcgcctgggcgttaatgcagccttcgatggccggaagaaggaccttttcagcttccactatttcgccggcgacgacgattttttgtgggttgaacaggttaatggcgatggcgatcgttttcccgaggtggcgccccacgtactcaatcacctcgcaggccagggcatcgcccttgttggccgctttgcagatagttttgatcgtgcagtcatccggcgtcagacggctctggtagccctgctccagcaggtggcgaacccgctgttcaatggcggcattggccgcgacggtctccagacagccgaagttgccgcagtggcagcgttcgcccagcgggtcgacctgaatatggccaatttcgccgacgttgccgttgcggccgataaaaatgcgcccgttggagataatccccgccccggtaccgcggtgcacgcgcaccagaatggagtcttcgcaatcctggcttgcgccaaaatagtgctcggccagcgccaggctgcggatatcgtggccaacaaagcaggtaacgttgaagcgtttctccagcgccccgaccaggccccagttttccaccgcaatgtgaggcatatagcggatcacgccgctttccgggtcgacgaggcccggcaggatcactgagatagcgatcagctcgcgaattttgcgctgacagttttcgataaaggtggcgatgatattcagcagggcgtgttccagcgtttcctgggtgcgctcgggcagcgggaagtgctcctcttccaggggcttgctgcttaaatcatacagggtcagagtggcgtcatagcggccaagccgcacgccgatggcgttgaagttgcgggtttctgcgatgatagagatagcgcggcggccaccggtggaggcctgctgatcgacttctttgatcaggccgcgctcaataagctgacgcgtgattttggtcacgctggcaggggcaagctggctttgttcggctatctgaatgcgcgagatgggcccatgctggtcaatcaggcggtacacggccgcgctgttcagttgttttacgaggtcaacgttaccaatttgagcttgtccgcctgctgtcatacttttacttactcagtgacgacctcgttaccattaacgatggtcttggtgattttataatcgcgtgtaaaggcggtcaggttagcgaccatgcccggcgcaatgctgccgagctgcttgtccacgccgatagcgcgcgcaggatagagcgtcgccatgcgcaatacttcgtccagtgccacgccgcaatgctcaaccagattacgcaccccttcaatcatggtcagggaagatccgctgagggtgccgttttcatctacgcacagcccattgcggtagtatattgttttcccggcaaaaatgaactggtcaatattcgcccccgccggcgcggtggcgtcggtgaccaggcacagcttgtcgcctttcaggcgcttggcgttgcgcacgttggcgtaatcgacgtgcatcccgtcgacgatgataccgcagtagacatccggctcgtcaaaaatcgccccggcaagacccggttcgcggccggtaatgtacggcatcgcattatacaggtgggtggcaaaggtaatgcccgcgcggaagccgactttcgcctctttcagcgtagcgttggagtggcccgcggagacaacgatcccggcggcgaccagtttgcggatcacttctggctcaacgcgctcaggggcgagggtcactttggtgatcacatcggcgttgtcgcacaggacatcgaccagcgccgcgtccggtttacgcacgtagtccggattgtgggtgcctttcttaacgatattcagccacggcccttcgagatgcaggcccagcgcctggttcggatgtttttgcagatattcgcgcatcacgcgcacgccttgcttcatcagatcgtcgctggaggtaattagcgtcggcaggaagctggtgcagcctgagcgttcgttggccttctgcatgatctccagcgtttcgacagtgaccgcctctgggctgtcgttaaactgcacgccgccgcagccgttgagctggacgtcgataaaaccgggggcgattattgcgccgttgactgagcgctgctcgatgtcagacggcaaatctgccagcggacaaagacgttcgataaagccattagcgataacaaccgcatggtcatcgagaatttcatgaccggtataaacccggccctgggttaatgcatacattacgacccccggtatatacgcctcatcaggtcagcgttcgttcgtttgccgccggcatgatggtgcgtacaaagaaaaagatgatcccgcgccagggcgcgggaaggactacattacagacctttaatattttcagcttctaattcgttgaaatatttcagcgtcttcactttcagctccatggtggacggttcgtcgcagacgatcaccgccttcggatgcagttgcagacaggtaatggtccacatgtggttgacgttaccttctaccgccgcctgcagcgccagcgctttctgatgacccagcaccagaatcatcacttcttctgcgtccagcagggtgcccacgccgacggtcagcgcatatttcggcaccagatccacatcgccgtcgaagaagcgggagttcgctacgcgggtttcatgggtcagggtcttaatacgggtgcgggacgccagagaagaggccggttcgttaaacgcgatatgaccatcgttgcccacgccgcccatgaacaggtggattttaccgtaggaacgaattttttcttcatagcgacggcattccgcatcgatgtccggcgcgttaccattcagcaggttgatattttctgccggaatatcaacgtggtcaaagaaattacggtgcataaagctatgatagctttccggatgctctttcggcaggccaacgtattcatccatgttaaaggtgacgacgtgcttgaagctaacctggcctgctttatgcatttcaaccagcgccttgtaggcggtcagcggggtaccaccggttggcagacccaggacgaacggacggtccgcggttggtttaaatgcattaatgcggttaacgatatggcgggcagcccatttaccgacctgctcagcggttaccaggggaatcagtctcattcttcacctctatagtcaaagtagattctggcggattggcgccagcactctaaggagagtattgcagcaactgcgccgaccggggtcaatccgtgttgatttttttaatgataaaataagttttcgttgttagccagtgcaagggaggagggaatacgatatttggtgataattatcacaaaaaatacccgtttaatttgcgatacgaattaatttttcacacactttgccggtaagtgataaaaccgaccttgttacacaataaaaaagtggctttgaaatgagcctcatcggggtctcatagggggaataagatgaatattttaggtttctttcagcgactgggtagggcgttgcagctccctatcgcagtgctgccggtcgcggcattgctgctgcgtttcgggcaaccagacctgttgaatgtacccttcatcgcgcaagcgggtggggcgatcttcgataatctggcgctgatcttcgcaattggtgtggcatcaagctggtccaaggataacgccggttctgcggcgctggccggtgcggtagggtatttcgtgatgaccaaagcgatggtcaccatcaatccggaaatcaatatgggcgtgctggccggtatcattaccggtctggtggcaggggcggtatacaaccgctgggccggcatcaagctgccggacttcctgagcttcttcggcggcaaacgcttcgtgccgatcgccaccggcttcttctgtctgatcctcgcggcgatcttcggctacgtctggccgccggtgcagcacgctatccactctggcggcgaatggatcgtctccgcaggggcgctgggttccggtatctttggtttcatcaaccgtctgctgatcccaaccggtctgcatcaggtgctgaacaccatcgcctggttccagattggtgagttcactaacgccgctggcgctgtgttccacggcgacatcaaccgcttctacgccggcgacggcaccgcggggatgttcatgtccggcttcttcccaatcatgatgtttggtctgccgggtgcggcgctggcgatgtatctggcggcgccgaaagcgcgtcgtccgatggtaggcggtatgctgctgtccgtggccatcaccgcgttcctgactggggtaaccgagccgctggaattcctgttcatgttcctggctccgctgctgtacctcctgcatgcggtgctgaccggtatcagcctgttcatcgcaacggcgctcgggatccatgcgggcttctccttctccgcaggtgcaattgactacgtgctgatgtacagcctgccggccgccagcaaaaacgtctggatgctgctggtgatgggcgtggtgttcttcttcgtctacttcctgctgttcagcgcggtgatccgcatgttcaacctgaaaacgccgggtcgtgaagacaaagccgctgacgtggtaacggaagaagccaacagcaacactgaagaggggctgacccagctggcgaccagctatatcgccgcggtgggcggaacggacaacctgaaagccattgacgcctgtatcacccgtctgcgtctgaccgtgggcgattcggcgaaggtgaacgacgccgcctgtaaacgtctcggcgcgtccggggtggtgaaactgaataagcaaaccattcaggttatcgtcggtgcgaaagcagagtctatcggcgatgagatgaaaaaagtggttacccgcggcccggtagcggcagcggcaccggctggcaacgtcgccaccgcagcgcccgcggctaaaccgcaggcggtagcgaacgcgaagaccgttgagtcgctggtttcgccgattaccggtgacgtggtggccctcgagcaggtgccggacgaagccttcgccagcaaagccgtcggcgacgggatcgcagtgaaaccgaccagcaacatcgtggtggccccggccgccggtaccgtggtgaaaattttcaacactaaccacgcgttctgcctcgaaaccaacaacggtgcggaaatcgtcgttcacatgggtatcgacaccgtggcgctggagggcaagggcttcaaacgtctggttgaagagggcacggacgtgaaggcgggtgagccgattctggaaatggatctggacttcctcaacgccaacgcgcgctcaatgatcagtccggtcgtctgcagcaacagcgatgactacagcgcgctggtgatactggcgagcggtaaggtcgttgctggccagacgccgctgtatgagattaaaggcaagtaaggctcctgagtcgagtttttgcctcagcggcgaagggaaaccttcgccgcttttttttccagcaatcggccccataatcctcttctgatacctattttacgtaactaatagttgtcactacgccctgcttgtaagatcatgtgccgttatacgttgtttacgctttgaggaacccgtgatgagtgaggcagaagcccgcccgactaactttatccgtcagattattgatgaagatctggctaccggtaaacataccaccgttcacactcgcttcccgccggagccgaacggttatctgcacattggccatgcaaaatccatctgcctgaacttcggcatcgcccaggattatcagggccaatgcaacctgcgtttcgatgacaccaacccggtgaaagaagatatcgaatacgttgagtcgattaaaaacgacgtgcagtggttaggtttccactggtccggggacgtatgctactcgtctgattatttcgatcagctgcatcagtatgcggttgagctgatcaacaaaggtctggcctatgttgatgaactctctcctgatgaaattcgcgaataccgcggcaccctgaaagcgccgggtaaaaacagcccgtatcgcgaccgcagcgtggaagagaacctggcgctgtttgaaaaaatgcgcagcggcggcttcgaagagggcaaagcctgcctgcgcgcgaagatcgatatggcgtcgccgtttatcgtgatgcgcgatccggtgctgtaccgcattaagttcgctgagcatcatcagactggcaacaagtggtgcatctacccgatgtacgacttcacccactgcatcagcgatgcgctggaaggcattacccactcgctgtgtaccctggagttccaggacaaccgccgcctgtacgattgggtgctggacaacatcagcatcccggtgcatccgcgtcagtacgaattctcgcgcctgaatctcgaatacaccgtgatgtccaagcgtaagctgaaccagctggtgactgagaagcacgtggaaggctgggacgacccgcgtatgccgaccatctccggtctgcgtcgtcgcggctacaccgccgaatccatccgcgagttctgcaagcgcatcggcgtgaccaagcaggacaataccatcgagatggcgtcgctggagtcctgcattcgtgaagatctgaacgaaaacgccccgcgcgcgatggcggtgatcgatccggtgaaactggttatcgagaactatccgcagggcgaaagcgaaatggtggtgatgccgaaccatccgaacaagccggaaatgggcagtcgtgaagtgccgttcagcgccgaaatctggatcgatcgcgcggacttccgcgaagaagccaacaaacagtacaagcgtctggtgctgggtaaagaagtgcgtctgcgcaacgcctacgtcatcaaagcggaacgcgtggagaaagatgccgaaggcaatattaccaccatcttctgcacctacgatgccgacaccctgagcaaagacccggccgacggccgcaaggtcaaaggcgtgatccattgggtaagcgcggcgcatgcgctgccggtagagatccgtctctacgatcgtctgttcagcgtgccaaacccgggcgcggcggaagatttcctcgcggtaatcaacccggaatcgctggtgatcaaacaggggtacgcggagccgagcctggcgcaggccgaagccggtaaagcttaccagtttgagcgtgaaggctatttctgcctcgacagccgctatgcaaccgcaaccaatctggtgttcaaccgcaccgtcgggctgcgtgatacctgggcgaaagcgggcgaataacatttcttttcttgtcaaagcgtcgctcccagcggcgctttttttgtttcagaatcagctaattaaacttttcattttcgcgatgcgaattaattctgtttctgcgcggtaataaatagcgcttctgatgtttcctgtcacatacaaaaaaccaatgtaatcgctttcaatgattgcgtttttccctgattttgcaatgacttccataacaaaatcatcagagataagactgtaacaaaacgacataaaatatgtgcgctttgtcataatcttaagctttgcctcacgaaaaacattgataattcgcgtcacgaaaaatagtctatctacagtggttttgcggtcttttttaccgccccacattttgcagttttatttattttttagcgattgaccgctggtcttcgccttttaaaacgtcaaagaggatatgcacatgcgtacgtttagtggcaaacgtagtacgctggcgctggctattgccgccgtcaccgcgatgtcgggctgggttgtggctccacaggccagcgcagcaggctttatcgatgattcaaccttaaccggcggtatctattactggcagcgtgagcgtgaccgtaaagatgtgaccgacggcgacaaatacaaaaccaacctttcccactctacctggaacgccaacctggacttccagtccggctatgccgccgatatgtttggccttgatattgccgcgtttaccgcgattgaaatggcggagaacggcgatagcggccacccgaacgaaattgccttctcgtcacgtaacaaagcctatgacgaagactattccggcgataagagcggcatcagcctgtataaagccgcagcgaaattcaaatatggtccggcgtgggcacgtgcgggctatatccagccaaccggccagactctgctggctccgcactggagttttatgccaggtacctatcagggggcggaggccggggctaacttcgactatggcacggcgggcgcgttaagtttctcctatatgtggacgaacgagtataaagcgccatggcatatcgagatggacgatttctatcagaacgataagaagaccaaagtcgattatctccactccgtcggcgctaaatatgatttcaaaaatgacctggtgctggaggcggcatttggtcaggctcagggctatatcgatcagtactttgctaaagccagctacaagtttgacgtcgccggcgcgccgctgagcaccagctaccagttctacggcacccgcgataaggtcagcaacggcggggtcaacgacatctatgatggcaccgcatggctgcaggcgttaacctttggttataaggtggcggatgtcctggatctgcgtctcgagggaacctgggtgaaggctgatggccagcagggctacttcctgcagcgtatgaccccgacctacgcctcttccaatggtcgtctcgatatctggtgggataaccgctccgactttaacgccaatggcgaaaaagcggtcttctttggcgcgatgtatgacatgaaaaactgggatatgccgggctgggcgttcggcgcgtcttatgtctacgcctgggatgcgaagccgggaagaatgtcctctccggatgcgtactatgaccctgactatcgcctgaaagagtcggcctatagcctggatgcaatgtataccgtacaggaagggcgggcgaagggcaccctgttcaaactgcactttacccaatacgacaaccattccgatattccgagctggagcggcggctacggcaacatcttccaggatgagcgcgacgtgaagttcatggttatcgccccgttcactattttctgatgcctgcgcggcgggcgtgagcctgccgcacctctgggagaacgacaatgaaaaaaatgctgcttattgccatgatggcagcgggcctggtggcctgcaccacgtcgccggcgccgaaagaagacaccaaactgaaagatgcctatagcgcctgtattaatacggcggaagggaatccggacaagattgaagcctgccagagcgtactgaatgtgctgaaaaaggataaacagcaccagcagttcgccaaccaggagagcgttcgcgtcctggattaccaacagtgtattcaggccacccgcaccggcaacgatcaggcggtgaaagcgcgctgcgatcagatctggaaggagatccgcagcaataatacgacccattaaatcagacgacagcggcaaacgggcggggcatatctccgcccgtttgtttttttagcgctgactctccgccggctgatagccgcggctcagccgcacgaacagtagcgcggtggcaatgaatccgcacagcgcggcgcacattagccaccagcccggcgcgcttttatcgccgctgagctcgaccagggcgatggaaatagctggcgtcagtcccccgaagatcgcggtggcaaggctgaaggccagcgaaaagcccacggtgcggacgtataccggcataacttcggtaagcgccgcgaccatcgcgccgttatacatgccaaagaagaacgagaaccatagcaggaccagcgtcatacgggtgaaatcgggcgcgacggtgagccagtgcatcaccggccaggtggtgagcagcgccagcacggtaatgcccatcagcaccggacgacgaccgattcggtcagagatcgccccgctggcgaagttccatatcaactctccggacaaagcggggatgaggaaagtcaccccaggggcgtgagcgggaagggtgccagaggcgcccataaaaaagccaaccggcaggttggcttttcagtctcagcgaagcggggaattatttttccaccgcgtcgtgggcgtgttcgtcctcgcggcaatccccttccgcacagtgaccgtacagatacagactgtggttggtcaggcggatgccgtggcgggaggcaatttcacgctggcgtaattcgatcgagtcgtcgctgaattcgatcacttttccgcagtcgaggcagatcaggtgatcgtggtgatgctgctgggtcagttcgaaaacggattttccgccttcgaaattatgacgagtcacgatgccggcgtcatcaaactggttgaggacgcggtaaacggtcgccagaccgatctcttcgcccatgtcgatcaggcgtttatataagtcttccgcactgacatgatggttatccggttcctgcagcacttcaaggatttttagtcgaggaagtgtgactttcaggccagccttctttaatgcggtattgttgtcagtcatgcggaatctgtcctgttgctaaacgatctacttccttcaacggaagtcatacagaaattaacccgacgtaatgcgtctcattatagaactgccactggtaaatgaaaactgcaagcatcaggcctggtttgctgtcaaaaacgaggcaccagctacaaactgcgtcacgtgcctcgtagaatcagaggacattgtacagatatgtgattaaaagttaaaaacttgtagctattagtttgattgcttttgtctattaatgcgacgcaactcaatgattgcgccgcttaatcatcaggcgtttttgatttcttcgaggtgcagctcttcggcaacctgcttcacccatttctcaacgcgctcgttggtcagctccggctggcggtcttcatcaatggcgaggccgacgaagtggtcgtcatccgccaggcctttggaagcctcaaaatgataccccgccgttggccagtgaccgacgatggtcgcgccgcgcggctcaatgatgtcgcggatggtgcccagcgcgtcgcagaagtattctgcgtaatcttcctggtcgccgcagccgaacagcgccaccagtttgccattgaagtcgatctcttccagcgtcgggaagaagtcatcccagtcacactgcgcttcaccgtagtaccaggtcgggataccgagcagcaggatgtcgtgggcttccaggtcttctttgctgcttttggcaatgtcgtgaacatcagcaacatctttaccaagctgcttttgaatcatttttgcaatattttcggtgttgccggtgtcgctgccaaaaaagatgccgatgattgccatgagtaaaataacctcttgaaacttaaatgatgtggtagggacgcaatgcccatagataacggcaatcatagcagaacaggcaagggcgcggaaacagcaatcacgcccgactgcacactctgctacatgaatgcgggtttttcgcggaaagttagacttttccctggctgcgcagggcggttaactgggtcatcagcatctcttcaatgagatcgctgcggctcatattacgcgcttccgccagctcgttgagcgcatcgaccgcatcggcgttgagttttaactccacgcgcttcagcccgcgaaccttatcgcgtttcagctggttacgtttgttgatgcgcagttgttcatcgcgcgacagcggattggttttcggtcttcccgggcgacgctcgtttgcgaacaaatctaatgtcgtacggtccgtttgttcttttgccatgattctgagtgacttcggggaaacaagctgccgggctctagccggcgcagatagcgcgccatcatacatcaggcgaacggctgcgccaacgaccgcgggcattctgcggcgcggtcgggcatattttagccaatcaggcggcgatgctcgtcagatagcggcggatggcgcgtaacaccgcctcgggtttctcggcatggacccagtgtccggcgccggcgatgacgtgggcccgggcctgcgggaactgggccagcagcgcgtcgcggtaggcgtcggtcacatagggcgagttgccgccgggaataaactgcgtcgggtgcggccaggccgggatggtttcccagccgacgatatgcggatactggtcccacagcaccggcacgttgaagcgccagtcgccgtcgacgaatgatttcagcaggaactgaatcacgccttcttcctgcaggtgctcgcgcatcacctgcgccgcctgctggcgggtgctggcggcggattcgctgacggcgcggatagcggcgaaaatctcatcatggcggcgaacgtgataatccaccggcgcgatatcgatcgccaccagaccgctgatgcgttcaggcgccagggcggtaagcgccattaccgctttcccgcccatcgaatggccgataaaggtggcgcgctcgatctggtgcgcgtcgagcgtatcaagcagatcctgcgccatggcggggtaggtcatctctggcgaccgcggcgacaaaccgtggttgcgcatatcgacctgcacaatatcgtggtcggcgatcaggtcgcgggcgaggatgcccaggttgtccaggctgccaaacagaccgtggaccagcacgatcggggagtggttgtgcggattctgtgcagattgcgctcggctatttaatttcatggcaaagttctttttttcgctccgtcgggttagggtattatgttggacattctgccatccggctgcaagacccagaagttttctgagttttaccgccatcctggtttgacgctatccgcggttgggatttgtacttataatcccaacgatttgtattcagaaaagatatcgcactggattaagatgaaaacaattgaagttgatgatgaactctatcgctatattgccagccacactctgcatatcggcgagagcgcatccgacattttacggcgtatgctaaaattttccgccgtttcccaaccggctacaccggtcagcaaagccgcgccgacgctggcgccagcgcctgtcgctgaggtgaaacccgctaacccggtgaaagataaagtccgcgccatgcgcgagatgctgttatctgatgaatacgccgagcagaagcgcgcggtgaaccgttttatgctggtgttgacgaccctctactccctggacagtaaagcatttgccgaggccaccgagtctctgcacggccgcacgcgcgtttacttcgcggaagatgcgcgtacgctgctgaaaagcggtaatcagaccaaaccgaaacaggttcctggtacaccgtggtgggtgatcaccaataccaataccggccgtaaatgcagcatgattgagcacatcatgcagtcgatgcagttccctgcggagctgattgaaaaggtttgcggcacgatctagctttttaacatttgcaccagaaggatcaggcaatggcaatcgataaacgtgcggggcagcctgcgcaacagagtgatttgattaacgtcgcccaactgactgctcagtactacgtgctgaagcctgaagtcggtaatgcggagcatgcggtaaaattcggcacctctggccatcgcggtagcgcggcgcgccacaacttcaacgaaccgcatatcctggccatcgcccaggccattgcggaagatcgtgcgaaaaacgggatcaccggtccgtgctatgtcggcaaagatacccacgccctctccgagccggcgtttatttcggtgctggaagtgttaaccgccaacggcgtcgacgtgatcgtgcaggaaaacaacggcttcaccccgacgccggcggtctccaacgcgattctggtgcataacaaaaaaggcggtccgctggcggacggcattgtgatcaccccgtcacacaacccgccggaagatggtggtatcaagtacaatccgccaaacggcggcccggctgataccaacgccaccaaagtggtggaaaaccgcgccaacgaactgctggccgcgggcctgcagggcgtgaaacgcatttctctggacgcggcgctggcttctggccacgttaaagaacaggatctggtgcagccgttcatcgaagggctggcggatatcgtcgatatggccgcaatccagaaagccggcctgacgctgggcgtcgatccgctgggcgggtccggtatcgaatactggaaacgcattggcgagcactacaagctcaatctgaccattgttaacgatcaggtggatcagaccttccgctttatgcacctcgataaagacggcgccatccgcatggattgctcctcagagtgtgcgatggccggcctgctggcgctgcgcgataagttcgatctggcgtttgctaacgacccggattacgaccgccacgggattgtgaccccggcggggttgatgaacccgaaccactacctggcggtagcgatcaactacctgttccagcatcgtccgcagtggggcaaagaggtggcggtgggtaaaacgctggtctcctccgcgatgattgaccgcgtggtgaacgatctgggccgcaagctggtggaagtgccggtgggctttaagtggtttgtcgacggcctgttcgacggcagcttcggcttcggcggcgaagagagcgccggggcctccttcctgcgcttcgacggcacgccgtggtccaccgataaagacggcatcatcatgtgcctgctggcggcggaaatcaccgcggtgaccgggaaaaacccgcaggagcattacaacgaactggcggaacgcttcggcgcgccgagctacaaccgtctgcaggcttccgcgacctccgcgcagaaagcggcgctgtccaagctctctccggaaatggtcagcgctgacaccctggcgggggatccgatcactgcccgtctgaccgcggcgccgggcaacggggcggcgattggcggcctcaaggtgatgaccgacaacggctggttcgcggcgcgtccgtcaggcaccgaagacgcctacaagatctactgcgaaagtttcctcggcgaagagcatcgcaagctgattgaaaaagaagcggtagagattgtcagcgaagtgctgaagaacgcttaacgacgcactaccatcaggccccttgcgggcctgattttttttgcaaggatagcgatgaaaatacaacggaagtccctgtttttgttctgggcgtggatggatctctttttcgtcctgcaattcttatggtggaatattgcccaccgccgcctccctttttacgacgatctactcgcttatctccagctattgcacacctggggctccgcggcgatctggctgtacccgctgaatgttctgctgattatcagcatcccgctatcgatgatcttttttttccgccagagccgctatgcgctgtggctggcctgggggcaggcgccgctcaggctgctgtttatgcagccttcgctatcgctgggcctgtggctgattcaggctgccggggtccggcatgtagcgatcctggcaggctttctgctgctctctgaagggctgaaaatcgccagcctctggtactgcagaggcgggattcagggcataaagcgatagccaatcccggtttcggtcagcaaatgctgcggccgtgccggatcggcctccagcttttgtcgcagatgacccatatagatccgcagatagtggctgtgctccacggcgttaggcccccacacctgattcagcagctgacgctgggtaagcactttgccgggattattcaacagcgccgccagcaggcgaaactcgataggcgtcaggtggatctcttcgctgccgcgcaggatgcggcgggcggggatattgacctccaggtcagcgaagcgcaccaccggctcatcggcctgcgccgcgccgtggcgacgcagcgcgacgcgcaggcgggcctgcagctcgccgatgccaaagggtttacttaagtagtcatcggcgccggcatccagggcggcaattttgtcatgctcttcgctacgcgctgacaggacgataatcggcatctggctccactgacgcaggtcgcgaataaaatcaatgccgtcaccatccggcaggccgagatcgaggatcgcgaggtcgggcttacgggtggcggcttcaatcagcccacgctgcagggtttccgcttcaaatacgcgcatgccgtcggcttccagcgcggtgcgcagaaagcgtcggatagcgtgttcgtcttcgataatcagaacgttaatcacaattcctcaggtagctcttccagttcagggggcgtttctccaggcagtgtaacacggaatgaggcgccgccctcgggccggttgctggcggagatggtcccgccgtggacgtcgacgatggcctgacagatggcaaggcccagcccgacgccagggatcgccgactctttgttgccgcgggcgaatttatcaaagatagtctgttcctggcctgccgggatccctggaccgttatcccatacctccagcgacagctgccgggcgtccgcctcggcgcggatgccgatgctcgcccgggcgccggcatacttatgggcattttccagcaggttgatcagcacccgctcgaacagcggcccgtcgacatgcaccagctggaggggatcgggtaaatccagctgaatatgctggccgccgaggcttggctcgagcatgcgcagcgcgctgccgaccacttcctccagcgtcagccactccttatgcagattaaagccgccggactggatccgcgccatatccaacagattgttcaccagccgggtggtgttgagcacatgctggcggatttcgttggcctgcggggcatgttttgaaccttcgctggccagatcgagggtcagaatttccgcctggccaaacagcacggttagcggagtacgcagatcgtgcgacagggcggcgagcagcgagttacgcaggctttcccgctcgctggtcagccgggcctgctcttcgctggcggtcagggtgaggcgctccagggcgctggccaccagcagggtaaaggtctccagcagccgctgctgctccgggatcatcaattggcgcagattctccggttccaccaccagtagtccccaggtgcgggcggcgctcttcaggggcaagatctgatacggcacgccgggcagggtatcggtgccggcgccggcaggctgccccttatcaaagctccagcgggcgatggcatcatcccacggggtcagccctggctggtgggttaagggcagcagttttccctgggcgtccgggagcagcagctggctgcgggcctgaaaggtggaggcgataaaccgctcgctggtggtggcgatatcctgctggctgcgacccaccgccagcgctttagacatctcatacagatggcgggtacggcgttcacggtagcgcgccacccgcgcctggtagcgcacgccggcggtgaggttgccgataagcaggcccacggtgagcatcacgccgaaggtgagcagatactggacatccgacaccgccagcgttccgcgcggggcgacaaaaaagagatcgaagctgatgacgttgatcaccgtcgccagcaccgatggccagcggccatagaccagggcgatgagcaccacccccagcagatagagcatcaccagattggcggcttcgaaggccatcaaccactgcatggccaccagggtaatgatggcgcatagcgccaccgccaccgcgcagccctgcagctgcaggcgccatttctccagcgccggacggctgtcgctggcgcgtgcggcaagggggaagggtttctcatcgagggcgatcaccaccagatcgaggtccggcgcatggcgagccagacgatcggcgaagccgctgcgatcccaccagcggcgcttgctttggcggccaatgacgattttgccgaggttatgttcgcgggcgtaatggaggaccgctttctcttccgacgggtcggagagggtagcggtttcggcccccagctcctgggccagacgcagcgcggcgagaatagcccgccgccggccttccggcagccggtgcagggaaggggtctcgacatacaccgcatgccagacgctgcccaggcgggcggcgagccgggcggcggcgcgcaccagcttttcgctgccggtgttgtgcccgatacagagcaggatcgcatcgcgggtgtgccagactttctcctggccctggcggtcgcgccaggcgcgcatctgctcatcgacgcggtcggcggtgcggcgcagggccagctcgcgcagcgcaatcagattgcccttgcggaaaaagttttcgatagcgcgctcggcctggccgccgatgtagactttgccctcattgagccgctggcgcagatcgtcaggggggaggtccaccagcaccacgtcgtccgcggcgtcaaagaagggatcgggaaccgtctcccgcacctgcacgccggtgatcccgctgacgacgtcattcaggctttccagatgctggacgttaacggtagtgaaaacatctatcccggcctccagcagttcatccacatcctgccagcgctttggatggcgggagcctggcgcattgctgtgcgccagctcatccaccagaatcagcgccggacggcgggcgagggcggcgtcgagatcgaactcatagacgtaccgcccgcgatgggcaagccgccgcggcggcagagtgctcaggccctgcagcatcgcggcggtctctttacggccgtgggtctccgccacgccaatcagaatatccagcccctgggcgcgcagccgctgcgcttccgccagcatcgcccaggttttccccaccccggcgcaggcgccaaagaacactttaagtttgccgcgatgcggggcggcggtgtgctgcagcaggcggtcagggtccgggcgcagcggctcgtcactcatttacttatccttcagggcatccagcgccatattgagttgcagtatattgaccaccggctggccaaggaagctcagcagcggggtttgtgtggcctgattcaccaactgggttacctgctcaacgctcagctggcgcgcttgagccacccggggcacctgccacagcgcggcggccggagtcaggttgttatcgagaccgctcgccgaggtggtgaccagttcgaccggcacccgcgggtcggcgtccgggttggcggcgcgcagagcctgcacgcgctcgctcaccgctttatccagcgccgggttgctggcggcgaggttgctgccgccagaggccatgggattatccgccgtctccgcggtggccgacgggcggccctggaaatagcctgcggcggtgaagttctggccaatcagcgccgagccgcgcacttcaccgttcaggcggatcagcgagccgttggcctgtgagttaaaccaccattgtcccaggctggtggttagcagaggatagacgccgccggtgagcagcgttaacagaataaatagcacaagtgccggacgaatcaatgacatagtttgttcctcacaccagaccgctcagggtcagcagcaggtcgatggctttaataccgataaagggcaccagcagaccgccgaggccgtagatccacaggttgcggcgcagcatcgccgaggcggagagcgggcgatagctgacgcctttcagggccagcgggatcaggaagacgatgatcagcgcgttgaagataacggcgctgaggatcgccgatgagggcgaatgcaggcccatcacgttcagcatggccagctgaggatagaccgcggcaaacgccgccggaataatggcgaaatatttcgccacgtcgttggcaatactgaaggtggtcagcgagccgcgcgtcattaacatctgtttgccgatatggaccacctcaatcagcttggtggggttggaatccaggtcgaccatgttgcccgcttccttcgccgcctgggtgccggagttcatagctaccgccacgtcggcctgagccagcgcgggcgcatcgttggtgccgtcgccggtcatcgccaccagccgaccttccgactggtactgacggatcagcgccagcttggcttccggcgtcgcttcggcgaggaaatcatcgacgccggcctcggcggcgatcgccgcggcggtcaggcggttatcgccggtgatcatcaccgttttaatgcccattttgcgcagctgggcgaaacgttctttgatgccgcctttgacgatatctttgagcgcaataatccccagcaccttttccccttcggcgaccaccagcggcgtggccccctggcgggcgacctcttccacctgcttatcgacatcggcagggaagtggccgccgttggcctccacgtggcggcgaatggcgtccaccgaccctttgcggatcatgcgctgatcgatattgatgccgctcatccgcgtttgcgcggtaaaggggacaaaggtggcgtgcagcgactgcagatcgcgttcgcgcagattaaagcgctgtttcgccagcaccacgatgctgcgcccctcaggggtttcatccgccagcgaggagagctgggcggcgtcggcgagggttcgctcttccacgccgcgagccggcaggaaggcggaagcctggcggttgccgagggtaatggtcccggttttatccagcagcaggacatcgacgtcgccagcggcttccaccgcgcggccgctggtggcgatcacgttggcgccgagcatacggctcatcccggcgacgccgatggccgacagcagcccgccgatggtggtcgggatcaggcacaccagcagggcgaccagtacggtaacgctgaccgcattgccgctccacgccgagaagggccagatggtggcggtggccagcaggaacaccagcgtcagggcgatcagcaggatcgtcagggcgatctcgttcggcgttttacggcgctgggcgccttccaccatggcgatcatccggtcgaggaaggtttctcccgggttcacgctgcagcggatcaccagccagtcggagagaatgcgtgtcccgccggtcaccgaggcaaaatcgccaccggattcacggatcaccggggcagactcgccggtaatggcgctttcgtccaccgaggcgccgccttcgatgacttcgccatcgcaggggataatatccccggcttccaccagcaccacgtcgcctttgcgcaggtcttccgccggcacgtggtcgaccggcgcgttatgctgcggggcgcgcagtttgcgggcgaaggccgtttttttcacccctttcaggctgttggcctgggctttgctgcggccttccgccatcgcttcggcaaagttggcgaacagcacggtaaaccacagccagatactgacggcggcggtaaaggtggcgctaccggtcagggcgccgccagccatggcgatcgccagcagggtggttaacagactgcccacccagacgataaacatcaccggattgcgccattgcaccatcgggctgagttttttcacggcatccagcagcgcctggcgcaccagcgtcggctccagcagggctaattgtttgcgactcataacagggtgctccgcatcgctcaaagtaaggaaaagtgttcagccagcgggccaagcgccagcgcaggaataaaggtcagggcgcccaccagcagcacggtgccgatcagtaaaccgataaacagggcgtcgtgggtggccagggtgccggggctggccggttgaattttcttcgccaccagcgagccggcgatggccatcaccggaacgatgacggcgaagcggccgaccagcatgcagaacgccagcagcaggttccagaacggcgtcgccgcgcccaggccagcgaaggcgcttccgttgttattggccgccgaggtgacggcatacagcacttcgctaaagccgtgcggtccagggttgaacatcccggcgcggccggcgtcggtcatcatcgccagcgccgtgccaagcagcaccagcgtcggggtgaccagaatggcgagggcgatcattttcatttcccggacatcgattttcttcccgaggtactccggggtgcggccgaccatcagcccggcgataaataccgccagcataacgaacagcagcatgccgtacaggcccgagccgacgccgccgaataccacttcgccaatctgcatcagccacatcggcaccatgccgcccagcgcggtgaaggagtcatgcatggcattgaccgcaccgcaggaggcggcggtggtgatcaccgcgaacagactgctggcgagaataccgaagcgactctctttaccttccatattcaggctactgtcggcgcccagcgtcagcaggtgggggttgccgcgagtttccgcccacatcaccacggcgacgcagaggataaagatcagcgtcattgcccacaggatggcgcgtccctgacgccgatcgcttaccacctcgccgaaggcgaagcacagcgccgccgggatcaggaagatcgccaacatctgcacgagattggtcagcgcggtcgggttttcaaacggatgggcggagttggcattgaagaaaccgccgccgttagtgcccagcagcttaatcgcttcctgtgaggcgacaggccccatcggcagcagctggtgcaccccttcgagggtggtaaagggctggtaggcctgcagattctgcggcacgccctgctgaataaagagcagggccaccagcagagagagcggcagcagcagccacagggtaatgcgcgtcaggtcgacccaggcattgccgagggtcgacattttctgccgggcgaaggcgcgggtcaggacgaagaccacggcgatgccggtggcggcggagaggaaattctgcaccgtcagaccgaccatctggctgagataactcatggtgctttcgccggcgtaagcctgccagttggtattgctgacaaagctgatcgcggtattgagcgccagatcccatgacagccccggcaggtgctgcgggttaaacggcagcacgccctggagcatcagcagggcaaacagcgccaggccgccgagggcgttaaacagcaggagcgccagcaaatactgcagccagcccatctcttcggcgcggatcccggccacgcgccacaggacgcgctcgacgccggccaggccgggaagcgggatatcgttcaccattcttgccagacacatccccagcgggcgcgccagcaccagcaataccagcagatagctggctaataataaaaatccctgggcagccatcagaatgcctccgcatgtatcaaggcataaaccagataagccagtaacaggaacaccagcccaacgccagtgagtacgcctgcagtcacaatccacctccgggtgtgttttcgatttacctggaggatagaaattacggcgcaaagatttcgcaaaaatccgcgggtgcggtgtaaaaaaagtataaaaatgacaaaggcacaaattaactgatggttagtattaatttaactttttcgtaactaatttacgtggcgaatgtaaattaagtataaatacgtgctttttagtggtcggatgagtagtaaaattacaagcagagcggtattattttgctcacacaaacatgattaattttaccggcgctgcttgccggcctgacaaaggggagagaaatgatggcgttgtacaaagcttatcctgctcatattattttgctgcgtcgtgctttcgccgtcgtggctggcgtcgcagcgctgccggtgatgctgttctggaaagatcgcgcccgctactacagctggctgcaccgggtgtggtcgaaaaccagcgagcagccggtgtggatggcgcaggcggagaaagccgctcacgatttctattaatcctcctgctgcgaagaaaataacaagaccgccgggttgccccggcggttttttttcgccgcttgtctacactcgtttttatgcgccgccttggaattggcaggtgcgtattttgccggagcgcgctatttttgccggcttagatcataagatgagtattgctgacggataataaggagtgatatggccacccatctggtctggttacgcacggatttacgcattcacgataacctggcgctggctgccgcctgccgcgatccgcaggcgcaggtgctggcgctgtatatcgccaccccggggcagtggcgtgaacatcacctggcgccacggcaggccgcttttatcgccagccatttacagagtctgcatgccgcgctggcggaacggggcataccgctgtgggtagaagaggcggacgattttaccgccagcgtcgaacggctggccgatttttgccagcagcatcaggtcagtcacctgttctacaactatcagtacgaattcaatgaacgccagcgcgatgccgccgttgagaacaccttgcgcgacgtgatttgccagggctttgacgacagcgtcctgttgccgcccggcagcgtactgaccggtggcggcgaaatgtataaagtcttcaccccgtttaaaaatgcgtttattcgccgtctgcgggacgggctgccggcgtgcgtggcggccccgaagccgcgccaggcgcctgcccgccaggcgccgccgctgcctgagcttaactacccgcaaacgccgtttgacgggctgctgtttgccgcggatgaaaaaacggcgctggcgcgtctgcgcgcgttttgtcagcaagcggcggcggattacgaggggcagcgcgacttcccggccgtggaagggaccagtcgcctgtcgccctgcctggccatcggcgtgctgtccccccgccagtgcctgcatcgtctgctgacggaacatcccgccgcgctggacggcggagccggcgccacctggcttaacgagctgatctggcgcgagttttaccgccatctgatggtctactatccgaagctctgtaaagggcggccatttactgcctggacagataaggtcgcctggcgcgcagaggaggcctccctacaggcctggcagcgcggggagaccggttttccaattgttgatgccgccatgcgccagcttaacgccaccggctggatgcataaccggttgcgcatgattgtcgccagcttcctgaccaaagatttgcgcctcgactggcgggcgggcgagcgctatttcatgagccagctgattgatggcgacctggcggcgaataacggcggctggcagtgggcggcttcaacgggcaccgacgccgcgccctatttccgcatatttaatcccaccacccagggcgaaaagtttgataaacagggggtgtttatacgtcgctggctgccggagctggcaaaggtgccggagaaggccctgcatcagccgtgggcgtgggcggataaacaagggatcacgctggattattcgcgcccgatagttgatcacaagcaggcgcggcaggagacgctggcggcctgggaggccgccagaaaaggaattactccaccgccagacggcgggtcctgactttcagcgaatgatacagccagatgaccagcaccacgccgacgcaggccagcgcgccccaggtgatctggctgaagacggtaatgtaggcgtcaatggagtagttcaccgctccggcggcgtcgaatgacgcctgcgaggtctggtcggcgataacgccggccagatagttggcgatggcccctgagagcagcatataaataccggtcagcaccccagtgacacccgggatctcaatgcgggtgatctgcgacatcgcgaccgggtcgataaacagttcggcaaagcccatcaccgccagacccagcaccatcagcggcatggacgactgaccataggccgccgaccagcgggcgctgagggtcaaaatgcagaacccggcgctcatcaggcccagaccgagggcaaatttcccccagatgcgcacggtgcgattgccgttcacgctctctttcaccagccacgccagcaccatcccgcagagcatcaccgcgaaggcgttgattgactggaacatagcggtagggacttcgtagctcatgatatggcggttaacgaagcggtcaatatacaggctgatggagctcccgccctgctgggcgaaggcccagaacagcaggctgaaggcggtcaggacgacgattaggcgcagatccttgcgctgtttatcggtttcggcgcgcaggtagatccgcgccagtaccgcgaggccaatggccgtggccaccatcagggcatacaccgaccactcctgccagaacagtaccgcaatcagcagcggggcggtaaccagcaataccagcagccagccccagttcggcaacaggaagcggcgcgcgcacagcgcctggcggttgacgccggcggtatgctggaaatgacggttgccgcagaggaaaatcaccagccccgcgaccatgccgatggccgccagggcaaagcccatcgcccagctatactcctcctgtacgtagccgcaggcgatcggcgcgataatcgagccgatattgccggcggcatacatcagcgaaaagccgccatcgcgacgcggatcggcgggttcgtacagctcgcccagcagacagctgacgttggatttaaacaacccgtagccgcagacgatgatcgccagcgacaggtacaggaaaagcggagcggtttcgctggccccgagcaccagatggccaatggccatcagcagcgcgccgagcatgaccgccatccggttgcctaacagcttatcggccagatagccgccgaggatcggcgtcacatagaccagcgaacagtaggcgctgaacagggcgtaggcatggttatcgtcatatttgagctgattggtgagatagaggatcagcagggcgcgcatgccgtaaaagctaaaatactcccagatttgcagcgccacgacgtagtagatcgcccgcggttgcgatgatgttgtctgcatatgaagtgtgtttcctggcgtaaagcgaaagtcgatcgttctgcatgaatagcgatttatcagtcatattcatggcttgaggggctttctgattatttaatatgctttattagtgcataaatatacactaatgcgcggcgggatgaatagacaaattgcgggattcgttaaaaagtcatggtcagtgacggtagcggactatcgacgacccgaatggatatggttatgttatgcctttgtataacctgattatctgctggagtggcgatgaaaaatagcgaactggaacaactgattaacgacaagctcaatagtgcggccatcagtgacttcgcccctaacggtctgcaggtggaaggacgcgaaacggtgcacaagatcgtcaccggagtgacggcctgccaggcgctgctggatgaggccgtccgtctgcaggcagatgcggtgattgttcatcacggctatttctggaaaaacgaatcgccagtgatccgcggcatgaagcgccgtcgcctgaaaaccctgctggccaacgatatcaatctctacggttggcacctgccgctggatgcccatccggagctgggcaataacgcgcagctggcgcatctgctggggattaacgtgctcggcgaaatcgaaccgctggtgccttggggcgagctgtcgatgccggtgtccggcctcgaactggcctcgtggatcgaagcgcggctggggcgcaagccgctgtggtgcggcgataccgggccggacaccgtcagccgcgtcgcctggtgtaccggcggcggccagagctttatcgacgccgcggcgcgctttggcgtggacgcctttatcaccggcgaggtgtcggaacaaactattcactctgcccgcgagcagggcctgcatttttatgccgccggccaccacgccaccgagcggggcggcattcgcgccctcagcgaatggctgacggaaacgaccgatctggacgttacctttattgatattcctaaccctgcctgacgggagagaagaaagtgcagcgagcgcgttgttatctgttaggtgaaacggcggtggtcctggagcttgagcctccggtgaccctggagagccaaaaacgtatctggggcctgacgcagcggttgaccgatcgcgaagaggtggttgaagtgatcccggggatgaacaacatcaccgttgtgctgcgtcgtccgcaggagatggcgtgggaggcgattgacaagctgcagcgctggtgggaagagagcgatgcgctggagccggaatcccgtgagataagtatcccggttatctacggcggcgaggcgggaccagatcttggcgacgtcgcgcgccatagcgggttgagcgaaaagcaggtggtcgaactgcactcttcggtggagtatatggtgtggtttctgggtttccagccggggtttccgtattttggcggcctgccggagcagctggcgatgccgcgtcgcgccgagccgcgcgtactggtaccggcgggatccgtcggtatcggcggatcgcaaaccggtatttatccgctggcgacgccgggcggctggcagctgctggggcgcacgccgctggcattattcgatccaaaacgtgaagagccggtgctgctgcgttccggcgatcgcgtgcgctttgtgccgcagaaggagggggtatgttgaaatttatccgcgccggcatgtatacctcggtacaggatggcggccgggaaggccagcgccagtgggggattagccgctgcggcgcgctggataaaccggcgatgaccattgccaatctgctggtgggcaatgcgccggaggcggcggcgctggaaattacgctgggtcaggtcgatgtgcagtttacccgccactgctggttcgcgttgaccggcgccgcctgtgaagcgacgctcgacggcgcgccggtctggttgggctggcgaatggaggcgaaggccgggcagcggctggtgctgaaaaatcctcagcatgggatccgcagctatctggcggtcgcgggcggtattgatgtccctgaagttttaggttcccgctctaccgatctgaaagtcggtatcggcggaatcgaagggcgccggttgcaggatggcgatcaagtgaagattgggaaatcgtcccgccgctttagcgcctcgcgcggcgttaaacagctgccgataggcaatattattcgcgcgctgccggggccggagtatcacgaattcgacagcgtgtcgcaggagtctttctggcgctcgccgtggaagctgagtccgcaaagcaaccgtatgggctaccgcctgcaggggcagccgctcaggcgcacaaccgaccgggaaatgctctctcatggcctgctgcccggcgtggtacaggtaccgcataacggccagccgattgtgttgatgaacgatgcgcaaaccaccggcggctatccgcgtatagcctgcattattgaagccgatatgtaccaactggcgcaaattccgctaggtcagccgatccatttcgtcccctgttcgctggaggaagcgctaaaagcgcgcgccgaccagcagcgctaccttgaacaactggcctggagattaagcgatgaaaattgatttaaatgccgacctcggcgaaggctgcgccagcgatagcgcgctgctgcagctggtctcttccgccaatatcgcctgcggctttcacgccggcgatgcggttctcatgcagcaatgcgtgcgcgaggcgctgaaaaacggcgtcgctattggcgcacacccgagcttcccggaccgggaaaattttggtcgaaccgcgatgcagttaccgccagagacggtctacgcccaggtgctgtaccaaattggcgcgctggcggcaatcgtacacgcccaggggggcgagctgcggcacgtcaaaccgcatggcatgttgtacaaccaggcggcgaaagagccgcctttggccgacgctatcgctcgtgcggtgcgcgatgccgacgccgacctggtgctggttgggctggcgggcagcgagcttatccgcgccggacagcattatcagttgacgacgcgccaggaagtcttcgccgatcgcggctatctggccgacggcagcctggtgccgcgcagccaaccgggcgcgctgattgagagcgaagagcaggcgctggcgcaaacgctggaaatggtgcagcacaatcgggtgcgcagcctgagcggcgaatgggcgcatgttaaggcggaaacggtctgcctgcatggcgatggcgctcacgcgctcgatttcgcccgacgcttgcgcgccgcgtttgccgggcggaatatcgacgtcagcgcggacctcgagtaatagtccgcctaagttattaataataattaaatcaaataattaacaacactcacaatactcacaactgaacaggacgttattatgcaagaggcgatatccctctggccgctaatcggcattgccgtgattgtggtcggttttgtattacgctttaacccggtgctggtggtgattatctccgggatcgtcaccggcgtggcggcgcatatgccaatagccactattctggagaaactgggcgagggcttcctgaatacccgtaatctgccgtttattctgctgctgccgctggcggtgatcgggctgctggagcgccatggtctgaaagagcgggcgcaggcgtggatcgcgaagatccatagcgcgaccgccggacgtctgctgatcgtctatctgtttgtgcgcgaagccaccgccgctctggggttgaccagcctcggcggacatccgcaaatggtgcgcccgctgctggcgccgatggcggagggggcggcggaaaagcgctttggcccgctgccgggcaatgtacgctaccgcctgcgcgcgatgtcggcggcgaccgataacgtcgggctgttcttcggcgaagatatttttgtcgccttcggcgcgatcatcttcatgcacaactttatgctggagtcgggtgggatccagacagaaccgttgcatattgccctgtgggggatcccgacggcgatctgcgcctttctgatccacgccgcgcgcctgtggcgactcgatcgccatctccagcgcgagctggaccggataaacgccggacaggcgaaaggcggtgcggcatgaatttccagcaaacctatttatactggctggccggcgcggtactgctggtcgtggctatcatgtcctggcgcgacaaaagcaatccgcgacgtctgacaaccggtctgttctggggcctgtacgggctggtgttcttgctcggcgactggacatatcaactggtgggcgataagcgtacggtgaatatcgctgtcggcggggtggtggtcgtcctggcgctgatcgccggttttggcggcgtgcgcctcggcagctaccatcagcgtacccaggaagagaaaaccgccagcgcgaaacgcctcggcaacaaacttttctttccggcgctggcgattccggtcgtcaccgtcattggcgtactgctgtttaacaatctgccctcatggcaggtggcgctcttcgggccgggcaaccacgcgacgctgattactctgttctcgatgactgtcggtacgctgattggcctggcgatggcgattcgtatgacgcatgaaacggtggcgcagccaatgcaggaagcgcgccgtttgcttgattccgtcggctgggcctttatcctgccgcaaatcctcgcggtgctggggctgctgtttaccgcagcgggcgtcggaaccagcatttcatggctgaccgagcactatctggcggtcgataaccgctttatcgccgtggctgtgtatgccatcggcatggcggtgctgacaatggtgatgggcaacgcctttgccgctttcccgattgtgaccgccggagttggcattccgattttagtcctgcagcacggcggcaatccggcggtaatggcggcgattggtatgttttccggctactgcggcacgctgatgacgccgatggcggcgaacttcaatattgtcccggcggcgctgctggaactgccggataaaaatgcggtgattaaagcccagataccgaccggtatcctgctgcttatcgtcaatgtattcttactctatttcctgatgttcctgtaaggagggatgatggctggcgtattgattaccggttttgagccgttcggcggcgaaacggttaacccttcatggggagtggttaagcagctggatggcatgattattcgcggacagcaggtggtggctaaacagttaccctgcgtattcggcgaagcgctgacggtgctgaaggcggcgctggaaacctatcaaccgcggctgacgattgccgtcggacaggccggcggccgtgtcgatattaccgtcgaacgtgtagcgatcaatgtcgatgatgcgcggatccccgacaataaaggccagcaaccgatcgatgaaccgatcgttgctaatggccctgcggcctgcttcagtacgctaccgatcaaagcgatcgtcagcgcgctgcgccagcaggggatcccggcctcggtgtcgcaaaccgcgggcaccttcgtctgcaatcacgtgatgtatggtttgctgcatcagctgcagggaaaaagcgggcagaagggcggttttatccatattccttatctgcctgaacaggcggcggcccacccggggcaggcgagtatgtcggtcgcgacggtacgcgcggcgctggaaacggcgattgccgtcgcccttgaacaggatgacgatgtcaaaattggcggcggcgccacccattaacagaaggatgacagtatgccggaaggtccggagatccgccgtgcggcggataaactggaggcggcaatcaaaggcgaacccttaaccaacgtctggttcgcctttcctcagttgcaaccctatcaaactcagctaattggtcagcgggtgacccatatcgccacccgcggcaaggccctgttaacccacttctccggcggattgaccctgtatagccataaccagctgtacggcgtctggcgtgtggtggatgccggcgttgagccgcaatcgaaccgcgtactgcgcgtcaggctgcagaccgccagcaaggcgattttgctctacagcgcgtcggacattgatatcctcacggcggagcaggttgccaaccatccgttcttgctgcgcgtcggaccggacgtgctggacatgacgttaaccgcggagcaggtgaaagcgcggctgctgtcggccaaattccgcaatcgtcagttttccggcctgctgctggatcaggcttttcttgccgggctcggaaactatctgcgggtggaaattctctggcaggtgggattaagcggtaagcgtaaagccgctgaactgagcgacagtcagctggatgcactggcgcacgcgctgctcgatatcccgcggctgtcctatcgtactcgcggtctggtggatgacaacaagcatcatggcgcgctgtttcgctttaaggtcttccatcgcgatggggaaaggtgcgaacgctgtgggggaatcattgagaagacgacgctctcctcgcggccattttactggtgtccaggatgccagcattaagccggctggcgggcgatttcagcatgaagcgcgttatcaggcataaaaaaacgcgccagcaggcgcgtttttatgatccggacagtgagattaacgcttaatgtcggactggaaatcgcgtttggcgtagccggtatacagctgacgcggacgggcgatcttcatgccatcgctgtgcatttcgttccagtgcgcaatccagcccacggtacgcgccatggcgaagataacggtaaacatggaggacggaatacccatcgctttcaggatgataccggagtagaagtcgacgttcggatacagtttcttctcgatgaagtacgggtcgttcagcgcgatatgctccagctccatggccacctgcagcaggtcgtctttggtgcccagctctttcagcacttcatggcaggtttcacgcattacggtggcgcgcggatcgtagtttttgtaaacacgatggccgaagcccatcaggcggaaagagtcattcttgtctttcgcacgacgaacaaattccggaatgtgctcaacggagctgatctcttccagcattttcagcgccgcttcgttggcgccaccgtgtgccggtccccacagggaggcgatgcccgcagcgatacaggcgaacgggttagcgccggaggagcccgcggtacgtaccgtggaggtcgacgcgttctgctcgtgatcggcgtgcaggatcagaatacgatccatcgcgcgctccagcaccggattgacttcatactcttcgcacggtgtcgcaaacatcatgcgcaggaagttgccggcataggagaggtcgttgcgcggataaacaaacggctggccgatagaatatttgtaacacatggctgccatggttggcattttggacagcagacggtaggcggcaatctcgcggtgacgcgggttattcacgtcgagggaatcatgatagaacgccgccagcgcgccggtgatcccgcacatcaccgccatcgggtgggaatcgcgacggaacgcgtggaacagacgggtgatctgctcatgaatcatggtgtggcgggtgacggtagttttgaattcgtcatattcggcctgagtcggcttttcgccgtacagcaggatataacagacttcaagataattagattcggtcgctaactggtcgatcgggaagccgcggtgcagcaggatcccctcgtcaccatcgataaacgtaattttagattcacaagaagccgttgatgtgaaacctgggtcaaaggtaaatacgccttttgaaccaagactacgaatatcaataacatcctgaccgagcgtgccttttagcacatccagttcaatagcagtgtcaccacccagggtgatttttgctttagcatcagacatttatggtctccttagcgcctttattgcttaagactgccgggtggtggatttgctttcggcccgcgcctgcatacgttaccagtttgttatgttgcacacagctctgcgtcagcgaaaagggcagggtacagagcaacggcgcttgatggcacgtccttcagggctgcggtgaaacaacagcaaatcagcgttttagcagtccgaatattaaaacctatataccactaataactgtcctgattacatcggtcaatactgacacactgttacataacttattctcaggtgaaagagtgaccccataacttttgagcattattgcatttaactggtaatggttgtaacaagaatgtttaatatttgtcaaatcaggtgattaaaaattaaaaaaatgttggtatcgtgaccttgatcactgttccggagaaaacccaacaaactatatgtaggttaattgtaatgattttgtgaacggcctatactgcggccaggtctccggaacaccctgcaatcccgagccacccagcgttgtttagtgatgttttaatgcctgaaaagacgttttaacatgacttctggttatagaaaggacgctgtctgacccgcaagcagaccggaggaaggaaacaataagaacagcatgtgggcgttattcatggtaagaaatgtgaaaaaacaaagacctgtcaatctggatctacaaacgatacggttcccaatcacggcgatagcgtccattctccatcgcgtttccggtgtcatcaccttcgtggcggtcggaattctgctttggctgctgggcaccagcctttcctccccagaaggttttctgacggcggcctccatcatggatagcttctttgtgaagttcatcatgtggggcattctcaccgcgctggcctatcacgtcgttgtcggtattcgccatctgatgatggactttggctaccttgacgaaaccctcgaagcagggaaacgttccgccaaaatttcttttgttattactgtcgtgctttcacttctcgcaggagtcctcgtatggtaagcaacgcctcagcactgggacgcaacggcgtacatgactttatcctggtccgtgctaccgccatcgttctgaccctctacatcatctacatggttggcttcttcgccaccaccggtgaaatctcatgggaagtgtggaccgggttctttgcctccggcttcactaaagtcttcactctgctggctctcgtttccattctcatccatgcctggatcgggatgtggcaggtgttaacagactacgttaaaccactggctctgcgcctggttctgcaactggctatcgttgtggcgctggtggcttacgttctttatggatttgttgtggtgtggggtgtgtaatgaaattgccagtcagagagtttgatgctgttgtcatcggtgccggcggcgcaggtatgcgcgcggcgctgcaaatttcccagagcggacagacctgtgcactgctctccaaagtgttccctacccgttcccataccgtatccgcgcagggtggcatcaccgtcgcgctcggtaactcccatgaagataactgggaatggcatatgtacgacactgtaaaagggtcggactatatcggcgaccaggacgccatcgaatacatgtgtaagaccggcccggaagcgattcttgagctggagcacatgggactgccgttctctcgtcttgacgatggccgtatttatcagcgcccgtttggcggccagtcgaagaacttcggcggcgaacaggcggcgcgtaccgcggcggcggctgaccgtaccggtcacgccctgctgcacactctgtatcagcagaacctgaaaaaccacaccactatcttctccgaatggtacgccctcgatctggtgaaaaaccaggacggcgcggtagtcggttgtaccgccctgtgcatcgagaccggcgaagtggtctactttaaagcccgcgccaccgtgctggcgaccggcggcgcaggccgtatctatcagtccaccaccaacgcccacatcaatacgggtgacggcgtcgggatggccatccgcgccggcgtgccggtgcaggatatggaaatgtggcagttccacccgaccggtatcgccggggctggggttctggttaccgaaggttgccgcggcgaaggcggttacctgctgaacaaacacggcgaacgctttatggagcgttatgccccgaacgctaaagaccttgcgggccgtgacgtggtggcgcgttccatcatgatcgaaatccgcgaaggccgcggctgcgacggtccgtggggcccgcacgcgaaactgaaactggatcacctcggtaaagaggttctggaatctcgtctgccgggtatccttgaactttcccgtacctttgcccacgtcgatccggtgaaagagccgatcccggttatcccaacctgtcactacatgatgggcggtatcccgaccaaagtcaccggccaggcgttgaccgtgaatgagaagggcgaagacgtggtgatcccgggcctgttcgcggtaggcgaaatcgcctgcgtatcggtccacggcgccaaccgtctgggcggcaactcgctgctcgacctggtggtcttcggccgcgcggcgggcctgcatctgcaggaatccattgccgagcagggcacgctgcgcgacgccagcgaatccgatatcgaaggctcgctggatcgcctcaaccgctggaacaacacccgctctggtgaagatccggtggcgattcgtaaagcgctgcaggaatgtatgcagcataacttctcggtgttccgcgaaggcgatgcgatgcacaaaggtctggagcaactgaaagtgatccgcgagcgcctgaaaaacgcccgtctcgacgatacctccagcgagttcaacacccagcgcgttgagtgcctggagctggataacctgatggaaaccgcctacgcgaccgccgtatccgctaacttccgtaccgagagccgtggtgcccacagccgcttcgacttcccggatcgtgatgatgaaaactggctgtgccattccctgtacctgccagagtcggaatccatgacgcgtcgtagcgtcaatatggaaccgaaactgcgtccggcattcccgccgaagattcgtacttactaatgcggagacaggaaaatgaaactcgagttttcaatttatcgctataacccggatgttgacgacgctccgcacatgcaggattacacccttgaagcggaagaaggtcgcgacatgatgctgctggatgcgctgatccagctgaaagaaaaagatccgtcgctgtcgttccgccgctcctgccgtgaaggggtctgcgggtccgatggtctgaacatgaacgggaaaaacggtttggcgtgcatcacgccaatctccgcgctgaatcagccgggcaagaagattgttatccgtccgctgccaggattaccggttatccgtgatttggtggtggacatggggcaattctatgcacaatatgagaagattaagccttacttgttgaataatgggcaaaatcctccggctcgcgagcatctgcagatgcctgagcagcgtgagaaactcgacgggctgtacgagtgtattctgtgcgcctgctgttcgacctcgtgcccgtcgttctggtggaacccggacaagttcatcggcccggctggcctgctggccgcgtatcgcttcctgatcgacagtcgcgataccgaaaccagcgagcgcctggacggcctgagcgatgctttcagcgtattccgctgtcacagcattatgaactgcgtcagtgtgtgtccgaaggggctgaacccgacgcgcgccatcggccatattaagtcgatgctgctgcagcgcagcgcgtaagcaacacggtctgtcccggatggcgctagcgcttatccgggctaccaaagcagtagccccggcaagcgttagcgccgccgggggatatagcaggaaatctttaaaaaccgccacaagatgtaccagtaatcgaggcgttcagtgcgaggtaaggcggcaactgagcgcatccccgggagcatagtgaactatgtgaccggggtaagcgaaggcagccaacgcaaccgcagcctgaacgctgaagattaatggcagtttttaaaggttccttagcggatagaaaccacaactcgtccgcaacaagtgaaccccggcacgtgcactcggtgtgcgtggtagtttctacggcgaaataagcatatgaatgcttaagggatcacgatgcagaacggcgcaatgaaagcctggctggactcttcttacctctctggttcgaaccagagctggatagaacagctctatgaagacttcttaaccgatcctgactctgttgacgccaactggcgttcaatgttccagcagttacctggcaccggagttaaaccggatcaatttcattccaaaacgcgtgattatttccgtcgactggcgaaggatgcctcacgttacacttcttcgatttccgacccagacaccaatgtgaagcaggttaaagtcctgcagctcatcaacgcataccgtttccgtggccaccagcatgcgaatctcgatccgctggggctgtggaagcaagagagagtggcggatctcgatccggcctaccacgatctgaccgaggccgatttccaggaaagctataacgtaggttcatttgccatcggtaaagacacgatgaagctgggcgagctgattgccgccctcaagcaaacctactgcggctccatcggcgcggaatacatgcatatcacctctaccgaagaaaaacgctggatccagcagcgcattgaatcggtagctggcaaagcgagctttaccgcggaagagaaaaaacgcttcctcagcgaactgaccgccgcggaaggtctggagcgctacctcggcgccaaattcccgggggcgaagcgcttctcgctggagggtggcgacgccctgatcccgatgctcaaagagatgatccgccatgcaggcaaaagcggcacccgcgaagtggtgctgggcatggcgcaccgcggccgtctgaacgtgctggtcaacgtgctgggtaaaaaaccgcaggacctgttcgacgagttcgcgggcaaacataaagaacacctcggcaccggcgacgtgaagtaccacatgggcttctcttccgatatggaaaccgaaggcggtctggtgcacctggcgctggcgtttaacccgtcgcacctcgagatcgtcagcccggtggttatcggttccgtacgcgcccgtctggatcgtctggacgagccaagcagcaacaaagttctgcctattaccatccacggcgacgccgccgtcaccggccagggcgtggttcaggaaactctgaacatgtccaaagcccgcggttacgaagtgggcggtaccgtgcgcatcgttatcaacaaccaggtgggcttcacgacctctaacccgctggatgcgcgctcaacgccgtactgcaccgacatcggtaaaatggtgcaggcgccgatcttccacgtgaacgcggacgatccggaagcggtcgccttcgtcacccgtctggcgcttgatttccgcaatacctttaaacgcgatgtcttcattgacctggtgtgctaccgccgtcacggccacaacgaagccgatgagccgagcgcaacccagccgctgatgtatcagaagatcaaaaagcatccgactccgcgcaaaatctatgctgacaagctggagcaggagaaggtggcgactctggaagatgcgaccgagcaggttaacctctaccgcgatgcgctggatgccggcgaatgcgtggtgcaggaatggcgtccgatgaatatgcattcctttacctggtcgccgtacctcaaccacgagtgggacgagagctatccggataaagttgagccgaaacgtctgcaggagttggccaaacgcatcagcacggtaccggaaggtatcgagatgcagtcccgcgtggcgaaaatttatgccgaccgccaggcgatggcggcaggcgagaagctgtttgactggggcggtgccgaaaacctggcctacgccacgctggttgacgaaggtattccggttcgtctgtccggcgaagactccggccgcggcaccttcttccaccgtcatgcggtgatccataaccagaccaatggttcaacctacacgccgctgcagcatgtccataacggccagggccagttccgcgtttgggactcggtgctgtccgaagaagcggtgctggcgttcgaatatggttacgccaccgccgagccgcgcactctgaccatctgggaagcgcagtttggcgacttcgccaacggcgcgcaggtggtgatcgaccagttcatctcctccggtgagcagaagtggggaaggatgtgcggcctggtgatgctcctgccgcacggttacgaaggccagggcccggagcactcctccgcgcgtctggagcgttatctgcagctgtgcgctgaacaaaacatgcaggtctgcgtgccgtccacgccggcacaggtttatcacatgctgcgtcgccaggcgctgcgcggtatgcgtcgtccgctggtggtgatgtcgccgaagtcgctgctgcgtcatccgctggcggtttccagcatggatgagctggcgaacggcactttcctgccggctattggtgaaatcgatcaacttgatccgcaggctgtgaagcgcgttgtgctgtgctctggtaaggtttactacgacctgctggaacagcgccgcaaaaacgagcaaaaagatgtcgctatcgttcgtatcgagcagctctatccgttcccgcatcaggcggtgcaggaagcgctgaaagcgtatgcgcacgtgcatgattttgtctggtgccaggaagagccgctcaaccagggcgcatggtactgcagccagcatcacttccgtgaagtgattccgtttggggcctctctgcgttatgcaggccgcccggcctccgcctctccggcggtagggtatatgtccgttcaccagaaacagcaacaagatctggtcaatgacgcgctgaacgtcgattaattaaaggatacacaatgagtagcgtagatattctggttcccgacctgcctgagtccgtagctgacgcaaccgtcgccacctggcacaaaaaaccgggcgacgcggtcgtccgtgacgaagttctggtcgaaatcgaaactgacaaagtggtactggaagtaccggcatcagcggacggcattctggatgcagtgctggaagacgagggcgccaccgtcctgtctcgccagatccttggccgcctgcgcgaaggcaacagcgcaggtaaagaaagcagcgagaaagccgatgcgaaagcgtccactccggcgcagcgtcagcaggcctctctggaagagcagaacaacgacgcgctgagcccggcgatccgtcgtctgctggctgaacacaaccttgacccagcggccatcaaaggcactggcgtcggcggccgtctgacccgcgaagacgttgagaaacatctggcgaaagccccggcgccggcagaagccaaagcgccagccgccgccccggcagccgcgccggcgccgcagctgggccaccgttcggaaaaacgcgtcccgatgacccgcctgcgtaaacgcgtagccgaacgtctgctggaagcgaaaaactctaccgccatgctgacgacctttaacgaagtcaacatgaagcccatcatggatctgcgtaagcagtacggtgaggcgttcgaaaaacgtcatggcatccgcctgggctttatgtccttctacgtgaaagcggtagtggaagcgctgaaacgctatccggaagtgaacgcttccatcgatggcgacgacgtggtgtaccacaactacttcgacgtcagcatggccgtttccactccgcgcggtctggtcaccccggttctgcgtgacgtcgacctgctgggcatggcggatatcgaaaagaatatcaaagagctggcagtgaaaggccgcgacggcaagctgaccgtagacgacctgaccggcggtaacttcactattaccaacggcggcgtcttcggctccctgatgtccacgccgatcatcaacccaccgcagagcgctattctgggtatgcatgccattaaagaccgtccgatggcggtcaatggcaaggtagagatcctgccgatgatgtacctggcgctctcctatgaccaccgtctgatcgacggacgtgaatcggtaggcttcctggtggcgattaaagagctgctggaagatccgacccgtctgctgctggacgtgtagtcagcaagcgtattacctaccgtaggccggataacacgcgttagcgccgttatcaggcctacaggtttaaagataattacaccctgaaggatggactgaacacatgaacttacatgaatatcaggcaaaacaactttttgcccgctatggcttaccggcgccggtgggttatgcctgtactactccgcgtgaagcagaagaagccgcttcaaaaatcggcgcgggtccgtgggtagtgaaatgtcaggttcacgctggtggccgcggcaaagcgggcggtgtgaaagtagttaagagcaaagaagagatccgcgcatttgccgagcactggctgggcaaacgtctggtgacctatcaaacagatgcgaacggccagccggttaaccagatcctggttgaagcggcgaccgatattgacaaagagctgtacctgggcgcggttgttgaccgcagctcccgtcgcgtggtgttcatggcgtctaccgaaggcggcgtggaaatcgagaaagtggcggaagagaccccgcacctgatccacaagatcgccatcgatccgctggcgggcccgatgccttaccagggtcgtgaactggcgttcaaactgggtctggaaggtaaacaggttcagcagttcaccaagattttcatgggtctggcgaccattttccttgagcgcgacctggcgctgatcgagatcaacccgctggtgatcaccaagcagggcgacctgatctgcctcgacggcaaactgggcgctgacggcaacgcgctgttccgccagccggatctgcgcgaaatgcgcgatcagtctcaggaagacccacgtgaagcgcaggcggcgcagtgggaactgaactacgtcgcgctggacggcaacatcggctgcatggttaacggcgcaggcctggcgatgggtaccatggacatcgttaagctgcacggcggcgaaccggctaacttcctcgacgtaggcggcggcgcgaccaaagagcgcgtgaccgaagcgttcaaaatcatcctctctgacgacaacgttaaagcggtgctggttaacatcttcggcggcatcgtgcgttgcgacctgatcgctgacggcatcatcggcgcggtagcggaagtaggggttaacgttccggttgtggttcgtctggaaggtaacaacgccgaactgggcgcgaaaaaactggctgacagcggcctgaatattattgcagcgaaaagtctgacggacgcagcacagcaggttgttgccgcagtggaggggaaataatgtcagttttaatcaataaagataccaaggttatctgccagggcttcaccggtagccaggggaccttccactctgaacaagcgatcgcttacggtacgcaaatggttggcggcgtgacgccaggcaaaggcggcaccactcacctgggcctgccggtgttcaacaccgtgcgcgaagccgttgaagcgaccggcgcgaccgcgaccgtgatctacgttccggcgccgttctgcaaagattccatcctggaagcgatcgacgcgggcattaagcttatcatcaccatcaccgaaggtatcccaacgctggatatgctgaccgtgaaggtgaagctggacgaagcgggcgtgcgtatgatcggcccgaactgcccgggcgttatcactccgggcgagtgcaaaatcggcatcatgccgggtcacattcacaagccgggtaaagtgggcatcgtttcccgttccggcaccctgacctatgaagcggttaagcagaccaccgactacggcttcggccagtctacctgcgtcggtatcggcggcgacccgatcccgggctccaacttcatcgatatcctgaagatgttcgaggaagatccgcagaccgaagcgatcgtcatgatcggtgagatcggcggcagcgcggaagaagaagcggctgcttatattaaagatcatgtcactaagccggttgtcggctacatcgcgggcgttaccgcgccgaaaggcaagcgtatgggccacgcgggcgctatcatcgccggcggtaaaggtacagcggatgagaaattcgcagcgctggaagcggcgggtgtgaaaactgttcgcagcctggccgacatcggcgaagcgctgaaagctattatcaagtaaaccctctctgcttgtccgcaagcagaaatctgtccgatttcgacatggttggccaccgtcaggtggccttttttgtgaccgttatcccgtctcgtcagaaccgcagcgccaacaacgaattgattttctgcgaaaagccctatctatcatattgatttaatttattatttaataagtattttcgatgcgctgtactggctaaaaaatatatcccggctgtaccgttgggaaacaaaagcggcagcgaaaaagcgtggggcaggggataaggaagaagataaaatactgtgagcggtctaacattattcggatcggttccttttttttgttttttttccacgacgttaaataatattacctatgattctcatatctctctttttagtaactggaaaagccatagtttaaacacttaattaacattaagttcaccaatattctttattgggctacataattaacacatagagtaaaaattgatttatatcaatacttaatccttggaaaaatccctcaaaaaacgttaaattgtctcaagtcaaattggctgaattcagccatcttcactatatattgatcaccgtcgaaaaatgtaaaactggaacaataaaaacatatttattgtaaggttattgcggcgtaatatattggggaatcaattgggtttttcgttaacgtatttgtaaccttaccctggcatggttttaccttcgattgaaacctgctgtggacgggcgacaaataaatttgtattggggcatgcgtatgagccagagcttctcggttcattttcggagtcttcatgcgatgagcaaggagtcatgatgttagatatagtcgaactgtcgcgcttacagtttgccttgaccgcgatgtaccacttcctgtttgtgccgctaacgctcggtatggcgttcctgctggccatcatggaaacggtctacgtcctttccggcaaacagatttataaagatatgaccaaattctggggcaagttgtttggtatcaacttcgcgctgggtgtggcgaccggtctgaccatggagttccagttcgggactaactggtcgtattactcacactacgtgggcgatatctttggtgcgccgctggccattgaaggtctgatggccttcttcctcgaatccacctttgtaggtctgttcttcttcggttgggatcgtctgggcaaagttcagcacatggccgtcacctggctggttgcgctgggttccaacctctccgcgctgtggatccttgtcgccaacggctggatgcagaaccctatcgcatcggacttcaacttcgaaaccatgcgtatggagatggtcagcttctctgaactggtgctcaacccggtcgcccaggtgaaattcgttcacactgtggcgtcgggctatgtcaccggcgcgatgttcatcctggcgattagctcctggtacatgctgaaaggtcgcgacttcgcctttgccaagcgctcctttgccatcgcagccagcttcggtatggcggcgatcctctccgttattgtgctgggtgacgaatccggttacgaaatgggtgacgtgcagaaaaccaaactggcggctatcgaagcagagtgggaaacccagcctgcgccggcggccttcaccctgtttggtattcccgatcagaatgcgcagaccaaccactttgcgatccagatcccctacgcgctgggcatcattgctacccgctcggtggacaagccggttatcggcctcaaggatctgatggttcagcacgaagagcgtatccgtaacggcatgaaagcctacgcgctgctggaacagctgcgcgccggttcaaccgatcaggccgtgcgtgaccagttcaataacgtgaagaaggacctcggttatggcctgctgttgaagcgctataccccgaacgtcgctgacgccacggaagagcagatcgccaaagcgaccaaagactccattccaagcgtcgcaccgctgtacttcgccttccgtatcatggtggcgtgcggcatcctgatgctgctgattataggcgcctccttctggagcgtgatccgtaaccgcatcggcgagaaaaaatggctgctgcgcgccgcattctacggcctgccgctgccgtggattgccgtggagtcgggctggtttgttgccgaatacggccgtcagccgtgggcgattggtgaggtcctgccgacggcggtggctaactcatcattgaccgcgggcgacctgatcttctcaatgttgctgatctgcggtctgtacacgctgttcctggtggctgaactgttcctgatgttcaagtttgcccgcaaaggacctagcagcctgaaaaccggccgctatcactttgaacagtcctctgcggctattcagtcgacacgctaagacaggagtcgtcaaatgatcgattatgaagtattgcgttttatctggtggctgctgattggcattctgctgattggttttgccgtcgccgacgggttcgacatgggggtgggcatgctcacccgcttcctcggccgcaacgacaccgagcgtcggattatgatcaacgccatcgccccgcactgggacggtaaccaggtgtggctgatcaccgccggtggcgcgctgttcgctgcctggccgatggtttacgccgcggcgttctctggcttctatgtggcgatgattctggtgctggcctcgctgttcttccgtccggtcggttttgactaccgttccaagatcgaggacacccgctggcgcaacatgtgggactggggcatcttcatcggtagcttcgtgccgccgctggtgattggcgtggcctttggcaacctgctgcagggcgtgccgttccacgtcgatgaatacctgcgtctgttctataccggtaacttcttccagttgctgaacccgtttggtctgctggccggtatcgtcagcgtggcgatgatcctgactcagggcgccacctacctgcagatgcgtaccgtaggcgaactgcacctgcgtactcgcaccgtttccatggtggcggcgctggtgacgctggtctgcttcgcgctggcgggcgtgtgggtctactacggcatcgacggctatgtggtgaaatcggtgattgaccataccggcccgtctaacccgctgaccaaggaagtggtgcgggaagctggcgcgtggatggtgaactttaacaatatgccagcgctgtgggcggtgcctgccctgggcgtggtgttgccgctgctgaccgtcgtttcgaccaaagcggataaaggtgcctgggcattcctgttctcctcgctgaccctggcctgcatcattctgactgccggtatcgcgatgttcccgttcatcatgccgtccagcaccatgctgaacgccagcctgacgatgtgggacgcgacctccagtcagcggacgctgaacctgatgacctacgtggcgattgttttcgtgccgatcattctggcctacaccagctggtgttactggaagatgtttggccgcatcacgcgcgaagacatcgaaaagaatacccactcgctgtactaaggtaaggagctatatatgtggtacttcgcatggattttgggaacgcttcttgcctgtgcttttggggtcattaccgcgctggcgcttgagcacgtggaagccaccaaagccgggaagaaagaagaaatctgatgaaatttatcgctactctgtacgcgataatggacaagcgcccgctccgggcgctttccttattgatggcgctgctgctggctggctgcattttctgggatccgtcgcgctttgcggcgaagaccagcgagctggaaatctggcatggtttcttgctgatgtgggcggtttgcagcggcgttattcacggcgtgggctttcgcccgcgtgccgttcactggcaggggattttttgtccgcttatcgctgatatcgtgctcgctttaggtctcttctttttcttcttttgaataagagatctctgttaatgctatgggcttgcataagcccataaaaatttacgccccgtttactttcccccattccaaaccacctttcccgcgcgtatagtagcgaagtttgaaagctctaacctttttttgcattaccgggatgtaaagtgaatacaacgctgtttcgatggccggttcgggtctactacgaagataccgatgccggtggtgtggtttaccacgccagttacgtcgctttttatgaaagagcacgcacagagatgctgcgccaccatcactttagtcaacaggtgctgttggctgaacgcgttgccttcgtggttcgcaaaatgacgctggagtattttgcccccgccagactcgacgacatgctcgaagtccagacggaaattacctcgatgcgcggcacctctttggttttcacgcagcgaatcgtcaacgccgagaatacagtgttaaacgaagctgaggttctcattgtgtgcgttgatccactcttaatgaagccacgtgcgcttcccaagtctattgtcgcggagtttaagcagtgactgacatgaatatccttgatttgttcctgaaggcgagccttctggtaaaacttatcatgttgattttgattggtttttctatcgcttcctgggctatcattattcagagaacgcgtatccttaactcggccgcgcgtgaagctgaagcgttcgaggacaaattctggtccgggatcgagctctctcgtctgtaccaggagagccaggggcgtcgcgataacctgaccggttcggaacaaatcttctacagcggtttcaaagagtttgcgcgcctgcatcgggccaacagccatgcgccggaagcgattgtcgaaggggcatcgcgcgcgatgcgtatttcgatgaaccgcgaactggaaacgctggagacccatattccgttcctcggcaccgtaggctcgatcagcccgtatatcggtctgttcggtaccgtctgggggattatgcacgcctttatcgcccttggcgcggtgaagcaggccaccctgcagatggtggcgccaggtatcgccgaagcgctgatcgccaccgcgattggtctgttcgccgcgatcccggcggtcatggcgtataaccgcctgaaccagcgcgtgaacaagcttgaactgaattacgacaactttatggaagagttcaccgctattctgcaccgtcaggcctttaccaccagcgaaagcaataaggggtaagccatggccagagcacgtggacgcggacgtcgcgaactgaagtccgagatcaacatcgttccgctgctggatgtcctgctggtgctgctgctgatctttatggcaacggcgccgatcattacgcagagcgtggaagtcgatctgccggacgccacggaatcgcaagcggtgaaaagcaatgacgatccgccggtgattgtggaagtctccggggtagggcagtacagcgtgaaggtggggcaggagacgctgtcccagctgccgccggagcaggtaattgccgaagcgaagcgtcgtcttgaagccaatgaaaaaacggtattcctgatcggcggtgcgaaagacgtcccttacgatgaaattattaaagcgctgaacctgttgcatagtgcaggggttaaatcggtcggcttgatgaccaaacctatttaatcgcttcaggtaggtgcgtccgtgcggcgtccggtggcgggtatcgctcgccgtcggtgcgcatcgcggatacaggcgaacagtttttgggaaccgatagtgtcaaaggcaaccgaacaaaacgacaagcttaaacgagcgatcatcatttcagtcgcgctgcacatcattctgatcgcgctgctgatctggagttcgtttgacgagcatctggatgcctctgccggcggcggcggcggatcgtcgattgatgccgtcatggtcgatccgggggcggtggtaaataactataaccgtcagcaacagcagcaggccagcgcacgtcgcgccgctgaacagcgtgaaaaacaggcgcagcagcaggcggaagagttacgtgagaaacaggcggcggaacaggaacggctgaaacagctcgaacaggagcggctgcaggcgcaggaagcggcgaaagaagcgaaggagcagcagaagcaggctgaagaagcggctgccaaggccgccgcggcggcaaaagccaaagcggacgcacaggcaaaagaagcgcaggaagccgctgccaaagcggccgccgaggcgaaagcgaaggcggatgcccaggcgaaagcggcagaacaggcggcggccaaggcggctgctgaggcgaagaagcaggccgaagccgctgcagcgaaagccgctgccgaggcgaagaaacaggcggaagctgaagcggcgaaagctgcggccgaggcgcagaagaaagcggaagcggcggctgcgaagaaagcgcaacaggaagcggagaaaaaagcccagcaggaagcggctaagcaggcggcagctgaaaaagcggctgctgagaaagccgccgcgcaaaaagcggccgctgagaaggccgccgccgagaaagccgcagccgctgaaaaagcggcggcagcgaaagcggctgcagcagagaaggctgcagctgataaagcggccaaggcggcagcagcaaaagccgcggcggcgaagaaagcggcggctgcgaaagaagcggacggcgttgacaacctgctcggcgatctgagttctggtaagaatgcgcctaaaacaggcggtggggccaaaggaaacaatgcctccgctgccgggagtggtaatactaaaaacagtgcctcaggggctgatatcaacaactatgccggacagataaaatcggcgattgaaagtaagttttatgacgcatcgtcctatgcgggcaaaacatgtaccttgcgtatcaaacttgctcctgacggtctgttgttaaatatacagtccgaaggtggtgatcctgctctgtgccaggccgctcttgccgcagcccgacaggctaagtttccgaaaccacctagccaggcagtatatgaagtcttcaaaaatgcgccactggacttcaaacctcagtgacatttttccccgtgcaaacggggaaaaacaatctatggtagtcacagggttttggtagttttgtatatttgagtttgttaacattctgctaaattatcgtgggctttctgcccggataagggagatatgatgaagcaggcattacgagtagcatttggttttttaatgctgtgggcggcggtgctgcacgcagaagtacgtatcgagatcacccagggggtggactcggcgcgccctatcggcgtggtaccgttccagtgggccggccagggcgctgcgccggaagatgtcggtggtatcgtggcagctgacctgcgcaacagcggtaaattcaatccgctggatcgctctcgtctgccgcagcagccgaccagtgcccaggaagtgcagcctgctgcctggtctgcgctgggtattgacgccgtagtcgtcggccaggtcacgcaaaatccggatggttcttatcaggttgcgtatcaactggtggacaccggcggagcgccgggcacaacgctggcgcaaggttcttttaaagtcactaagcagtacctgcgctatgcggcgcacgcggccagcgacgcggtatttgagaagctgaccggcatcaagggcgccttccgtacccgtatcgcctacgtggtgcagaaaaacggcggccagtacccttacgaactgcgcgtgtccgactacgatggttacaaccagttcctggttcaccgttcctcccagccgctgatgtccccggcctggtctccggacggttctaaactggcctacgttacctttgaaagcggtcgttctgcgctggtggttcagaccctggcgaacgcctctgtgcgtcagatcgcctccttcccgcagcacaacggcgccccggcgttctcaccggatggttctaaactggcgttcgcgctgtcgaaaaccggtagcctgaacctgtacgtaatggatctgggatcgggtcagattcgtcaggtgaccaacggtcgcagcaacaacaccgaaccaagctggttcccggacagccagaatctggccttcacctctgaccaggcaggtcgtccgcaggtatataaagtcaacattaatggcggcacgccgcagcgtatcacctgggaaggttctcagaaccaggacgccgacgtgagcgcggatggtaaaaccatggtaatggtcagctcggccggcggtcagcagcacattgccaaacaagatctggaaacgggtggtgtacaggttctgtcatcaacgtttttagacgaaacgccaagtctggcacctaacggcactatggtaatctacagctcttctcaggggatgggatccgtgctgaatctggtttctacagatgggcgtttcaaagcgcgtcttccggcaactgatggacaggtaaaatcgcctgcctggtcgccgtatctgtgataataaataattgattattaaaggaatcaaagaaatgcaactgaacaaagtgctgaaagggctgatgatcgctctgccggttatggcaatcgcggcatgttcttctaacaagaacgccagcaacgaccagagcggtgaaggcatgctgggtgccggcactggtatggacgctaacggtaacggcggcaacatgtcttctgaagagcaagctcgtctgcagatgcagcagctgcagcagaacaacatcgtttacttcgatctcgacaagtacgatatccgttctgacttcgctgctatgctggacgcgcacgctaacttcctgcgcagcaacccgtcctacaaagtgactgtagaaggtcacgcggatgagcgcggtacgccggaatacaacatcgctctgggtgagcgtcgtgctaacgccgttaagatgtatctgcagggcaaaggtgtttctgccgatcagatctccatcgtttcttacggtaaagaaaaaccagcagtactgggtcatgacgaagcggcatatgccaaaaaccgtcgcgccgtactggtttactaagagaattgcatgagcagtaacttcagacatcatttattgagtctgtcgttactggttggcatagcggccccctgggccgcttttgctcaggcgccaatcagtagtgtcggctcaggctcggtcgaagaccgcgtcactcaactcgagcgtatttccaatgctcacagccagcttttaacccaactccagcaacaactctctgataaccagactgacattgattctctccgcgggcagatccaggagaaccagtatcagctgaatcagatcgttgagcgccagaaacagattctgctgcagatagatagtctgagcagcggtggcggcgcagcatcaggtgcgcaggctccgtcgtcttctggcgatcagagcgcggctgccaccagcgcagcgccagcggccacctcaggcgccccggcgatgaccggcgatgcgaacaccgattataatgccgctattgccctggtgaaggatgcctcacgccaggatgacgcgatggtggcgtttcaaaacttcgtcaaaaagtacccggattcaacctaccagccaaacgctaactactggctcgggcagttgaactacaataaggggagaaaagacgacgcggcgttttacttcgcttcggtagtgaagaactacccgaaatcgccaaaagcgcctgacgcgatgtttaaagtcggcgtgatcatgcaggacaaaggtgataccgcgaaagcgaaagcggtttaccagcaggtgatcaataaattccccggcaccgacggtgcgaaacaagcgcaaaaacgacttaatgctcttggttgattacggcatgaccagaaatcgcgttatttctggtcttgtcgcctgaatcgccagcagttaagtgatctttatcgaaattttagttgcgctgaattctgaaatcagtaatatatgccgccgttgccaagggatatcaaacaagcccaaagcaatgccagagtgggtcgttagctcagttggtagagcagttgacttttaatcaattggtcgcaggttcgaatcctgcacgacccaccaatcgttctggtggaacgcgatagtaaaacgtgaaggataacgttgcgtcagcaacggcccgtagggcgaggcgaagccgagtcatcctgcacgacccaccgcttagtagtatccagcgtagtatcgggtgattagctcagctgggagagcacctcccttacaaggagggggtcggcggttcgatcccgtcatcacccaccaccgggtcgttagctcagttggtagagcagttgacttttaatcaattggtcgcaggttcgaatcctgcacgacccaccatctttaacatcgaacgtcggtgttaaacgtgaaggataacgttgcttcagctacggcccgaagggcgagcgaagcgagtcatcctgcactccaatcatttttatgatggggtaggtggacgcagtatcggtagtatccagcgcagtttcgggtgattagctcagctgggagagcacctcccttacaaggagggggtcggcggttcgatcccgtcatcacccaccactcgggtcgttagctcagttggtagagcagttgacttttaatcaattggtcgcaggttcgaatcctgcacgacccaccaatttcagcatttaactcagatgctgaacgtgaaggataacgttgcgtcagcaacggcccgaagggcgaggcaaagccgagtcatcctgcacgacctaccaatttctgaattggtgtcgagtgaaattattcaggtagtaccagagcgggtcgttagctcagttggtagagcagttgacttttaatcaattggtcgcaggttcgaatcctgcacgacccaccaatttcagcatttaactcagatgctgaacgtgaaggataacgttgcgacagcaacggcccgaagggcgaggcgaagtcgagtcatcctgcacgacccaccatcctgaatgatggcagcagtaaaatcccgcaaggggtcgttagctcagttggtagagcagttgacttttaatcaattggtcgcaggttcgaatcctgcacgacccaccaatgtaaaaaggcgccctaaaggcgcctttttgctatctgcattttccctgccactcatcaatgttaatactttcttaattcatcattttcccacggtcacgctgcgcttaccgtgcctgcacaggatacgaaccggtcgttcgggcagatgcgcagcaccgtccccgggaaaagggtctgatgtacaaaattcatcacgacttttagctcgtaatcggctatcttgtttagcatataaaacaccatgaccgtattaagccgccgacaggccatactgacggttatagagttaagccagtaaaacgagattgcatgatgagcgtaatgtttgatcctgaaacggcgatttatcctttccctgctaaaccgcagccgctgaccgtcgacgaaaagcagttttaccgcgaaaaaatcaagcgcctgctacgcgagcgcgatgccgtgatggtggcgcattactacaccgatcctgaaattcaacagctggcggaagagaccggcggctgtatcgccgactcgctggagatggcgcgctttggcgcccgccattcggcctccacgctgctggtcgccggggtgcgttttatgggggaaaccgccaaaattctcagcccggaaaagaccattttgatgccgaccctgaacgccgagtgttcattggatctgggctgtccgattgaggaattcaacgccttttgcgacgcccatcctgaccgcaccgtcgtggtctatgccaatacgtccgccgcggtgaaggcccgcgccgactgggtggtgacctccagcatcgccgtggaactcattgaccatctggatagtcttggtcaaaagatcctctgggcgccggaccgccaccttgggcgttacgttcagcgtcagaccggcgcagacgtgctgtgctggcagggggcgtgcatcgtgcacgacgagtttaaaacccaggcgttgatgcggatgaaggctctgcatcccgaagccgccgtgctggtccatcccgagtcgccgcaggcgatcgttgagatggccgatgccgtaggctccaccagccagctgattgcggcggcgaaaagcctgccccagcgccagctgatcgtggccaccgatcgcggtattttctataaaatgcagcaggcggtgccggagaaaacgctgctggaagcgcccaccgccggcgaaggagcgacctgtcgcagctgcgcgcattgtccgtggatggcgatgaatggcctgaaagccattgccgagggtctcgagcagggcggcgctgcacatgaaatccatgtcgacgaagcgctgcgaaccggcgcattaattccccttaaccggatgctggattttgcggctacactacggggataacctattgtcgcgtcgccagacgctgaggggaggaaatggatttttttagcacgcagaatattttagtacatatacccatcggcgctggggggtacgatctctcctggatagaggccgtggggacgattgccgggctgttgtgtatctggctggcgagcctggagaagatcagtaactatgctttcgggctggtcaacgtcacgctgttcgccatcatcttctttcagatccagctgtacgccagcctgctgctgcagctgttcttttttgccgctaacgtttacggctggtatgcatggtcgcgacaaagcagcaaccatgaggctgagctgcagatccgctggctgccgcgcagcaaagcgctgggctggctggcggcctgcgtggtagcgatcggcttgctgaccctgtttatcaacccgttctttgctttcctgacgcggatcgcggtcagcctgatgcaagcgctcggtttgcaggtcactatgccggaactgcagccggatgctttcccgttctgggactcctgcatgacggtgctgtcggtggtggcgatgatcttaatgacccgcaagtatgttgaaaactggctgctgtgggtgatcgtcaacgtgataagcgtggtgatttttgcccgtcagggcgtctatgccatgtcgctggaatacctcttgctgacgttcattgcgttgaacggcagccggatgtggataaacagcgcgcgtgagcgaggttctcacgcgttttctggctaatggtggtggtgatgatcgtgcccggcgtgcatcgtgttgagatggcactccgggccgctgcagggctggtactccatctgcaccgtggcatgcgcaatttcatatttatgttccaggaaatgcaggatgcggttgagtaacgcgtcatggtcgtgcggtggaacgacctgtacatggagcgtcatcaccggtttttcccccaccagccagacgtggacgtggtgaacatcgcgtacctccgggatagagcgacggatatcccgctgcagggccgccacatccagcgaacgcggcgcgccttccagcaattcattcagactctctttcagtaatcgccaggcactacgtaataccaggcaggaaaccagcacggaaagaatcgggtcgacaggcgtccagccggtggtgaggatcaccacggccgccacgatcgcgccgaccgagcccagcaggtcgccaagcacgtgtagcgctgcggcgcgtacgttaagattccgctcctcgctaccccgatgtaggatccaaaacgccagcacgttggccagcagaccggcgactgcaatgaccatcatcgtcacgccggctaccggctgcggatgctggaagcgctgaatcgcctcccagacaatcagcatggtgatcaccaccagagcaatagcattgagaaacgccgccagggtggttaaacgcaaccagccaaaggtatggcgggcatttggtgggcggctggcgaagcgaaccgccagcagcgcaaacagcagagcggcggagtcggtgagcatatggccggcatccgccagcagggccagcgagccggagatcgcgccgccgacggcttcaatcagcataaagccggcggtgacgataaacgcccatagcagccggcgggcgttgctgttatccggagcctggacagaggagtgcgaatgcgagtgcgccatagtgtcgtcccttaatagttatcattattacgctatgacatcataaacagagagcgataaaaaacgaagaaaaggcgagaccggctcgccttttcttcgatctgcccacctcatgtgttactgggtggtgccgtcggttttgctgttgtcttgggtcgtattgccgccgttgtccagttttttaccggtgtccggacagcggccgtctttacacatcgagtttttatgcacctcatcgctcgacatattatcctgggtcatcgtcgagcccgtggtgcccccagagccagagttgatctgactattgtccacgttgttcggcgccacgttctcacgggcatccggcgccacctgaccggcatccgcggaagagttggcctggccattattggactgggcaccggtgtctgccgccagggccgcgccgctggcaagacctaaggtggcggtgagcaaaagggtcgtcagttttttcatattcatcggatactcctgttaagccgggaaggggaaatgcgcttcccgcggtgagtgtgccagggatctgactcgctatggtttaagactccgcagacgatcgcagtgtcactatataatcctgaaacgtaagacttaattagctttaacagttaaatattgtagttcatgagcctggtttcgctactttatggcgtatttttgcctatttccaggattattccatcactactgtaaaatcacgtttacactatttcagcgaagagatagattggagggattgcatttcattgaataagtatggcaacgctggaaagaagatgaattatcagaacgacgatttacgcattaaagagatcaacgaattattacctcccgttgcgctcctggaaaaattccctgctaccgaaaatgctgcaaacaccgttgcacatgctcgcaaagcgatccatcagatcctcaaaggcgacgatgaccgtctgctggtggtgattgggccttgttctattcacgatccggcagcggcgaaagagtatgccgcccgcctgctgaccctgcgcgaggcgctgaagggcgagctcgagatcgtcatgcgggtctattttgaaaaaccgcgcaccaccgtcggctggaaagggctcatcaacgatccccatatggataacagcttccgcatcaacgacgggttgcgcatcgcgcgcaaactgctgctggacattaacgacagcggcctgccggcggcgggggaattcctcgatatgatcaccccgcagtatgtcgccgatctgatgagctggggcgccattggcgcgcgtaccaccgaatcccaggtgcaccgtgagctcgcctccggactctcctgcccggtgggctttaaaaacggtaccgatggcaccatcaaggtggctatcgatgcgattaacgccgccggcgcgccgcactgtttcctgtcggtcaccaagtggggccactccgccatcgtgaataccagcggtaacggcgactgccatattattttgcgcggcggcaaagagcctaactacagcgcgaagcacgtggcggaggtgaaaatcggtctggcgaaagcgggtcttccggcccaggtgatgatcgacttcagccatgccaactccagcaagcagttcaagaagcagatggaagtgggcgccgacgtatgccagcagatcgccggcggcgagcgcgccattatgggcgtgatgattgaaagccatctggtggaaggcaaccagagcctcgagagcggtgaaccgctgacctacggcaagagcgtcactgacgcctgcatcggctgggaggataccgaaacgatcctgcgtcagctggcggaagcggtgaaaacccgccgcggctaagctactccgcgctagcgcaggtcataaaaaaagcgtggagatttccacgcttttttgttctcaccaggagaaattacttcgctttaccctggttggcgacggcagcagctttcgccgcgatctcttccgcgttgcccagatagtaatgtttgatcggcttgaagttttcatcgaactcatataccagcggtacgccggtcgggatgttcagttcgaggatctcgtcttcgcccatgttgtcgaggtatttcaccagcgcgcgcagggagttaccgtgagcggcgatgatcacgcgctcaccgcttttcaggcgcggcagaatggtttcgttccagtaaggcacgacgcggtcgatggtcagcgccaggctttcagtggtcggcagttcggcgtcggtcagttttgcatagcgcggatcgtggcccgggtagcgctcgtcgtctttggtcagctccggcggagtgacagcgaagccgcgacgccactgtttaacctgctcgtcaccgtatttttcagcggtttccgctttgttcaggccctgcagcgcgccgtaatgacgctcgttcagcttccaggatttctcaaccggcagccaggcctgatccagttcgtccagcacgttccacagggtgtggatggcacgtttcagcacggaggtataagcaaaatcaaagctgaagccttcagccttcagcagtttacccgctgctttcgcttcgctaacgcctttctcggacagatccacgtcgtaccaaccggtgaagcggttttcgttgttccactggctttcgccatgacgaaccagtaccagcttagttacagccattctctcactcctctctacacgccatccctcgcgccgcgaacggtgcgctgaatgtgatggtgtatgtgttattgattgataactattctcattatattgccgtgatttggcgcacggcaatgcttatccctaaccatagcgaaaatagtggcgcagtgtaaggtgcttgtaatacacaggttatttttttgtcctttggtgacggaaaatagagcaggttgctgaaaaaagaggcggcagagaggagggcggggacgaaaagcagcgccccctgatggagggcgctggcgattatcgggcgataaactgatattccgtcaggctgacgtactcctggcccggacgtaatacacagtccggctgcggccattgcggatggttcggcgaatccggcaggaattcgctctccagcgccagcccctgccagtcggcgtagggctccgtcgtctgcgacggggtgccgccgagatagttgccggagtaaaactgcagcgccggagcggaggtatagaccgtcatctgcagcttgccatcctgcgaccagacctgtgccgcaggctggctggcgtcgcctttggcatccagcaggaaggcatgatcgtatcccttcaccttttgctgatcggcatccgcgaggaagtcggcggcgatggttttcggctggcggaaatcaaagctggtgttagcaacatctttcagttcgccacccgggataccgtcgctttccaccggcagatacctctgggcgaggatctggagctgatgctggcgcacatcgccctgctcaccgtcgaggttgaaatagacgtgattggtcatattcaccgggcagggttggtccacggtggcgcgataggtaatcgcgatgcggttatcgtcggtcagacgatagtgcgcggtggcctgcagggtgcccggaaagccttgatcgccatcgggcgaggtcagggcgaacagcacttcctgctcgtcggcgcggacaatgcgccagcggcgcttatcaaacccttccgggccgccgtggagctggtggcccgcgtcgtttgacggcgtgacgttgacgacctggccgtcaagcgggaaacggctgtggccgatacggttggcgtagcggcctaccgaggcgccaagaaatgcggcctggcgagcatagtcttccagctttgcgcagcccagcagcggtcggcgcaggctgccatcggccagcggcacctcggcgctgagcagcgtcgcgccccagtccgccacggtgacggtcatccccgacttattgcgcagggtcacctgctgccatggctggccgtccggggccagcgcggtggtttgcgttagcattgcccggccccctgtgacggtttgcagacatagaatgtctctttaataccggttttcgcttcatactcgttggcaacggcctgctgaacggtatcgaccagttcttccgggattaacgctaccacgcagccgccaaagccgccgccggtcatgcgcacgccgcccttatcgccgatcgcggccttaacgatctccaccagggtgtcgatctgcgggacggtgatctcgaaatcatcacgcatcgaggcgtgggactctgccatcagctcacccatccgcttcaggtcgcctttttcgagggcgctggcggcttccacagtgcgggcattctccgtcagcacgtggcgtacgcgcttcgcgacgaccggatccagctcatgggcgacggcgttaaattgctcaagggtgacatcgcgcagggcgggctgctggaagaagcgcgcgccggtttcgcactgttcacgacgggtgttgtactcgctgccgacgagggtgcgcttaaagttgctgttgatgatcaccaccgccacgcctttcggcatcgagacggctttggtgcccagcgaacggcagtcgatcagcagcgcgtggtcttttttgcccagcgctgaaatcagctgagccatgatgccgcagttgcagccgacgaactggttttccgcctcctggccgttgagggcgatttgcgcgccatccagcggcagatgatacagctgttggaacacggtgccgacggcgacttccagcgaggctgaggagcttaaccccgcaccctgcggtacattgccgctgatcaccagatccgcgccgccaaagtggctgttccgctgctgcagatgctttaccacgccgcggacatagttcgaccactgctgggtgtcgtggctgataatcggcgcgtcgagagagaactcatcggtctgattgtcgtaatcggcggcaatcacccgcaccgtacgatcgtcgcgcggcgcacagctgatcaccgtctggtagtcgatagcgcaggggagcacaaaaccgtcgttgtaatcggtatgctcgccgatcaggttgacgcggcctggcgcttgaatgacatggctggccgggtagccgaaggcgtcagcgaacagggtttgggttttctctttcagactcatcattacactccggattcacgaaaatggacgtcgctgacggcgcgcagtcgttcggcagcttgctcggcggtcagatcgcgctgagtttcggccagcatctcataaccaaccataaacttgcggaccgtcgcggagcgcagcagcggcggataaaagtgggcatgaagctgccagtggttatggtcttcgtcgttaaacggcgcgccgtgccagcccatggagtaggggaatgagcactggaacaggttgtcgtaacggctggtcagctttttcaacgccagcgccagatcgctgcgctgggcgtcggtgagatcggtaatgcgctgcacgtgcgctttcggcaacagcagcgtttcgaacggccaggcggcccagtagggcaccaccgccagccagtgctcggtgtccaccaccgtgcggctgccgtcggccatttcgcgctgcacatagtccagcagcatcggctggccctgtgcggcgtaatactctttctgcagacggtcttcccgttccgcttcattgggcaggaaactgttggcccacacctgaccatgcgggtgagggttggagcagcccattgctgcccctttgttttcaaaaacctgcacccacgggtagcttttcccgaggtccgcggtctgttcctgccacgttttaaccacgtcttccaacgcttcaaggctcagttccggcagcgttttgctgtggtctggcgagaagcagatcacccgactggtgccgcgggcgctctggcagcgcatcagcggatcgtcactctccggtgcgtccggggtgtcggtcatcagggccgcaaagtcgttggtaaatacgtaggtaccggtgtaattcgggttggtgtcgccggtcacccgggtgttgcccgggcacaggaaacagtccggatcgtgggccggcaaggtctgttttgccggcgtttcctgcgccccctgccaggggcgcttggcgcgatgcggagaaaccagaatccactgtccggttaacgggttataacgacgatgtggatggtcaacggggttaaatacgctcatgaaggttccttagtctggataaccctgcggatgacgggactgccagtgccaggtgtcctgcgccatttcgtccaggttgcgcgttacgcgccagttcagctcgcggtcggccttggcagcatccgcccagtaggccgggaggtcgccatcgcggcgcggcgcgaaatggtagttaatgggtttgccgcaggccttgctgaaagcattgactacgtcgagcacgctgctgccgacgccggcgccaaggttgtagatatgcaccccggctttgtcagccagtttttccatggccgcgacgtggccatcggcgaggtccatcacatggatgtaatcgcgcacgccggtaccatcttcggtcggatagtcgttaccaaaaatggccagcgattcgcgacggccaacggcgacctgggcgatgtagggcatcaggttgttcgggatcccctgcgggtcttcccccatgtcgcccgacgggtgggcgccgaccgggttgaagtagcgcagcagggcaatgctccactccggctgggctttctgcaggtcggtcaggatctgctctaccatcagcttgcttttgccgtaagggctttgcggggtgccggtcgggaagctttcgacatacgggattttcggctgatcgccgtagacggtagcggaggagctaaagataaagttcttcacgccagcggcgcgcatggcagagactaatttcagtgtgccggtgaggttattgtcgtaatattccagcggcttggcgacggactctccgacggctttcagcccggcgaagtggatcactgcctcaatggcgtgatcgtggaggatctccgtcatcagcgcttcgttacgaatatcgccttcaataaaggtggcttctttgccgccgagacgttcaatcaccggcagtacgctgcgcttgctgttgcagagattgtcgaggatcaccacctcgtgtccctgctgcagcagttgaacgcaggtatgacttccaatgtaaccgctaccacctgtaaccagaactttcatgattcgctccattcggcttatcgtttgtgaggaagatagcatatcaaagaagtgaaaagtgtgacatagcacaagttagtggaatcgtttacactcaagggcgaaatgatatcattgaatatattttgctttaaaaacatgtcattatattattttggcgctatttttctgaaaaataccagggatctttcgatccccggcagggggcgtcaggccacggggccgagctgataagtgtaaccgtctccactgggaacgaacgccaggcgatgggtaatacagtccggggcatcttccgcatggtgcgagacaaacagcagctgtgtggccccttcgccaatcaacacgtcgacaaagcggcgcaccagctggcggttgagggggtccagcccctgcagcggttcatcgaggatcagcagggttggatgcttcaccagcgcgcggacgataagcgccagccgctgctggccccacgacagactgtgaaacggcgcgtcggcggtacgcttatcgatgccgagaatatccagccattgctgcaccagcttatgctgcttgtcggagaccgcctgataaatgccgatcgagtcaaaatagcccgacaggatgacgttgcggacgtttgtgctgacccggtagtccagatgcaggctgctgctgacgtagccgatatgctttttaatatcccagatggtctcaccgctgccgcgccggcggccaaagagcgtgagatcgttgctgtagccctgcggatgatccccggtgaccaggctcagcagcgtagatttaccggcgccgttgggaccgacgatctgccagtgttcgcccggattcacggtccatgagaggtgattgatgaccgggcgatcgttataggagaccacgccgtcgttgagcacgatacgcggcgccgagtctgtcagcgcatgacgggccggtgggacatccggctccggcagggtgatgccgtccagtttttcactgtgcgccagctgggcgaccagcgcctgctgcagcagggaagacttctcgcccgtctcgctaagggtgcagtcagccagcacgccggcgaattgcacaaactccgggatctcatcgaaacggttgagcaccagcaccagggtgatgccggcgctgtgcaggtcggccagcagggcagccagctgctggcgggagttgacgtcgagaccgtcgaaaggttcatcgaggatcagcagttgcggatcggtcatcagggcctgacacagcagggtcttacgcgtttccccggtcgacaggtatttaaaccggcggtccagcagggcgctgatgccaaactgttcggccaggcgcgcgcagcgggcaggatctttcacctcatcctggataatctccgcggtggtgcggccggtgtcttcttcgcctgggctgagcaggtcggtgttattgcgctgccactcgtcgctgaccagcttctgcaattgttcgaaggagaggcgggttacgcgggagaagtggctttcgcgctggccgctgagcagggtcaggtcgccggccagggcccgcgcgagggcggatttgccgctgccgttgctgccgacgaacgcccagctttcacccgccgccacgctcaggtggtctatttttaaggtctttgtatcgctcaggcgaaacgtgccttgcgaaatttgcaatgatgacatgatgtatcccattttttgcagcgatgtgcatcagggatacgacttcaggcgcgtaatgtcaatggggtcagcataacgtcgcgagaatgatgcgatcggcattgaagtaagcgatcgcctccgttccttccgccaggccagcggcctgcgcctgtggcagggtggcgcacagggtttgaccgtccgccagggtcatcagtacttcgcactgtccggacccgcattcgatatgactgatacgtcccgacagctggttatcggcctggcgggctgctgcgggatcgagggtgatgccgacccatggcgctttgagcaggaccagcacctcctggccctcatcgagtcccagcttctcagcgctttgcgcggtgatggcgacgttcaggcgggtttttccgtcagccaacagtacttccacgtgctgctgcacctgctggcgatcgcggccggtaatggtgccgaaccactggttgcgggcgctggtctgcagggaaaagcgcgagatggccgccagcaggctatccagcggcagggcatcgtcatcgctgagtacatcaaacgctttctgctggatctgcgccagcagatcgtacagctggatcagacgctgcccgtagcgggtcagcaccgcgccgccgccgccctttccgccggtggcgcgatccaccagcggctgttcgctgagctggttcatctcattgatggcatcccaagcgctcttatagctgatacccgcatgcttcgccccctggcttatcgaaccggtctggtcaatctgtttgagcagggcgatccgccgcggatcggcaaacaggcgctgctgtagcttaagggtgagaagaatttcggcctgcataatcgtttcctgacaaaaaagggtattgtgaccgatagtcgcccacttgcaaaacctctctgcgcggttggtcattacccaccgcacaaatgggacgtgttttttcggctgaaatcgttacaatcaggaaatcatactatctggagtgaaccatgttagagcttttgaaaagtctggtttttgcggtcatcatggtaccggtggtgatggcggtcatcctgggactgatttacggtcttggcgaagtgttcaacctcttctccggcgtaggccacaaagatcgcagccagcaaaatcactgatttcccggcgcccggtttaaccgggcgctgtgctatttccctcctgtatcatttccttcgttttattgtcctgtgtcactataaaaacgcttcgcatatcgttatattatcgactacataacgcattgacaggagagtaagatggcaggttcttggttacgcggggttgtcggggtatcactcacgctgtgcgtcgcgggtcaggcgctggcggcagagggtaaagtgaccgttttcgccgccgcatcgttaaccaacgcgatgcaggatattgccctggcgtacaagaaagaaaaaaacgtcgaggtcgtgtcgtcgtttgcctcgtcgtcgacgctggcgcggcagatcgaagcgggtgcgccagcggacctgtttatctccgccgatcagaaatggatggattacgcggcagataaaaaggccatcgatccggcaacccgcgccactctgcttggcaacagcctggtggtggtcgcgccgaaagccagtgcgcagggggcgataaccattgatgagaaaaccgactggaccagcctgctgaaaggaggccgtctggcggtgggcgatccacagcatgtcccggccggtatctatgccaaagaagcactgcagaaactcggtgcctgggagacgttgtcgccgaagctcgccccggctgaagacgtgcgcggtgcgctggcgctggtggagcgcaacgaagcgccgctggggattgtctatggctccgatgccgtggccagcaagggggtgaaagtggtcggcaccttcccggaagcctcgcatcagaaagtcgagtacccgctggcgattgtcgatgggcaccgcaatgcggccgtgagcgccttctatgactacctgaaagggccggaagcgtccgctatctttgaacgttacggatttaccacccgctgatgtttctgagcgaacccgaatggcaggcggtgctgctgagcctgaaagtctcctccctggcggtggccttgagcctgccctttggcatctttttttcctggctgctggtccggcgcacctttcccggcaaggcactgctcgacagtattctccatctgccgctggtgctgcctccggtggtggtggggtacctgctgctggtggccatggggcggcgcgggtttattggcagctggctgtatgactggttcggcatcagctttgcttttagctggcgcggggcggtgctggcggcggcggtgatgtctttcccgctgatggtgcgcgccattcgcctggcgctggaaggtgtggacgtcaaactggagcaagcggcgagaaccctcggggccagccgctggcgggtatttttgaccattacgttgccgttgactctgccggggattattgtcggcacggtgctggccttcgcccgctcgttaggggagtttggcgcgaccatcacgttcgtctccaatattcccggtgaaacgcgcaccctcccttcggcgatgtacaccttgattcaaaccccgggcggggagggggcggcggcccgcctctgccttatcgccatcggactggcgctggtttcgctgctgatttcggaatggctggcccgcgtgagccgccagcgcatgggaggataatgatgctggagctggactttacccagaccctcggcagtcactgcctgcagatccgtgaaaccctgcccgccagcgggatcaccgccgtctttggcgtctccggcgcgggcaaaacctcgttgattaacgccatcagcggcctgacccgaccccaggcggggcggatcgtgctcaacggcagggtgctgaacgacaccgcgcagcgtatctgcctggcgccggagcagcgccgtatcggctatgtctttcaggatgcgcgcctgtttccccattataaagtgcgcggtaatctgcgctacgggatggcgaaatccatggtcagccagttcgataagctggtggaattgctggggattgcgcccttgctggatcgcctgccgggtcggttatccggcggcgaaaagcagcgagtggccatcggccgcgccctgctgaccgcgccagagctactgctgctggatgagccgctggcctcgctggacattccgcgcaaacgcgagctattgccctacctgcagcggctggcgcaggagattcatattccgatgctctacgtcagccactcgctggatgagatccagcatctggccgatcgtgtgctggtgctggaggccggtaaggtgaaagctttcggtccgctggaggaggtctggagcagcagcgtgatgcacccctggctgccggcggagcagcagagtacgatccttagcgccaccgtcgccgcgcagcacccgcagtatgcgatgacggccctggcgctgggggaccagttgctgtgggtcaaccggctcgaacgtcccgcaggcgacaccgcacggatccgcattcaggcgtcggacgtttcgctgacactggcccagccgtccgggaccagcatccgcaatatcttgcgcgccgaggtggctcagtgtctggaggtcaacggacagattgaagtgcagctcagagtgagtgaccgtctgctatgggccaggattagcccatgggcgcgggacgacctggcgatagcgccaggtcagcaggtgtttgcccagatcaaaagcgtgtcgatcgccgcctgattacagcagttggcggtagataaactcggcgatgctggtggactcattgtcgccgatgactatgttggcgcgggctttcacctcgtccaccgcgttgcccatcgccaccccggtgcccgccgcttccagcatgctaagatcgttgtagttatcgccgaaggccaccacatcctgcatcgacagcccctggtcggccacccattgcgccaggcgtttgcctttgctgttgccggcgcgcgcgatatctacctgatcgtgccacgaccattcgcactcgaggcccagcgtctcgccaacctgctgcgcaaaccgctgcaggcggggaatgtcgtcatcggtgagagcgaatttccataccgcgttaacttcgcgaaccgcctgcgccagcgaatcgacctgagcgaaaactggacgctgatcttccggtaacgcctgcgcccagttgcgggtgcggatcacatgcccggtggggtgttcataaagcatcgcgtcgtccacatatgccaggccgtggatctgctgtttggcgagcatggcagtgaggcttaccgcttgctctaccggcataggatcggcggccaaaaccttttttgcgtgataatcatacaaataggtgccattacaacaaattgcaggtgtatcgagagccagtgcctgataaaaaggatggatagcgacgtgatgacgtccggtgacgacgatgacctgatagcctgcctctctggcgcgggccagcgcctccagcgaagcgggcagaatggtttttttgctggtaagcagggtgccgtctaaatccagggcaatcacgcgtgttgtcatgtgttatttccggttgatgttgaaaagtgacctggccatgatggtacaccgccgtggcgtcaggaccaatttttccacatctgccgtgaatgtctgtatgccctttgtgccgccgtccggcggaaattcggcggacgatgcgagtatcatgggcggatgtcttataattttcagggtgctgttatcctgaaaatgaaaattccacgtgcagtgagggaaggagtagtcatgaaacaaaccgtttataccgccagcccggaaagccaacaaatccatgtctggagtcttgaagcggacggcaaactgacgctggtgcaggtggttgatgccccagggcaggtccagccgatggtggtcagccccaacaaggaatttctgtacgttggcgttcgtccggagtttcgcgtgctggcctatcgcatcacgccggataacggggcgttaacctttgcgggcgaagctgcgctgccgggcagcccgacccatatctctaccgatcaccatggccgctttgtcttcagcgcctcctacaatcagggctgtgtcagcgtgaccccgctgcacgacggcctgccgggcgaaaccatcaccgtggtggaagggctggaaggctgccactcggccaatatctccccggataatcgcaccctgtgggtgccggcgctgaagcaggatcgcatttgcctgtttaccctcagcgacgatggtttcctctcggcacaggagcccgcggaagtgacgaccgtcgagggcgccggtccgcgtcacatggtattccatcccaaccagcagtatggttactgcgtcaatgagctaaacagctcgattgacgtctgggagctgaaagatcctaagggcaacatcgaatgtgtacagaccctggatatgatgccgcctgattttagcggcgtgcgctgggcggcggatattcatatcaccccggatggccgtcatctttacgcctgcgatcgtaccgccagcatcatcacggtgttcagcgtttcggaagatggtagcgtgctggcggtggaaggctatcagcctaccgagacccagccgcgcggctttaacctcgatcacagcggtaaatatctcattgccgccgggcagaagtcgcaccatatcgcggtgtacgacatcgtcggtgagcagggactgctgcaggagaaaggccgctatgcggttgggcaggggccgatgtgggtagtggtcaacgcccactgaaccgccatcaggtaaaagaaaaaacctcgccttagcgaggttttttttgctcagagcggacaggctctgcggagaaggcgttgtcctggcgggccagaagcgtggcgacgttagatatcgtccatggtgtagccaacgacaatctccaacgtttttcggatcacgtccgcggtcaccacgtcatcggtggtttccagcgcctgaatcagccataaaataatggccttattgttcaggtgaccctcggactggagaatactgttgatggcgagcgacatgacggcggactcatcaaccagtttatcaccggcgttacggaaatagtcggagagcgcggtgtcctgcagtcttgcgtaaatatctggttgctgatgcatagtctgtctcatcacattctcactctgtttaattcaccatggttgggataatcagtggatctttttagcttccgacggcatgctgtctggcgccagcgaacctctggtttcccaacggccattgattttctttacctgtaaaggcgcgtacttccgctgacggataagcttcgcgcaaatttcttcgatcacggcagcgatgatctttctacgctggcgatctggttctgtcgcctgcattaaccgaagtcgaaccagcagggtcggggtggtaatcgggcgattcgttttcagaagcgctagaaccgcctcgccgatgatttcatcggttatttcctcagtttcactgttattcataaccgtctctatgcatgccacccttttcctgaataggcgaacggcattcaggtcagcagcaggtttgtggaagcgatcgcccctcatctgctactgcggcgctgcaacaggcgacgatcgatgacgttattcctggccagcaaacagcagaccaattaaggtctgatagtggctctcttcctccggcgcgcgagcgcggtccaggcggctcaacagtttggtgcatagcgctttgcggttgagatgacgcccttcgttaagaatatccatcacgatctgacccagggtttcctgctgggaaggcaaagatgctttgttgaaatactgggcaattgcgttcgctgtatctggaatgtaaccattctgctgcatatgtgctcctttcatttcattcatctgttaactgccattaaacttatacaataattattaacctgtacacacaaagttgcacaataatgattcatgttagtttaactatatgatttttaattgtttaattttttttgcctggcgcggttctggcttgtaaaggtggggtttagcgttgcatgttgtacaaggaaagaaaaaaagggaaaaccttgcacaaaaaagggatttttagtgtatcttttttgttaagacaaaacgtagttttacgagacccttagcctgataactgctactgtgaatgcttatccctcccatctggaatcactatgctaaccaccatcatttatcgcagccatatctgcgacaatgtctcattcaaatcgatcgaggccatggtcgccagggcaaacgaaagaaatgggcaggcggacgtcaccggtattttactttttaacgggacgcatttttttcaactcattgaggggcctgaagaaaaggttcaggatatttatcagcatatctgccaggatcctcgccactataatctggtggagttgctttgcgattatgcgccgtcccgtcgttttggtaaggtcgggatggaactgtttgatttacgcgaacacgatcgcgaggaagttctgcaggcggtgatggaccgggggacgtcaaaatatcagctcacctatgatgaccgggcgctgcaatttttccgtacttttgtcgaagccacagaaaaagcgaactattttgagattccttccgcagatagttgggtttttattcctgataaggagacgttctatcctgataccccgattatcgataatacggaaggttgttcctttgccttccagccgattgtcgaccctttcgcctgcgaaattatttcgtgggaagcgctgttgcgtacaccggacgggcaatcccccggcgcctattttgccgggctgaccggggacgatatttatctcgctgacctgcacagtaaacgggtggcgttgtcgctggcgggaaaattaggtttacgtaataaggcgttaagcattaatttactgccgatgaccatggtcaaagcgccgaatgcggtggctttcctgctcgacgaaattagtcgcaatgaccttattccggagcagattattgtcgagttcactgagcgggaagtgatttcgcggatggacgattttaccgatgcggtgcgcaaactgaagggcgcgggaattaatcttgccatcgatcacttcggcgccgggtttgccgggctatcgctgctggcgcaataccaacccgacagaattaaaatcgaccatgagctgatccgcaatatccaccaggacggaccgcgccagtcgattgtacaggcgattatcaaatgctgtacttctctggagattgcggtctcagccgtcggcgttgagcgtgctgaagagtggatgtggctggaatcagccggtatttcacagttccagggtaatttgttcgccagcgcgcgcctggggggcctacccgccgtcgcatggccggagaaaaaatgaaccaccgcgaaatcagctaaacattttttcatcttttttcccgggcgctgtgagccgcaacctgatatctttatctgtacaagaaaatagagttgtacaggatgcctgaattcgttagtttaggtattaaggtatcaggttgatgtgaggctgctatggcgttttacagtatcggtgaagtcgccgaacgttgcggaatcaatccggtcacactgcgcgcctggcagcgtcgttacggtctactgaaaccgcagcgtagcgaaggcgggcatcgacaatttgatgaagaagatatcctgcgtatcgaagagatcaagcgctggatagagcgcggtgtatcagtagggaaagtcaaagcgctgctggaggataacctgccggcggcgcgcgacgaatccgcgcatcttcaggaagagatgatgtccattctgcgttatatgcagcccgccagaatccgcgccaaattaatggcgctcagtcatcaacaccccgtcgacaccctcatcgatagcctgttagtgccggtacgacagcgtctcaagctggatcagaatacctcgctggtgattagcagcatgctggacggcctgttaattgactgcgtagcgttgtttctcgccgaagcgcgtaaaaaaaatggcaaagagacgctgctggtgggctggagcaatgaggacaggacgcgtctgtggctggaggcatggcgtctttcccaacgcggctggcatgtcaacgttctcgccgaaccgctggagtcgccgcggcctgagctatttcccgggcagcatattttcgtctggaccggacgtgccgccacgcctctgcaggaggagctgctcagccactggcaggagcagggcttcagcatccattttcacggccaaaattaagcgccccgatccgtggtgcggatcagggcttgagtgctgggttacaggtgaatctggctccaggatttgaacgtttcgctgcggctgatattaaaaaaatcggttctaccgctgcagccgagctttttaatcagattcagccggatctgataaatggtttttatatgcaggtttagcgaccggccaatgctggcgaccgcttcgccattgctgataagttgaataactttcttttcccgctcggtaaactgcaccgaggcgcctggcgccggatgggttttgtaatagcgggtgggttgatgcagaaatatctttaactcttccggcgtcgagttggccggtaagcgcagcataggcagttcactaagaaaattaagatcgttgccttcggttaacagaataaataatgtatcccgccgattatagttgtgctgcagtaccgcgaaataattgtcgctggtgaagaaaacatgttttttgcggaagtaagatgccggcaggctattcaggatcagcgacatcccatagagaagaaaaccattatcaaaccacagatcgtaatgctcagaacgatagcaagtattatggtgtgacatttttttgcctcagttagccgatagagacccaggcgcgccggtacagcaggtcgaagcctgctgccagcacagtgggtttatttaatgatgaggtttgctgtacagcatatccagcgcctgcagatagagatcggaaagtatttcgttactttccgtttgcagacgatgctggatttccgtaatcatccgctcattatttaccgttctgtgctgcttaatgagcgtattctcaatattcttcatcagggccgaattgaagacaaactctgctggaatggtatttttaatatgcatagctcgaactctcccacgtataaagcaaacagacaataaaagtcgcagcgtaccgttggtacgcgccaagtcacgaacaggaaatgtataaccaggaaccaccgtccgactcgctgcgcaatcgtcaagcttccccgctttgttgcgcaacaagcagttaacactccaaaactatagacgctgatttcactatgtacaacttttttcattactatatgtacaacgtaacggcttattttttgtgtgtgttttaatttgttgatttatagcaattttattaagtgataacttgtacagaaaagtcgggttgtgcaggatttcgctgtaaaaccagcgggaagaagctgatgatggtagaagaaagccaattgtgaaaattctgtcatggctggcgaaatgcatgaaattgcgccgatgcgcgaaggggtaaacagcaacgctgtcgtcgacaggtggctttcttccgcgtcggagtctgagcatagcggaaaatatgatgaggctttgtctgctttttgcacagtaaggtaaaggggtaacgtctgccatgtcgtaaacggcccattcgatttgttggcgaataagggctgtgctacgctttttggtaacgacgcggcggtttggcatcgttatttttcccccatttccctgtcgagtcttatacccctgtcacgaccggtaaatacggcaaaagctttctgtccctggacaggccttgaggactgaggagggaaaatgcgcggcaaaagcgtgatgctcctggccgggttagcctctctcgcgcaggcgaacgaacttaacctctattcggtgaataccggttcctatgtttaccatctgaccaataatcaaggacaatatacagagaatttcgaaaatcattttttctcagtggagcggaaattctctgcagactccaaatacagccttctgcttggcactatgaataacagcttcaacgatcgctgcctggcgctgggggtgagaagagactggtaccacagcggcagcgggtggaccttcaaaggcgtttacggctataccggcgaattcttcttcgacgcctttgagcattgcggcgatcatggctcctataaagactttaaggacgccacggggatcggcttttcaccctatatctaccacgctatccagtataacttcaccgattatttcgccgttgaaagcggcattattattcccagcgtgtttgtgatcagtatccagtggagcttccgctaaatcgtcccgttgtcggttacaaggtaatcaccttcctgagcagcgtactggagagcgcggcaagggaaatgagcaccgacaggacaaaggtcagcgctattacccccagcttggtggctagcgaatgcacagggatgagcatcaccagcaggtgaaacacggaatagtggaggatataaactccggtcatcgctttactgaccgtcgccagcacggcctctttccactcgcggttctttttaaactgcacggcgttagcggcgatcaccagcaggacgatcaggatataaatttgcgatcccgtgagaatgaacgcattacgatctgctttaaacagggcgaagaagaaatggcgttcataaaaccaggtaaataaatagacaaagggcagggcgataatcgaccctttaatcacctgtgggttgcgtatccactccgcgacctttggatcgttaaacaactgcccggttaaataaaacagtagccatgtccacaggcgatactgcggcggcaaactgaaaagatgtctgtccgggtagatcaccgagagcaggtcgtaaccgtaggagcagcacagcagcgtcaggagcacggcgaaaaagagcccgcgccgctggctgagccaggcgatcaaaggatgaaaggtatagatgacaatcagggcgaaaataaaccagggctggatcaggtagccgcgctggtaaggctcccagacataatagaccgtcacccaaaacagaaagacgatgaccacgcttttaattttaccaatttgccagttggcatcgtggcgcgtctgcgcatcaagatagccggccacgacaaaaaacagcggcgtcgcgatggtcgagataaaggtcagcagcccgaggatccagtgatagtcataatcaaagcgatcccaggtgttatagatggtgaaaaaggtcaccgctgtcatacagcctaatgtcttgataatgctcagaccggtactgttcatcgttgaggcgtcatatccttatggtgaaagcaggcgtaaataaccggcagaaccagcagcgtcagcacggtggcaaaggcgaggccgaacatgatcaccaccgccatactctggaaaaagacatcgcgcagcagcggggccaggccaagtacggtggtgaaggcggtcagcaggatcggccgcagacgagaggttgccgcatcaataatagcttgtcgttgatctttctcctgtttttcttgctctatctcttctaccagcacaatgccgttacggatcagcataccgctcaggctgagcaagccgattaaggccataaagccgaaggggatgccggtaagcagaaagccgggtgtgaccccgatcagcgccagcggaacggtcagccagatggcgacggcgtttttcagcgaactgaacatcagcaccgttatgataaacatcaccagatagccaagcggcagggttgtaaacagcccctgctgcgcctcactggagttctcggcatcgccgccccattcgatacggtagccgtggggcagcggcagtgcgtcaatgcgcggtttcacccgcgcgagaatatcacccgaggtttggccgcttagcgggctggggtcggtctggaccgtcagcacccgggtacgatcccggcggaggatcaacggatcttcccactccagggcgaaaccattgctgacgttactcagcgggatatattgctggcgactctggctccagaccagcacattattcagatggttggcatcctgacgttctgcttccggcggccggacgatcactggcagcagatcggccccttcacgatataacccggcgcgactcccggagaaattcatctccagcgcgttatcaatatcctgtttatccacccccagctcgcgtcccagcgccggggaatactgcgggcggatcactttgctgcggttctgccagtcattacgcacgctgtcggtcgccgggtccgcggcgaggatatcgcctacctgactcgccagcgcgcgcagcgtatccgggtctgggcccttaatgcgcacctcaatcgcgctatctccggaggggccgaacataatgcgtttggtgctggcgttaacctgcgggtagtatctggcaatccagtcctccacgtggcgggtgacaggggcgatgccgcgttgatcatccatccgcaccataatctgcgcgtagttgctgtactggcgctgcccgctgtaggtgagaatgaaacgcatactgccctggccgatggtggagacggtggtgaccacccccggctgaccggctatcgaccgctcgatatcccgggtcatcttctccgtggcgtttatatcggtaccgtagggtagccacaggtcgacaaagaatataggcgtattcgatgacggaaaaaaattctgccgaacaaaggtaaagccccagatcgctccggctaacagcgcgcccatcagcaccagggtcagggtcttttgctgcagcagtattcgcagcgcctgctgatagccacggtaaaagctgccgcggtaaggatcggccttttcctccgcggcggcggccgacggggcgtttttaaacagccaccacttaataagcaccggggtgatggtcagagcggaaaaccagctcagcatcagggagatcagcagcacctggaacagcgatttgcaatactccccggtagagtcctgggagaggccaatcggcgcgaaggcgaggatggcgatgatcgtcgcgccaagcagcggcagggcagagcgacggatcacatagttaatcgcgcccagcagcggagagccttgctgacgggcgatgagcaccccttcgacaatcacaatggcattgtccaccaacatactcagggcgatgataagcgctccgagggagatccgttgtagttcgatcccccagatatacatgataagcagggtgccgagaacgttgagcgccagcgacagagcaataataatcccgctgcgcacccccataaataccagcagcacgccgacgacaatcgccagggccatcagaaaattggtaataaagccattgaccgagtgggcgacctcagctgcctgatcgtaaaaaatagcgatgtcgatgcccgccggtttgtcggcggccatctgctggaggcgggcctcgagagcgtggccgacgtcaataacgttgacgcctgggataaaagaaactcccatggtcaccgcctggcgcccgttggcatgatagatactggccggcgagtcggttagcccgcgcgacagcgtagcaatatcccgcagtcgggtggtggcgctggcgccgtgagggctgaccagtagatctcccagctcatcgatgctctgaaactcaccggtggggtggaggcggatcgattcgctgccaacgcggatctccccggcgctggacaccacgttgagtcgggccaggattgcggcgagctggttgagggtgatcccgcgcgccgtcatcttcgccagcgagatatccacattgatctgctgcggaatgacgccgccgatagcgactttaccgacccccggcaccagcaccagctcccggcgcaactgttcggcatagcgcaccagctccgggttggtaaaactgtcgcccgagatagcgaagaaaaagccaaacacatcgccaaagtcatcgttgacgaaaggggggactacgccaggggggaaaaggcggctggcgtcaccgacccggcgacgtagctcatcccagatttgcggcagctcgctggaatggtactgcgaagcaatattcaccgtaatttgcgataagccattcgaggagatggagctgacgttatccagcgagggaagctgctgaatcgcgttttccagcggcagggtaacctcctcttccacctgctgagcggacgcgccagggtagtgggtgacgatcactgccgttttgatggtgaaggcgggatcttccaggcggccgatattgagcagggcgaacaggccacccacccctaacagcaaaatggctaaccagacgcgggtcgggttgttaataaactgacgggaaatatccatttataatcctcgttcacgcgtccagacccgcaccggctgcccggcatgcagctcgctcacgcccgccgcaaccacctgttcacccgcgcggagaccgtcggtgatcgccactccctgcgaagtcacctcgccgacggtgaccttacgctcctcaagatatcgatgcgcgttatcgcctttcaccacccagactaccggctcgttctttggccggttatcggggttaaacaccgcctccgctggcacaatgagggtttcccgtccggcgctggccggtaaattgccgagattgaccgtcacggtgccgctgaccccgccgacggcgggaaaatcatctggccgcggcatggttaacacgatctgccaggtgagggtgctattgtcgctgctgccggtatgctctttgtattccgcggtaaactcgcggcccggcagggtattgaacctgacgacgggacggtaggcggtattgcggatatccagggaggtgaacagattttcgggaatgctgaagaccacatccagcaggtcggtccgcgtcagggtgatcaccggttggccggcggcgaccacctgatggttgcggatatgcacgccggcggcaatcccgctaaagggcgcgatgaggctcatttgcgccagctcttcgcgagcgatttttaaggccgcattggcggcatcgcgattggcgcgctgcacgtccatctccgcctgggaaatcgcctggcgcccggccagagtctggaagcggtcgaactgacgctgggcgagagtggccgccgtttgccgctcattgacccgttgctgggcctcgcgggcattcaggcgcgccagcgtttgcccctgggcgacgcttgccccctgacgaatatctagcgactccacctggccaccccgcttaaacgacagttcggtggaatcgccagactcaatgcgtgccggaaacgttcgctgctgggtattgcccacggcggtcacctgcgccactttaaccatgcgcggggcggactcgacggtgggtgctttctgatcgcaagcggttgtaaatataataacaaccgggatgagagaaaaataacggttcacaatattcccctcagattcaggatttattttacatttttattacatggcgcctgcttattctgcgagagcggcgacgaccagataagtgaagagccccaccgctgtgcaggcgacaatggccagcgcgacaaacaaacccaggcgtaacaggctataacccaacataatttcctccctttactcccacccgaaccgtgaatgtcatttaattcggcccccactgtgaccaccggacattcggagcggcatgcctgcttgtaatcagcatagtcggagaaaatatgaagtgttaaaaaagagaatgccgcgagcgttggcggcattaaggggaaagcgcaggagatccgcagagaatatgcggtttttataatatttttcagtctattaatccgccattttctaatgttaattttcctgtgctacgtttaataacatctattccgctcgccgcttctgttgttgagatttcgttcctccccaagtaaggggctattcatcactacgcattgtattggtaataaaaggattatctcatgtataaaaatatcgttgttcccgttgacgtgtttgatgcgggcctggccgacaaagcgctctctcatgcgaaattcctcgcccaacattctgccgggcaaattcatcttatccatgttattccggccttttctcctgtattaacccgcggatttatctctgatgcccgaaagatggaagaccatttgcttaataccgctaaggaaaagctgagcgagctggtgaagaaaaatgggcttgcggaagacgccagccatctttatgtgcgcagtggcaatgttcgcgatcaagtgattgccctggccgatgagctgaaagcggatgtggtgattgtcggttcgcgcaatccggggatccagactcatttgctgggctcggaagcggccaatatcgtgcgctatgcccatgtaccagtgttcgttgtgcgctgatgatggcgggatgtcgccctgacttccgcttcagaaatcgagggaaagagtatgaatacagataaaccgggggcgccctattatcagcgctccgtcgaggagactctcgccagcgtgcagagttcgccggaagggattagcggaacagaggcggctacgcgcctgcagcagtatggcgaaaacgccctgccgcagaagccgggtaaacccgcctggctgcgttttattgcccattttaacgatgtgctgatctacgtcctgctggcggcagcgttgctcaaggcggtgatgggccattggatcgacatggcggtgatcctcgccgtggcggtggtcaatgcgctgatcggcttcattcaggagagtaatgcggaaaaatcgctgcagagtatccgcaatatgctgtccagcgaggcggtggcgatccgtcagggcaaccatgaaaccatccccaccacctcgctggtacctggcgatatcgtggtgatccgcgccggcgaccgtatccccgccgatctacgggtgattgaggcgcacaacctgcgggtggaagaggcgatcctcaccggcgagtcgacggtggtggaaaaaaccaccgagccgctaagcggcgatttaccgctcggcgatcgcagcaacctgttgttttccgggaccaccgttagctcaggggcgggaaaagggatcgtggtggccaccggcggcaataccgagctgggccatatcaaccaaatgatggcgggcattgagaaacaccgcacgccgctgctggtgcaaatggacaagctaggcaaagccatctttatccttattctggtgatgatggcggcgctgttcgtctttagcctgctgttccgcgatatgccggtctccgaactgatgctgtcgttgattagcctcgcggtggcatcggtcccggaagggttgccggcgattatctcgattattctgtcgctcggcgtacaggcgatggcccgtcagaaagcgattatccgcaagctgccgacggtggaaaccctcggcgcgatgacggttatctgctcggataaaaccgggaccctgaccatgaacgaaatgacggtgaaggcggtgatcactgccgacagcgtctatcgggtggaaggggatagctatgagccggtcggtaagatccacgccattgacgatccgacgccggtcacgatcgcgcccggctcgctgttcgagcgctatctgcgcaccatcgatctgtgtaacgacagccagcttatcaaagaggagagcgggctgtggaaaatcaccggcggcccgaccgagggggcgctgaaggtgctggcggcgaaggtcactctgccgccgctgaccagcgaactgcgcagtaaaattccttttgattcgcaatataaatacatgtcgaccctctaccggctgggtgaagaggaggtaatgctggtcactggcgcgccggatgtcctgttccgcctgtgccagtatcagcagagcgacagcggattgcagccgctggatctcccgtactgggaaggcaaaattgaagagtacgcccgggaagggctacggatggtggccgcagcctggaagccggctgccgcaggccagaccgaactgacccatcaggatctgcagcaaggggtgattttgctaggggtcgccgggatgatggatccgccgcgtccggaggccatcacggcgattgccgactgcctgcaggccgggatccgcgtgaagatgatcaccggcgaccacccgcaaacggcgatgagcatcggcaagatgctggggattggcaatgcgggaaatgccattaccggacgtgagctggaggtgatggacgacgcgcagctgagcgtagccgcgcagcagtttgatatcttcgcccgcaccagcccggaagataagttccgcctggtgcaggctctgcagagtaagaaagaaattgtcggaatgaccggcgatggggtgaacgatgccccggcgttgaagcaggctgacgtcggcgtggcgatggggatcaaggggaccgaggtgaccaaggaggccgccgatatggtgctgaccgatgataacttcgccaccatcgccagcgcagtccgcgaggggcgccgggtgtatgacaacctgaagaaaaccattctcttcgtcatgccgaccaaccttgcccaggggttactgatcgtgatcgcgctgctggcgggcaacgtactgccgctcacgccggtgttgatcctgtggatgaacatggccacctccgccacgctgtcgtttggcctggcgtttgaagccggtgagaaaaatattatgcggcggccgccgcgcgatccgaaaattcacgtgatggacggctttgccatctggcgcgtagcgtttgtggggtcaatgattgcggtcagcgcctttattctcgaagcctggctgcagccgcgcggctattcgccggagtttattcgtaccgtgctgttgcagactctggtcaccgcccagtggttctatatgctgaactgccgcgtatcggatggattctcgttaaccaaaggtctgctggccaacaaagggatctggatcgtcagcggcgtactgctgctgctgcagctgctgattatctacgcgccttttatgcagatgctgttcggcaccaccgggctgccgttccgctactgggtgatcacctttatcatcggcttcgccatgttcctgatcgtggaactggaaaaaccgctgacccgcaaatggcgttccgcctgacggcgtgaagcgctgaacgaaaaagaaaagagggggcatcgccccctctctggctgacgacaaacctgtttcgtcattgtgctcgcatttctgccgggtggcggcattcgccttacccggcctacgaaagacttcaatatcaaaccgttatgcagttatctgtaggcccacgcaagcgcagcgccgccgggcaattcctgaagattgcacgttgtcagcagtttgagagagggcatcgccctctcttttattatggttcacgcttgttgcgctttactgtttcggctcggcgaccacggtgcttcccacgccgcggttattgtactcccacatgcggttgaagccgttgtcgttgaggttgcgctgcagattgcctttgtcatcggcgctgccggtgttgccgctgaacgggcggccggagcctaccgccgccgcccacggctgggcaatattaaagccttcattgatagcgctgtcgcggatcaccacctggccgttgctgttgccatcgacgtccagcgcgcggccgagctgcgcgacgttatccccggaggcggtgaagcggctgttggtcgccaggaagccgtaggtcacgctcttcagagtagccggcgcgaagacgtaggcctctttctgggtacgggaattcaccacgcggaaatcggtgttatcaaacaccaccgcgccgcggccggaaacgatatccacatcgccttcaatgtagctgttggtcaccagggtgcgggtctgacggttgtcctgcagacggttttgcacgccgctgttggtcacgaagaaggtgttttgacggccaagaatattgaccttattgatctgcacctggtcgccatcgctgcgcaatgccaccgcctggtgggtaccggcgtcaacgctgtcgccgaggttgttggcgatggtcaggttctgcagctgcagaccattattctgtgaccagaagactgcggaacacattacgccgacggtcgccgcggatttgctttggcaactgtcgaacatataccacgccggtttacccggcatatatttaccgcctggattgaccagacgacgccaggtgttgcgatccatctcggaatcaatggcttcgctgattttcacgtcgattggcttatcgccagtaccatacagggtcagggcgcccggcgccgccggaacgtagacggttcccgggtactcgcccggcataatcgcgatatacagacgacggttagagtgacgggcaattgccgcatccaccgccgcctgaatggtggtatgggttacgccctgggttcccgcagggccgacgataaagtcaggctgcgccggcaggctgatagcagacggcgtccaggcggcggcgttgggagccagcgactggaaataggccgccggcgtgaagtttttcgcttcttcggcgttgagtatgggacgcgcggtagtgcccggtgcagtctgcgttgagggctgttgatcggcaggcgtcgagctacaggcggacagcgtcacgccgaaggccagcgccagcgccagacgggaaacggaatatgtgttcatgttgctccgggcaaaattaagcgtaatgaaataccccggctgaaacgccagggtataagtcctttaaaacctgctgttttatactaacttgaacgaaacgggaagacgtggacggaaaaacttaccgtctttacgcaacgcgcagccctgccggatggtctttagtcacaaaaaaataacatttccctgcgctattgttgactttaccggcgttatgaaaataaatgtctatacaacccatgacaagttaagcgctatgactgaagccacttccgaactcgttatctggcgaaacgggcgtctcgccaccctgaaccccgatcacgctcaaccttacggcctgctggagcgccatgcgctgctggtgcgcgacggccgcatcgcggcgattgtcgccgaagatgacgtccccagcgggcgcagtatcgatcttgaaggccggttggtaacgccgggattaatcgactgccacacccatctcgtcttcggcggcagccgggcccaggagtgggagcagcggctgaacggcgtgtcgtatcaaaccatcagcgccagcggcggcggcattaactccaccgtgcgcgccacgcgcgacagcagcgaaactgaactactggcgctggcccagccgcgtctggaacgcctgctgcgtgaaggggtgaccaccctggagatcaaatccggctacggcctcgacctgccaaacgaacgcaaaatgctgcgggtcgcccgacaactggccgatcataatggcgtggaactgtcggcgacgctgctctccgcccacgccacgccgccggaatatcaaggcgatgctgacggctatattacgctggtctgcgagaccattttgccgacgctgtggcaggagggactgtttgaaagcgttgacgtcttctgcgaaaacgtcggcttcagcccgcagcaaactgagcgcgtctttcaggcggcgcaggcgctgggcattccggtaaaaggccacgttgagcagctctcgtcgctgggcggcgcgcagctggtgagccgttatcatgggctttccgccgaccatatcgagtatctgacggaagagggcgtggcggcgatgcgcgaaagcggcaccgtggcagccctgctccccggcgcattctacttccttaatgaaacccgtaaaccgccggtcgagctgctgcgcaagtaccaggtgccgatggcggtggcgaccgatttcaaccccggcaccagccccttcgccagcctgcatctggcgatgaacatggcctgcgtcaagtttggcctgacgccggaggaggcgtgggccggggtgacgcgccatgccgcgcgggcgctggggcgccaggccagccacggccagctggcgccgggctttgtcgctaacttcgccatctgggatgctgagcatcccgtcgagatggtgtatgagccggggcgcagtccgctctggcatcgcgttgttcaaggagaattgcaatgatgctgtggcaagctacgccagccagtctctggcagggacgcgacgacagcgcggaagcgcccaatgcgctgcgcctgttccagaccatcgcccgcgcggaacgcttcgcgccgcaggagatgcccggcgatatcgcgctgctcggcttcgcctgtgacgaaggggtccggcgtaacaaggggcgtaccggggcagcggacggcccggcgaccctgcgccgggcgttggccaatatggccagccatcagggtcatgaccgctgcgtggatatgggcaccatcagcgtcgacggcgagcagttagaagtcgcgcatcaggcgctgcgcgaggcggtggccgactgtcagcgggcgggtaaacgcacgctggtcctgggcggcggccacgagacggccttcggccacggcgctggggtactggatgccttcccgggcgaaaaagtgggcattattaatctcgatgcgcatctggatctgcgctttgccgactgcgccagctccgggacgccgttccgccagttggcgctggagtgtgacgcgcagcagcgcggttttcactatacctgcatcggggttagccgggcggcgaacacccaggcgctatgggatgaagcggcgcgccgccaggtggctatcgttgaagatctggaggtgctgacagccttcgaaactcgcgtattgccggagcttgagcgcaatatcgcgcaattcgaccgtctgtatctgactatcgatctcgacgtgctgccggcgcgagaaatgccggcggtgtcggccccggcggcgctgggcgtgccgctggccacgctgctgcgcatcgttgagccgctgtgccgcagcggtaagctgcaggcggtggatctggtggagtttaacccgctgtttgacattgacggtcagggcgctcgcgtggcggcccgtgtggcatggcaaatcgcccattggtggcgctagcgatccgcgctattattttcgtttcgccgctccgcttattacgcataaggaaagccaggccatgtttgcacaacaacctcgttccgcgcccgcgcctttctatgaaaaggtgaagcaggcgatcagcgaaaagatccacagcggcgtctggcgaccgcatgaccgtatcccgtcggaagctgagctggtggcccagttcggcttcagccgaatgaccatcaatcgcgcgctgcgcgagctgacggacgaaggcctgctggtcaggttgcaaggggtgggaacctttgtcgccgagccgaaagggcagtcggcgctgttcgaggtgcgcagtattgccgcagaaattgtcgcccgtcaccatcagcaccgctgtgaggtactcctgctggaggagacccgggcggatcatattcaggcgacggcgctcagcgtcccggaaggcacccgcatttttcactcgctgatggtgcattacgaaaacgaggtgccggtgcaaatcgaagatcgctgcgtcaatgccgcagtggtcccggactatctgcatcaggactacaccgccaccacgccccatgattacctgtcgctgatcgcgccgttaactgaaggtgaacacattgttgaagcggtgcaggccacggcggaagagtgcgcgctgctgcatattcacgcccacgatccgtgcctgctgatccgtcgccgcacctggtcgacaacccacatcgtctcccacgcgcgcctgctgttccccggtagccgatatcgtctgcaggggcgctttggctcctgatccacgctggcgtcagcaaaacgtgattgctgacgcaatataacaaaattgtatcatttctgttaaatcctggcttgcgcatgcttgtatagacaagtatatgtatctacgtaaacaacgttcattgtcaggagaaaccccgatgtcgcaaagcaaatatcgccagctggacgtccgtgcgccaagaggcacgacgctgaccgcgaagagctggctgaccgaagccccgctgcgtatgttaatgaataatcttgatcccgatgtcgccgaaaacccgcacgagctggtggtctatggcggtattggtcgcgcagcgcgcaactgggaatgctatgacgctatcgtgaaggcgctgaagaacctggaaagcgatgaaaccctgctggtgcagtccgggaagccggtgggcgtattcaaaacccatgaaaactcaccgcgcgtgctgatcgccaactccaacctggtcccgcactgggccacctgggaacactttaacgagctggatgccaaagggctggcgatgtacggccagatgaccgccggcagctggatctacatcggcagccagggcatcgtgcagggtacctacgaaaccttcgtcgaagccggtcgccagcactaccagggcagcctgaaaggccgctgggtattgaccgccggtctgggcggcatgggcggcgcgcagccgctggccgcgacgctggccggcgcctgctcgctgaatatcgaatgtcagcagagccgcatcgatttccgtctgcgtacccgctacgtggatgagcaagccacctcgctggatgacgccctggcgcgcatcaaaaaatacaccgccgaagggcgggccatctctatcgcgctgtgcggcaacgccgcggagatcgtaccggagctggtgaagcgcggcgtgcgcccggatatggtcaccgaccagaccagcgcccacgacccgctgcatggctatctgccgaaaggctggagctgggaagagtatcagcagaaagccgaatccgacccgcagggcactattctggcggcgaaacgctcgatggccgatcacgtgcaggcgatgctggccttccatgagatgggggtcccaaccttcgactacggcaacaacatccgccagatggcgcaggaagtgggcgtcagcaacgccttcgatttcccgggcttcgtgccggcctatatccgcccgctgttctgccgcggtatcggcccgttccgctgggtagcgctgtccggcgatccgcaggatatctacaaaaccgacgcgaaagtgaaagagatcatcaaagatgatcagcatctgcaccactggctggatatggcgcgcgagcgcatcagcttccagggactgccggcgcgtatctgctgggtcggtctggagtggcggcaaaagctcggtctggcgtttaacgaaatggtgcgcagcggcgaagtctccgcgccgatcgtcattggccgggatcaccttgactccggctccgtcgccagcccgaaccgcgaaaccgaagcgatgcgcgatggttctgatgcggtctccgactggccgctgctcaacgccctgctcaataccgccagcggcgcgacctgggtgtcgctgcaccacggcggcggggtaggcatgggcttctcgcaacactccgggatggttatcgtctgcgatggtaccgatgaagcagcggcgcgtatcgcccgcgtcctgcacaacgacccggccaccggcgtgatgcgtcatgccgacgcgggttacgatatcgccattgaatgcgcggcggaacagggtctgaatcttccgatggttgcggcaacgcaggggaacgctaaatgaaatctttaactttgatcccgggtcaactcagcctgtcgcagctccgcgacgtttacagccacccggtaaatattaccctcgacagcggcgcgtttgccgccattgacgagagcgtggcctgcgtcaacgccatccttgccgaagggcgtaccgcctacggcatcaacaccggttttggcctgctggcgcaaacccgtatctcgacggaagatctggagaacctgcagcgttcgctggtgctgtcccatgcggcgggcgttggcgagccgctggacgatgatctggcgcggctgattatggtgctgaagattaacagcctgtcccgcggtttctccgggatccgcctgagcgtgatccaggcgctgattggcctggtgaatgccggcgtgacgccgtggatcccggccaaaggctccgtcggcgcttccggcgacctcgcgccactggcgcatatgtcgttgaccctgctcggagaaggtaaagcgcgggtacgcggcggcgactggctgccggccaccgaagcgctgcgtcaggtggggctggagccgattaccctggcggcgaaagaggggctggcgctactcaacggcacccaggcctcgaccgcttttgccctgcgcggtctgttcgaagccgaggatctgttcgcctccgcggtcgtctgcggggcgttaaccaccgaagcggcgctgggctcacgtcgtccgtttgatgcgcgcatccatgaagtgcgcggccagcgcgggcagattgatgcggcggcgttgtatcgccacctgctgaccgacgatagcgcgatctcgcagtcgcaccataactgcagcaaggtgcaggacccgtactccctgcgctgccagccgcaggtgatgggcgcctgcctgacgcagatccgccaggcggctgaggtgctattggctgaagccaacgcggtctccgataacccgctggtctttgccgccgaaaatgacgtcatctccggcggtaacttccatgccgaaccggtggcgatggccgcggataatatcgcgctggcgatcgccgaaatcggctcgctctccgagcgccgcatcgcgctgatgatggacagccatatgtcgcagctgccgccgttcctcgtcaaaaatggcggcgtcaactccgggtttatgattgcccaggtcacggcggcggccttagccagtgaaaacaaagcgctgtcgcacccgcatagcgttgacagcctgccaacctctgccaaccaggaagaccacgtctcgatggcgccggcggccggtcgccgcctgtgggcgatggccgagaacacccgcggggtgctggccgttgagtggctggcggcggcacaggggctggatatgcgcgaaggactgaccaccagtccgctgctggaagaggcgcgtcacttgctgcgcgaacgcgtgccgcactatacgcaggatcgctacttcgccccggatatcgataacgccattgcgcttctggcggcccgtcacctgacgcgtctgctgcctgccgtactgcattaatcaccgttgttctctgtacccgcgtcgggggaagtcattcccccgaccgccctacaccgcatatttgtcgtcatataaaaaaatcaggacacctgtatatgcaacaacaacacaagccacatctgctgcgcgggctcaatgcccgacacattcggtttattgcgctcggctccgctatcggcaccgggctgttctatggctcggcctcagccatcaaagcggcgggcccggcggtgctgctggcctatctgatcggcggcgcggcggtgtttatcgtcatgcgcgcgctgggcgagatggcggtgcgcaacccggtttccggctccttcggcagctatgcccgccagtatctcgggccactggccgggtttattaccggctggacctacacctttgaaatggtgatcgtcgccctggccgacgtcaccgcattcggtatctatatggggttgtggtaccccgatgtgccgcgctggatctggatcctcagcatcatcttctttatcggcgcgatgaacctgtgcaacgtgcgggtatttggcgagatggagttctggctgtctctggtgaaggtggtggcgattatcgccatgatgctggcgggggcggggatcatcttctttggctttggccacagcttcccggccaccgggctggaaaacctctggagccacggcggctttgcccctaacggctggcagggcgttatcgcctcgcttggcatcgtgatgttcgccttcggcggggtggagattatcggcgtcaccgccgcggaagcgaaggatcctaagaaggtgatcccgcaggccatcaataccattccgctgcgcattatcctgttctacgtctgcaccctggcggtactgatggcgatcttcccgtggaacagctttggcgaacaggggagtccgtttgtgcttattttcgacggtctggggatcccggcggcggcgaccatccttaacatcatcgtgatcagcgccagcatctcggcgattaacagcgatatttttggcgccagacgcatgatgtacggcatgtcgaaagaggggctggcgccgaaaagcttccagcgcatcgccagcaacggtgtgccctggatgacggtggtggtcatgggcggcgcgctgctggcggcggtggtattgaactatctgatccccgagcaggtatttgtgctaattgcttcgctggcggcattcgccacggtatgggtgtggctgatgattctgctatcccattttgccatgcgccgcggtttgtctgccgaagagcgcagccagatcgcctttcccattccgttctggccggttgcgccgctgttgacgctgctgtttatggggctggtcatcgccgtactagggatgtttgccgaaacgcggatggcgctgatcgccggcctggtctggctcgggctgctgacggtggtgtggtatgcgcgggtgcgtaaaacggcgctgcaggtagccactgaacagtaagatcaatttccccggtggcgctgcgcttaccggggctacaaatggcacggaccgtaggccgggcaaggcgtcagccgccgcccggcataaaagcggctccgtgcccgcggcaatcgcccggcggcgctgcgctagcatgggcctggggggagtgtagatactgctatcggcttgtaacggttttaatccggtaaaaacagttgttttgtattaattccgagcacattgcgctcccgaaatgtcttctacgttatgttactcatggcgcagggagcgcacagggggcggccagtcgccgccgccccctgtacgcccgggcttcggccagcaacatcgccactgcgtggtgccttcgacttatccctgcaggcttcgggtcgggccgaggcagcgtccttgcaaaacacggccctcagcccgcatccatgcgggctgccccggccttccgggaacgtctcagcgatgttgaggccgccagccccggcagtttcagcggccccatgtttggcggcgattcacatactgggtctggaccccgtaggccgggtaaggcgtcagccgccacccggcaaaataaccgcgcaatagcaccgtaggccgggcaaggcgtcagccgccgcccggcataaaagcggctccgtgcccgcggcaatcgcccggcggcgctgcgctagcatgggcctgggggtagtgtaggtcgggtaagcgcagcgccacccgaaaaacaaatggcgcctcgggtaccccggataaggcgcaagccgctatccggggaagattaactgaacagggcggtgatggaggcgctggcgagggaatggaaatggacgttaaagccgaccatcgcgccgctggcctcagcatccacctcaattttctcgacgtccagggcgtggacggtgaagatatagcggtgggtttcgcccttcggcggcgccgcgccgccgtagcctgccttaccaaaatcggtgcgggtctgaacggcctcttccggcagctccgcctgaccggaaccggccccttgcggcaggacgcgggtatcggccggcaggttagcgaccacccagtgccaccagccggagccggtcggcgcatccggatcgtagcaggtcaccacaaagcttttggttcccgcgggcacatcatcccacatcagatgcggcgaaatattgtcgccatcgtagcccatgccgttgaagacgtgacgattaggcagcttaccgccgtcctggagatcgtgactgatcagtttcatgcttcatcctcattgataatgcgctgattaacaaagaagtgtagccttcccgacgacgcaattccgctatttattcgctaaaaaatgtttcgtcctgcactgcctggttgaccgcacgggtcaggcgggtcagctgctcgggcgtgatgatgtacggcggcatcagataaatcagccggccaaacggacggatccagactccctgctcgacgaaaaagcgctgcagggcggccatgttgaccgggcgacgggtttcaaccacgccaatagcgcccagcacgcggacgtccgcgaccagcgcagatccccgcgccggggccagctcggcctgcagctgggcttcaatcgccgccacctgcggctgccattcgccgctctccagcaggcgcaggctttcgctggccaccgcgcaggccagcggattgcccataaaggtggggccgtgcataaagcaaccggcttcgccattgctaatggtttcagcaaccgttcgggtagtgatggcggcggaaagggtcatggtgccgccggtcagcgctttgcccagacacagaatgtcggcggtaatcccggcgtgttcacaagcgaacagcttgccggtgcggccaaagccggtggcaatctcatcggcgatcagcagtatcccttcccggtcgcacattttacgcacccgcttcagccactccggatggtacatccgcatgccgcctgccccctggacgataggttcgaggatcaccgcggcgatttcatgacgatgcgcggccatcaggcgggcaaacggcaccatatccatctcgtcccactcgccgtcgaagcggctttgcggcgcgggggcgaaaagattatccggcaggtagccctgccacaggctgtgcatcgagttctgcggatcgcagaccgacatcgctccgaaggtatccccgtgatagccgttgcggaaggtcagaaaacgacgacgtggttcgcctttagcctgccagtactgcagcgccattttcatcgccacctctaccgccactgaaccggagtcggcgaggaaaacgcactccagcgaggccggggtcatcgccaccagctgacggcatagcgctactgccggcggatgggtgatcccgccgaacatgacgtgcgacatttggtcaatttgccccttcagcgccgcattgaggcgtgggtgattgtagccgtggatcgccgcccaccaggaagacataccgtcaaccaactgttcgccgccggcgagggacagctcgcaaccgtgggcggacaccaccgggtagaccggcaggggggaagtcatagaggtgtaggggtgccagatgtggcgccgatcgaaagcgagatcgtccagtgtcataagcgacttgtaaaccattttgaaaacatttaggtttacaagtctacactgaacttacttacaatgaaacgtacacaaaatatttcgcgcagcatcgaggcggcaagcgagaacatccccaggagcatagttcactatgtgactgggaggcgcgagtgccgccaacaaagaggctgtgtgaaataggaagtgtacgaccttttggagaggaaaatggctcaccaacctcgctggacaatgtcgcaagtaacggaattatttaataaaccgctgatcgatctgctattcgaagcacagcaaatccatcgtcaacactttgatccgcgccaggtgcaggtcagcaccctgctgtcgatcaaaaccggcgcctgcccggaagattgtaaatattgcccgcagagcgcacgctacaaaaccggcctcgaagccgagcgcctgatggaggttgagcaggtgctggaatcagcgcgccaggcgaaaaacgccggctccacccgcttctgtatgggcgcggcgtggaaaaaccccaatgaccgcgatatgccttatctggagcagatggtgaaaggggtgaaggcgctggggctggagtcctgtatgacgctcggcaccctgaccgacagtcaggcgcagcgcctggccgaagcgggcctcgattactacaaccacaaccttgatacctcgccggaattttacggcaacatcatcaccacccgcacctaccaggagcgcctggatacgctggataaagtgcgtgatgctgggatcaaagtctgctccggcggcatcgtcgggctgggagagagcgtaaaagatcgcgccggactgctgctgcaactggctaatctgccaacgccgccggaaagcgtaccgatcaacatgttggtgaaggtcaagggcacgccgctggcggataacgacgacgtcgacgctttcgatttcatccgcactatcgccatcgcgcgcatcatgatgcccacctcctacgtgcgtctctccgccggccgcgagcagatgaacgagcagacccaggcgatgtgctttatggccggggcgaactcgattttctacggctgcaagctgctgaccacgccgaacccggaagaggacaaagacctgcagctgttccgcaagctggggatcaacccgcagcagacggcggtgctggaaggcgacaatgagcagcagcagcgtctggagcaggccttactcaccccggacactgaggaatattacaacgcggcggcgctatgagctggcagcagcgaatcgatcgggcgctggatgagcggcgggcggcggaagcttttcgccgccgcctgccggtgacgcacggcgccgggcgctggctggagcgggaaggggagcgctggcttaacttctccagcaatgactatctgggcctgagtcagcatccggcgattatcgccgcctggcaacagggggccacgcgctatggcgtcggcgccggcggctcgggccacgtgagcggctatagcgaagcccaccgcgcgctggaagaggcgctcgccgactggctgggctatccgcgcgcattgctgtttatctccggctttgccgcgaatcaggcgctgatcgccgccctggtggagaaagacgatcggattgtcgccgaccgcctgagccacgcctctctgctggaggcggcgagcctcagcccggcgcagctgcggcgctttacccacaacgatccgcatcagctcgcgcaactgctggctaagccgctggcgggcgaacagttggcggtcactgaaggcattttcagcatggacggcgacagcgcgccgctggcggccattcacgccgcgacgcaggcagcaggggcagtgttgctggtggatgacgcccacggtgttggcgtggtcggcgacgaaggacgcgggagctgcgccgcgcaggcggtgcgccctgagctgctggtggttaccttcggcaaggccttcggcgtcagcggcgcggcggtgctgtgcgacgaagcaatggccgattatctgctgcagtttgcccgtcatctgatctacagcaccgcgatgccgcccgcccaggcggtggcgttgagcgctgccctggggatcattcgcagcgatgaagggcagcagcgtcgcgacatcctggccgcccgcatccgtcagttccgtgagaggatgggcgaggtgtcgctggggttgaccgactccgtcagcgcgatccagccgctgatcgtcggcgacaacgcccgggcgctgaacctggcctgccgtctacgcgacgcgggctgctgggcaacggcgatccgtccaccgacggtgccggtcggcagcgcgcgtttgcgcctgaccctgacagccgcccatcatgctgaagacattaaccgtttactggaggtgctgcatggccacagtgaataagcaggcggtggccgcggcgtttggccgggcggccagcggctatacgcaacatgatgaactgcagcggcgctgcgccgatctactgctgcgccagctggcgcgccgcgattttgcgcaggtgctggatgccggctgcggccccggcagtatgagtcgctattggcgtgaggcgggcagcgtggtgaccgcgctggatctctccgccgggatgctcgcccaggcgcagcgtaacgacgccgcgcagcattatctgctgggggatattgaggcgctgccgctgccggacgcctgcgtcgatctggcgtggagcaatctggcggtgcagtggtgcgacgatctacgggcggcaattggcgagctgtaccgggtggcgcgtcccggcggcagagtggcgtttagcacgctgctcgccgactcgctgccggagctcaatcaggcgtggcaggccatcgacgaccggccgcatgccaaccgtttccttagcgaagcggcggtgcgcgcggcgcttagcggcctgcgcgcgaccggcgaggttcatcagattagcctgccgttcgccgatgcgctgagcgctatgcgctcgctgaagggcatcggcgccacccatttgcaccaggggcggaccgccgccccgcttggccgcggcaaactgcgcgagctgcagctggcctggccgcagcggcagggcatctgcccgctgacgtattctctttttacaggagtcattgagcgtgactaaacgtttttttgtcaccgggaccgatactgaagtcggtaaaaccatcgccagcagcgccctgctgcaggcggcgaatctgctgggttttcacactgccggctataagccggtggcctccggtagcgagcttaccggcgatgggctgcgtaatgaagatgcgctggcgctgcagcgtcatagtcgggtcgcattgcgttacgaccaggtgaacccctataccttcgccgagccgacctccccgcacatcatcagcgccgacgaagggcggccgatcgccgcggccaggctctccagcgggctgcgtgagctggaaggtctcgccgactgggtgttggtggaaggcgccggcggctggtttacgccgctctcggattccctgaccttcgccgactgggcgcaggcggaacagctgccggtcattctggtggtgggcgttaagctcggctgtatcaaccacgcaatgcttaccgctcaggcggtacgccaggcgggactaccgctggcggggtggatcgccaatgacgtacagccgccgggcaagcgccacgccgaatatctggcgacgctgaaaaaccgactggccgcgccgttcctcggcgaaataccgtggcttgccgatatcgcgcagcgcgacgatctcggccagtatctggacctcagggcgctggatccggcgttatccactgcgccagcagcggctcatccagcgccataatatcgccttcggcgacgttacggccccggtgcaagacacagaagcgatccgccacccggcggataaagggcaggtgctgctcggcgagcagcaccgtcaggccgatatcgcgatttaaccgcaacagcagatccgccagcttttgcaggcagcgcggccctctgccgcgcgagggttcatcaaggatcagcagccgcggctggacgatcagcgccctggccagcgccagctggtactgatcgtcgtcgctcagcgaggcgcctttgcgctgccgtagggcatagagctcgggaaaatgctcataaatctcgccgccgctggcgttagccccgggtttcccggccgccagggcgatgtgcaggttctcttccacgctgagttgggaaaaaatgcgtttatcttgtggcacgtagccgataccaatggcgctgcgcgattgagcggacaggggggtgagatcctgcggcggggcgccaatgtcatgccaggtcatccggccgctagccaccggcaggtggccagcaatgcagttaaccagggtggtttttcccatgccctcgcgtcccagtacgccaatgcactctcccgggcgtagtacaagatcgacattccacagcgaatgctggttgccgtaaaagtgatttactgcctgtaaattcaacatggacgttttctccttatcctggcgtcagggcgacagaaagatgctgcaaaactcttgccaggaaaaagaacgctcggaaaaaagcgctaaacgccgataccatcgggcctcgtcagcgccggggctgcacttttccggtgcccgacgctaaagggtggtgcaaaaagcagcaaaaatcgagcggctttaagcggatagttatcaaaaatagttcgataaaaatttttcgccacgcggttgaccgcaaaaggcgacaggcgccgggcggcggtggtcttgggctgcggacagttatccactattcctgtggataaccttgtgtattagagttagaaaacctgcggtaagctagagcgtacgcggcttgcggctgaattggcgcgaaaggcgtcttttctttaaagatcttaaatatcagcttgttagataaaatcaatgggtgtaagaaaagcgtcatctgctgccataaaagtttcacccgtccgcttgacaaatgttaaaaggtaaaattttctggggataaccctggcggccggaggattattccgtctgacgcgcgttttgcacccagcttgccggccaataagacccttttgtggcgttatcataagtacgcactgtttaaatatccagtataatttattggcaaaaaacggtccggggggtagaattaaacaccggccgctaattcttttttcaggttctgattgatgagtaaatcgtttgtactgcattccgcctttcgcccctccggagaccaaccggaagccatccgccgcctggaagaggggctggaggatgggcttgcgcatcagacgctactgggggttaccggctccggtaaaacctttaccatcgccaacgtgattgccgacctgcagcggccgacgatggtgctggcgccaaacaaaaccctggcggctcagctctacggcgagatgaaagagtttttcccggagaatgccgtcgagtatttcgtctcctactacgattactatcagccggaagcctacgttcccagctcagataccttcattgagaaggacgcctcggttaacgaacatattgagcagatgcgtctgtcggccaccaaagcgctgctcgagcggcgcgacgtagtggtggtggcgtcagtctcggcgatctacggcctcggcgacccggacctgtatctgaaaatgatgttgcatctaacggtcggtatgctgattgaccagcgagcgatcctgcgtcgtctggccgaactgcagtatacccgcaacgatcaggccttccagcgcggcacttttcgcgtgcgcggcgaggtgatcgacgtcttcccggcggaatccgacgatatcgctctgcgcattgagctgtttgacgaagaggtcgagcgtctgtcgctgttcgacccgctcaccggccacgtcgaagggacggtgccgcgctataccatttatcccaagacccactacgtgacgccgcgggagcgcatcgtccaggcgatggaagagatcaagctggagctggcggagcggcgcaaggtgctgctggccaacaacaagctgctggaagagcagcgcttaacccagcgtacccagtttgacctcgaaatgatgaacgagctgggttactgctcgggcattgaaaactactcgcgctttctctccgggcgcgggcccggcgagccgccgccgaccctgttcgactatctgccggcggatggcctgttggtgattgacgaatcccacgtcacggtgccgcagatcggcggtatgtaccggggcgaccgggcgcgcaaagagacgctggtggaatacggtttccgcctgccgtcggcgctggataaccggccgatgaagtttgaagaatttgaagcgctggcgccgcaaaccatctatgtgtcggcgaccccgggcgcctatgagctggataaatccggcggcgaggttgtggatcaggtggtgcggccgaccggtctgcttgacccaatcatcgaagtgcgcccggtggcgacccaggtcgacgatctgctgtcagagatccgcctgcgcacggccatcaacgagcgcgtgctggtcaccactctcaccaagcggatggcggaggacttaaccgagtaccttgaggagcacggcgagcgcgtgcgctatctgcactcggatatcgacaccgtcgagcgcatggaaatcatccgcgacctgcgtcttggcgagtttgacgtgctggtggggatcaacctgctgcgtgaggggctggatatgcctgaggtgtcgttggtggcgatcctggatgcggataaagagggcttcctgcgttctgaacgctcgctgatccagaccatcggccgagcggcgcgcaacgtcaacggcaaggccatcctctacggcgataagatcaccccctccatggccaaagccattggcgagaccgagcgtcgacgggagaaacagcagcgctacaacgaagagcacggcatcgtgccgcaggggctcaataagaaagtggtggatatcctgcagctgggccagggcctggcgaaaaccaaagccaaagggcgcggtaaagcgaaggccgttgagcctgccgggcttagcgctgtggatatgacgccaaaagcgctgcagcagaaaatccacgagctggaagggcagatgatgcagcacgcgcagaacctcgagtttgaggaggcggcgcaaatacgcgaccagctgcatcagctgcgcgagctgtttatcgccgcctcctgattctgggcgcagaccggcggagtggacgtgcggggtatagtgaaggcgcgcttctcttatcgtcctgcttgccagataacaaacatttgagaagaaaaaaggccgcgttgcggccttcttaatgtttgcttaatctcgccaggcgacactatcttcaacctgatgaggatagcgcccatgcaaaaaattaacttccgtgaatatctggcggtcgccaccgccctggtcattattgttgccttcatccatcaatgggtgctgacgttctgacccccgcgctgcgggaatagcacccacgcgcggacccctggccctggctgtcggttatgcaaaaaaaactgggcgtcatgcagctgagcgatgcgcgtgacgatgctccgtccgaggccaatgccgccgtagcgactgtccatgcgcacgaaggctttactgagttcgccgcttttcgcctcatcgatccccggcccttcatcttccaccgccatcaccggcatcaggcccgctttcaccgacacacggatcgtcgacccttcagggctgtagcggtgagcattctccaccagattgcgcaggatcacgcggattaacgtcgcatcgccagagacgacggcctcgttttcgatatccgtcagcagcagccgctgctgacgctgcgccagcatagcctccagttcgtcctgcaggggttttaccacgtcatccagcaacagcacctgctgggagctgccggcggagaaggactggccgacgcgcgccagctgcagcagctgggaaatgctggtggtcatctgatcgagacgctggatcagcgggtcgacgcccatgccatgcactttcgccagcagctcaaggtgcagccgcagcccggccagcggggtgcgtagctcatgcgccacgtcggcggtaaacagccgctcgcggtcgagggtcagattgaggcgggaaaccaactgattcagggcggtggtcaccgccgtgccttcgggcaccgattcgctgagtacgataggagtgaggttgtccggcgtgcggttctccagttcgctttgcagtcgtgaaagcgggcgggtgatcttgcgcaccgccagcatgctgatatacagcgccaggccaacgatcagcaggctcggcaccagcaggctggcaaccgcttcccgtacctcatgctccacatgtttctggttgttgtgcccttcgatggcgctggccaccagcagctggatctgctctttgctctcatgccatagccagaagacgcttatcagctggcagaccaccaggatggcgccgatggtcagcagcagccggtggcgcatggtccaggtttcagttgcaaacagagccatggtctattccgtgtcgatgttgttagccagcatatagccaaagccccggacggtgcggattcgcgatttgccaatcttttcgcgtaggttgtgaatatgcacttccagggtattggtcgccggctcgttgtcccagctgtaaatgtcgttgtagaggatctcgcgatgcaccgggctaccggctttcatcatcagccgcgacagcagggcatactctttcggcgtaagatccagcgccgtttcacccagccacaccaggcggcgagtgacgttaaggcgcagatttccgacgctgatttcattatcgccctggttgttatgccggcggagcagggcgcgaatgcgcgcattgagttcctccagggcaaagggttttaccaggtagtcatccgccccggtatcgagaccgctaatgcgatcctcaagcgtatcgcgggcggtgaggatcagcaccggctgggtcattttctcccgccgcatgcgggagagaaaatgcagcccgtcttcatccggcaggccgagatccagcacgatcaggctgtaatgattgctggccagcgatagcgcggcttcgtgcgcggtggagacgccgtcgcacacgtatccttcactttgcatcgccagaattaacccctgcaacagcagcgcatcgtcttcaatgactaagattttcatcaaccagcctctctacatggcgttaagatatcatctgccgcctggtactcgcgggtgctgacgccgagcaggccgagcagggtggagaacagattatcctgcgagtaattctctttttgcgcccgctgctgtagacagtgcgcggaaatgccgtagcgctgctggtagtcggcggagagccacagcgccatcggcacatgtttctgcgtatccggcgcgatggaatacggcagaccatgcaaatagacgccatcttctcccagcgattcgccgtggtcggacaaataaaccagactagtggtaaatttatcctgtttagattgcagtagttttatcgctttatcaacgacatagtcgacataaaggatggtgttgtcataggtattggtcaactgctcccgggtacagccctggatctcattggtgtcgcaggtcggcgtgaatttgcgaaacgccgctggatagcgattgtagtacgtcggaccgtggctgccgatggtatgcagcacaataatgccatcctgttgcaggttatcgatatagctgtcgagattatggaacaggacgtcatcgtagcactcgccatcgatgcactgcccggtgagcttcaggtcggtgacgttctggtgtggtacccggtcgcaggcgcctttgcagccgccgtcattatcgttccacagcacctggatccctgcgcgctgtagaatatccaggacgccttcctgatggtgcgccagctcttcgtcataatgcgcgcgcggcatattggagaacatgcacggcacggaaactgcggttgccgtgccgcaggaagtggtatgcggaaaatagatcacgccgtcctgccgcatcagcgggttggtgtcgcgcgaatagccgcccagtgagaagttatccgctcgcgaagtctcgccgagcacgacgatcgtcaggttcttacggggagcgttatgcatcaccgctttctgcatggcatcttcgccaatcttcaccagcggcaggttgtccatccgatgatgagcataccaggagttcacggccacaatgctgttggaagggctaagggatttcaccagctctttgttgttacggaacaccgaggcgtaatctttgtagaacagcgcggccaccagaataatcagcagcgccgaaacggcgatattgagcaggcgcatcgccgcgccgcgccaccgcgtggcgggcttacggattttcacccaccaggcgacgaataccgccaaaaccccggaaaggccgaggacggcaatcatttcgccggagagtagagcaaagctttccgccggagtggtgtcgaggatattggtgatcatgctgcggtcgatcaccacgccaaagttccagatgaagtattgcgccgaggcgctgagcagaatgaacaggctaatcaccagccggtccagcttcaggaacgaggcgagagtggtgaggatattcatcacgctaatggccacgatcggcatactgaggaataccagccagttatgcaggctatttaccggcagtaacgggaaaacctggcgataaaaagccaggttgagacagataccgatatagcaagcaaagagaatcagataagtcgtgcggctgaccaccggccgacgcagaggcaataacgacataatgcacacccacagaaaaagatgagggtatagtgccagccctattttaagacaaccttaagattttaaggtgcgccgaagagggccgcctccggcgcgcaggatcagcccggcagctggatcgctttctccagcgccccgcggagcagcgcccggtcatgacgatagggaacgtcgctggcctccagcggcgtctggatcaccaaccggtcgtcgatgccgctgatatcggcttttggaccggcgatcaccgcatccaccacccgtttgcctacatagcgctccataatcgcgatgcgctccgccagcgacagcctcgcggccgggctatgctctttgccgaggttatcgataaaaaccatcggcgccggggtgcggcgcaacgcctgggccatctcgtcgagcaacaggatcggcagcaggctggtgtaaaaactgcccggcccaatgaggatcaaatcggcttcggcgatagcctccaccgcctcgcgggtggccggtaccggcggggtgagcatcagctcctgcggcacattatcaagctgatcaatattcacttcgccataaacttcatggccttcatgatcgagcgccatcaaatccaccggttgttctgacatcgggatcaggaaagcgtccactttcagcaggtttctgatcaaattgatcgcctctaatggccgcacgctcaggtgatccagcgcctttaacatcaaatttccgaggttatgtccggaaagctcgccgttaccgccaaaacgatactcaaacatcgccgacgctacgctcggctcggcaattaactgattgatgcaattgcgcatatcgccccaggcaatgccaccttccgaacgacggatccgcccggtggaacccccgttatcggtggtggtgacaatgccggtcagccgtgagccgagcgaggagagggaggacatcacccggcccaaaccatgcccgccgccgagcgctaccacccgatcgaggtcagcgaatgtacgattgcgcatagaaattccttatttcacataaacggccacacactacccgatctacccctaaaagacgatgggaggagcccgacaaactgaccgacatcaaggcaaaaaaatgatttatggctattctgtagcgaaaatgcacgaagatagcgatatgtataagattatatagcgaaatcgccaatggcgaaactgcctgtaacgcgctactatcgacataacctgttaacactctagcctcttcgcctgtgtcaaaagatatggcgatttggccgcgacgccaccagttgtcgccagggcgtggaaagaaatgaccgcgtctcccgtatttggaaaggtgtatatggcctcacagcttaccgatgcattcgcgcgtaagttttattacctgcgtctgtcgattaccgatgtgtgcaacttccgttgcacctactgcctgccgaacggttacaagcccggcgccgtcaataacaatggctttctcagcgtagacgaagtacgccgggttacgcgcgctttctctgcgctgggcaccgaaaaagttcgcctcaccggtggggaaccctccctgcgccgcgacttcaccgagatcattgccgccgtgcgtgaaaacccggcgatccgtcagattgcggtcactaccaacggttaccgcctggcgcgcgatgtcgaacgctggcgcgatgccggcctgacggcgattaacgtcagcgttgatagcctcgacgcccgccagttccatgccatcaccggccaggacaagttccaccaggtgatggacggcattgacgccgccttcgccgccggctttgacaaggtgaaggtgaataccgtgctgatgcgtgatgttaaccatcaccagctcgataccttcctcgcgtggatccaaccccgtcgtatccagctgcgctttattgagctgatggaaaccggtgaaggcagcgacctgttccgccgtcaccatctctccggcatggtgctgcgcgatgaactgctgcgccgcggctggatccatcagatccgccagcgcagcgacggcccggcgcaggtcttttgtcacccggactacgccggcgagatcggcctcatcatgccgtatgaaaaagacttctgcgccacctgcaatcggctgcgcgtctcgtccgttggcaaactgcacctgtgcctgtttggcgaaggcggcgtcgacctgcgcgacctgatggccgaagaccagcagcaggccgcgctggaggcgcggatcgccgaagccttaacccataaaaagcagacccatttcctgcatcagggcaacaccggtattacgcagaacctgtcctatattggcggttaatcgttttcgaaaggagcattcagatgagccaggctagcgctgagtttatcccgacccgtattgctattcttaccgtttccagccgtcgcggcgaagaggacgacacttccggtcactggctgcgcgaggcggcgcaggaggcggggcaccaagtcgtcgagaaggcgatcgtcaaagagaatcgctacgccatccgcgctcaggtatcggcgtggatagccagcgataacgtgcaggtggtgctgatcaccggcggcaccggttttaccgacggcgatcaggcgccggaagcgctgctgccgctgtttgatcgtgaggtcgaaggctttggcgaagtgttccgcatgctgtcgttcgaagagatcggcacctcgacgctgcagtcccgggccgtggccggcgtcgccaaccgcacgctgattttcgccatgccgggctcaaccaaagcctgccgtacggcgtgggacaacatcatcgccccgcagcttgatgcccgcacccgtccctgtaacttcattccacacctgaagaaataatctatgtcacaactgacccatattaacgccgcgggcgaagcccatatggtcgatgtctccggcaaagcggaaacggtgcgcgaagcgcgcgccgaggcttacgttgaaatgcaggcgacgaccctggcgatgattatcgacggcagccaccacaaaggcgatgtgttcgccaccgcgcgtatcgccgggatccaggcggcaaaacgtacctgggagctgatcccgctgtgtcatccgctgatgctcagcaaagtggaagtcaatctgcaggcgcagccggaacataaccgggtgcgcattgaatcgctctgccgactcaccgggaaaaccggcgtcgagatggaagcattgaccgccgcctcggttgccgcgctgaccatttacgatatgtgcaaagcggtgcagaaggatatggtgattggctcggtgcgcctgctggcgaaaagcggcggcaagtccggcgattttaaggtgggtgaatgccatgattaaggttctgttttttgcccaggtgcgcgagctggtcggtaccgattcgctgacccttgatgccagcgaactggcgactgtcgaagcggttcgtcagcagcttgccgcccgcggcgatcgctgggcgctggccctggaggagggcaagctgctggcggcggttaaccagacgctaacctctttcgaacatccagtggccagcggcgacgaagtggcgttcttcccaccggtaacggggggctgacatgacgcaaacccgtatcgtggtcagcccggcgcgctttagcgtcagtgaggaatatccctggctggcggaacgcgatgaagacggcgcggtggtcaccttcaccggtaaagtgcgtaaccacaacctcggcgacagcgtgaaggcgctgaccctcgagcactatccggggatgactgaaaaatcgctggcggaaattgtcgagctggcgcgcgagcgctggccgctgggccgggtgacggttatccatcgcatcggcgaaatgtggccgggggaagagattgtgtttgtcggcgtcaccagcgctcaccgcggcagcgccttcgccgccggcgagtttattatggattacctgaaaacccgcgcgccgttctggaagcgtgaagcgacgccggatggcgaacgctgggtcgacgcccgcgacagcgatcgccaggcggcagagcgctggtagtgtgatacgcttacagggtgaaactttgtttatcaggagagagtcatggacagatatccgcgttccgattcaatagtgcagggccgtaccggcctgcagacttacatggcgcaggtgtacggctggatgacggtcggcctgctgctgacggcgtttatcgcgtggtttgcagcgaatactccggcggtgatgatgttcgtcttttcgagcaaaatcactttcttcgggctgattattgcccagctggcgctggtgtttgtgctgtcgggaatggtgcagcggctgagcgccgggatggccaccacgctgtttatgctctattcggcgctgaccggactgacgctatcgagcatttttatcgcctatacctattcatcgatcgccagcacctttgtggtcaccggcgggatgtttggggcgatgagcctgtatggttacaccacgaagcgcgatctgagcggcttcggcagcatgctgtttatggggctgattggcatcgtgctggcgtcgctggtcaacctgtggctgaagagcgaggcgctgatgtgggccgtgacctatattggggtggtgctgtttgtcggtctgacggcgtatgacacccagaagctgaaaaacatcggcgagcagattgatacccgcgacagcgccacgctgcgtaaatactcgatcctcggcgccttaacgctgtatctggacttcatcaacctgttcctgatgctgctgcgtattatgggcaaccgccgctaacctctttatatcaaggggttgcatctccgaacgcccggcaagcgcagcgccgccgggcgagatttcaggcacggtacccttgattttgccgggtggcggctgcgccttacccggcctacaggatcctctcacaggcttacgctccgtaggcccgcgcaagcgtagcgccgccgggcgatggcatcagacacggtacccttgattttgccgggtggcggctgcgccttacccggcctacaggctcctctcacaggctcacactccgcaggcccgtgcaagcgcagcgccgccgggcgagatatcaggtacggtacccgtggtattgccgggtggcggctgcgccttacccggcctacaggatcctctcacaggcttacgctccgtaggcccgcgcaagcgtagcgccgccgggcgattgcatcaggcacggtacccttgattttgccgggcggcggcaggcgccttgcccggcctacaggatcctctcacaggcttacactccgtaggcccgcgcaagcgcagcgccgccgggcgagatatcaggcacgatacccgtgatgttgccgggcggcggctggcgccttacccggcctacaggatcctctcacaggcttacaccccgcaggcccgcgcaagcgcagcgcggcctggccgtttcattcgcgggccagcttgcgctggttcttttgccgccgctttttcgcccggctctccagcagcagataggccaccgtcgccagcagtaatggcaggaaataatagagcgcgcgccaggcgagcagggcggcaatgatcgcgcccttcgaaatagcttccccggagagcatggcgataaacaccgcctccagcacgccgatcccagccggaatatggataatcaccccggcgatactgctcaccagcagcacccctaataccagaaaatagttaatctcgctgcccaacagcagccagattatcgcccccatcgccatccagttcgccgccgagagcaccatctgcagcagcgcgaagcgccaggagggcagcaccagccgctggcctttaatcgtcaggtgacggcgtttagcgaacgcgcagccgaacagatagcaaagcgtaaggatcagcatcaccccgccgataatgcgcagagtggtctggctgatgtaccagtgcggcggcagcttcaccagatctgccgtgaatatcaccccgcccagcagaatatagcccaaccagttggtggtaatgcttaaggaaaaaatacgggtgatggtgctgccgttcagccccagccgcgagtacagccggtagcgcataccgatcccgccgacccaggtgctgagtgtcaggttgaaggcgtagcagataaacgacaccagcatgacctggcgtttcgccagtttgtgcccgcaataggcccgaccgagcagatcgtagcagccgtaaatgaggtagctgacgataaccagcgcaatggcgctaaacaaggccagccgatcgtagccgcggatcaccttccacacgtcctgccagtcgactttttgcgcgtagatcaccaacaggacgatgacggcgataaaaaagagcacggtcagcactcttttcgccatccgccagcggggatgtgatttgctcatagttgattatccctggctggagactcgacgcggtcctgagtttcaatttccggctggaccggcgggctgactctggccagccgcggggtatgagccggtagccagccgacccatgccgggaagtggcgcagaaagtggaaagccatcacgctgacgcccagccgccaccagttgcgtttcggcagcatcgttttatcgatccgctggcaatcccgggcgataagcccgttgagattatcgcgcagcgtctggttaaacacccgatcgtggatgatcagattggcttccagattcagcgacaggctaagcggatccaggttgcttgacccaacggtggcccagtggtcgtctgccagagcgaccttgccatgcagcgggcgacggcgatattcgtaaatctgcaccccacccttaacgagatagtgatagagcaggtgggcgccaaacttcacaatgggaatatccggttcgccctgcacgatcagcttaacccgtactccgcgccgcgcggcattgcgcatcgcatgcagcaggcggtagccggggaaaaaataggcgttagcgataatcacttcccggcgggcgctggtcagcatcttcaggtagtggcgttcaatatcgtcgcggtgatcctggttgtcgcgccagacgaacagcgcctgcgcctcgccgggggtctggttaatctccggctggtggcgacgacgtcgccaccagcggcgggcggtttcgctgttgggcaggttttccagctcgaactgcaggatgtcgagcaccaccggcccttcgacctgcaccgcataatcctgcttcgcctccggaccgtagtcgctcatatgttcggcggagtagttaataccgccgacaaaggcggtggtgtcgtcgattaccacgattttacggtgcatgcgacggaacagattggtgcgcatccccatcagcttaggacgcggatcgtagtagcggaaaatcacgcccgcggcggtgagctcgcagacaaattcatcgctgagatccggggaaccatagccgtcgaggagcacctccacctggatgccgcggcgggcagcctcgagcaggaccgcgtgcagccgccggcctacctcatcttcaaaccagataaaggattcgaggatcacccgccggctggcgcgaccgatggccgcaaacagcgccggatagtactggtcgccattctccagtagcgtaatgcggttgccttcctgccaacgacatttcacaaatgtatctccacgctaaggggtgcatgatcggacagatgccgccaatgtttaagggccagcgccttcgggcgactggcgtgggcgttcttgacgtaaatgcggtcgaggcgcaacagcggaaaactgaccggaaaggtgcgcgccggccgtccgcgggcgcgggtaaagatctcttccagcccggcctgggcttttaacggctggttagcctgctgacgccagtcgttaaaatcgccagccaccaccaccggctcgcccgcgggcagggtattgacccactccgccagcatggtcaactgcgcctgccgttggtcggcgcgtagaccgagatggacgcaaatcacgtgaatagttatcccgctccgcggcggcacgatgcggcagtacagcaggccgcgcttctccccgttgccgaccgagatatcgcgattttcgtagtattcaatgggaaagcgcgacagcacggcgttgccgtggtggccttccggataaaccgcattgcgcccgtaggcgtagtcgctccacatggtgtcggcgagaaattcataatgggtcgtatccggccagttttcgatgtgcagcggatgtacctcatgagcgcccatcacctcctgcaggcaaacaatatccgcgctaacgctgcgcacggcgtcgcgcagttcgggcaaaataaaacgccgattaaacgccgtaaagcctttatgggtgttaattgtcagcacgttcaacgaaaatcccgccgttggctcagccataattctccagtaaatgtcactttcctgaataaaatagtgtagtagacgtcacaaaaagatgcggtgttacggaattttccgtaaagtgcggtactctgagtagcagagaaaaatccttcaggagagaagccatgaagtggcaacaacgtgtacgcgtcgcaacgggtcttagttgctggcagattatgttgcatctactggtcgtggcagtactggtgatgggttggatgagcggcgcgctggtgcgcgtcggattgggactgtgcgtcctctacagcgtcacgctgctggcgatgctgtttttacagcgtcaccatgaggcgcgctggcgcgatgtgggagacttccttgaggagctcaccacgacctggtacttcggcgcggccatgatagcgctgtggctgctgtcgcgcgtgctgcacaacaacctgctgctggccctcgccgggctggtgatactggcaggcccggcggtggtctcgctgctggcgaaagataagagccgttaccctaaagcgttcgggctacaacaaggcggcaacgcagcgaatccccagaagcatagataactatgcgactggggtgagtaaggaaagccaacgccgttgtagtttgaacgatgacgggtattacgcaatcttccttcggaacatcgcatacgccgctgagccggtggtggccgctatgaccagtagcggccacaaacttccccacacaatctccagactcgcatccttcagataaatttgcttggtgatatcggtaaagtggcggatgggatttatccaggtcagatcctgcagccactgcggcatgttttccactggtgagacgtaccccgacaggagaatagccggcatcataaagacgaacacgccgataaacgcctgctgctgggtggcgcacagcgacgaaatcaataagccaaagcccaccagcgatagaccgtaaatcaccatggtgaaatagaacagcagcagcgagccggcaaacgggatctgataggcccagataccaatcgccagcacgatagttgcctgcagggtggcgacgatcagcgccggcaccgccttgccgacgaaaatttgccaggtggcgaggggggagaccagcagctggtcaagggtgccctgctcgcgctcgcgagccaccgacagcgaggtgacgatcatcaccccgatggtagtgatcatggcgataagcgacggcaccacgaaccatttatagtcgagattcgggttgtaccagttgcgcaccaccagctcgctgttgttcggcttcgctttaccctccagcagctcctgctgatagtttttcacaatctgttgcagatagttggcggcgatttgcgcgctgttggagttgcgtccgtcgagcagaagctgcagcggggcggttggatagttatccagattgcgcgagaaatcggccgggaagcgcaccaccagcagagctttttgttcatcgatggtcggcgggatcgcctgcgggctttgcagcagcaggacgtgggtaaaggctttggcgcgggcaaagcgctgagtgagttccaccgcgtggcgaccgctgtcctcgttgtagatagcgatggtggcgttggtcacctccagcgtcgcggcaaagggaaacagcagcacctgaatcagcaccggcatgattaaaatcgcccgcgtctgcggctcgcgcagcagcgactgcagctctttgcggattaatgtccataaacggtgaaacataatagctcctttggcccattcaaccacgccgggcggcactgcgtttgcccggcctacgggatcggcgaaccgtataatcgatgttggttaaaccgtaggcccggtcggcgcagcgccaccggacaaaacctaatccagacgccgtttggttttcagccacgtcagaccgataaacatcaccgccgacgcaatcaaaaacagcacgttgaccagcagcaccaccggaatattgcccgccagaaacaggctttgcagagtactaacgaaatagcgcgccgggatcacataggtcaccgcgcggatcaccgccggcatactgtctatctggaaaataaacccggacagcataatcgacggtaaaaaggcggcgttcagcgccacctgcgcggcgttaaactggttgcgggtaatggttgagatcagcagccccatccccagggtgctgagcaaaaacagactggtaatgacaaacaggatcggcagcgagccgcgatagggcacgccgagaataaataccgacaccagcatacacaacagcatcgccagcatgccgaggaaatagtagggaatgagcttgcacagcagcagttcggcgcgggtgatctccgtcgacagcagcgcctccatggtgccgcgctcccattcgcgggccaccaccagcgaggtcagtatggcgccgaccacggtcatgatgatggtgatcgccccggggataataaagtgctggctaatagccgccgggttaaaccagtagcgcatctgcacgtcgatcagcggttcaaaggtttcgccgcggtcttccgcccgctgctgctgccagatttgccaaataccttccacatagccctgagcgaagttggcggtattgggctcgctgccgtcggtgatgagctgcagcggtgcgtcggcgccggggcgggccatctggcggtcgaaatccaccggaatgaccaccatggcgcggatgcgcccggcctgcatcatctcaatcagctgcctgcggctgtcgctgacggtggcatcgatatagggcgagccggtcatggtatggacgaaatccagcgcctcttcgctctgctgctcaagcaatacgccgacccgcagcctgctggagtcgaggttaatgccgtagccgaagataaacagcagcagcagggggatcaccaccgcgatcagccaactgctgggatcgcgcacaatctgccgggtctctttgacgcacagggcgcggacccgccgccaggagagaatgctattgcccatggctattctccttgtcccagcggttaatcagggtaataaacgcctgctccatggtcgggtccgtctggctgtcgtccgccgcctgggccttcagcgcgtccggggtcccgctggcgataagcttgccgtgatagaccagcccgatgcggtcgcagtattccgcctcatccatgaagtgggtggtgaccattaccgtcacgcctttatcaaccatgctattgatatgtagccagaactcgcggcgggtaaggggatcgacgccggaggtgggttcatcgagaaacagaatatcgggttcatgcatcagggagcaggccagcgccagccgctgcttgtagccgagcggcagctcgtcggcggcgtggcgggcgatacttttcaggccaaaggcatcgctcatccgggcgattttttcattttgcgccctgccgcgcaggccatagacgccggagaaaaagcgcaggttttgctcgacgctgaggttgccgtacagcgaaaatttttgcgccatatagcccagatgctggcgcgccttgccagagctgaccttgagatccattcccagcaccagcgctttgccggaggtgggcaccagcaggccgcacatcattttgaaggtggtggatttcccggcgccgttggggccgagcaggccgaaaatttcaccgcgcttaacctggaaatcgacatggtcggtagcggcgaaatcaccaaactttttcgttaacgactgggcttcaatgaccgtttcctctttgctgccgtcaacgcgatggataatcgcccccaacggcgattcagcggtcccggcgccgccgagcaggtcgataaacgcatcttcaaagcgcggcgcggtgtcggccacctgcagcggcggcatgtcgccatgctgctggacttcctcaatgcgcgcgtcctttttcaggatcagacgcaccgatttgccctggatcaccccgtcgctaacctgcggcagcttcagcgcccgctgcagcaggcggcggttgttctcctgcgggctggaaaccagaaagctgcgcccggccatggtttgcgtcagcgccgtcggctcaccctggtagagcagtttgccttcgttcatcagcagcacatcgcgacactgctcggcttcatcgagataggaggtgctccacaggatcagcatgccgtcgccggccagctcgtgcaccttctgccatagctcgcggcgcgagatagggtcgacgccgacgccgggctcatcgagcagcagtactttcggatcgcccaccagggtacaggcgaggcccagcttttgcttcatcccgccggaaagcttgcctgccagccgttcggtgaatggaccaagggaggtgaactccagcaggcggtcgaaaattttcttccgcgcctcgccggtgacgctgcgcaggtcggcgtacagggtcaggttttccatcaccgtcagatcttcatacaggccgaacttctgcggcatatagccgagcaccgcgtgcagggcgctgtcgtcttttagcgggtcgaagcctatcacgctggcgcgaccctcatcaggcttgagcaatccggcgagcattcgcatcagggtggttttccccgcgccgtcgggtcccaccagcccggtgacgtagccggcgcggatcgtgcaggtgagcggcgctaccgctggcctgtccataccgggaaaacggcggctcaggccgtttaaggcgatgacggtctcactcatgtccgttcccgtggctaaaggagatggtcaccggcattccctggcgcagcgcgccgtcggcatcagtcaccacaatgcgcagacggtagaccagatcggtgcgcagatccggggtctcgacggtcttcggcgtgaattcagcgctcggcgagacaaaaccgattttgccgtgatagggcttatccggccggctgtcggtatagagcagcacttcttgtcccggctgcgcctggccgaggtttttctcgtcaacataggcgcggacccacaccggatgcgttaacgacagcgtcagtacggtaccgccggcgttgagcatagtgccgggctcgacggcgcgggtcatcagcgtaccgtcagaaggggcggtgagcacggtatcgtgcaggtccagtttggcctgggccagcgccgcctgcgcctgttccagactggctttggcctgggcaatctcctgcgggcggttaccggcgcgatactgacgcagcttatcctgcgccgatttgagcgttgcctgcgcctgatcgcgcgaggagcgggcattctccagatcgttggcggaaatggcgctgctggcgcgcagcccgagctggcgctgataaaagttttgcgcatagtcgtaagcggcctgcgcctgtttcaccgccgccgcggcctgggcaatctcttccgcgcggtagccggccatcatcaggtcatactgcgcctgggcggtggatacattggcctgggcctgcagcagggcattttcatacggcgcgcggtcaagctcgccgagagtttgcccggcgcggatgctgtcgccttcgtcgacggtcagcgaggccagcctaccgccaacgcggaagctcatgttgacggtgcggatatcgacattgccatacagggtcagcggctgctgccggctgctctggtaccaccaccagccgccgcccagcgcggcgagaagaatcacgatcagcagaatgacgacgacgggttttttcatcagcccaaactcctttgcgataacccatgcaggatgaaatcgatatgacaggtaatgacttcgaaaatctgttccgttttttgcgcgtcaaactgcgtccagccggtgcgcagcaggatagtttcacgcccgagacggaaagcgagcacctcgcccagcagggcgtgggtatggaggatcatttgcgtatcactggcttcgcagccggtccaggcggcaatcagccgggtgagataatggtgcaagggggcaatcacctgctggtggatcagatggtaggcggcggtcggcgccagctgctcacgggaaatgaatttgcttaagttaaccgtgtcgtcctgggtgagcagcaggatcatgttgtggcaggcgctaaggatgaggtcgcggatcgcctggcgatccggcgcttccccggcaagcaggtgctccgccgcttcggcctgcgggcgaaaattgtcgccgataaaatcggcgatccactgggcgcaggcaagatacagatcgtctttcgagccaaaataataggtgatagcggcgatattctgcccggcctgggcggcgatatcgcgggtggtggcgtgctggccgtactcgccaaactgggcgatagcggccgcgataagctgattttttgcctgttcgcctttactggtcatcgcgctcggtaaaagttaaacaatcgattgattaactttaggcgccgactggcggtttgtccaccagccgggatcaaatatggaacccttcctctttcagctctccggcgacccaggcgaagaagcgctggaccttctccttctgttcattagcgtgggggaggacgaagtggtgcgcgccgaccggcatgctccgctcgtcggcaaataccggcgtcagctgcccctggcgcacgtgtccgccggccagcagattgctctcgaggatcacgcccatccccattctggccgcctcgatgctcatatatgaccggtcgaaattaaaaatgaagtttttatgccagccgcggaccttgtgccacgacagccagttgctccagttaatcaaggtgctgtcggagtggatcagatcgcaggccagcagatcttccacagcctgcacaggatggctggctaaataagacgctgcgctgtagggcaggacgcgctcatttttaatggttctgaccagcagcgtcggccactgtgacagcccgtgacgaatatcgatatcaatattatcccgggagaactggatgctttcgtatgaacaggtcaggctgatttttaacgccggccacgcctggcggaatttatccagacggggcatcagccatagcaggccgaagctcggcgccgaatgaatgcgtaaataatcctgatggatatcgttgatcacctggctggtggcctggccaatcatattcagcgccccggagacctctttgagatatttttctcccaccgccgttaacgtgacgcctttgctgctgcgggagaacagttttttccccagaaagtgctccaggctggctatctgatggctgaccgccgaggcggtaatattgagattctctgcggccagattaaggctgccggtagcggcgacttcaataaaagcctggatattgcgtaaagagggcatcggcagatttttattgggtagcggttggctcatggcggcatcctgcgcggggcgcgaataaaagaaaatagcgaacagcgtggcgcagccgggatgtacagcatagggaaaagcgaaaaaacaacgttaatttgtgatgggcttaacaatttatcttgttaaaagcgcgcaggtcagaaaacgctaaaaatttgcgggaagtcactaactcaatttttctcaatcataattgaggttttttgaataccgtttcattttggggttgttatattcctctcacaggcctgataacaatctgcgatgctcttgcatcgcaattataaaacacctaaccacctgtttcgctggcgaaaagcatttatctcttgctcctgtatggatagtaaaacgcggtgatccgaagcggcagcttacagcgaagtggatgaggtataaaacgaggaaaccctatgtcacgtatagatacgctggtctgtactgacgccaggaaaacgaaatatcgtttcgtggttttgacgatgatttttctggtgtatgccatcaattacgccgaccgaacgaatattggcgcggtactgcctttcatcattgatgagtttcatatcaataattttgaagccggggccatcgccagtatgtttttcctcggctatgcggtaagccagatcccggccggctttttcatcgccaaacgcggtacccgggggctggtatcgctctccattttcggcttctccgcctttacctggctgatgggcacggtgagctccgtgtttggcctgaagctggtgcggctgggactggggctgagcgaagggccttgcccggtggggctggcttccaccataaataactggtttccaccaaaggagaaagccacggcaaccggcgtttacatcgcggcgaccatgtttgcgccgattattgtgccgccgctggcggtgtggattgcggtgacctggggctggcggtgggtctttttctccttcgcgatacccggaattgtggcggccatcgcgtggtatctgctggtcaaatccaagcctgctgagagcggatttgtttcccaaagcgaactggcagagattaatgccgggcgtgaaagtcataataatagcgtacgcgaaaatatcttaattgccgaaagattcacctggctggataaaatcattcgggtaaagaaaatggcgccaattgatacggcgaaaggcttattcacctcaaaaaatattctcggtgactgcctggcgtattttatgatggttagcgtgctgtacggattattaacctggatccccctgtatttagtcaaagagcgcggtttcgatgtaatgagtatgggcttcgtggccagtatgccgtgcatcggcggctttattggcgcgatcggcggcggatgggtttcggataagctattaggccgccggcgtaaacccaccatgatgttcactgccgtgtcaacggtggtcatgatgctaattatgctgaatatcccggccagcaccctggcagtttgtattggattattctttgtcggcttttgtttaaatatcggctggccagcctttaccgcgtacggtatggccgtttcggatagcaaaacctatccaatcgcctcttccataattaatagcggcggcaacctcggtggatttgtcgcgccgatggcggctggtttcttgcttgataaaaccgggagttttaattctgtatttacctattttggtatctgcgccgccattggtttggtggtgattcttttcctcgatgaaccacaataacggaaatatatcctgttaattaatatgacgtaatgtcatggagtgaaactatgttattaaaagataaagtcgccattattactggcgcggcctccgcacgcggtttgggcttcgcgactgcgaaattattcgccgaaaacggcgcgaaagtggtcattatcgacctcaatggcgaagccagtaaaaccgccgcggcggcattaggcgaaggccatctcggcctggcggccaacgtcgctgatgaagtgcaggtgcaggcggccatcgaacagatcctggcgaaatacggtcgggttgatgtactggtcaataacgccgggattacccagccgctgaagctgatggatatcaagcgcgccaactatgacgcggtgcttgatgttagcctgcgcggtacgctgctgatgtcgcaggcggttatccccaccatgcgggcgcaaaaatccggcagcatcgtctgcatctcgtccgtctccgcccagcgcggcggcggtatctttggcggaccgcactacagcgcggcaaaagccggggtgctgggtcttgcgcgggcgatggcgcgcgagcttggcccggataacgtccgcgttaactgcatcaccccggggctgattcagaccgacattaccgccggcaagctgactgatgacatgacggccaacattcttgccggcattccgatgaaccgccttggcgacgcgatagacatcgcgcgcgccgcgctgttcctcggcagcgatctttcctcctactccaccggcatcaccctggacgttaacggcggcatgttaattcactaagcgaggcaaacagatgaagatgaccgaatcacaaaaagtcgccgcggcggcgtggcgtattcgccgttacgccctgcaaatgggggaagtgcaggggcagggctatatcggccaggcgctgggctatgccgatgtgctcgccaccgccttcagccatgccatgacctatcgcccggaagatcccgagtgggaggggcgcgatcgcttcctgctctctcatggccattacgctatcgcttattatgccgcgctgctggaggcgggcattatcccggaagccgaactggaaacctacggctccgacgacagccgcctgccgatgtccggcatggcgacctacaccccggggatggagatgtccggcggctcgctggggcaggggctgtctatcgccgtcggcatggcgctcgggctgcggcagaaacagagtaaggcctgggtctacaactccatgtccgatggggagctggacgaagggtcgacctgggaggcggcgatgtcggcggctcactatggcctgagcaacctgattaaccttgtcgatgtcaacaaacagcaggctgacggcgattcacgcaaaatcctcggctttgagccgctgcaggataaatgggccgccttcggctggtacgtacagcgcgtggacggtaacgatctgccggcggtgatggccgcctttgacaacgcgaaaagttattccggcaatcagccgcgggtcattttatgcgacacgctgatgggcaaaggggtgccgttcctcgaaacccgcgataaaaaccattttattcgcgtcgatgccgacgaatggcaaaaagcgatcgcggtgctggacgctaacaaaccggaaggagtgctgtaatgagccagagtcaaccccgtttaaaaacgtcggcgatgatcgcctcgattgctgatgaaggccaggcgaccgtccctgcgcccttcggcgtcgcgctgtcaaaactggcggcgcagcgcccggaaatcgtcggcatgaccgcggacctgtcaaaatataccgacctgcatattttcgcccaggccttcccggatcgctttttccagatgggcatggccgaacagctgctgatggcggcggcaggggggatggcgaaggagggatttattcctttcgccaccacctatgccgcctttgcaacccgtcgcgcctatgattttattcaccaggtcatcgccgaagagcatctgaacgtgaagatctgcgcggcgctgccgggcctgacgaccggctatggccccagccatcaggccaccgaagatctggcgatcatgcgcggtatccccgggatggttatcgtcgatccttgcgatgcgctggagatagagcaggcggtaccggccattgccgatcaccaggggccggtgtatatgcgtctgctgcgcggtaaggtgccgctggtgctggataaatatgactatcagttcgaactgggtaaggcgaagctgctggaggacggcaacgatgtgctgattatctcctccgggctgatgaccatgcgcgcgctggaggcggctgaaaagctgcgggccgataatatcggcgtggcggttctgcacgtgccgaccatcaaaccgctggatgagaaagcgattattgaacaggcgtcgaagccgggccgcctggtggtaactgcggagaaccacaccgcggtcggcggcctgggggaagcggtggccgcgctgctgatgcgtaagggcgtacgctgtgagctggatagcgtggggctgcccgacgcgttcctgttagccggcgccctgccgaccctccacgatcgctacggcatctccaccgcgaagattgtcgaaaaaattaagtatcgtctgcgttaaccgcgctgctatgacccactggccgctgagcgcgctcggcggccttctcatgcccgccagccaggcgcggcattcttttgcagattttatgcggcctgtcacaaaatctgctagactgcgccccttcatggcattgtggtttttgccatctcttatcgcaataatctccctgaaaactacgcccttcaccgggccggggcggttcggagttgttatgtcttttgattcccttggcctgaatcccgatatcctgcgcgctgtcgctgagcagggctacgttgagccgacccctatccagcagcaggcgatcccggcggtactgcagggccttgacctgatggctagcgcccagaccggcaccggtaaaacggcgggctttaccctgccgctgctgcagcgcctgatccagaatgagccgcacgcaaagggccgtcgtccggtgcgcgcgctgatcctgaccccgacccgtgagctggcggcgcaggtgggcgagaacgtccgcgattacagtaaatacctgaatattcgctcgctggtggtcttcggcggcgtgagtatcaacccgcagatgatgaagctgcgcggcggcgtcgacatcctcgtcgccaccccgggccgtctgctggacctcgaacatcagaacgccgtcagtcttgataaagttgaaatcctcgtgctggacgaagcggaccgtatgctggatatgggctttattcatgacatccgtcgcgtactggccaaactgccggcgcgtcgacagaacctgctgttctcggcgaccttctccgacgagatcaagggcctggccgagaaactgctgcacaacccgctggaagtggaagtggcgcgtcgtaacaccgcgtccgagcagatcacccagcacgtccattttgttgacaagaaccgcaagcgtgaactgctgtcgcagcttatcggcgaaggcaactggcagcaggtgctggtgtttacccgtaccaagcatggcgccaaccacctcgcggaacagctcaacaaagacggcatccgcagcgcggcgatccatggcaacaagagccagggagcgcgtacccgcgcgctggccgactttaaatccggcggcattcgcgtgctggtggcgaccgatatcgccgcccgcggtctggatatcgaagagctgccgcacgtggtgaactacgagctgccgaacgtaccggaagattacgtccaccgtatcggccgtaccggtcgcgcggcggccaccggcgaagccttatcattggtgtgcgtggatgagcataagctgctgcgcgatatcgagcgcctgctgaaaaaagagatcccgcgcatcgcgattgccggctatgagccggatccgtccattaaagccgaacctatccagaacggtcgccagcagcgcggcggcggtcgtgggcaaggtcagggacgcggcggccagggtcagggacgcagcggacagccgcgcagccagaataatgccccgcgccgtcaggacggcgaggcgccgaaagcgcgcactcaggacggcaaaccgccgcgccgccgtcgcccgcgtaaaccggctggcgaataacacgctgatgtccgggccgcgataacgcgccccggctcaggcccgtctgtccgctacgcggcggcgggcctttttctttccattacactatttgtcgagcaggcttccacactccgcagaaagcaatacctccgggcgggcaaaaatggcacaatagtggctgtttatacagtattcaggttttctcatggctttgaccgctgcgctgaaagcgcaaatcgccgcctggtataaggcgcttcaggaacagatcccggactttattccgcgtcccccgcagcggcagatgatcgccgatgtggcgaaaacccttgccggggaagagggcaggcatctggctatcgaagcgccgaccggtgtcggcaaaacgctgtcatatctgatcccgggcatcgccatcgcccgcgaggaacaaaaaacgctggtggtcagcaccgccaacgtcgccctgcaggatcaaatctacagtaaggacctgccgctgctgcgtaaaatcattcccgacctgcgcttcaccgccgcctttggccgcggacgctacgtctgtccgcgcaacctgacggcgctggccagcaccgcgccgtcgcagcaggatctgctggcctttctcgatgacgatctcaccccgaataatcaggcggagcagaagctgtgcgcgaccctgaagcaggatctcgacagctaccgctgggacggcctgcgcgaccataccgacaaagccatcgacgatgggctatggagccggctgagcaccgataaggccagctgcctgaaccgcaactgccactactatcgcgagtgcccgttctttgtggcgcggcgggaaattcaggaggcggaagtggtggtggccaaccatgcgctggtgatggcggcgatggagagcgaagcggtgctgccggagccgaaaaacctgctgctggtcctcgatgaaggccatcatctgccggacgtcgcccgcgacgcgctggagatgagcgccgagatcaccgccccctggtttcgcctgcagctggatctgttctgcaagctggtggccacctgcatggagcagtttcgtccgaaaaccacgccgccgctggccaatccggagcggctcaccgctcattgcgaagagcttttcgagctgattgcctcgttgaataatattctcaatctctatatgcccgccggtcaggaagcggagcatcgcttcccgatgggcgaactgccgcaggaggtgatggagatctgccagcggctggcgaagctcaccgagttgctgcgcggcctggcggagctgttcctgaacgatctcagcgaaaagaccggcagccatgacgtggtgcgcctgcatcgggtgctgctgcagatgaaccgcgcccttggcatgtttgaaagccaaagcaagctgtggcgcctggcgtcgctggcgcagtcctcaggcgcgccggtaaccaaatgggcgacgcgggtggtgcgcgatggccagatccacgtctggttccactgcgtcgggatccgcgtcagcgatcagcttgaacggctgctgtggcgcagcgtgccgcatatcgtggtgacgtcagcgacgctgcgctcgctaaacagcttctcgcgcctgcaggagatgagcggtctgaaggagaaagcgggggaccgcttcgtggcgctggattcgccgttcaaccacgtggagcaggggaaaattattattcctcaaatgcgttatgaaccgctgatggataacgaagagcagcacattgccgagatggcggcctattttcgccagcaggtggagagcaaaaaacatctcgggatgctggtgctgtttgccagcgggcgggcgatgaaccgcttcctcgagcatgtgaccgatctgcgcctgatgctgttggtgcagggcgaccagccgcgctaccggctggtggagctgcatcgcaaacgggtggaaagcggcgagcgcagcgtgctggtgggtctgcagtcctttgccgaaggtctcgatttaaaaggcgatctgctaagccaggtgcatatccataaaatcgcttttccgcccatcgacagcccggtagtgatcaccgaaggcgaatggctgaaaagcctcaatcgttatcccttcgaggtacagagtttgcccagcgcctcctttaatcttattcagcaggtggggcgtttgatccgtagccataactgctggggagaggtggtgatttacgataagcgtctgttgaccaaaaactacggcgcgcgtctactgaacgcgttacctgtttttcccatagagcagccgggcgttccggaggttatagtaaaacggaaagcaaaacagacagcaaaacagacgggccgcaaacgtcgctgacgccggcgcgtgatgcaccagggggagccatggagtacagcaaaattataaaagaggtgggtcgcggtaagaatcatgcccgcgatctcgatgaagagaccgcccgtgcgctctacgcgcggatgctgaacggcgaggtgccggagctggagctggggggaatattaatcgccctgcgcattaaaggcgaaggcgaagcggagatgaaaggtttttacgccgcgatgcagcagcatacgctgcgcctgaccccgccggccggcaagccgatgccgatcgttatccccagctacaacggcgcgcgcaagcaggcgaacctcacgccgctgctggcgatgctcctgcacaagctgggatttccggtggtggttcacggcgtcagtcacgatcccacccgggtgctgaccgaaaccatttttaccctgctggacattccggccaccctgcacgccggacaggctcaggcgcagctggagggccatgaaccggtgtatatcccggtgggggccttctgtccgccgctggagaaacagctggcgatgcgctggcggatgggcgtacgcaacagcgcccataccctggccaagctggccacgccgtttggcgaaggggaggcattgcgtctctccagcgtgtcgcatccggaatatgttccccgggtggcgaacttctttcgcgagaccggtggccgcgcgctgctgatgcatggtaccgagggcgaagtgtacgccaacccgcagcgctgtccgcagatcagcctgattgatgagcagggcgtgcgggtgctgtacgaacgccagactgagatggcagcggaggcggtggtcctgccgacctcgaaagaccctgaggtcaccgcgcgctggattgaacgctgcgtcgctggcgtcgaaccggtgcccacctcgttgaagatccagcttgcctgctgtctgctggcctgcggggaagtcacctcgctggagcagggcctcagccgcgtcaacgactgttggtgatcggatctgcaggataaaaaaagcccgtccggtggctcggacgggcaaggcaagggtattaaaggtcttttcagggttaattcagtggcttacagatgggtgcagcgattatttatagataaccgcagtaccgctcagtttgttgttggtgttagcggaagtaatgctgtagccggtcgcgccagcggcttcggctttagcagccagttttgcttccagaccatctaaagtggttgcgccttgcgcagacaccacgccgatcttattcatgctttcagcctgagcgggggtaaccggttcggcggcaaaggcgccgaaggaaagagcggtcagagcgatggcagcggcagcatatttgatgtttttcatagttaatctctcgcaggttgttctgttcaggggacgatgttccgtcgatgtgataagtatcacgcttttctgcgagagataaaatcgaaggaaattcacagtcttcatcgaattttttgaatgattaataatttactgattattaataaattatttctcattcttttcgtcacgaagcgtagcgaggaacaccgacgcgtttaagggcacatattgcgactttttccgccaaaaaatgtgcgcgaaaagataatgcgaaaggctgtcataaacggtaaaggaaagtcagcgtagctggctatccttggaaccgcgacgattatatcctgaaaatgtattgttatgtaaatctttctcctgctggcacttcacgcagtatctgacccctgggatggcctgtcgacgggcctccggaatcggctctccgcattcatcacaaaatttgttgctttcgccgcgcggaagctcgcggcgggcgcgagccaccgcatcgtcaatagtgctgtcgatctgatcctgtacggcgccgtcgcctgcccaacctgatgccatcgtctgcctcctgtaaaaggttattgataaattatagctgaaccgtacagccggttaccgctgctggcggcattgatccgccaggctatcgccccctgacggtgggccttatccgcgagggcggccgccaggtcgtccagggtgctggcgccgaaggcggagacggtgccgacagggcggagcggcccgttatagggcagtacgggtggcggtggcaggggagaggccgcggtggcatgagcggtgagcgccgcggcgaacagcagcgagacgaatttcatcagcatatcctcataaaccgcatgggacatagcttaagtgtaggtctttccagaccgcgcgacagggaatgtttaatgcaaaacagtgcgttttgcatgctaccggcgcaggggagcgctactctggccggtagattatttagcgggcgtcagggcggatcatgtcaaagcgcaggctgtcatcaataccgtaataggcgctcgggccaccggcgcgcaggatcggctgggcccgggcggtttgatagataccgttgtccagcagtgattcatcgatatgcacggcgaccacttcgccgagcaccagccacgtatcgacagggttgccgtcggcggtggtgagttgaatacactgcgacagacggcactcaaagttcaccggactctccgcgacccgtggagcgctgaccaggcggctggcggcggcggtgaggccggcgcgcacgaattcgtcctcatggtgcggaatcgaggctgacgtttcatgcatcgccatggccagcggtcgcgtcgccaggttccagacaaactcctttgtttcgacgatatttcgcacgctgtctttccagccgctgctggcgaaaccaatgatcggcggccgatagttaaagcagttaaaaaagctgtatggcgccagattacgctggccctcggcgtcctgcgaggcgatccagcctatcgggcgaggcccgattatcgcgttcagcgggtcatgcggcaggccgtggccctgcgaaggttgataaaagtacatgctgcacctgtcacggataatggagatatccagactcccttatttaccgcgccgccgtcaacgggtatcttacgcggctgttcaaaggagattgtcatgaaagcccagaaaccggggttacacccgcgtaaccgccaccatcaacgctacgacctgcccgcgctctgccaggcccatcctgacctgcagggctacattacgctcaatccgctgggtgagcagaccattgattttgccaatccgcaggcggtgaaggcgttgaataaagcgctgctggcgcatttctacgcggtcaaacactgggacattcctgacggctttctctgtccgccggtgcctgggcgggccgactatattcatcatctggcggatctgctggccggggatagcggcgaggtgccgaaggatgccacgatccttgatattggcaccggcgccaacctcatctatcccctgatcggcgctcacgagtatggctggcgctttaccggcagtgaaatcaacccgcaggcgttcgccagcgcgcaggcgattatcaatggcaacccgggcttgacccggcagatccgcctgcgccggcaaaaagagagccaggctatctttcacggcgtgatccataaaaacgagacctacgacgccacgctgtgtaatccgccgttccatgactccgcagagagcgcccgggcggggggcgagcgcaagcgccgcaacctcggactcggcgccgaaagtggcctcaattttggcggtcaacagcaggagctgtggtgcgaagggggcgaagtagcctttatctcgcagatgatccgcgaaagccaggccttcgcccgccaggtgaaatggtttacctcgctggtgtcgcgcggcgataatctgccgccgctctaccgcctgctgaccgaggtcggcgcagtgaaagtggtgaaaaaggagatggcccaggggcaaaagcaaagtcgctttatcgcctggagctttatggacgacgccaaacgccgtcgtccattctaacgctactcggcggccgggctgtcggcgcccggcatcggcagctgctgccaggtctgtaccggcgcgcgaaccccggcgcgatcgaagtgctttttcacctgggtgtcgagggcaaaacgcaccgtccactgcttcagcggcagggtagtgaagctgacgcgtagcgtaaaggcggtattgctcagccccaccagcccggcgaacgacggttcgccaatgatcagaccgcggatctcctcttgggccagcagatcgtccaccgccgccttcagcgcctggctggctttatccagatcctcatggcggtcaacgtcatagttagccacaaccgagccaatgccacgcacgaagttggcaaaggtggtgatcgaggaccagggaataatgtgataggcgccggtatcctgacgtacccccacggagcgaatcgacattcgttccacggtgccggtcaaagggccgatggtgaccaggtcgccggtgttcatcccgttctcaaactggataaatatgccagtgataatgtctttgaccagggtttgcgcaccaaacgaaatggccagccctaacgccccggcgcccgccagcagcggcgcaatgtttaccccaatttccgagagcaggatcatcaccgtgatggtgctgatcaccaccgccagcgcgttgcgaaacagcgtcagcagcgtccgggcccgcgcgctgggcagcggacggccatgaatatccgatgccagccggttttcaatcaggctggccagaaccgtccagccaatggcggagaagaagaggatcagggcgatgcggatcagcacatccaccgttttttgcccggcatcgttgtgcagccattcccggaagtcaaacaggccccaggcgctcaacagcagcatgatggcgacacagacggtgagaatgcgcgccgccttcagcgaggcggagatccagccatttagacgcttttgcagttcagggtagttgcgctgagtggcgggcgacagggtgatggttttggctatccagcgcgacaggatgccagataccagcgccgcgccgccgataatcgccaggctttgcagggtggcgcccatcatgaatttcaggctgttgcccgggtcgaacagggaaaagaaaaaaagcaccacaaagtaggcgcaggccagccagtgccagaccagcgcgaaggcgcggataaacaggctaaagaaagcgagtgagtggtcggccaggtggatcaacccttgagtaatcaccgctttgttatgaaaaatcaggtacagcgcccacagcgtaatgcacagcatgatgacgacgttagccagcgcgccaacctgaacattcacctgattggaaataatcggcaccgcgacgatcagaccgtaaccaatcaggctgctgagcgcgctcaggcgcaggctccagtatgacgcggcctcgtcgctgaggttaaagggccgcagggcaggaatgcgcgggcagaaaatgagccgcagaatagctttaaaaaactcgatcagcgcgaaggcgttgaggaaaaggctctgctggaaggcgatggtagggttattcccattcaggcgatcgcttagcagctgaccgacaaacagggttagcgccagcagcagcaggtcgatgataaacgccccggcgatggtcaggggcagctggagccagttaccgcgatcgcggtttttatgccgtccccattcgcccattttgcgatacagcggcagcgccgcgaggcgtaccagccaccagaaggcaaacaccagcccggccagcagtaaaaaatgccaggccgcgctggtaaaggtttgcggattaaagggcttatgcggtgagccggtgatattgcgccacagctgggaaaagcgtgatgagagctgttcgccatattcccggcttatctgggtgacgttctccagtaccgtggtctcttctttcaccgccggtggcgtcagcgtcggggtgctgtcgggcggcggcgtggcggctgctttacgcagctggtcaatgagctcctgacgggcggagtcgttggccagcacatcggccagtgcggcataagccgctcttttctgttccacatcgggttcgctggcgctgtttttatcagtgttagccgtcggcacgccggggagggtggcggcggaaagcggggcagtaaacagtgcagcgagcaaaagcaggatccacggcatgggcacctccgttgcaacgtaaacgggtaagtatagaagccgctggcggaaggggagggaagaggattctggaaaagcggctctcatcgtgggggagagagccgttgcgggtcaggcgacgtgttgcaggaattcacgcaggcgcgggctgggcgggttcttcaccagctcctggggattgccgtcttcagcaattcgtcctttgtcgatgaagattagtcgcgaggccactttttcggcaaagccgatttcgtgggtcacaatcaccatcgtcatgccctcttccgccaggtcctgcatcaccttgagcacttcatggcgcagctccgggtcgagcgcggaggtcggttcatcaaacagcatcatcttcggcttcaccgccagcgcgcgggcgatggccacacgctgttgctggccgccggagagttcggacggatagtgatgcgcgcgctcagccagaccgactttcgccagcagctctttcgcctgcttctctgccgcctgcttgctggcgccgcgtacccgcagcgggccaaacatcacgttttccagcgccgtgaggtgcgggaacagataaaactgctggaaaaccatcccggcttcctgacgaatcagacgttcgtccaccttcgggtcgttgaccttcagaccatcgacaatcagatcgccgctggtgatctcttccagcttattgatgcagcgcagcatcgttgatttaccggaaccggaagggccgataatgaccaccacttcaccctgattaattttcagagagatatcgtgtagcacctgggtcggaccaaagtgcttggagacgtttttaaattcaatcacaggattttcatccttctttcaagacgacgcagaataaagctcaggaccagggtgataatcaggtagatcacggctacagcgctccagatttccagcgcgcggaagttgcccgcgatgatctcctgtccctgacgggtcagttcggcgacgccgatgacgatgaacagcgaggtatccttgatgctgatgatccactggttgcccagcggcggcagcatgcggcgcagcgccagcggcaggatcacgtggcgaatggtttcgcgacgcgacaggccaagcgccaggcccgcttcgcggaatcctttatgtatggagagcaccgcgccgcgggtgatttccgcgatataggcgcccgagtttatcatgatggtcactaccgccgcggagaaggggtcgatgcgcagatcgctaaaggccatcggcagcgcaaagtagatgaacataacctgcaccacaatcggggtgccgcgaatgatttcaataaagaccagcgcgatgtggttggcgatccagccgccgaagcagcgggcgaaaccggccaccagaccaattatcagaccgccggccaggccgaggacggaaatccacagcgtcattttggcgccttccagcaaaatcggaatggcaggccagatggcactccagtcaaactgcataatacgttcctgttaccgtgtcgagagcagaggaaagcctccgccaaaataccgtctcccgccgagcctgtgccggaagaccgttgtggtgtcgccggacctcggtccggcgaagtacgtttttattatttgggttcagtgccgaaccattttttataaatttcgttataggtaccattgtcgcgcagcgttttcagcgcaccgttcactttctcacgcagctcgtcgctgcctttcgggaaggcgataccgtagttttgcgcttccagtgattcgcctaccgctttgaacttaccgttgcccgcggttttgatgaagtacagaatattcggcgtatcgtgcagcacggcatccgcgcgaccggttcccagctccatataggcgttatcgatgttcgggaactgacgcagatctttggttttgatattggctttcgcgtagtcaacggagccggtgccgctcttcaccgcgaccactttaccgttcagatctttgacatctttgatgtcgttattattggcgttgaccatcaccagcaggccgcttttgtagtagccgtcggagaagtcgatcgcttttttacgctcgtcggtaatggtgatccccgccagcgccagatcgatatttttggtttgcagcgccgggataatgccgctgaagtccattggcttcagggtgtagtcgagcttcagctctttggcgatagccgcccacaggtcaacgtcaaaacccacatacttatcgccttgcttaaattcgaacgggacgaacgccgtatcggtggcgacaaccagggtcttattggcggcatgggaagaaaccgcaaaagccagggtcagtgcagccagtgaaactttaaatacagacttcatagcatttccttttatatccacgggacgatcccctgcgagaacgactagcctaatgaaaaaatcgtgccacttttacaagctgttgtttttcaacaaacgaagcgtaagtcgttgcacaagatcgatcatttcaggcagtgactgcaccatgatggggcgtcattttggtgcgtcataagggtgctgaattaccagcccatttttagcgcaaaccctgatgggaaaacaatctcgacgtaacgattgtgtgaggtgattattacaatctttttacttttgcgcgcattttcatcaatctggtgccctgaaacggtgcaaggccagtggaggatgaaaagcaaaggatggaatatagggcagggagaaacgctgaggcgccgccgaccgcgctgggccggcggcaaagccttactcgatgttggcttcaatgaaccacaggaatttatccagatcgcgggaagccgcggtgaagatatctgcagtgtcttcgtcttttgcttcgtcgatcgccttacgcacatcgttcgccactaccgcgtagcggtcagccagggctttcaggtgatcctgaacgtgatggatgtccagcgggtagctctgcagcggggttttgctgttaatgacctgagtggtacccagggcgacgccgcccagctgcaccgcgcgctcggccatggtgtccagatgttcggtcagcgcggtacgaaagccatccagcatttcgtgcacggcgataaagttcgcaccgcgcatattccagtgtgcctgcttggtgataagtgacaggtcaatgaactggatcacctggcgattcaacagctcaatggtcgctttcttttcgctgtcagcgacatcgttgcgggtatagaccagattagacgcttttgatttaaccagttttgcggtactcatcgtttcatatcctcttgatattgatgctcatcacacttcagatctgaatgatgtggagcgttgtcccaaatgacttcggaaataagtatagcaagggttttcaagagtgaggcatcggcaggctatatcactccgatagcgcaaagtggttggttattttaaaaatatttaaatatcagctatttatatttggctgaacggcccggatttctctcgggccggcgccgtaacagaatgttaattgatatcgacctgctcgactttactctgccgttgcatagtcagcgtggcgcccatcgaggcgataatgatcgcgccgagcgccagggtctgggagagcttcagcgtttcaccgaggaagatcataccggagagggcagctaacgctggctcaaggctcatcagcgtgccgaaggtgcgcgtcggcaagcgcgtcagggccatcatctcgagggagtagggcagcgcggtagagagaatcgcgatccccaaacccagcggcagcagcgaccactgccacagcgtatcggtggcctgtgccatgcctaacggcacaaacaccagcgaggcgatgagcgaccccatcgctaccgtggctggaccatgctcttcaccggcacgctgtccggtcagaatatagaccgcccagcacgccccggcgccgagggcgaacagcgcgccggttaaatcgacctgcgccacgttctgccccagcggcagaagataccatagtccgaggatcgccagcgccacccagacaaaatccagcgggcggcgcgaaccaaacagcgccaccgtcagcgggccggtaaactccagggccaccgccacgccgagcggaatgcgctgcagggataaataaaagagatagttcatcgccccgagcgctaggccgtacagtagcagcggcacgcgctgcgccggggagaaacgtagccgccatggcttgaacaccaccaccagaatcagcgttcccagcgccagacgcagggcggtgacgcccggggcgccgaccaccgggaacagcgatttagcaagcgatgcgccgctttgaatcgaggtcatggcgactaaaatcaccagtatcggcaaccatgccgccgcttttctggatggaccgggcatcctttctcctgtcaggttttgtcaaaaggggtaaaagttccagtgtactggaattacctgccggcggttgagctaatgttgaaaaaaacaggggcaaaaacagtacaatggcgaaaactgctgagaaattcaccaggcggttaggattaatctggatgcttgcgaatttcttaatgagcgttaagatgtaagttaacgccaaaaattgttgttttccatattgttacagaaatatggaaacttttggttacatgaaaaagtatgttagacaatgtaaactccaaagagtttcccaaaagtttttgatatatttaaggcttaggacttattagaaacacatttgaggtggttatgaataaaattgcacgtctttcagcactggccgttgttctggctgcatccgtaggtaccactgcatttgctgcaacttctaccgtaaccggcggttacgcgcagagcgacatgcagggtaaagcgaacaaagctggcggtttcaacctgaaataccgttacgagcaagataacaacccgctgggcgttatcggttccttcacctacaccgagaaggataacaacagcaacggtacttacaacaaaggtcagtactacggcatcaccgctggtccggcttaccgtctgaacgactgggcaagcatctacggcgtagtgggtgttggttacggtaaattccagaacaacaactaccctcataaatccgatatgagcgactacggtttctcttacggtgctggtctgcagttcaacccgatcgaaaacgttgctctggacttctcctacgagcagtctcgtattcgtaacgttgacgtcggcacctggattgctggcgtgggttaccgcttctaatcactccggtgatatgaaaaatccgcctctcggggcggattttttttgcctgctgacggccggcccgggcgactggccgggccggcgcgattaattgactgtgaactcatcggtaccgaggtgagcgtagtccaccttctgcagctggaagttggtgatgtacaccggaccggccttttgctcagagataaaccgatagcgtggggtgatttccgccgcctggatcccggtccactgggagaagaaactgaggaaatcattcgccgaacgctgcgccttaatcactttatgcgctttgtcatcgctggatagcaccataaacggcacctggaagttctgctggaacttatcatcatgcgccagatactgcacctctttgccccgctccttgaacgccagaccatgatcggaaaaataggtcagggaaaaagtgtcaccggaattttgcaactgatgataaagcttagccagcagcgaatcggtctgcgtcatgctgtagaggtagcatgaggtctctttcgactgaacgaaaaccgtgtatttgcccttggtccgatcgcaggcctgtgggtgagagcccatcaggtgcaggacaatcagctgcggctgggtacgctgggttgagagcacctgctcggtcagcttcagcaactgctcgtcctgggtgtttttattggcttcgaaatcgccgtttttcaggaactgtacttcatccgcccgtttggcgatgctggcgatagcggtgtcgtactcgccaatttgcccctggttggagaaccaccaggtctggaaaccggcgcggttggcgagggtgacaaagttatcctgatactgtggtttgccatcgaccacccggttaagcgtcaggccgagcgatttctgcgttgagccgctggcggcgatgtagttgttaaacagataaccgtttaccgagctggcaaacggcgtgttgtcccaatggccaccgaaagcgccgagggcatcgcggcgcgcgctttcaccgatcaccaccacatagagatggtattttggctttaccgccagcacgtgccagctgtctttcatgccagccagctgcgccatccgggcctgttcgtccagcacctcgttgttattcaccaccacgtctttgacaaaacgaaaggccggataaccggtgtcaatcaccttgaatacaccgccccaggcaaggttttgcaccggctggagaaagaagatcccgatgctgaacaacaggcccagcgtatccatttttccccagcgtgatggctcaacgatcctacgacgaaccgcaatgaccccgagagcgaagatgaagaccgccagcagatagttgtaccacgggaagatggtcaggatttccgtagactcttccacgttggtggcgtgcagcgccagcagagtgttgaagttgggggcaccgtaggcctggccaaagggatagtacagagccgccagcagggaataggcgccgaccaccgctttctggacgcgcggaaaggcgcgccagagcagatgtaacacgcaggtaaatgccacggtataaagcaggctaaattcatagcccagcgccaggttaattaacagcgactgtaaaaagtagaatcccgtccatgggttcagtgccagtcggcgggcgaccagcgtatctttcagggtggtgacattcatagtaaacaatcaaaaagaggccatgcgcatcccctggcgtcaaggggtaaaacctgctggacagtgcgtgaagagggtctctgcgagccgcgaatgtggcagggctgtgcaaagatagggcttgtaaatggtaaggtcaaccagacataacagattgttttgcgagggcgcttacaaaacttgaaaaaaggtcagggaaacggggggaaccggtcattttaccggcagaaaatgacagaaaaatgaagcggcgtaccgcgacgccgccttaggaattgggtttgccctgctgcggtttaccgttgatcatctcgcacagcataccgatcagcattaatcgtactttaaagggggaatggctaaacacgtttatgcacctcttgaattcattcatctgctctcctcctgccagttcgctccgtcattccctgatggatgtttgcattatatacagatatagcacaggctatattttatagctatggctaaaacgttaattttttgtgctcttggcgcaatccattacaatgtggatctttttatacgatgcttgacgcgtcacacgaatgaggaagcacaatgaaccgtcgcgcaggtaagccaataacaaaaaaagtgacgcagttagtgaatgttgaagagcacgtggaagggtttcgccaggtgcgggaagcgcatcgccgcgagctgatcgatgactatgtggagctgatctccgatctgatcaacgaagtgggcgaggcgcgccaggtggatatggccgcgcgtcttggcgtttcgcaacctacggtcgctaaaatgctcaaacgcctggccagcgtcggtcttattgaacagatcccctggcgcgggatcttcttaaccccggaaggtgagaagctagcccaggagagccgcgagcgccatcaaatcgtggagaacttcctgctggcgatcggcgtcagcccggagattgcccgacgtgatgcggaagggatggagcatcacgtgagcgaagagacgctggcgatgttcctgaaatttacccaaacacagggatctcaggaagcatgactcttcccttcgtccagtcgctgctgcgcgatcgttttctccatttgctgctgattatcgcctgcgtgctcagcgccatcgtgccgtttgtcccggcaagctggccggcggccattgactggcataccatcgtcacgcttagcggcctgatgttgttgactaaggggatcgaactgagcggctattttgacgtgctgggccgaaaaatggctcgccgctttgtgactgagcgccagctggccatctttatggtgctggcggcggcgctgctgtctacctttcttaccaacgacgttgcgctgtttattgtggtgccgttgacgctgacgctaaaaaaatggtgcgccatcccggtgaaccggctgattattttcgaagcgttggcggtgaacgccggttcgctgctgacgccgatcggcaacccgcagaatattttgctgtggggacgatccggcctctctttcttcgggtttatcggtcagatgctgcctctggcagcggcgatgatgctgaccctgctggcgctgtgctggttctgttttccggcgaagcggctcagttaccagagcagcgacagggcgccgtcatggcaacctaagctcgtctggagctgtctgggactgtatgtggtgtttctgacggcgctggagatgaatcaggccctgtgggggctggcgctggtgctgctgggcttcctggtgctggcccgggcggtgatcgtccatgtcgactggtcgctgttgctggtgtttatggtgatgtttattgacgtccatctgctgacccagcttccggcgctgcaccaggtgctgagcggggtggggaccctctccggcggtggactgtggctgaccgctattggcctgtcgcaggtgatcagtaatgtgccctcgactattctgttgctcaactatgtcccgccgtcgatactgctcgcctgggcggttaacgtgggcggctttggcctgctgccgggctcgctggccaatattatcgccctgcgtatggccagcgatcggcgcatctggtggcgcttccatctctactccattccaatgctgctatgggcggcactcagcggctactggctcttcaaactctgcgcctgatctcaacagaatcgcgccatcattcacatcgatcgccaggatcgcctttcggggcgatctttttttgtccggctcacagaaaccgatcccgacctttgcttaccttttcactttccggtatatgactagtcattatgtttaaatgactagtcatataccgaggcgcagcatgaagaacagactaccggcagattttttatggggaaactccgtctccagcatgcagacggagggggcgtggaacgagggtggcaaggggatgtcggtgtatgatatccgtcaaccggcggagttcgcctccgactggaaggtggcgaccgactcttatcatcgttatcgggaagatttcgatctgatgcaggatttgggcatgaactgctaccgttttcagatcgcctggagccgggtgtgccctgacggagatggcgaattcaatgaacaggggatcgccttctaccatcaatttatagatgaactgatcgcccgcggcattgagccgatgatctgcctgtatcacttcgatatgccgctgtcgctggcggagcgctacaacggttttaccgaccgccgggtgatggacgcttttatccgctacggccagaagatgatcgcctgctatggcgacaaggtgaaatattggctcacctttaatgagcagaatctgtaccattcgccggaagcgtttctgatttccggctatctgcagggggagaagaccctgcgcgaactgtatctgatccagcatcatgtgatgatggcgcacgtccatctgactcactatctgcaccagacgaagccgcagtgtctgatgggcggaatgctggctcacgctctggtctatccggctacctgcaaaccacgcgatatcctctgcgcccagcagctggatgagttcttaaaccagaacctgctgcgcgcctacgcgggtgagggttatagtccggaggtgatgcattttgtcgccgcggaagggttcgatgatatctatcgtcgggaggatctcgccctgatggcgacggtgaaggtcgattatctggcgttcagctattacgccagccgcacattgaacagcgacgcgatcccgccgggaacggcggtcaacaactatatgctgtttggcaaccaggataacccgttcctgaaagcgacggaatggaactggcagattgatccgctgggcttccggacgatcatcactcgttactataacgattggcgcctgccggtgttcccgattgaaaacggcatcggggtgattgagtcctgggacggcgaacatcccattgccgatgattaccgcatcgcttaccatcgcgaccatatcaacgccatgaaagcggccatctttgaggatggggcgcaggtgatcggctatctcggctggggattaatcgatatcctgagctcacagggcgatatgcgtaagcgctacggcgtggtgtacgtcaatcgcgaaaaccatgacctcaaggacctgcggcgggtgccgaagaagagctatgcatggctgaagcaggtgttccgcagcaacggcgaagcgatgtaacgctgccctggcggtcagatggtgtatccagcccgccagccactcactgaatggataaggaccgggaaatgacggcgaagtatctgcaaatcgcgcgggaaataaaaaaacgcatcatcagccagcagtatcctgccagcgcgccgctacccgaccagtttgcgctggcggcggagttcagcaccagccggatgaccatccagcaggcgatgcgccagttaatcgtcgaagggctgatctatacccgtaaagggcagggcacctttgtgcggaaaaatttccttcagctgtcgcagtgggagctgcccggcagcgactatttcggcgccaccaaaacctgggagcatcttggcgaggtgcaaagcgaagtggtgcgctttgcggtgcgctttcccagcgacaaggagcaaagttcgctgcttatcgacgccgatgccccggtgtatgactttgttcgcctgcggctgctcaacggcgggccggtatcgctggatctgacggtcatgccggtggggctggtgccggggttaaccaaaagccatctggaaggttccgtgtttcgctatgtgcaggagacgctggggctgaagctgatgggatcttaccgcgtggtgcgggcgatgaagcccggggaactggataaacagcatcttcactgcgaaccgaccgatccggtgctggaggtggagcaggttatctatctggaggatggcacgccgctggagtacgcccactgccattatcgctacgatcacggcgggattattctggtgaataacggctaggccggggctcctgctggcggctgcgcatagcggggttacggcgtggtagggtttggtagcccgggcgagcgttagccgcctcgagggaaaatgccgataaaaaaacggcgggcatcaggcccgccgtttttcttgtcagcacaacttagttcagacgcaccggcataccggagcggttctggatagcctgctcaaccacgttctgatcgacatcagactggctggtaactgcctgtaccggctgagtcagggtgatcggcacgatctcgccgccctggaactgcgcttcggtggtcgacagcgggttgtgcacctcgatgtaacggctgccgtccggctcggtggtcgcttttaccggctcatcgataaactgtacgcgggtgccgaccggcacgttctcaaacaggaatttgatgtcatcgttacgcagacgcacgcagccgtggctcacgcgcaggccgataccgaagttagcgttggtgccgtggatggcgtacagacggccgatatacagcgcgtacagccccatcgggttatccggaccggccggtacgacggctggcagcgggttgccggcggcggcgtattcagcatgcattttggcggtcggtgtccaggtcgggccggccttcttgcgttcgactttggtggtccagttgatcggcgtatctttacctaactggccgataccgatcggcagaacgatcacggtattggtgcctttcgggtagtagtacagacgcatttccgcgctgttgataatgatcccttcatgcacggtatccggcagaatcagctgctgagggatgttcaggacgctaccgcccttcggcaggtaagtatccacccccgggttggcttccagcatgttggaaagccccatctgatatttcgccgcgaagtattccagcggctgtttgttatcatccggaatggtaatgacctgattctgaccaaccaaacggctgccatcggttggcaaaggataggtgacagcagacgctgtattgcaaaagcctacgatggcgaaggctgccgctaagagtgtagataatttcatagtctttaatgtcgtgtgcgaaatcaacgccacacaggcctttgttaatgattgagacagtagatgggagcgcattatatgtgcattccgctgaacaggtaaatcagatgtgtacgaaatcacatttttttccctgtcgcctcggctgccgcggtccggcaggcggccgaagcatcgctcgccgcgcgggtaaagggcggttactcttccagcagccgggcctgcagcgcggcgcgaaccggcgcggtaagctggtactctgccgccagccaggcgtcgacggtgccatagcgctggtgaatagccgacagcgcggcggcgagataggactcttttaccgtcagaatatccgccaggctttggcgcccctgggcagtgaggtcgttgccgagcagctccaacatccaggcctccacctgcgtcagcatgccgtgggtaaggagatactcctccatcaccgtttcgctgtcgcagccgacggcgaacagcgttaacgcgcagccgacgccggtgcgatctttgccgaccgcgcagtgttgcagtaaagcgccttcaaaaggcgtggtcagccaggcggcgagctggcgataggccgggttgttaaacggcagctggcggtagagttgcagcataaactgctcgccgttcagcgcgttaagggtggcggcattcagctcggtgaccttcgcatttacctcgctcaccggcggattggccggcgcgttaagataatgggtaagcgggctaagcttgtccggagtacgggctacctctccggggtcgcgatagtcgagcacccggctgagcggcaaagtatcgaggtggttgagatcctccgccgttaaccggtttagcgcgccggatcgcaatagcttgccgctgcggacgcggcgtccgtcggcggcaagctggccgcccaggtcgcgaaaattgatgccgccctgcagggataaaaaagccgggtgtcgcgataggctgctggtcatgggactccttataaatacgtacagaataaccgtttgagcgcgggtttccggctcatctgacaaagaccttagcacaagcgccgcggtggaatttaccgcaggccgtgaaaagtgtgtcatttgctggcataatgtctgctgtatcacacccctcatactcttttttcaggatatccccgtgctagtatccagcaacgttaccatgcagtttggcagtaagccgctgttcgaaaatatctccgttaaatttggcggcggcaaccgttatggtctgatcggcgccaacggcagcggtaaatcgacctttatgaagatcctcggcggcgatctcgaaccgacgctgggcaacgtttcactcgacccgaacgagcgcatcggtaagctgcgtcaggatcagttcgcctttgaagcgttcaccgtgctggatacggtcatcatgggccacggcgagctgtgggaagtgaagcaggagcgcgatcgcatctacgccctcgctgagatgagcgaagaagatggctacaaagtggccgacctggaagtcaaatatggcgaaatggacggctactcggcggaagcgcgcgccggcgaactgctgctcggcgtcggcattccggttgaacagcattatggcccgatgagcgaagtcgcgccgggctggaagctgcgcgtcctgctggcgcaggcgctgttttccaatccggatatcctgctgctcgatgaaccgaccaacaccctggacatcgacaccattcgctggctggagcagacgctgaacgatcgcgacagcaccatgattatcatttcgcacgaccgtcacttcctgaacatggtctgcacccacatggcggatctcgactacggcgagctgcgcgtgtatcccggcaactacgacgaatacatgaccgcggccacccaggcgcgtgagcgtctgctggcggacaacgccaagaaaaaagcgcagattgcggacctgcagtcgttcgttagccgcttcagcgccaacgcctctaaatcgcgtcaggccacctcgcgcgcgcgccagattgacaaaatcaagctggaagaggttaaagcctccagccgtcagaacccatttatccgcttcgagcaggataagaaactgttccgtaacgcgctggaagtggaagcccttaccaaaggctttgatgaaggtccgctgttcaaaaacgtcaacctgctgctggaagtgggcgaaaagatcgccattttgggcgccaacggcgtgggtaaatccaccatgctgaaaaccctggtaggcgaactgcagccggacaacggcagcgtgaaatggtctgaaaacgcgcaaatcggctactacgcgcaggaccatgagtacgagttcgaaaacgacctaacggtcttcgaatggatgagccagtggaagcaggaaggcgacgacgagcaggcagtacgcagcatcctcggccgtctgctgtttagccaggacgatatcaaaaagccggcgaaggtgctttccggtggcgagaaagggcgcatgctgttcggtaagctgatgatgcagaagccaaacatcctggtgatggacgaaccgaccaaccacctggatatggagtcgattgaatcgctgaacatggcgctggagatgtatcagggcaccctgatctttgtctcccacgaccgtgagtttgtcagctcgctggcgacccgcgtcctggagatcactccggaccgcgtgatcgacttcagcggcaactacgaagactacctgcgcagcaaaggtatcgagtaatccctgtccgttacccgggtagcggctacgccttacccgggcgacacgcggtgccgtttttttgtcgggtggcggctaacgccttacccgacctacggttcttgcgacctgcctttaatgtcttcaccgcgctggctgaaactaccggcctaaggtcagaacctccactccgttccttcaacgccattcaccagcagcttacgcttttctcctaccggtaatgacagcttcagcgctttccacgccgggcgatagttgccgcgggcgttgatatccaggtttatgctgctggcgctgcaggtcatttcccactccagccatagcgcatccccctgtttatagccccagctttcgccgtcgtcttcaaacagcagaccgcgggttgagccggtacctttcagcgggaacagctgcagttcgcgacgatcgtctttttgcgcatcgacatggctgatacgttcactaagcggcagaccggcgccggcgcggaccaacagcggcagtttttccagcggcgcgtccagcgtcacccactggccgccggcgaaccactgatggctgtagaaatcgtaccaaccggcctgattatccggcagccatacttcacgctggcgggcgcccggctcgaccacgctggccaccagcaggtcgcggcccagcaggaagtcatcgcattcggcgaaggtctgcgcatcgtgctggtgatcgaggaaggtcgggcggagcatcggctcatcatcagcatgcgcctgccatagcagagtgtacagatagggcagcaggcggtagcgcagctcaatggctgagcggatcgccggagtgatggccggatacatccatgcttcgtttaccgtctggtcgtcattccacgagtgaatggtaaagcgcggatgcatgacgccattttgtacccagcgcacaaacagttccggctcgggtttatcgccggagaaaccgccgacgtcgtggccgacgttaaacagcccggaaaggctcatccccaggcccatgcggatgttatagcgcagcgtatcccagttggtgcggttgtcgccgctccaggtctggacgtagcgctgcatcccggcgcagccggagcgggagatcagatatgggcgcttttgcggcgcaaagcgctgctgggcttccagcgaggcgcgcatcatcaacagcggcatcaccgggcgaatatgtttgatggcgatttcacggccaaagccgtagcagcgggcttcgccgtcccatacttcgtattcgttattatcgttccaggtcgaatcgatgcccatctccagtagctgggtggtcacgccttcctgccaccaggccaaggtttgcggattggtgaaatcgagatgcgacccttcatcatcccagaagctggaacgctccggagcgtcagtttgcgaatcgcgaatgaagagaccgcgctccgccacctcgccgtagcgcgggtgatcctgcagcaggcacggtttgatattggcggccagcttcagcccggcatcgtgaaacgactggctcatcactttgggctgcggcaccttgtcgtagttccagttaaagacgtagcgcttgccgttgattgaggtatagccggaagagagctggaacgaatcgcaggggatcgcgtgctgctcgcacaggcggataaagttcatcagctgattttgcgcatccggcgcgtcggtatagtgcatggtggagccgctgtagccgaggctccatttgggtccaaacagcgttttaccggtcaggcgaacgaaggctttggtcacatccagcacctgcttaccggtaaacaggtaataatcgatgtcgccggcttccgcctgccagcggcgataggcggtgtggtagttgtcgatctcgttccccagatccagccagcagctgctcaggttgtcatagaacaggccgtagctgatatcgctgcgctgggtgatggtgaacggaatatgtttatacagcgggtcagtgctgacggcgttgtagcccatggcatcgaggttacgcatctcatagcgtttaccggtgcgctgcaggtcgccggccttttcgcccaggccgtagaaacgctcatctttgcggcggctcagataatgggcgacgccgtcgccgtgggcattcgccaggtaggcgctggtcggacggtcattggcaagcggctgccattcgccggcctcgtcgcgatagctccactccagccacagcggctggtgaacggtgacgcgcagctggcgggtggcgatagtcagcgtatcgccctcctgggccagctgccaggccgggagactaaaaccgctgaggtcatcccgggcgcggccttcccacggcacatcctgctgcggagcgatgctccaggtgcgatccagcgccagctggccctggcgttttagcaggacgcggaacaaattctcttccagtacatacaggcacagggtgtgctggccatcgaccgtcagttcaacgtgatgctccagctgttgatgcaaactccagtgtttcagcgtcttcatatcttacatccactctcaggcgcgcttggcgcgacgttcagcaataaatgccaccaggaaaacggcgccaatcaggtcaaagaaacccatggcgataaatagcgggttgaagccgattttgtcggcggtcaccccgattaataacgagaacaagaagctggcgatccacgctgcggagccgcgcataccgttgaccgtcgccatttgtcccttgtcgaaagactccaccaccagcgcgctgagcatgcaggagatgatctgatggccgaagccgccaatggagatcaggatgatggtgatatagggatcgcgggtgatggcgacgagggccagggagagcatcaggaacgcgccggttaccgagctggcgatcaccgagttcactcgcgtacagccgaaccagcgaacatacaggcgggtgaggtagccgctgaccacgctgccgagatcggcggcgagaaacggcagccaggcaaacatggcgatctgcttcaaatccatgccgtgctctttcgccaggtacagcggcacccagaaactcagcaccgcccaggcgggctcggccataaaggcggggatggcgatcccgtagaaacgtttatttttcgagacggttttgagcgcggtaaagaagggctgttttaccggcggggcttcgttatcctgtttgatgtactccagctcgcttttgctgagattggggtgcttttccggggtctgatagaaggcccaccatagtactacccacagtagcgccagcgcgccggtaaacataaacgccccttgccagccgaaggaggcgtgggcgaagtagatgatcggcggggccagcatcgcgccgatggagaacccaacgccagcccagccggcggcaatcgggcgttcagatttcggaaaccattcgccgatggttttggcgttcgccggagtagcggccgcctcggccccacccataaagaagcgcaaaatagccaggtgcagccagctaccggccccggcgtgggcgatacaggccagcgcccacagggtggcgcagatcataaagccaagcttcaggccgatgacgtcgataagccagccgcacagcggctggaaaatcgtgtaagccagctgaaacgcgccgacgatccacgagtattgttcggtagtaatgccgagggtcgctttcagttccggcgcgataattcccagcgagttgcgtgtgatgtagttgacggtaacgccaagtaaaaacaggaccagcacccaccagcgcaggtttttcactacccggcgcgttttgctgacggcgatatcattgttgaggccttgactcatagcacactccacaagacgtttgtagggggaaagtgacggtctcactccctgagtggtcacgtagatttattaactatttgaatagtctatttttaatctcaacatcattggtataactagtatgggagatgttggaccaattcaggctagggcagaaaaatcgtctggcaaagcgctatttatgcaagttttttcatgaaatgagcgagatcgcatatttgacagcggaatttgcttgtaacgtgtgctttggcgattatgaaaattctttcatttttcaatcggagctggatcacaaaatggataaaaagctgcgcgtcgccgaaattgccgcccgcaccgggctatcgcccagcaccgtttcacgcgtcctggccgggaaagcgaataccagcgacaaggcgcgccgggcggtgctggactgcgcccgcgagctgggtgtcatgcaggggttggccgccgggcgtctgctgctcaatcatctgctggtgtttgccccgcagcgcgcattcgatgagcgatcggatatcttctactaccgggtgatccagagtatcaataacgcgctggcggcgcatgaagtgcgcctgcgctactgcgcgctggatgagaacgacagcgacgccaacctgtttcttgcccgcatgaatgaacctgagacccaggccgcggtgctgctggggatcgacgatccgcatattcatggcctggcggcggatctgggcaaaccctgcgtattgatcaactgtcgggatgaagggatgcggctgccgtccatcgctcccgatcatcggctgatcggccagtgcgcggcccgctatctgtttgatatggggcatcgggcggtgatgaacgtgatgtgcctgcgccgctataccatggagctgcggctgggggggattcaggaggcgtggcgcgcgcgtaatctgcgctttaccgccagccgggatcttatcagcgtcgccaactttagcgccagagagacggaagagcaggtgggcgcctggcttgacggcttacagggcaggccgttgcccaccgccttcctggtgggcggcgattttatggccgccggcaccgtcagcgcattgcaaaagcgtggcctgcgggtgccgcaggatgtctcggtgatgagcattgacggatttaatctggcggcgattcaggaggtgccgctgaccgcggtgcatgtgccgcgggatgagctgggcagcgaggcggtgcatctcctgcagcagcgcctgctgcgcccggaggcgccgcacggctcgctactgctgcatggcacgctggtggtacgcgattcggtacggcggatccggccgggcaaaggccataccgccgtcgagccgcaggggctggatgacgattagaccggcatacccagcgcccgtttgccgtggatattcagatcctccagggtgaagcgcccctgccagctggcttcatagtcctcgcgcgggaaatcccccggcgaggcgcctttttccagggcgattttcactttctgcgcgtaggcgaggttcttctcgcacatcggcgcggccggaatgtacatcacatttccccagccctgctgattttccaccggcgccaccgagtgaatgatgtcgcagtgccaccagacggagtccccggcattcagcgctggaatcgagcttaacgctttaattaagagcgggtgccactgctcagagatcggcagcactctgcccggcgcgacgccgcacagctcatcttccggcacatcgtcgagcagggggcgcagcagcacataagccatcgcctccgggatcggcaccacgtgcagcagcccctgacccgggatcatgtccgacagcgcggtccagccctggaaggtgcggaacaccgagcatttggtggtgttgtcgacggtatactcttccacttcggtacggtgcgcggcgtcccacgggtcgtaggcgtcgatattgccattaaaaacgttggcgaaaacctgctgataggcgggaagcagccagcgctccagcgcgccggaatcggtatgcgcccccagccccttcgaagtggttcccggcgggcggcggcggatgcggtcgggatagatcacgctgacgtccggatcgaaccagcgtttgccattctgttcaaaacgccacaggcggttgaggaaagattgcactgccgccatttcatcgctctgccgcgcctgcatttgcgagggcgaccagtagatcgggtagatctccgggcgcgaagcctccagcgaaccgaagaagctgtcgccaggccctttgtaaacatcgtcgaaatggttgcgatccagatattccagcatcgcggtatcccacgccagcgcctgttcgcgtgggaagtggcctttaatcaccgcgcagccccggcgcttaatggccgcgcgctgctcatcgctcactgttccttcggcgatatcgcggaacggaatggttggccagacctcctggcctgcggctttcagtgtctcaatctcctgcagccgctcgctgatgcgcgctgagagcttatcgaacaccgcctggacgtcgccaatttgcgcccgcagggcctgtttcatctggcgaatcgccgctttgtgatcggcgggaagtgtttcgtgggtcgggagagcagccataataacctcgctgtatctttcattcgaaagtataaaatcttacaaacgttaatttaagttaaaatggagttaatgcaagtttaaaatcttgctgcggcgcacaaaatggaaaaccggggcgcgatgccccggcgaagggtcaggcgttgaagggcggggtgttatcgaggacggcctggataacgttcagcgcgccgtcatggttattatcgtcggtagtgtagccggcgatggccttgatgctgtcggcagcgttacccatggcgaaagcgtatttcaccagcttcagcatttcggcgtcattgccgctgtcgccgatggcgacgcattgctgcggcgaaagatcccagcgcttgagcaaacggctgatgccgttggctttatgcaggccagggataatcaaatcgacaaagccaaagccgctggtgaccggcttcatgatgccgtcgagcgacacgtgcagtttattaatcagctgtgggatctcgctgtccggcaggttgagagagaatttaaacagcgtatcgtcgatggcgtgatagtcgctcacccgctgtaggcgatggtagtgcttcgacatcagctcaacaaaggcgtccggagctttatcgctgacgtaggcgctctgcaggccgcaggcgacaaagttgagctgcggatctttgagcaattcgccaatcaccacttgtgattcgtggcgggtcagttcgccgtggaacagctgcttgccatgttcataaaccagagcgccgttttctgcgacgaacgaaatctgctcgcggatctccgggaagaaggagatcaactgatagtactggttgccgctggcgacaacaaattcaatgccgcgctgctgcaactgggcgaattgcgccagaaaccgtgagcgatcgtaggttttggcgtcattgagaaaagttccgtccatatcggtgacgataactttaacggtcataaggggatgctcctggcttaacttcgaccagtaacattctaattacaatgtgatggagagcacaaatttatttcgaatgaaagttcaggcattcagaaaatgccggaagggcatgtcttttccggcctgcagaacagggttggcccgctaagcatagcgccagcgggcacgaaggattacagcgtatgttcggtacgggcgatgatatcgtcctgggtatccggcgacagggcggtgaagaacgccgagtatccagcgacgcggaccactaaatcgcggtactggtcaggatgtttcttggcttccagcagcgtgtcgcgcgacacgatgttgtactggatatgccagcctttgtgcacctcgaagaaagtgcgcagcagcaccatcagcttctgcttatcggactcgttctccagcgttgacggattcagcttctgattaagcagcacgccgccgaggatcgccccggtcggcagcttgcccaccgaactgataaccgccgtcggccccagatggtcggtaccggaggccgggctggccccctccgccagcggggtatgcgctttacggccatccggcgttgccatggtctgcgcgccgaacgggacgttagcggaaatagaggaggtgccagcgtaataattgccgccaatcgggccgcggccatagcgcgggttgtgatactgcttcagctcgtcgatataggtctggtaggcccgcgccagcagttggtcgacgctgtcatcatcgttaccatacttcggcgcgccgttgatcaaccgctggcgcagctgctcgtgggtcagaccgtcgaaatcttccgccagcgccttcgccagctcctgctggccgatggcgccctgatcgaagaccagttttttcaccgccgcgaggctgttgccgaggttggcgatacccacctgcaggccggaaacccagtcatacttcgcgccgccctgcttaatgcttttcgcccgttcgatgcagtcatcgaccagcgccgagcagagaatatcgtggacgttctcttccagcatggtatcgaccacgtactcaatctcgatggatttacgggtgtagtaacgaatctggcggtcccagtcggctagcacctgatcgaagttagcgaagttgcctttcgacagggcgtgctcctgcggcaggaacacctgaccgctggtggcatcgcggccgccttccagcgtcgccagcatcacccgcgcgaagttaataaagctcatgccggtgcagcggtagccccacttaccgccgaccgcggtttcgatacagccgatagccgcgtaatcgtaggcgtcctgcggctcaatgcccagcttaatgaattccgggatgacgatttcatcgttgttaaacgccggcatgccgaaaccgcagcggatcacctggacgcaggcgtcgaggaagtcgttgctcatcccggcgtggtagcgcacgctgaggttcggctgggtagaacgcaggcgaccgcaggattccaggatcgcatacgacagcgggttgaccgcgtcctgcggcttaccatccaccagattctggccgccgatggtgacgttctggtatagcgggctgccggcagaggctttggagtgtgagccggaacggatcttattgacctccagcagcttcagccagcagctgtgcagcagctcaatggcctgttcgcgatccagcgactgttgcaactcaacgtcgcggcggtagtacgggtagaggtactggtccatacggccgaaggataccgaatggccattggattcaatctgcaggataagctgaatgaagtagcacagctgcagcgcctgccagaaggttttcggcggctcatgggcgatgacgtcgcagttttcggcaatcgtcagcagttcgtggcggcgtgattcgcgggattctgctgtcgccatctcgcgcgccagcgcggcgaagcgtttgctgtgatcgctgaccgcttccagcacgatatcaatcgctttcaggaactgctcgccgtgcaggtcttccagtaccgtcaaattgatacgcgagcggcgttcggcgactttcgcacgcatcccgtcgaggcctttctccagcagcaaggggtagttgaccgcgaggtgagcatccccggaggtcatattgccttccgccttaataatgccggtggcgagcagcgccttttgctcatcggtgaacataccgtagcagcggtcttgtacggtctggccgcgccaccatgggcacacttcatgcaatacgcgtttattctcctcgctgaccgagaagccggcgccggggcggtcggcgagatcgtcgatctctttctcaatccagctgacggtgtattccgggaaaataggcgcggcgcgcacttcgctggcctggttaccgacgatcagctcatcgtgcttgatccagatggtgcgctccgccaggtggtgagccagcgccagcgcgcggcgcaccgggatcggtttatcgagatgctgctgatacatctccgtatagtgacgggcgcgctcggtacagaccggcggcttgacgatatgcaccagcgccattttatgggcctggatacgggcgctgagggtgttgagcttcagggttgtcatagggttatcctcgtaatatcgccgttagccccttgctccgcgcataatcttgcgcgaaggcgagcagctcaggagcgtccagcggtttgtccggtgcggtgtagggctgactgagtaactggtatttgttcattcccagcgtgtggtacggcaggtaatggatctcgctgacctgcaggcgatcggcggcaaaatcggtgatcgcggcaatgtcggcttcgctggcgttgaatccctggatcaacggcacgcgaataatcatttttttccccgcctgcgccagacgctgcaggttatccagcacccggcgggcgctgccgtcggtccactgctgaaaaacggcctcgtcaacgtgcttcagatcggcgagaaacaggtcgacaaagggtaaagacggttcaatgtatttccacggcacgtgcaggcaggtttccacggcggtgtgaatgcctgcctgatgactggcttcgaacagcgcttgcgccagcgttgggttcataaagggttcgccgccggaaagagtgatgccgccgccgctgcgatcgtagaatggtttatcacgcagcaccgtcgccatgatctcctcgacgctcttctcctcgccgcacaccgtgagtgcggtggtggggcagcagtcgcgcagcgcggcgatatggctgtcgttaacgttttgccggtgaatgatcaggccatcgagggtgcgggtgataaccgccggcgccgcctgctggcacagctcgcagccgggcaggcacagccgcgagtcatacagcagatcttcgctacgggcgcggctctccgggttctggcaccagcggcagcccagcgagcagcctttcaggaagacgacggtgcggatccctgggccgtcatgggtggaatagcgctggatgttgaagatcatggcttatcctcttgtttgcgtatgaatataaaaacactttcgaatgaaagttatgttgacgcaaatcaacaagcgggatggggataagtcagagaggagaaaataacgagagcggtcacaaaaccaccggcgactctcgtcgccggtgtgggggtcagtgcgagccgcatacctcgcactgcgggtgacgcatcagcctcatttcgcgaaactggcaggtcatggcatcgtagatgacgatttttccgctggcaggggtgccgtagccgctcagcagcttaatcgcctccatcgcctgcagcgaaccgatgatgcctaccagcggggccattaccccggcttcgacgcaggtgagggcattttcgccgaacagacggctcaggcagcggtagcagggttcgccatcctgataggtaaagacgctgatttgcccctccatacggatcgccgctccggagaccagtggggttttgtgctgaaagcagccgacgttaagctggttgcgaatggcgacgttgtcggtgcagtcgagcaccagatcgtgatcggcaatctgcgccgccagcgccgcctcatccagcaaggcattgagcgggaccagacggacgtgcgggttaatgcgcgccagcgcctcgcgggcggaatccaccttcggctggccgagggtggcgtcgctgtgcagcgtctggcgctgcaggttggagagcgagacagtgtcgaaatcgagcagggtgagctgcccgaccccggcggcggccagatactgcgcggcggcgcagccgagcccgccgaggccgaccaccagcacgcgagcggcttttaaccgctcctggccgtcaaaatcaaaaccgcgcaagacgatctgccggttatagcgcagcatctcttcatcgctcagctcaacggtcattacagccccccaaacaggtgactgaagggttcgacctcgacccattcacctgcttcaacatggccgcgctcacgctccagcacgataaagcagttgccgaggctgaaggagctgaaaatgtgcgagccctgatggccggtggtgttcaccaccagttcgccgtccgggttgcgctgcagaataccgcgctgaaaatcgaggcggccaggcgactttttcaggcgcgtggcggcgcggacccgcaggcggggcgcctgaagcgggccgtgcttgcccgagagtttcgccagcaggggttgcaccagctgacagaaggtgacggtggcggacaccgggttacccggcaggccgcagaaccagctgctgctgagcttgccgaaggcgaagggtttccccggcttaatcgccagcttccagaagccgatctcccccagctcttcgaggatagttttggtgtaatcggcttcacccactgagacgccgccggagctaatgaccacatcggcctgctggtcggcggcgataaaagcgtcacgcagcttcgccgggtcgtcaggaataatgccgaggttaatgacctcgtagcccaactgctgcagcatcaggtgcactgccaggcggttggtatcgtaaatctggccgtcgccgagcggttgacccggcagctgcagctcatcgccggttgagaagaccgcgacgcgtaccttgcgcaccacctcgacctcggcaatgccgaacgaggccagcaccggcagctcggccaccgtcaggggtgtccccgccgggaagaccaccgcgccgtgggcaatatcttctccgcggcggcgaatatgctgcccggcttttaccggcgcgataaagcgcacgccggcctcggtctgttcagtctcttcctgcatcaccaccgcatcgcagccttccggcaccggcgcgccggtcatgatgcggatacaggtccccgacggccaggcgtcgttgaacggctggccggcgaaggccttaccggcgaccggcagcgccgcgccgtcgcgaaggtcgttcagccggacggcatagccatccatcgccgcgttatcaaagccgggcacatccagcggggagacgatgtcatgggcggtcacacgcgagaaggcctgcaacagcggtacagtttccgtcgcgttcagcggcgtaatacgatcgagcatctgggcgagggctgtgtcgagcggcatcagtccggcggtaaaatccatgggtcactcctgcgggcaaaacagcgaaaacgcctattatggcagaaaagcggcgcgggctgtatgccacctgggtacgaggctttacatcgcccgccgctctttctatattcaaaaattgtataagacattcagcaatataatgatatcaatacccttattcatgacgtgaccggcgccgcgccgcggtacgacagggcaggggcgatccacttcatcgttaaggactggcgaaatgggcaaggcggttatagcaattcacggcggcgcaggggcgatttctcgcgcgcaaatgacgccggagcgggagcgagagtatgtggcggcgctgtcgactatcgtcgaaagcgggcagaaaatgttggccgcgggcgccagcgcgctggatgccgtgaccgaggccgttcggctgctggaggagtgtccgttgttcaacgccggaatgggcgcggtatttacccgcgatcaaacccacgagctggacgcctgcgtaatggacggctacagcctgcaggcgggcgcggtagccggggtcaaacatttgcgtaatccggtgctggcggcgcgtctggtgctggagaagagtccgcacgtattactgatcggcgagggggcggaaaattttgccatctcccacgggatggcgcgcgtggataacgatctcttttccactcctgaaaggctgctgcagctgcaggaggcgaaagcgggcggggagattatcctcgaccaccacgccgctccccttgacgaacgccagaaaatgggcaccgtcggcgcggtggcgctcgatctggccggcaatctggcggcggcgacctccaccggcggcatgaccaacaaactgcccggacgcgtcggcgacagcccgctgccgggcgcggggtgttatgccaataatgccagcgtggcggtctcctgtaccggcaccggcgaagtctttatgcgcaccctggcggcctacgatatcgccgccctgatggagtatgggcagctcagtctctattccgcctgcgagcgggtggtgatggagaaactgccggctctcggcggcagcggcgggctgatagccgtcgatcgcgaaggcaacgtcgttttaccgtttaacagtgaaggcatgtaccgcgcctggtgctatgccggcgatacgccgaccattggcatttatcgcgaatagaacaagggagagggcgagtgtcgcaaactcacgaaaccgatacctgcgaagtgctggtggtgcgcaacctgaacgtggcgttccgccagcaggatgcgccggaggtgcaggccgtgcgtcagctttccttcagcctgcgccgcggcgagacgctggcgatagtgggtgagtccggttcgggaaaatcggtgaccgcgctggcgctgatgcgtctgctagacgcggccagcagcgaggtgaacagcgaggggctgtggttgcggcggcgtaaccggcaggtgatcgcgctcaatgagcaaacggacgctgagatgcgccgggtgcgcggcgcggatctggccatgatttttcaggagccgatgacctcgctgaatccggtttttaccatcggcgagcagattgccgaatccctgcgcctgcaccaggggctggggcgcgaagaggcgctgcgcgcggcgaaaaagatgctcgatcaggtgcgtattccccaggcggaagagatgctctcgcgctatccgcaccagctctccggcggcatgcgccagagggtgatgatcgccatggcgctctcctgtcggccggcggtgttgatagccgatgagccaaccacggcgctggatgtcaccatccaggcgcaaattctgcaactcattgccgtcctgcaaaaggagatggcgatgggggtgatctttatcacccacgatatgggcgtcgtggccgatatcgccgatcgggtgctggtgatgtatcgcggtgaggcggtagagaccggcagcgttgaggagatctttcgttcgccgcagcacccgtatacgcagtcgctgctggcggcggtcccgcggctgggggagatgcgtggccaggatctgccgcgccgttttccgctgccgggccagccgctggcggagagcgaaacgcccgatacggtagtcgccggcgagccgatcctgcaggtgcgtgacctggtggcccgttttccggtgcgcggcgggctgctcaatcgcgtgacgcgcgaagtgcatgcggtggagaaggtcagttttgatctctggccgggagagaccctgtcgctggtgggcgagtccggctgcggcaagtcgactaccggccgggcgctgctgaggctggtagagacccagggaggcaccattaccttcgacggtcagcggatcgataccctcgccggcggcaagctgcaggctctgcggcgcaatattcagtttatttttcaggatccttacgcctcgcttgatccgcgtcagacggtcggcgattcgattatggagccgctgcgggtgcatggcctgctgcgtggggaagcagcgcgtgagcgggtcgcctggctgctgaagcgcgtggggttgcagccggagcatgcctggcgctatccccatgccttttccggcggccagcggcagcggatctgcattgcccgcgcgctggcgctgaatccgaaggtggtgatagccgacgagtcggtgtcggctctggatgtctccattcgggcgcagattatcaatctgatgctcgacctgcagcgcgagatgggcatcgcgtttctgtttatttcccatgatatggcggtggtggagcgcatcagccaccgcgtggcggtgatgtatcgcggtcgcattgtcgaaataggcccgcgccgcgcggtgtttgaaaacccgcagcacccctatacccgtaagctcatggccgccgtaccggtggccgacccgggccaccgtcatccgcagcgggtcctgctgtctgatgacgtcccgggcaatatttataagcggggcgaggagatcgccagcgtgccgttgcagcaggtcgggccgggccacttcgtcgcccgcgaatccgccgatgtgctgggcagaacataacaacacataacgcatcttttcaggagaacacgatgacacaacctgtttcacgcaaatggtggctggcgctgagtatcgcggcagccctggcgagcgctcccgcctttgccgccaaagatgtggtggtggcggtcgggtctaacttcacgaccctcgacccctatgatgccaacgataccctgtcgcaggcggtggcgaagtccttttatcaaggcctgttcggccttgataaagagatgaagctgcaaaacgttcttgctgagagctataccgtgtcaccggacggcctggtgtacaccgttaagctgcacagcggggtgaaattccaggatggcactgactttaacgccgaggcggtaaaggctaacctcgatcgcgcgagtaacccggataaccatctcaagcgctataacctgtataaaaatatcgccagcaccgaggcggtcgatccgactacggtcaaaattaccctgaagcagcccttctcggcgtttattaacattctcgcccatccggcgacagcgatgatttcgccggcggcgctgaaaaaatatggtaaggatatcggcttccacccggtgggcaccgggccgtataagctcgacacctggaaccagacggattttgtgaaggtcagcaagttcgatgggtactggcagccggggctgccaaagctggattctatcacctggcgtccggtggtggataacaatacccgggcggcgatgctgcagaccggcgaggcgcagttcgccttcccgatcccttacgaacaggcgccgctgctggcgaaaaacagcaaactggagctggtggccagcccgtcgatcatgcagcgctacatcagcatgaacgtgacgcagaagccgttcgataatccgaaggtacgggaagccatcaactatgcgattaaccgtcaggcgctggtgaaggtagcgttcgccggctacgccaccccggcgaccggagtggtgccgccgtcgatcgcctatgcccagacctacaccgcctggccatacgatccggcgaaagcgcgccagctgctgaaagaggcgggctaccctaacggtttcagcaccacgctgtggtcatcacataatcacagcaccgcgcagaaagtactgcagttcacccagcagcagctggcgcaggtggggattaaggcgcaggtgacggcgatggacgctggtcagcgggcggcggaagtggaaggtaaagggcagaaagagagcggggtacggatgttctataccggctggtccgcctccaccggtgaagccgactgggcgctgtcgccgctgttcgcctcgcaaaactggccgccgacgctgtttaataccgcgttttacagcaacccgcaggtggataacgcgctgagcgaggcgctgaaaaccaccgatccgcaagagaaaaccaaactctataaagaggcgcaggatattatctggaaagagtcgccgtgggtgccgctggtggtcgagaaactggtctccgcccacagcaagaacctcaccggtttctatatccagccggataccggctttagcttcgaacaggcggacctgacgccgtgatcatgttcatcttcatgcgtcctctctcccggaatgggagggagcgatgctgaattatgtgattaagcgcctgctgggcctgatccccactctgcttatcgtcgcggtgctggtgtttctgttcgtccatatgctgcccggtgacccggcgcggctgattgccggacctgaggccgatgcccaggtggtggcgatggtgcgccagcagctggggcttgaccagccgctgcatgtccagttctggcactatatcaccaacgtgctgcgcggcgattttggcatttccatggcctcgcggcgtcccgttgccagtgagattgccagtcgctttatgcccacgctgtggctgacgctggccagcatgagctgggcggtactgttcgggatggcggcggggattgcggccgcggtgtggcgcaatcgctggcccgaccgtctgggaatggcgctggcggtgagcggtatttcgtttccggcttttgcccttggtatgctgctgatgcaggtgttttcggttgagctgggctggctgccgacggtgggggccgacagctggcggcactatattttgccgtcgttgacccttggcgcggcggtggcggcggtcatggcgcgctttacccgcgcgtcattcgtcgatgtgctgcatgaagactatatgcgtaccgcccgggcgaagggggtgagcgaaacgcgggtggtgctcaagcatggtctgcgcaatgcgatgatcccggtggtgaccatgatggggctgcagttcggctttctgctcggcgggtcgatcgttgtggagaaggtgtttaactggccggggcttgggcgcttgctggtcgattcggtggagatgcgcgattacccagtgattcaggcggaagtgctgctcttttcgctggagtttattcttatcaatttagtggtggatgtgctgtacgcggccataaacccggctatcaggtataagtaaggtgcgattgcttaactggagaaggcaggcggcgctgaacgccatgccgggcatcagacccggcgagatccataccccctggcatgagttctggcggcgctttcgtcgccagccggtggcgatgggcgctggtattttcgtgctgttgctgattgcggtagccatcgttgccccatggatagcgccgtacgatgcggaaaattatttcgactacgaccgtctgaacgagggaccttcgctggtgcactggtttggagtcgactccctgggacgggatattttcagccgggtgctggtcggggcgcagatctcgctggccgccggggtactggcggtgctgattggcgcggccatcggcacggtgcttgggctgctggctggctactatgagggctggtgggaccggctcattatgcgactttgcgacgtgttgttcgcctttccggggatcctgctggcgatcgcggtggtcgccgtcatgggcagcgggatggccaacgtgatcatcgccgtggcgatcttctcgatcccggcgtttgctcgtctggtgcgcggcaatacgctggttctgaagcagcagacctttattgaatcggcgcgcagcatcggcgccagcgacgccaccattctgttcaaccatatcctgccggggacggtgtcatcgatcgtggtttatttcaccatgcgcattggggtatcgattatttcggcggccagtctgtcgtttctcggcctcggcgcgcagccgcccaccccggagtggggcgcgatgctcaacgaagcgcgggcggatatggtgatgtctccgcacgtggcgctctttccggcggtggcgattttcgtgaccgtgctggcgtttaatctgctgggagatggcctgcgcgatgcgctggatccgaagttaaaggggtagggtgagggaaagctccgccgggagtcctttatgttatctgcggcttcagcgcacattgcgcttccggttaattttctgcgttatgtctctcatggcgcagggagcgcacagggggcggccagtcgccgccgccccctgtacccccgggctccggccagcaacatcgccactgcgtggtgccttcgacttatccctgcaggcttcgggtcgggccgaggcagcgtccgtgcaaaacacggccctcagcccgcatccatgcggcctgccccggcctttcgggaacgtctcagcgatgttgaggccgccagcatcggctgtttcagcggccccatgtccggcggcgattcacatattgggactggaccccgtaggccgggtaagcgtagcgccacccggcaaaataaccgcgcaacagggctgcctggaaggtaatcaatgcttgcccgcggcgctgcgcttgcgcggacccgggggtgagcctacgggaggaccccgtaggccgtggaatgcgctaagccgctatccgggaagctggactagacccgggtaccccacaggtcgtattcgtcggcgtgctcgactttcacccgcaccacgtcgcccggcttaacgcgggtttcgccgttcaggtacaccgcgccgtcgatttccggagcgtcggccatgctgcggccaatggcgccttcttcatcaacttcatctaccagcaccaggatttcgcgccccactttctcctgcagacgctcggcagagatctgctgctgcagctgcataaagcggttccagcgctcttctttcacctcttccggcacctggtccgccagctcgttggcggtagcgccttcaaccgggctgtacttgaagcagccgacgcggtcgagacgcgcctctttcaggaagtcgagcagcatctggaaatcttcttccgtttcgcccgggaagcccacaataaaagtggagcgcagggtcagatccgggcaaatttcacgccactgcttaatgcgcgccagctgacggtccgcagaacctggacgcttcatcagcttcagaatacgcgggctggcgtgctgcagcggaatatcgaggtacggcagaatcttgccttccgccatcagcgggatcacatcgtcaacgtgcgggtacggatagacatagtgcaggcgcacccagatgccgagcttcgccagctcttcgcacagactgaccatgctggtcttcaccggcataccgttgtggaagccggtgcggtgcttgacgtcgacgccgtaggcagaggtgtcctgcgaaatcaccagcagctctttcacgccggcgtcagcgaggcgtttggcttcggccagcacttcgccaatcggacggctcaccagatcgccacgcatggacgggatgatgcagaaggtgcagcgatggttgcagccttcagaaatttttaagtaggcgtagtggcgcggcgtgagcttaaccccctgttccggcaccaggctcaggaacgggttgtgcttcggcttcggcgtataatgatggacatgctccagcacctgctcatagctgtgcggaccggtgatctccagcaccttcggatgcacttcgcggatctgatcctctttcgcgccgagacagccggtgacgattaccttgccgttctctttcaacgcttcgccgatcgcttccagcgattcctgcacagcgctatcaataaagccgcaggtgttaacgatcaccatatcggcgttgtcgtaggtcggtacgacgtcataaccttcggtgcgcagttcggtcaggatacgctctgagtccacgaggtttttcgggcagcccagggagacgaagccgattttcggctgatgcgtgacattgctcatagcttaaaaagtgttcaattattggaatggtcagggcaggaattctacagatctttgcgaaaaagagtatagctccgtcgcggttaatggtgaaaaagcgcccccgacctgtcttttacgccccccaccgccagagcggatcccacacgccccggagcagaggggcgggacacgcttctgacaagccgtgcgcgcaggcggctcaagcccggcgtggctgccgggcagagacttattgcgccgggttaatggctgcggagggcgtggcgccggtttttttcggctcgcgcttatcctgcagcgtgaaaatagagatcagggtaaagagcccggcgacgctgccgagaatcagataggtgttggcgaagccaatggtatcgtacagatagcctgccagcggagagtaaatagcggtggcgatcgaggcgacgaacagcaccagcaaatagaccgtcgaagagagcttgtggtcgaagttggcggcgatgaatttaaagaccgataccagaatcaacggcttctccagagcatgcatcattttcaccgcaccaatccacaccgggccgaggggcacggctgagccgacaatacgtaccgacatgatcagcccggcgatgatcagcgcccatttggcgccggtccggttaacaaaccatggcatcaggcagaggaacagggtttcaccgcagacctgaatagacgcgaggatcccgtaccagcggttgccttcctccggcgtcgggaactgtagcgagaagtactgggcaaactgctgatcgtaggtgtcgtaaatctgcgtgacgaacagggtaaagagcagcagcatccagaactgaccattcttcgccagctcaagggcatgagagaccttcagcgattcgcttcgcgccacatcggcgtcggttaattcaattttggttagcataaagcagatggcggcgatgacaatggcgaggctggcgagccagaaggccagattaggattgctgtctatatatttacccacaatccaggccgccgctgcccagcctaacgagccccacatccgcacacgaccatattcgaactgatagcgccgggaaatcttatcgatataagagtcgattactccgcagccggagttaaagatgatccccagatagatccctcccagcaaggcgccaaaccaaaagttgtgcaccagcagcggcgcgtaaacgtagataaagaaggggcccaccggcaggagcagggcgaccagcagccagataagccgttttttcaggccgaacttgtcagagataaagccgaagaaaggctgcatcagcagggcgataaaggcgttgaccgagtaaagcagcccggtcttcgtggcgctgatgccaagatgctgggtggtccagataacgaagaaagccatggtcgacgaccaggcgaacaggtagaggaaatcgaaaagactcaacagaaggtagtttcttttaccggacgtcatgtttcagttccttgcaaatgggcagagagaatttcagcgatccgcgggccgcgttcgctgttttcctgacatgttatacgtattacattaattatttgttatgacatcctaattgacgatggtgcaacaggtcatatgaggtattgtgatcatcgctgcactaattttgtcttttattgccattttctgtttattaatttcatattgaaattaattgtgatcgtataacattatttttgttatacaccctacaatgcgttaaagttgccacattgtaaatgatgttaaagaactggggattattgacctggcgcatcattttgcacaaaaaataaccgtattatggaaagggtaaaggacgacagaggaggaaccgtgatgaccgttgacagactataccgccaccttctgcagaagcttattaacgccaatatcgatattgacgcctatctgcaactgcgaaaggccaaaggctacatgtcagtcagcgaaaatgaccatctgcgtgataacttgtttgagctttgccgtgaaatgcgtgcgcaggcgccgcgcctgcagaatgccatttcaccggaggagagggatgtccttcgcctggccggcgaatcggtcgccgccgctgcactatgcctgatgagcgggcatcatgattgtccgctatacatcgctgttaacgtagagaagctagaacgctgtctgacaggattgacctcaaatattcataaattgaataaattggcgccaatcactcatgcctgatcggctgaaacccaggggaagtgaacgcttcccctgttaaaggttatgtaaaaatcgccgcgcaaatttccccgctggctaccctttagcccagagctgacgaaaggagaatgccatgcgtccgatcccactgctgttgatattgagcgccttagcgctaccagccctgagccaggccgcggtgcgggtggaggtattgcaaaaccggctggcccagccgtggggcatggcctttctgcctgacgatcagggcatactgatcaccctgcgcggcggcgagctcaagcgctggcagccgggtaaaggtctgtcggcgccgatagccggcgtgccgcaggtatgggccaacggccagggtggcctactggacgtggcgctggccccggatttcgcccagtcgcggcgggtgtggctgagctatgcggaaagcgacgccagcggtaaggcgggcaccgcggtgggctatgggcggttgagcgaggatgccacgcagctgacgaactttaccgtggtctttcgccagcagccgaagctctccgtcggcaatcattttggcggcaggctggtgttcgacggcaaaggatatttgtttatcgggctgggcgaaaataatcagcgcgccaccgcccaggatctcagcaagctgcaggggaaagtggtccgcctgacggagaccggaggtgtaccgccggataacccttttgtcggccgggctgacgccaggccggagatctgggcttacggcatccgtaatccgcagggcatggcgatgaatccctggagcgaggcgctgtggctgaacgagcatggcccgcgcggcggagatgaaattaatattccgcaggcggggaaaaattacggctggccgctggcgacgcacggtattaactacagcggcctgcccattccggaagcaaaaggcaaaacggttccggggaccgaacctcccctgtatgtctggccggtctctcccggggtgagcgggatggccttttattcggcgccgacctttccccagtggcagcataagctgtttatcggcgcgctgaaggagacatcgctgattgtcctggcggtggacggtaatcaggtccgcgaggaggggagattactggaggcgcgcggaaaacgcatccgcgatgttcgcgtgggacccgacggctatctgtacgttttaaccgacgagtctaacggcgagctattgcggttgagtcccgaggcttagcctcaggtcaccgggatctgcactacttcgcgccaggcaggacgttggctaatctgctgataccagcgctgcagatggggccgcggttgccagctgtcgtggatcgacaacagattgtagacgaagggagcgacggcaatatcgccaaggccgaactgctcgccggagagccacggcgttttggccagttcgtcatccagcatggcgaacagcgcttcgcaggcgctgatccccgcggcgatggccgccgggtcgcgctgctccggcggcgttctcaccaggcccattaataccgggcgatgggcgggagagagggtgccgttggaccaatccatccacttttccccttgcgcgcgctgcgccggcgcggcaagccacagacggtcaacgccatactgggccgccaggtagcgaataatcgtatttgattcccacactaccaccccggtggcatcgtcctttaacagcggcaccagcccgttcgggttcatcgccagatattccgggtcatgattgagaccaaactccagcccggcgaggatctgctgataaggcagatccagctcctccagcacccagcgtactttcttcacgttggtcgagttattacgtccccacagtgtaatcattttcgctcctgagtttgtttcactgccgttgcagcgcgatcggcgatcatgttgggataaagttaaaaatccggcaagcttttttatttggctgttattaaaggtttttatgcttactcccttcagccaggggcactcctgggttacagggcccggaaagtgtttttactattttacaggagtaatatctatagggtgttacgctacgaaggaaagggcgtgaatatggtgtatcttattgataattaaagctttaaatcatgcatgcatctataaaaacgctccctctccgtctcggttaaaatctcaatgtcgcctgagggtataatttgatgctgattattgcatcgcaatcatctgaggaacacaggttaatattaataaatagaaagtcagtgaaagaattatatttttacagggatgaactgttgtttttatcgatcggatatacatctttttcatcccacccagaaaaaatagaccatgagaggcgccgactggctggaagatattctgaaaaatagcaaaaaaaacccagtgactggcactggggagtaaatttactcagggttgcatgctgttctcaagataatattcgagtctcgaagtatgggttaaccaaaggtaaccatcaacttccatacagactacatgggaaatatactgtattaaataaccaggaatccacccttacttttgtgctatttatcttacctgggtaattacggcgggggtaagtggtatataatgcaataatcagtatttgaatctatagcgttaaacgagcagagcctggtagaggactttactttccccggaaggatttgaaaaaggcggttaaaatgaatgactgataaggatggccagcatactatcgcggtgctatcaaaacatccctgcaaaacgaaatagggataaaagaagcactggcgaactgcagtctggaagagcgagtcgtagagctcgatatggcatcggacgagaagggtaggagattacccgggaagagatgttaaccttttcatcaaaccggcgtgattaataacgggcaacagaatcagagcggcccggggttttgagagcaatacttctgtaaaggccacggctgtggatgcgctgttatgaatgtatttgtaaaatttatcaccatccagagtcgccttgaaaaaaaaagcccagcgacaggctggggtgtaattacacgcataaagggatatgccattttcaacacaatatgcgaatcttaatttatggaataactgcgggtgagctacccgcttccataaagattgcaggggaaactatactgtatttaatgaccaggaatccatccttatcgatgtgctatttttcttacttgtgtaatacggaaagggaaaatagcccgataaactatcttttaccgatatgccgactaaaacaggaaagccgtctgcctgcttatccagtgggcgaataattcatatcattagcgggaggctctcccttcctgacctcaattcctgatggtggcgtatagaggggatagctgattgatatcctttatcaaggagattgcgcctccatcggcggaatgctatggcaatcgaagccctgctgaacatggcgatcaggcaggcccgatggagagaaaagtgcgggcgttgttgctaatttcctgagacgggcgtaatgaccgtctcaagcatagcccgggagttctcaactgcatttcaggcgtaaatacggcctacagaaccttcaggtttatatttaagcgtctgagacttctacagcagcaagccagatgtggttattgtgagttcggaagttgaactgggcctcatggaatgcaaccgggccgacattttgagttttgtgaagggtatcagcagtaacaaccatccccggttctcaggtgaagggggtaggggcgacgcgactggatatcactggccaggctttcgcttaccccacacggccccgccataatgtgaatctatgaccaggcaaaccacaatgaaagacacgcttgcgacgtctctttagtagcattttccccgaagagaagtgagctatgtcattgaaatttcggtgactaattggttttgaaaggcgatttttttcttgccataataaagttaacattaaggcgattacgatcaaaaaaattgttctgattaaagcacagcggcatgttattgcgtaaactttaaaaactttaccaactcgctgtttctttaaggtcatttgtacgctttactcaccggttgctgcggcgcggtcagagtggcgcggcatattttgtttggaaaggatacttgggtggctcttatgatgcatgacgctttttcccttcgcggcctcgcggcaggttgcgcgctgttatttcttgtcgcacctgcggtgcaggctgcggaacaactccccgacgccccttcaattgacgctcgcgcctggatcctgatggactatgccagcgggaaggtgctcagcgaaggcaatgccgatgaaaaactcgacccggccagtctgacgaagatcatgaccagctacgtggtagggcaggcaataaaagcgggaaaaatcaaactgaccgatatggtgaccgttgggcgcgatgcctgggcgaccggcaacccggcgctgcgcggctcatcggtgatgttcctcaagcctggcatgcaggtttccgtagaagatctgaacaaaggggtcatcattcagtccggtaacgacgccagcattgcgattgctgactacgtagcgggcagccaggacgctttcgttagcctgatgaacggctacgccaaaaaaatggggctgaccaacaccacctttatgaccgtccacggccttgacgcgccggggcagttcagcaccgcccgcgatatggcgctgctgaccaaagcgatgatccacgacgtaccggaagagtatgcggtacataaagagaaagagttcactttcaataaaattcgccagccgaaccgcaaccgcctgctgtggagcagcaacctcaacgccgatggcgtgaaaaccgggaccaccgccggggccggctataacctcgtctcctcggccactcagggtgatatgcgtttgatcgccgtggtgctggggaccaaaaccgaccgcattcgctttaacgagtcagaaaaactgctgacctggggcttccgcttctttgaaaccgtgacgccgattaaaccagatgccaccttcgttacccagcgcgtgtggtttggcgatagcaatgaagcgaaactgggggctggcgaggcgggctctatcactttgccgaagggccagctgaaaaacctgaaagccagctataccttaaatcagccgcagcttaccgcgccgctggagaaggggcaggtggtcgggactatcgactttaagctaaatgataaaaccattgaacagcgtccgctgattgtcatggagtcggtaaaagagggcggcttcttcagccggatgatcgacttcgtgctgatgaaactgcacggctggttcggcagctggttctcctgatgcctgcccgcgccctgcggggcgcgggcagcgacgcttcaatacagtagggaaatctgctgcgccttcgccagcgcgaccagctcatcatccgggcagatatcgctggcaatcacgtcaaatttcgctaacgcccccatgcgcgccggacgcactttgccaaacttgctgtggtcgaccaccagcacgtgatagcgcgcgtgacgcatcgcccagtgcttaaccggcagctcttccaggttatagcaggtcgccccctgctcgcagtcgatccccgccgccgagtaaaaggcgatatcagggctcagatggctgagggtatcctcaaggctcagcggcataaaaatcgcgttgctggcatgaaactccccaccgcacaggaccgcgcggcactggggtttttcctgcagggccagaaaggtgttcagggagtagcagacgccggtgaagggcagggcatcgtcaatggcgtcaataatccacggcgtggtggtcccgcagtcgaagaaggccatctgatgggcctccagcagcgcggccgcatggcgagcggcacggcgtttttcctcaaccagccgggttttttgatcgctgagcaggtaatgggtggcgctgcgcggctccagcacaatgtatccgccgagcagcacaaccgggccgctgtggccattgaggtcgcgacgaatggtcatttccgacaccccaagcagggaagcggcttctttcagatgcagcttatcgctgcgtttaagtgcctgaatgagctgactgatacgttcgtcacggcgagtttccatattccctctgcgctaaaatcgccctgcgggggcagggcgttagcgggattttacctgtcgcttgcgggttagtcacgcggtggccgcagcgacggcggcgtttagccgcgcacccaacctttgcggattggcaaggagaagcagagacgatacagccgctgcagctgatggtatagcgccgggccgaacgtatgccagatcagcgccgcgccaaggcagccgcacatcccggccagcagcccgccgaccatatccagcggccagtgcacgccgagatagacacgggaccaggcgatggcggcggcaatggccatcagcagggcgccggaccacaggcgatgccagaacaggaaggccagggcaaaggtaaagctgacggtgccatggtcgctggggaaggagtcgtccgccgcgtggtgcaggaagttatagcctacgccggcgacaaacggccgatcgtgcggataaagatggccgatcgtccacgacacggtcaggctgatcgtcagcgccagcatcagcttaaacaccatctgccgctgggcaggcccccacagccacaatgtcaccaccagcagaggtacgatcagaatcagatctttagcgatgaagatcgccatctcaatggcccactgcggcgaggcaggcgtcgcgttgagcagggcgaacagcgcatagttaatattttccagcatagacttccaggctcgttggtccgatagcaattaagccgcctaccctaaataaaagcggtgcggagataaaggcggcattgtcttaaagatcaggttgttatgaaatccactaccataaagtctacggctaacagcctgaaaaacgtcagtatatcgtttgtcacattgctgaaacataaacggaatatatacacaggctgaataacaggggagaggcaggacgatggcgcacggctcgtaatattgtgcggtgtcacccacaattcactatctccgcgccgggagtttcattacactttgcgcgatttttgatagataagagatttcatgcaaaattattcgctttcaggccgccgcctcggaaggcaggcgctgttgttcccgttatgtctggtgctgtacgagttttccacttatatcggcaacgatatgattcagccgggcatgttagccgtggtgcaggaatttcaggtgggcaacgaatgggtacctacctcaatgactgcctatctggcaggcggcatgtttttacagtggctgctggggccgctgtcggatcgtattggccgccgtccggtgatgttgaccggcgtagtatggttcatcgtcacctgcctggcgacgctgctggcgcagaccattgagcagtttaccctgctgcgcttcctgcaggggatcagcctgtgctttattggcgcggtgggctatgcggcgatacaggagtcctttgaggaggcggtgtgtatcaaaatcaccgccctgatggctaacgtggcgctgattgccccgctgctggggccgctggtgggcgccgcctgggtgcatgtcctgccgtgggagatgatgtttgtcctgttcgccgtgctggcggccatctcgttcttcggcctgcagcgggcgatgccggagaccgcgacgcggctgggcgaaaagctgtcggtgaaagagctgggccgcgactatcggctggtgctgaagaacctgcgcttcgtcgccggcgcgctggccaccggctttgtcagcctgccgctgctggcgtggattgcccagtcgccggtgattattatcagcggcgaacaggccaccagctatgagtacggcatgctgcaggtgccgattttcggggcgctgattgccggcaacctggtgctggcgcgcctgactgcgcgccggaccgtgcgctcgctgattatcatgggcggttggccgatcatgtttggcctgatcctctctgcggcggcgaccgtggtctcttcccacgcttatctgtggatgacggccggtctgagcttctacgccttcgggattggcctcgcgaacgccggcctggtgcgtttaaccctgttcgccagcgagatgagtaaaggcacggtctcggcggcgatgggaatgctgcagatgctgatcttcaccgtcggcatcgagctcagcaaacatgcttacgagctgggcggcaacgggctgttcagcctgtttaacctgctgggtggggtactatggctggggctgatgatttactttctgaaagataaaagcgtcggcaattcgcagcaggggtagttgttttcaacccggatgcgctcgcatccgggtcttatcaggcgaacggcgcttcgcgatccaacaccttatcaataatctgcaggacaccttcttcgttgttatgcggcgcctgatagcgggcgacggctttgacgtcttcccgggcgttggccatggcaaagccaaacccggcgtgctgcagcatttcgatatcgttgccgctgtcgccgaacgccaccacctcgtgatcctcaatgccccagcgctgctgcaaaatgcgcagcccgttggctttgtgcacacccgggataattaagtcgatgctgccgtagccggtggccaccgcggtgaccatgtcccccagcgtcgcgtgcagcttcggctgaatttccgggatcaggctgtctggcacgttgagaccaaatttgaggatggtgtcatcgagatggttaaaatcatccaccagttctaggcggtgataatacttcgccgccaccgtcttcagcgcgtcgttgtagcgattgagggtgtaggcgctgcgcttcccgcaggcgatgatttcgatattcggcaacgtctgcagatggtcgaccacggcgttgaagtggtgaaccggcagttggcagttgaagacgtcttcattgccgctcaccacccagccgccgttttccgccacgaaggcgatctgatgggcgatctccgggaaaaaggagatcagctgataatattggttgccgctggcgaccacgaagcgaatattctgttcgcgcattcgctggtactgggcgaggaagcgcggccggttataagttttggcatcgcttaaaaaggtgccgtccatatccaccgcaatcagtttgatgctcattagctgttctccataacgggttcagattgtggcttagccaccgcgcgggcgaccagcgccgccgccatcaccagacccagcaccaccatcatggcgctgcgcaggccgaagtgttcgccgaggaaacccagcagcggcggcccgacgaggaaagcgagatagccggtgatcgccaccacgctgacgcgcttgggcgcgtccggcccggtatcgctggcggcggagatggtcagcgggaagccgagcgaggcgccaatgccccacagcagcaccgagatgcccgccacccaggggttatcgacgaagatgatcaggcctatgccgagggcgcccatcactgcgctgccgcggaccaccgccacccggctgtagcgatcgataaaccagccgccggtaaagcggcccagcgtcatgccgagggtgaaaccggcataaatcagggagccggaggtggggctaaagccgtggccatccaccatcagcagcggcagccagtcgttggccgagccttcggcaaaggccatcgccaggacaatgacgccgatcagcagcagctgcgcgtcgcgccacaccggcagacctttcgcctcaccgtgggcgacttcggcggcatttttaccggtgccgtcgggaatggcgcggatagcaatggcgatgggcaggatagccaccagcgcagccgccaggatgtgcggggcggccggcagaccgaatccggtcactgccatgcccaccccggcgccgaacagggtgccaaagctgtagaagccatgcatcatcggcagcaccgttttattcatctcccgctcgatggccgcgccttcgacgttaatagcgacctctgcggagccgaagctggcgccgaagatagccagaccgaaggcgaacagcggggcggaagtgacccacagcgccaggctgagcaccagcatgccaagcacggcgaaggacatggtggtgcggatgaccttgcgggtaccaaagcgcttcaccagccacgccgagcagagaataccgctcattgaccccaccgacagaccaaacagcaccacgcccatctctgcggtggatagcgccaacagatcgcggatcgccggcgtgcgggtggcccaggaggccattaacaagccggggatgaaaaagaacataaacagcgcccatagccgaagctgcagcgctctgcgcgaggattgcgtcgtcatccgtaaacgccttaaaggagaagagtgaagacaacagtagcaagtaagtgtacatttgtacataaaccggaagaggaaaatcatggcccgtagaccaaacgatccgcagcgccgcgagcgcatcctgcaggcgacgctggataccatcgcggcgcatggcatccatgcggtgacgcaccgtaaaatcgccacctgcgcgaatgtgccgctgggatcgctgacctactatttcagcggcattgaggcgttaattgaggaggcgttcagcctgtttaccgccgagatgtcggcgcagtatcagcaaggcttcgtcggggtaacgaaccgggaacaagcctgcgatgccatcgcggatctgatcttcagcgcccaggtgaccacggcgcgcaatatggagctgatgtaccagctgtacgcgttctgcagcagtcagccggcgctgaaggcggtgatgcagaactggatgcggcgcagccagcagacgttggagcagtggttcgcccccgataccgcccgcggtctcgacgcctttattgaagggatgaccttgcactttgtcaccgaccgcgcgccgctgtcgaaggcggcaatccgcatgatggtcgggcagctggcgggggagagggcgcaggaagaggggcgctgaagcggcgtttcacccggaatggctaaacgcaggcaacaaaaaacccatcaaccttgaaccgaagtggcggggttgatgggctccacaaaatggggacatcaaagaaaagcagtggcattacttatgactgatgccctgagaaaaagttctgcctgtgacggcttttttctcaaaaaattattgtagccctggccagatgatcacgatgagcgtcccggcaagggtaagcagcacgttggcgatggcgtaggtccctgcgtagccgagcgctggaatattgctgcgcgcggtatcgctgatgatctccatcgccggggcgcaggtgcgggctcccatcatggcgccgaacagcatcgcccggttcatgcgcagcacgtaggcgccgaacaggaagcagatcaccaccggcaccaggctgacgataagccctgccgccagcatctggccgccgacggcgcccagcccgttattgatcccggccccggcgctgagaccgaccccggccataaacaccatcagaccaaactctttcaccatgttcagcgccccctgcgggatatagccgaaggttgggtggttggcgcgcaggaagccaagcatgatgccggcgaacagcaggccggcggcgttgccgatgccgaagctgaaggagctgaactggaaggtgatcatgccgatcatcaggccaacgataaagaaggcgcagaaggccagcagatcggtcacctggctgtgaatggagataaagccgatgcggtcggccacggtttttacgcggcgggcgtcgccgctgacctgcagcacgtcgcctttgttcagtacgacgttatcgtcgataggcatctcgatctggctgcgaataacccggtttaagaagcagccgtggtcggtaagcttgagttgcgccaggcggcggccgacggcgttgtggtttttgaccacaatctcttcagtgacgatgcgcatgtcgagcagatcgcggtcgaacacctctttaccgttgcggaagctcgggtcgaggcgggcgtgggcgtccgggtaacccaccagcgcaatatcgtcacccatctgcagcaccgcgtcgccgtccgggttggccagaatgccgttgcgacgaatgcgttcaatatagcagccggtctggcggtaaatacccagttcgcgcagatttttgccatccgcccaggccaccagctccgggccgacgcggtaggcgcggatcaccggcaggtagactttacgtttggaatcggtatcgaggccgcgctcgcgggcgatttgctgggcgctggtctgcagatcctgatgctgcagcttgggcatatagcgggcgccgacgatcaggctcaccagaccaaccagagaggtcagggcatagccgaggctcagatggtcaagcgactgcgccagctgatcgctgggcaggccgaaatggcgcagggtgtcgcccgcccccaccagcaccggggtggaggtcatggcgcctgccagcataccggcggtgagcccgatatcccagccgaacactttacccagcaccatggcgatcagcatcgcgctgccgaccatcaccagcgccagcatcaggtagtttttcccgtcgcggaaaaaaatagaaaaaaagttgggcccggcttctacgccaacgcaaaaaataaacagcataaagccgagattaagggcatcggtgttaatcgcgaaatgctgctggcctaataatagagaaacgactaaaacgccaatggaattaccaagttgtactgagccgagacgcagttttcccaggcatagtcctaatgcaagtacaacgaataataacaggatgtaattcccgtttaacaaatctgcgacgtttatattcacgaaagccaacttctcatttactagtaagttgttgaaggaaatggttatttggtctaaggttgctcaggcgttcgcgttgtcgcgaacctattctggcaccctgttataaccagcaaaaatataccgctagtttaatccttcctggatgcggcggctagtgacaatcgtttttaggctggtaggggagttattggcatggattgccgaaatgctttatctgactgggcgacgtggacgtgagttagaggcaacatcaggaggatacggtgaaatctgagcgtagttgggccggcattatctgtggcttcgttctgttcattgtggtgtgcttatcgttgttgttacatatgaaaggggcatttcgcgccagcggcaacccggagctgggcctgctcttctttttgctgccaggggcggcggcgagctgtctctctcccggacggcgggtgctgcgtcctttgctcggcgcgatactggcggcgccggtctgcatggtgacgatgcggctgttcttcgtgacccaccggacgttctggcaggaaatggcgtgggtgttgagcgccgtgttctggtgcgcgcttggggcattgtgctttttgtttatctgcgcctggcttgatacctggcgcagtcattcatcgagcaaataaattgactcaggcaaacaggccgagattctcttttgcccaggcttcaaaatcggtgcagccgccgatgtgtttctggtcgacgaaaatctgcggcacggtttcaaccggtttgccaacggttttttccaggtcagctttgctgatgccttcggcatgaatatccacgtagcggtagttgaaatcatcacgctcgttggtcagtttttctgccagttctttagcgcgaacgcagtaagggcagcctggacgaccaaaaataacggtaaacattgcttctctccttaaacctcagccggatggcgaatggcgcttatgatgcctgcaacgggcggggagggaaagaaggttctgccttttacttcgatggtttacggctatgtttgataaatgtcggactgtcaaaacacgtatactggcccgacggcgcggtggaattggctggcgcgccgcgtttatcaaccggagaggcgtgatgcgaaaatttgccccattgccgaaaagcatactgctggttgagctcctcgggatggggctgttaaccctcgcctggctctcccttaaccagtatgtccagctgcctgcgcccattgccagcccgaccgcggcgctggtgatgctctttgccgggatcgtgctgatgatccccgccgccatcgtcgtgatgtggcggatggcgcagatcgtggccccgcagttaacgcactctccaaagcctgaatccttgtctgacagagaaaaacgaaatgacgccgaccattgagctgctgcgcagccaccgttctatccgccacttcaccgatgcccccgtgagcgacgaacagcgcgcagagattatcgccagcgcgcaagcggcatctacctcgagttttttacagtgcacctccatcatccgtattactgacccggcgctgcgtgaacgtctggtcccgctgaccggcggccagcagcacgtcgcccaggcagcggagttttgggtcttctgcgctgactttaaccgccatctgcagatctgcccacaggcgcagctggggctggcggaacagctgctgatcggcgttgtcgatacggcgctgctggcgcaaaacgcgctgaccgccgccgagtccctcgggctagggggcgtctatatcggcgggttgcgcaacagcattgaggccgtcacagagctgctggagctgccgcagcacgtcctgccgctgttcggtctttgccttggctggccggcggataacccggatatcaagccgcggatgccggcggccatgctggtgcatgagaaccgctatcagccgctggataacgcgctgctggcggagtatgacgaacagctggcgcactattatctgtcgcgcggcagcaacgcccgccgcgatacctggagcgaccatatccggcgcactatcgtgaaagagagtcgtccgtttattcttgactatctgcataagcaggggtgggcaacgcgctgattacgtgtacactgctgctccggccaggtgatatccgccgccggccgcaggaaaggtgaaagtgtgttcgatagctgaggcccgccagagcgggtcttttcgcagaggtgcaggatgaaaattgccatattatcccgggatggaacgctttattcatgtcggcgcctgcgcgaagcagcgcaacagcgcggtcatcagatcgagatcctcgatccgctttcctgttatatgaacgtcagcccggtggcctcgtcgatccactacaaagggcgtcagctgccgcactttgatgcggtgatcccgcgcattggctcggcgatcacctactatggcaccgcggccctgcgccagtttgagctcctgggaagctatccgctgaacgaatcggtcgctattacccgcgctcgcgataagctgcgctcgctgcagctgctggcgcgccagggcatcgatctgccattgaccggcatcgctcactctccggatgacaccagcgatctgatcgccatggtgggcggcgcgccgctggtggtgaagctggtggagggcacccaggggatcggcgtggtgctggcggagacccgccaggcggcggagagcgtgatcgacgcctttcgcggactgaacgctcatattctggtgcaggaatacattgccgaagcgaaagggtgcgatatccgctgcctggtggtcggcaatgaggtggtggcggcgatcgagcggcgggcgaaagagggggatttccgctctaacctgcaccgcggcggcatggccacggtggcgcagattagcgacgaggagcgggccattgccatcaaggcaacgcaaactctcgggctggacgccgccggtgtcgatattttacgcgccgcccgcgggccgctggtgatggaggtgaatgcctcgccggggctggaaggggtggaaaccaccaccggcgtggatgtcgccggcaagatgatcgcctggatcgagcgccaggcgacgccggaattctgtttgaaaataggcggctaaccgccggatgcaagacggccatggtatgcggcgctttttttgcgtaagctatggcgtcgtttttccactgtaagaggtcacaggcactatggattcactggtcgttccaggtctggatacgctacgtcgctggctggacgaaatcggcatcagcttttttgagtgcgattcctgtcaggcattgcacctgccgcatatgcagaatttcgacggtatttttgatgccaaaattgacctggtggacaacgtggtgctcttttccgccctggcggaggtgaagccgtctgccctgctggcgctgtcggcggatctctcggccatcaacgccagctcgttaaccgtgaaggcgtttatcgacattcaggacgataatttgcccaagctggtggtttgccagtcgctgtctatcggcccaggggtgaccatggagcagttcgcctggttcttccgccaaagcgaagagcagatctcgatggtaatcctcgaagccggcgcaaatcagctgctgtacaaaggcgaagaagaagagcctgcggcggaaaacgtgcaataccattttcttcactaaacctgcctaaaattagcgcagccactaccgcagcggctgcgtattacccgcttttattctgcatttaacctttctttaaagcattattcaccgccattcaggccgttttggcttatcacgtagaccgttattgcataaaaatttgataaaaggcgtttttttacctgggctatagcctcttattctggctacagttattctggcgatgcttccagttgcgagcaaccactccgggagagatccgctctccttttctcaggcaatgaaaaaatatgcatgatttttgcatgcgtagaaatgcgtatatttgagcccgtaagttaacgggcgttgagaaggaaaagagatatgaccgcctttggtaaaaaatggttaacaggtctggttacgggtgcgctgatggccgtctctgccggttcgctcgccgccgaacaaaaaaccctgcatgtttataactggtctgattatatcgcgccggacacggtagcgaatttcgaaaaagagaccgggattaaagtggtgtatgacgtttttgattccaacgaagtgctggaaggcaaattaatggcgggtagcaccggtttcgacctggtggtgccgtcggcaagcttcctcgaacgccagctggcggcgggcgtgttccagccgctggataaaagtaagctgcccaactggaagaaccttgaccccgaagtgctgaagctggtcgccaagcatgacccggagaataaatacgccatgccttacctgtgggcgacgacgggcattggctacaacgtggataaggtgaaagccgttctcggcaaagatgcgccggtggacagctgggatctggtgctgaagccggagaacctcgaaaaactgaaaagctgcggcgtctccttcctcgacgcgccggaagagattttcgccaccgtgctgaactacctcggcaaagatccgaacagcagcaaagcggatgattacaccggcccggcgaccgatctgctgctgaagctgcggccgaacattcgctacttccacccttcgcaatatattaacgaccttgccaatggcgacatctgcgtggcgatcggctgggcaggggacgtctggcaggcggccaaccgcgcgaaagaggcgaagaacggcgtcaatgtctcctactttattccgaaggaaggcgcgctggcgttctttgacgtctttgccatgccggccgacgcgaagaataaagatgaagcctatcagttccttaactatctgatgcgtccggacgtcatcgccaaaatcagcgaccaggtgttctacgccaacggcaacaaggcttccacgccgctggtcagcgagactatccgtaacaacccggcgatttatccgccagcggatgtgttcgccaaactgttcacgctgaaggtgcaggatccgaagatagaccgcgtgcgcacccgcgcgtggaccaaagtgaagagcggcaaataattcctgacggcccgtcgaatacgggccaaatcagatctgcactcgccgggaaatagcagcgcgcccggcgagcagaagcaccaggatggtgcaaatgcactgttaagcacgaagtatggcaccggaccatatggtgatcgtttttttgccggagagcacccgattgaacgacgtaatgccccgcccacaggcgaaagcccccaaagcgctgaccccgctactggaaatccgtaacttaaccaagtcgtttgatggccagcatgcggtcgacgacgtcagtctcactatctacaaaggcgaaatttttgctctgctgggcgcgtcaggctgcgggaaatcgacgctgctacgcatgctggcgggctttgaacaaccgaccgccgggcagattatgctcgacggcgtggatctggcgcgcgtgccgccctatcagcggcctattaatatgatgttccagtcctatgccctgtttccccatatgaccgttgagcagaatattgccttcggcctgaagcaggaccgcctgcctaaggcggaaatcaccgcccgggtgcaggagatgctggccctggtacatatgcaggagtttgccaaacgtaagccgcaccaactctcaggcggccagcggcagcgcgtcgcgttggcgcgcagcctggcgaaacggcccaagctgctgctgcttgatgaaccgatgggggcgctggataaaaagctgcgcgatcgcatgcagctcgaggtggtggatattcttgagcgcgttggcgtgacctgcgtgatggtgacccacgatcaggaagaggcgatgaccatggcgggccgtatcgccatcatgaatcgcggcaagtttgtgcagattggcgaaccggaagagatttacgagcaccctaccacccgctacagcgccgagtttatcggctcggtgaacgtctttgaagggctggtgaaggagcgtctggaagacggtctggtgctaagctcgccgggactgatgcatccgctgaaggtcgaccccgacgcctcggtggtggacaacgtgccggtctgggtggcgctgcgtccggagaagatcatgctgtgcgatgaaccgccggcggacggctacaattttgccgtcggcgaggtgattcatatcgcctatctgggggatctctctatctatcatgtgcgcctgcaaagcgggcagatgatcagcgcccagctgcagaatgaacaccgccatcggaaagggacgcccacctggggcgatgaggtgcgtttatgctgggatgctgacagctgcgttgtgctgacggtgtgaggagagggcgatgaataccgttgaatccccgtcaggggcgaaaaaaccgggcggcttcgcgctgtgggcggcgcgcctgcagatggcgcatggccgcaagctggtgattgcgctgccctatctgtggctgatcctgttgtttatgctaccgttcctgatcgtgttcaagataagtcttgccgagatggcgcgggcgatccctccctacaccgagctgatggagtgggcggacggccagctgacgctgacgcttaactttgccaacttcctacagttgactgacgatccgctctattttgaagcttatctccagtcgctgcaggtggcgggtatctcgacgatctgctgcctgctgctgggctatccgctggcctgggcggtggcgcacagcaagccgtcgacgcgtaatattctgctgctgttggtgatcctcccgtcgtggacctcgtttttgatccgcgtctatgcctggatggggctgctgaagagcaacggggtgttgaataacttcctgctgtggttaggggttatcgatcagccgctggagatcctgcacaccaacctggcggtgtacatcggtatcgtgtatgcctatctgccgtttatggtgctgcctatctacaccgcgctgacccgcatcgactattcgctggtggaggcctcgctggatctcggcgcccggccgctgaagaccttcttccaggtgatcgtcccgctcaccaaaggcggcattatcgccggctccatgctggtgtttatcccggcggtcggcgagttcgtgatcccggaactgctgggcgggccggacagcatcatgattggccgcgtgctgtggcaggagttctttaacaaccgcgactggccggtcgcctcggcggtggcgattgtcatgctgctgttgctgatcgtgccgatcatgtggttccacaagcaccagcaaaaacagatgggagagcagggatgaacgacttgccggtagtacgctcgccgtggcgcattctgatcctcgtgctcgggttcaccttcctctacgccccgatgctgatgctggtgatctactcgttcaacagctcgaagctggtaacggtctgggccggatggtcgacgcgctggtatagcgaactgttccacgatgatgcgatgatgagcgcggtaggattgagcctgaccatcgccgcctgcgcggcgacggcggcggcgatcctcggtaccatcgccgcggtggtgatggtgcgctttgggcgttttcgcggctccaacggcttcgcgtttatgatcaccgcgccgctggtcatgccggacgtgatcaccggtctctcgctgctgctgctgttcgtggcgctgggacatgccatcggctggccgtcggaccgcggcatgttgaccatctggctggcgcatgtcaccttctgtaccgcctacgtggcggtggtgatctcctcgcgcctgcgcgagctggaccactccattgaagaggcggcgatggatcttggcgccgcgccgctgaaggtcttcttcgtcatcacgctgccgatgattatgccggcggtgatctccggctggctgctggccttcacgctgtcgctggatgacctggtgatcgccagctttgtctccggtcccggggccacgaccttgccgatgctggtcttctccagcgtgcgcatgggggtcaacccggagatcaacgccctggcgacgctcatcctcggcgtggtcggtattgttggttttatcgcctggtatttgatggcccgcgcagaaaagcagcgagtgcgcgatatccagcgtgcaagacaaggctgaaccacctaaaatcggtacagcagcctccggtcggcgccaccctgtggcgccgttttcatggaagacattacgttgggattgtttacgaaaactcgctcatcgcatgcccgccttaacgtccctgcgctggtgcaggtggcggcctttgctattattttgattcgtggcctggatctgctgatgatccttaatctgttgggcctgcaggggctgaacgaattcatacaccgcagcgttcagacctggaacctgacgctggtcttcctcggcagcctggcgctggtgtttatcgaaatctggtgcgccttctcgctggtgaaagggcgcaactgggcgcgctggatctatctgctgacgcagattatcgctgccggctacctgtgggcggcgtcgctgggctacgggtatccggagctgttcagcattcccggggaatcaaaacgagaaattttccactcgctggtgatgcaaaaactgccggatctgctggttctgacgctgctgttcgtgccggcgaactgccgtcgctttttccgcctgcaataacggtgatacaatccccgcccctggatttttgaaggtcaattatgcattgcgcactctacgacgccggccgctgccgctcctgtcaatggctggagcggccggtcccgcaacagctcgccgataaaatggccgatctgcgcacgctgctggcggcgatcccggtcgcagcctggggcgagccggtcagcgggccggaggcggctttccgtaacaaggctaaaatggtggtcagcggcagcgttgagcgtccgctgctggggatgctgcaccgcgatggcactccggtggacctcaccgactgcccgctctatcccgccgagtttgccccggtttttgctaccctgaagccctttatcgcccgcgccgggttaacaccttacaacgtcgcgcgcaaacgcggggagctgaaatacctgctgctgaccgccagccagcagggggagatgatgctgcgcttcgtgctgcgctcagaggccaaggtggctcagctgcgcgccgcgctgccgtggctacaggcacagctgccgcagctcagcgtgatcacggcgaatatccagccggtgcatatggcaatcatggaaggtgagcaggagatcttcttcaccgaacagcaggcgctgggggaggtctttaatggggtgccgctgtggatccgcccgcaaagcttctttcagaccaatccggcggtagccagccggctgtacgccacggcccgcgactgggtgcgcgcgctgccggtccagcatatgtgggatctgttttgcggcgttgggggatttggcctgcactgcgcgacgccgacgatgcgcctgaccggtatcgagatcgccccggaagccatcgcctgcgccagacagtcagccgcgcagctggggctcagcaatctgcattttcaggcgctggactccacgcagttcgccactcacgaagcggatgccccgcagctggtgctggttaacccgccgcgccgcggtattggcgctgaactatgcgactatttaagccgcatggcgccgccctatattatctattccagctgtaacgcccgcaccatggcgaccgatatcgctcgtcttagcggctatcgcgttgagcgggtccagctgtttgatatgttccctcacaccgcccactacgaagtgctgaccctgctggtccgcgaagtttaaacaaaatgtgaaggctttgcgccgctgaaatcgggtaagcttgaggcagcatgttttgttattggtggggggaatctaatggccaaaaccattctgctggtggaagatgacgaggatatagccacgctgctgcggctcaatcttcaggatgagggctatcagatcgtccatgaagccgacggcggccaggccctcgcccggctggagacgcaggtctgggatgcggtgatcctcgatttgatgctgcccggcgtcgatggtctggagatctgccggcgtatccgccagatgacccgctacctgccggtgattatcatcagcgctcgcaccagtgaaatgcaccgcgtgctgggcctggagatgggcgccgacgactatctggcgaagcccttttcactgctggagcttatcgcccgcgtcaaagcgctgtttcgtcgccaggaggcgatggggcagaatctgctgatggacgccgggcgcctgtcctgccatggcctgagcatcgacccgctgtcgcgcgaagtgaagctgcgcggcgagacggtggacctcacgccgcgtgaattcgacctgctgtattacttcgcccgccaccccggggaagtgttttcccgcctggcgctgctggagcaggtctggggatatcagcacgagggctatgagcataccgtcaatacccatatcaaccgcctgcgcagtaaaatcgaacgtgacccggccgagccggacatcattcttaccgtctggggaaaaggctataagttcgccccggtgacgcaagaggccgtcccgtgatccgccgcctgagcctcagccagcggctggcgctggtggtggtttccctgctgatgctatgcgcggtggcggtatgcgccgtccagttacacagcagcgcgcagtatggcaacgccatggtgcagcgtctgtcgtccgggctggctcaacagattgtcgcccgcgagccgttgctggacgcccacggcgaggtcaaccggcaaaccctgaagtcgctgtttgaccgactgatgacctttaatcccagcgtggagctctatctgctgtcgccggatggcgatctgctggccgatgcggcgccgccgggccatatccagcgccagcgtatcgacatggcgccggtgcaggcttttctcaccggcagtgcgtcgccggtgtatggcgacgatccgcgcagtcccgacggacgaaaagtcttcagcgccgccccgctgcgcgtcgacggccaactgcgcggctacctgtatatcattttgcagggggagacgtttaatcagctggcggccgacgcctggcaaaaaacgctgtggagcattgttctgtggacgctgctgctggtggccctgtttggcctgctggcaggggggctggcatggttctgggtcacccggccggtccgcctgctcaccgcccaggtggcggcgagcggccaggacagcatcagcgccatcaaaaccctggcggcccgcaggccggagccccggcctggtaacgaggtggcggtgctcgagaaccgctttattgaccttgcccggcagattgccgatcagtgggatcggctggccgacagcgatcgccagcgccgtgaatttgtggccaatatctctcacgatttgcgcacgccgctgacttcgctgctggggtatctggaaacgctgaccctgaaggatgaatggctgaccgccgaggagcgcaggcagtatctcaccatcgccctgcgccaggggaacaaagtgcgccatctctcgcagcagctgtttgagctggcgcgactggagcatggaggcattaagccgcagcgcgagcgtttcgcgatgggggagctgatttccgacgtggcgcagaagtttgaattaactgcccgcacgcgcgaggtgaacctgcatattgatgtaccgggaccgctgccgctgattaacgccgatgtgtcgatgattgagagggtggtgaccaacctgcttgataacgcgatgcggcatactcccgtcggcggggagatccgtctggcggtctggcaggagaatcaacagcttcaggtcgaagtggcagacaacggagcgggcgtcgatgccgcgctgcgcgacgatctgttccagcggccgtcggcgttgtctacccaggcatcgcgggaggagcgcggcgggttagggttgctgattgtgaaacgaatgctggagctgcacgggggcgatatcagactggtggagtcggtaagcggggcgcggttcaggttcttcgtgccactttgagaaatcgccgggtgacggctacgccttacccggccatcgtggaagagcggtggccgggtaagcgcagcgccacccggcgaaaaaagttactccgggaaccactggttgctaattttctggtaggtaccgtcggccttaatcgctttcagcgcggcgttcagtttctccagcagcgccttgttatccgggcgcacggcaatgccgagtccggtgccgaagtattgcgggtcggtcactttcggcgtggctgcccccagctgcgggttagttttcagccattcgttgaccaccgcggtgtcgccgaacacgccgtcgatacggccatttttcaaatcgataatcgcattctggtagctgtcataggcgacggtcttcacctcaggatgcttatcctgcagatatttctggtgggtggtgccgttttccatgccgatccgtttgcctttcaggtcatcgaaagaatggaacgcatcttttttggcgatcaccagcgccgagttggcgtagtacgggtcggtgaaggccacctgcttgctccgctccggcgtaatatccattccggaaatcaccgcatcatatttcttgaacttcagcgccgggatcaggctgtcaaacgcgtggttggtaaaggtacattctgcctgcatttgtttgcacagcgcgtgggccagatcgatatcaaagccgacaatctggttatttgcgtccatcgattcaaacggcggataggttgcggagacgccaaagctgattttttccgcggcagcggcgccgaacgcgaaagaggtgagcagtgcagccagaactaactttttcatcgtggaactcccgtctgtctatcttatgattattcaccgtgtctgcggcatagagtgacaatgccatgaaatgaatttatatgcaattaaaatgattaagtatttctatcgtcataaaaaaagacggacaggtgtttgacttgtccgccttgctgtttgctttttatgcaatatgctcaggtgctagctacgtcgctcgaaggccagcgctttgcgttccaccaggcgcatcagcagcgtcagcagtccattaacgatgagatagataatcccggcggcgccgaacaccatcacgtcgtaggtgcgtccatacagcagctggccgtggcccatcacttccatcagcgtgatggtgtaggccagagaggtactcttgaaaaccagcaccacttcgttggaataggacgatagcgcacgcttaaaggcgtacggcagcaggatcgccagtgtatcctttttattcatccccagcgcgctgcaggactgccattgcccgtcggggatcgcccggatggcgccataaaacagctgagtggtgtaggcggcgctgttgagcgacagagcgatcagggcgcacagccacggctcggagataagatgccacagccacggatactcctgcagcgaagggaactgtcccgggccgtagtagatcaggaagatctgcaccagcagcggcgtaccggtaaacaaggtgatatagccgcgcactatccataccagccccggcgtcttcagggtcaggataatggtgaagatcagcgacaggatcagcgccacgataatcgacgccacggtcagcgtcaggctggtatgcagtcctttcagcagttcgggtaaatagtcgagcatcagcctggtctccgttcgaagcgcgtcgcacgctggtcaatccgcttaaggatgtattgactcaacagggtgatgacgagatagattgccgccgcaatgatataccagttaaagggttcctgagtgcgggtggcgatgcttttggtctgcagcattagatcgttgacgctgatcaggctcaccagcgcggtgtccttcagcagcaccagccactggttaccgaggccgggcagggcatggcgccacatctgcggcatcaccagacggaagaatatggccgctttcgacagccccagcgcctggccggactcccactggccctgcggaaccgctttcagcgcgccgcgcagcgtttgcgaggcgtaagcggcatacagcagcgacagggcgatcgccccgcagaggaatgggctgacgtcaaagttctcaatttgcatctgcaccgggatctgcgtgaacccgagcgggatggtgaaaccgtcagagagcgtcagcagcagctgggaagagccgaaatagataaacagcaccaccagaatttccggtagcccgcgcaggatggtcactatgccggttgcaagccaggctaccgggcgccatttcactgactccagtaccgcaaagagcatcgccaggaccaggccgatgacgagcgcgcaaacggcaaggccgacggtcatcccggcggcgcttgctaatggaaaaatttcgttcattcagtcttacttctggaaccatttgttatagatggtctggtaagtgccgtctttcttcactttttccagcgcagcgttaaatttctgctgcaggtcggtgttgccctgacgtacggcaatgcccagcccggtgccgaaataggctttgtcggtcactttatcgcccacggccgccagcttcggattgctcttcagccattcggtcaccacggcggtgtcaccaaagaccgcgtcgatacgaccgttctgcaggtccagcttcgcattctggtagctgtcgtaaggcacggtagtgatttccggatgtttatcggtgatgaatttctggtgggtggtgccgttctgcacgcccacttttttgcccttcagctgctcaatgctggtgaacttaccctgctggccgacgaacagcgccgagttgtcataatacggggtagagaacagcacctgcttttcacgctccggcgtgatgtccatcccggccatgaccgcgtcgaaacggcggaatttcagtcccgggatcaggctgtcaaaggcctggttggtgaaggtacaggtggcgtcgatctctttacacaacgcgttcgccagatcgacatcgaaaccgacgatctggttgttggcgtccaccagctcaaacggaggataagaggcctcggtggcgaaacgaatggtctgcgcggcggaagcggagaggctcatgcctgcgagcagggcggcaatcaatacttttttcatcgtcatttccccgaaaaacatcaatgtgaaagatagtttttaaacgcgtcagtttgcggatgcgtgaagcaggaggcatccccttgctcgacgatatggccattttccatatacaccacccggctggccgtcttgcgcgccacttcaacttcgtgggtgacgataacctgggtaatgccggtttcagccagctcgcggatgatgctgacgatctgagccgtgatttccgggtcgagcgccgcggtaggctcatcgaacagcagaacctgcggctccatcatcagcgcgcgggcgatagccacccgctgctgctggccgccggataaatgcagcgggtaacgatcgctgtacggcttcagacgcaggcgctccagcagcttctctgcgcgagccagcgcctgatccttgcttaaccccagtacgcggcagggggcctcgatcaggttctgctgtaccgtcaggtgcggccacaggttgtattgctgaaagaccatgccgacgttctgacgcagctcgcgaatcgctttatcggacggcgctctggtgaagtcgaattggttaccggcgatggataacgaaccggaccgcggcatctccagcaggttgagtacgcgcagcagcgagctcttcccggcaccgctggggccgagcagcaccagcgtttccccctgcgggcaatccagcgtgatgtcgaacagcgcctggtgtgcgccgtagaagcaattaatgccgtttagtttaatactcatctgggcagtctgatacgaatagctattgaggccgcaaatactacctttggcagaatagttatgcaatatttatgcgttaaaagttaaatctaaaccacgtttagctttaaagttagcacaaaatatggcctggtgggtgaggggggcgcaaatgtcggcattcctggggcgaataccgacattttaccggggttatcgtttcagcggcgtcgcttcaactccggaatcagcgtttctccagactctgtcgcagcgtcccggctggcgcatggctgttgttgccgagatagcgaacgtcatcgacggcccagcactggccttcctggatcatcagcacttcatctttccagctctgggtgccctgtttcagatcgacgcgcagcggaatattgcgcgcatcgcggttcgggatggtggaggcgctggcgaccacggcgctgtctgccggggtgctgctgctggagaacggattagcctgcagtaatttgctgttggcgggatcctggcgggcgtcattgagtaactgcgccaggccgtcgctcagataggggcgcagcgccgccggatcctgagtacgattctggatctgggtgtcgtagaatttttgcgctacgtcgtcagggccgccttcgacgcaggggccgctgcgggtgccattatctttataggccggggtgacggtcgtacaggcgctgagcgccagcgcgcaagggagaagtacagcaaaaagtttgtagcgcatgatgatttccttataagcgaactacgttttcagtttccgttaaagcatagcgtatagcgtgcggattgtacttgacgcaaagagctaagaccttgatgtggctacagccttagggcgggaaatcggcacggggatgacagaattccgtcaggcgctaaaaggcagggtagtataaaaataaacttaattttcccgtgaacaagaaatattatcccgtaaaatagggaaatggctcttgaaagataagggtaattatttcttcttatagatgcgagtggcgacgtgcatttttttatccgtattaccggaggaggggacaatgacgccccccttgttcatttgtttttttaatcagctcttcacgggcatcgttggatgcggtttgaccagtagaggaaatggcgccgattttggtatattgcgtatggactttatcaaaagctgttttgttaaaatctctgcggagacggcattggccgcttaaaacaatgctgtacctgccactaaagctgcatatttaatattcttagcccctattgtttatctcgctatcatcatgctcttctttgcattcaccaatgaatgatttcagattgaactcacactgctttttgtaagcaaaatgctgcaatttaatgacggttagttaacgctttttagcgaaaagatgacgtaattcgcagtgctgatgcttgttttttgagccggttacccatcgggagcggaccaggctattttcttcggtcgttagctgaaaatcaccctgagaggccggagctgaggggatagggcgctgacagacattcccggtaacatggtttatcatatagaaaagcaggggctgcgcccatggtcatgcaggtcaccagagagttaagatgttaacaaataagcgagagcgcgcccggcagcagcgagccgcgttgtgggccaccagagataatgtccagcgccatgcgctgtccatgagtatgccctggctggcctttgtcaatatcgcttttgcgttaatgattttcttccgcaatttgatctttacttattttgataagaggctactgacgcaccgggcggttattccttatatcgaagcggcgttgattgcggttattatcatttcggccattttagtgattattgccctcacgccgcgactggcgcagggacgatatacgttgaatatcatcaccgggctgctgctggcgctcagtctgtgctggtccctgagtaattattgttttatttttttctggaccttgccctttgcctggccgctgctggtgatattaatgactaccggcctcaccgcgctgtatcaccattggcccggcataaccgcttttatgctgccgctgtgggtgaccgccttgctggcgggaatacagctccactatcacaccgagatccgctttttgatcctctgggccatttttaccgcgattttgctgtatggccgacgtattttgcagcgctggtatgacgaagcctgggatacccaccaggagaatatgcagcttattcagcggctggaaagtatcgccaaccaggatgccttaaccggaaccgctaaccgtcgggcgctcaatgcttacctggcggcgatctggcagcaaaaaacgccgctggcgctgatgatgatcgatgtcgattattttaagcgctataacgatcgctatggccatcaggctggtgatgagtgcttatcttctgtcgcgcaggtgcttaaaatggcggtccgggcggagggcgatctggtggctcgctacggcggcgaagagtttgtcgtcgtgttgcccggggtgtccttagcgcatgccaccgctattgccgagcgcattcagcagaagatccgcgaggcaggcctaccgcacgccgcttcggcggtggcgtcggaggtcaccgtgagtatcgggatcgtcgcctccgatggcacggtcccgatagagacgctgatcgcccgggcggacagtgcgctgtatcaggcgaaaaataaaggacgtaatcaatggtcttattaacccggagacgctgccgggcaagggagaagggatgaaacggatgatgcggatcgtgctgctggcgctgctgctgaccggctgcgctggggaaaagggcattatcgatcgcgacggataccagctggacacccgtcatccggcgcaggctgcctatccgcgaataaaggtgttagtgatccactatacggctgacaattttgatgtctcgctggccacgttgaccgataaagaggtcagctcccactatttaattcctgaacagcccccgcgttatcagcataaaccgcggatctggcagctggtgccggaagaggatttagcctggcacgccggggtaagctactggcgcggcagtacgcgcattaacgatacctccattggcattgagctggagaaccgcggctggcagaagacggcgggcgtcaaaagttttaccccctttcatccggaacagattgcggctctgatcccgctggcgcgcgatatcatcgcccgctaccacatcgcgccgcagaatgtggtcgcccatgcggatatcgccccgcagcgcaaagacgatccggggccgttattcccctggcaacagctggcgcagcaggggatcggcgcctggcctgacgagcagcgggtggccttttatctgaacgggcggccggccagcgagccagtggaccccgaaatcgtactggatttgctctcgcgctatggctatcaggtgacgccggagatgacccccgcgcagaagaagcgggtgattatcgccttccagatgcacttccgtccgcagcgctgggatggggtagcggatgcgcaaaccgaagcgatagccgaggcgctgttagaaaaatatggccagggttagcggtgtagtttaccgtggtcgcgaagccaggcggcggtgcgcacgatgccctcgtcaagcgtcaccaccggctgatagcccagctcgtcctgcgcgcgggtgatatcgagcgtaaaatcaaagttaagcttggagacgccgtagtgggtaaacgcgggttctttggcggttttatcgccaaagcgctccatgctgcgggcgataatatccagcatcggatagggaactgagcggatccggcatttgataccgagctcgtcgatcaatttctgcacgatgctccgcaaggtgcgcggttcgccgttgctgatattccacgcgcgggcggagggaagatgatcgcaggccggctggctcgccagccacatcgcatgtacggcgttttcataataggtcatgtcgaccagcgcgctgccgccgcgcgggagcaggacgctgccataatgctgcatcatttgcgccagccgggggataaagactttgtcgtgcggcccaaacaggctctgcggccgcagaatggtaaaacgggtatgcgggttagcctgcgccagcaggttgatcacctcctcgctggccgccttgctgcgggcaaactcgttggcgaagcggtgtggacggaaatcttcctggatatcacgatgatggtgataatcaaaatagagcgatggcgaagagatatggacgaaattgcgcactccccatgccactgaccattcgcccagacgacgggtggcgcggacgttagcgagatcgaaagcctgctgagtgccccatggcgaggtaaagctggagcagtgccatagggtatcgataccggcgagcatcactttagcctgcgaagagaccagctcggttaaatctgccgggatgaattccgcccccattttgctcagaagcttgcccatcgcttcgttgcgcccggtcgctcgcacgctgatgcccttgttgcgcagatattccactgcgttgcggcctaatccgctggtcgcaccggtaaccagtaccttcatatcactctactgtcccagaaaagaatttcgtgcgcatttttccgtgattctcccgactatgcaatgagaatcatgaaagaataacgcttatccttcgactctgcctgagatttgttcggccagccgggcgatgcgttgcgccataccgcggaaaataaacaggtgcgccgggatcatcagcagccagtagatcaggcctggcataccgtgcgggtgccaccaggcgcgcacgtccagttcacgacgatcgcctttatcgttaatggtaaagcttaatcggcccagcccgggcgctttcataccgaatagcagggtgagctgtttttcttcctccacgataattaccttccagctgtcgaccgtatcgccggtttgcagataagcgcgctgcggccgccctttggccagccggtggccgaccagcagatccatcgcgccgcgggttttccacagcagattgccgaaaaaatacccctcttcaccgccgatttggttaacgacctgccacagggcctggcggcttgcctgagtggcgacggtgcaacctgcctgcttcggatagtagccgtactctggtcgccagcgggcgaaagcctgagcgtcgtagccccagtcgctggagtttactaactgctcttcttctttcagcgtgcggcgaaccgcctgatcgaaggggatcagcgtttgcgggatcagcgcccgcagcgcccgatcgtcagcgattagatcgtgcttcagcccctgaatcagcgccttggcgatggtcggcggcaccgaggtgatgacattgaggaaccacaccgagatccagcgcgtcggcaggggaatgggaatgagcgggcgatgtttaccgctgacggccataaagcgaatgaactgctgctgatagcttaacacctccggaccggcggcttcgaagacgcggtgcgcatcggagggatgattcagcagctcaaccaggtcaacgagcaggttttccagcgcgacaggggtagtacgcgaacgtacccagcgcggaggggttagcaccggcaggttataaaccatgtcgcgcatcacctcgaaggcggcggagccggcgccgacgataatcccggcccgcagctcggtcaccggcacgcccgactcacgcaggagatcgccggtaatctgacgagcgcgcagatggtcggactgctcctgcgccggggcctgcagcgaactgagaaatatcacctggcgcactgatgactgacgcagggcatcgcgcacatacgtcgccccccgccgctcatgggcgataaaatcaccgccttcgcccatgccgtggaccagataataaagggtatcgataccggtgagtagcgcaggcaggtcctgcggctgattgagatcgactgaccggcaggtaacgccgggcaaagcgagtttttgcaatcggtcgatatggcgtgccgccgccagcaccggatagccccgcgcgcttaatgtgcgcactaaatgctggccaatatagccgctggcgccgagcaccagaactgattgcgacacgcctgactccttagcgttgtaaaaaagcctgccagtgggcgaccacctcgctcagctgctgacggttgacatccaggtgagtgaccagacggacaacaggcgaggcgttaatcaataccccctgcgcctgcataaacttgccgagcgccggggcctgctcttcgccgacgcgaacgaacagcatgttggtatcgtgacgggtgacgtcggcgccgatagcgcgcagctgctccgccatccacgcggcgttgtcatgatcctcctgcaggcgctgcacgttatttttcagcgcgtacagcccggcggcggccaggatgcccgcctggcgcatcccgccgccgaccattttccgccagcggacggcgcggcgaatgtacgcctcgctgccgagcagcagcgagcctaccggagcgccaagcccctttgacaggcagatggtcaaggagtcgcagtattgggcgatatcgcgtaactcgcagccgtaggccaccacggcgttaaagatgcgcgcgccgtcgacgtgcagcgccagattgcgctggcgggtaaacgcccaggcttcctgcagatagtcgcgcggcagcaccttaccgttatgggtgttttccaggctcagcaggcgggtgggggcaaaatggatatcgtcgggtttgattttcgccgccactttatccagaggcagcgaaccatccgccgcggcgtcgatcggctgcggctgaatactgccgaggaccgccgcgccgccggcttcgtacagatagttatgcgccccctggccgacgatatactcttcgccgcgctggcaatggctgagcaggccaacgaggttggcctgggtgccggtgggtagaaatagcgccgcttctttgccggccaggtcggcggcatagcgctgcagttcattgacggtagggtcgtcgccatacacatcgtccccgaccggggcggccatcatggcctccagcatggcgcgcccgggacgggtaacggtatcactgcgtaaatcgatcacggcttttccttggtctggttcaacgtattgcttctgttttacctgagccagttggttttcgccagttcgatgacctcatcgccgcgcccgctgatgatcgcccgcagcatatacaggctaaagcctttggcctgctccagcttgatctgcggcgggatcgccagttcctctttggcgacgacgacgtcgaccagcaccggaccgtcggtgcggaaggcggtctgcagcgcttcatccccctcggaggctttttcaacgcgtatacctttgatgccgcaggcctcggcgatgcgggcgaagttggtatcgtggagctccgtaccgtcggtgagatagcccccggccttcatttccatcgccacgaagcccagcacgctgttgttaaagatgacaatcttcaccggcagcttcatctgcgccagcgacagaaaatcgcccatcagcatgctgaacccgccgtcgccgcacatggccactacctgccgctccggcgcagtggccttggcgccgatggcctgcggcatggcgttggccattgagccgtggttgaacgagcccagcaggcggcgtttaccattcattttgagatagcgtgccgcccagacggtcggggtgccgacatcgcaggtgaaaatggcatcttcatcggcaaaatgactgatctgctgcgccagatattgcgggtgaatggctttatcgctgggtttagccagatcgtcgagcccttttcgcgcgtcgcgatagtgctccagcgccttatcgaggaagtggcgatcggttttctcttccagcagcggcagcagcgccttcagcgtcgatttaatatcgcccaccagcgccatgtcgaccttactgtgtgcgccgatgctgccggggttgatgtcgatctggataattttcgcgtcggttgggtagaaggcgcgataggggaactgggtgcccagcaggatcagggtatcggcgttcatcatggtgtggaagccagaagagaagccaatcagcccggtcatgcccacatcgtacgggttgtcgtactccacgtgctctttgccgcgcagggcgtggacgatgggggctttaattttggctgcgaactccaccagttcctggtgggcgccggcgcaaccgctgccgcacatgagcgcgatattgctggagtagcgaataagctgcgccagcttgcgcagctcttcttccgccggggtgaccgtcggcagcggcgcatgataccagtggctgctggcgctttccggggcggccttcagcgccacatcgccgggtagcaccaccaccgagacgccgcggttaatcactgccttacgcatcgccactgccagcacctgcgggatctgctccggcgtggagaccagttcgcagtaatggctgcactcgcggaacagctcctgaggatgggtttcctgaaaatagccgctgccgatttcgctggatgggatgtgggcggcgatggccagcaccgggacatggttgcgatgacaatcaaacaaaccgttaatcaggtgcaggttgcccggtccgcaggagccggcgcagaccgccagctcgccggtcagctgcgcttccgcgccagcggcgaaagcggcgacctcttcgtgccgggtgggcatccagtcgatggtgcccatgcggttaaggctatcgctcaatccattgagggaatctccggtgacgccccagatacgtttcacgccggcctgttccagcgttttggcaatgtatgccgccacggtctgcttcatgatctccatctcctttttttgataacgccttcaagcttagatgaaactgaccgcaatgtaaccgattacccctgattttttgctggttttattcctctccggctgcgcatactcaggaagtacacaggatgcaaaacaggatgcacatcaaatggttaaaggattgttaaacacagtaaatcgcaggctgtcgcatgatgacgccggtaaactcttgttacgacttgccgtcggcggcttaatgcttttccatggaatccataagctgatagatggtgtggatggcattagcgggatgctggcggcgcagggattgcccgggtttatcgcctacggtgtgctggtgggggaagtggtcgctccctgcttgttaattatcggcgtcctgacccgcccggcggcgttggtgctggcgttcaccatggtggtggcgtggctgatggtcggcttagataagacgtttgcgcttgatgcggtgggagcgtgggccattgagaatctggtctatttctttgttggcgcactggcgattgcgctactcggcgcggggcgttattcgctggccggtcagtcggcctggcggtaaaaatgcctcattcgtcctggggcgtaaagtcgatactgttggcgatttgcaattttttcagtccgggaaagcgtttatctcatgtcgcctgagcgtttattgtcgccagggattttcccggaggcggcgcattgcgccttctccgggctaccaaatcgcacagcgctgtagccccggtaagcggtagcgccaccggggattttgacctcaggcgagaaccagatcgctctgcggatgacaggagcaggccagcacatagccgtcggcgatttcggcgtcggtcagcgtcatggtgctggtgacgctgtacttcccggaaaccactttggttttgcagcagccgcagacgccggcgcggcaggcgacggtcaccggcactttattgctctccagcgcgtcgagcagcgtggtgcccaccggcgcgtaaaactcgcgcgccggctgcagtttagtaaatttcagcccgctggtggcggcctcagccaccggggtgaagaatttttccttaaagaagcgggtgacgcccagggcggcaacatcctgctcgaccttctccatataaggcgccgggccgcaggtcatcacggtgcggctggctaaatccggcacgctctgcagcagctcccgggtcagacggccggcgacaaaatcgtgcgtcgcattgtgctccgctaccagggtgaccgggtagttgcgccactcttcggcaaagattacatcttccggcgaacgcacgttataaatcacctgtacgtcggcctgcggtcgatacttagccagccagcggcgcatcgccatgatcggtgtcacgccgcaaccggcggccagcagcaggaatttatcttccgctttatcgtcgcaggtaaactcgcccatcgcatcggacagccaaaggtaatcgccgcgtttgacctcgcgggtcaaccactgcgaacccgtaccctcgtcaatacggcgaacggtcagcgtaatgtattcgctgacccccggcgtcgaggagagggtataggcgcgcagcgtttccgccgagttacgcacgctaaccagagcgtactggccagcgcggtacggatagtaatcgtggcacagcagcgaaagggtccacacgtccggggtttcctggtgaatgtggtgaacctgcatccgccacgggcactgggaggttggcatagtcatcagggactccttaagcgctcagcagctgctgcatatcttgttccacggtggtcacggaacgcagaccaaacttctcattgaggaccgccagcagatccggggtgaagaaaccaggcgccgtcggaccggtgacgatgtttttcacacccagcgacagcagcgtcagcaggatgacgatcgctttctgttcgaaccaggagagcaccagcgacagcggcagatcgttgatgccacagcctagtttctccgccagcgtgaccgccagaataatcgccgagtaagcgtcattacactgcccggcgtcgaccaggcgcggcagcccttcgatatcgccaaagtccagtttgttgaagcggtatttaccacaggccagggtcaggatcaggcagtcatccggcacgctggtggcgaaatcggtgaagtagttacgctccccgcgggcgccgtcgcagccgccgacgaggaagatatggcgcagtttttcacgactgaccagatcgatcagcgtatccgccgcgccaagcagggtctgacggccaaagccgacggtgatcagatgcgggatttcgctgtacgggaagcccgccatctgctgcgcctgggcaatgaccggggagaagtcttcgccttccagatggttcacacccggccagccgacgatgctgcgagtccagatgcggtcgtcgtaggcgccgacggtcgggtcgatgatgcagttagaggtcatcacgatggggcccgggaagcgggcgaactccacctgctggttttgccagccgctgccgtagttgccaatcagatgtttgaatttacgcagctccggatagccgtgagccggcagcatttcgccatgagtatagacgttgacgccggtgccttccgtctgctccagcaggttatacagatccttcagatcgtggccggagatcaggatgcacttcccttcggtggctttaacgttgacctgagtcggcgtcggatggccgtatttggtcgtttcaccggcgtcgaggatgctcatcactttgaagttcatctggccgatttccatcgaacattcgagcagcgcattcatatccgcaggccaggtgcccagccatgccatgattttatggtactgggcatagatagcgttgtcgtactggccgagcacgtgggcgtgctccatataggccgccgcacccttcagaccgtacaggcacagcaggcgcagacctagaatattctcgccgatggcggctttatctttattcggggtatagtccgccgcctgacgctgcaggtcgcccagatcgtcgctgaccagctgcaggtcggcgaccgggctgtcgaccgcggcgctggcatcgatcgccaggcattgcgctttcagcgcctcacgcagggcaattgcctggcgggcgtagccgacgatgcgcggggaatcgaagttaacgttagtcagggtggagaagaaggcgcggggggcaaagctgtcgacctgatgatcgataatgccatattcgcgcgctttaagcgcccaggcggacaggccttgcagtgacgcaatcagcagatcctgcaggtccgaggtttccgctgttttaccgcacatcccctgcgcgtaagagcagccgttgccggctggggtacgaatggtttgttcacattgcacacaaaacatggtcacacctttaaagttatatttgatatacatgtttaaggttatgccgcgcggcaacgggtgaaaaggtatttctaagacaacttaaagggagattgatttagcgcaaatttggcggcaggagggctgccgccaacgggtgctcaggcggtaaaaaaggcgatcaggatcgggaccagcaaactaagcagaaaaccgtgcacgatggcggcagggacgatttcgacgccgccggaacgctgcagtaccggtaaggtgaagtccatcgaggtggcgccgcacagccccagcgccgtggagcggctgcggcgaataaggcccggaattaacatgatggccagcagctcgcgacagagatcgttaaagaacgccgcgctaccgatgaccgggccaaaggattcggtgagtaaaataccggagagcgaataccagccgaaaccgctggccattgccagaccggtctttaacggcagaccgagaataaaggcgttaagtatcccgccgagtaatgaactggccgtaaccaccacggcgacgatcattccccggcggttaaggactatttgtcgcagactcattccattattgcgtaattggataccaacgaggaacaggagaaagatcaacgtatattcgctggcttctgtcgcgtgctgtaaaaaaggcagtctggtcagaccgagcagaaaaccgagcacgaccacaccgcacagctgcagcgattccagggccatggccaggcgcgagggtaatttctcctgacgatgctgactgcgccatggcattttactttccagccacagcagtgcggcgatattacacagtaaaatgataaccacgctcaccgcggcgtaatgcaatattgccagcaggttgctggccagattgtcgaggaacgccaggctgatacccataaaaaaaaggattacatagacaatccagctgagcatgcggtttatcagctttagcgcggaggagtgacgaagaggcagtaaatagccgacgaccagcggcaacagaataataaagagtcccgaaaacatgaacgatgcagcccttgcatgatgagaatagcgcccatgacactacccaaatcaccgggccgagtaaagctgtcgccagaaagaaaaagcccggagacccgggctttgaaaagcgttaatcgcgtttttccagcagggtgcgatacagcacgccgccgaggatcccgccgacgattggcatgacccagaacagccacagctgctgcagcgcccagccgccctggaaaattgccaccgcggtgctgcgcgccgggttgaccgaggtgttggtgactggaatgctgatcaaatggatgagggtcagcgccaggccgatggcgatgggggcaaagcccgccggcgcatgtttatcggtcgcgccatgaataaccagcaggaagccgcaggtcaggacaatttcaatgacgatagccgacagcatagagaagccgcccggggagtgttcgccatagccgttggaggcgaagccgctggcggcggcatcaaagccggctttaccgctggcaaccacgtacagcaccgccgcggcaataattccgccgaccacctgagcgataatatagccaatgacctcttttgccggaaaacggccgccggcccacaggcctaaggtgaccgccgggttgaaatgccccccggaaatatggccgaccgcaaacgccatggttaataccgttaagccaaatgccagcgcgacgccggcaaaaccaatacccagctcggggaaagccgcggcgagcacggcgctaccgcagccgccaaatacaagccagaaggtgccgaagcattcggctgctaattttctgaacataaccacctcaattaaattgtttacgcgcacgagcggaccgtgccggtctttatttatcgtgataagggatgacgataaaaataaagcggcgttattctagagataatcgccatcccggagccagttaaatatattgatattatttgatttagggcaaggtgagtggattccttttgccagtttagcctttcctttatccatggaagattatcaatagtgtagatcataacgcctgaaataaaactattttgtttgatgaataatcaacagccggtaataggcgataagtgagtaattttatgaatatatttaatccgctgaatatgagccacggatgcgattaagcagagtgtcatcttgcctccgccctcgctatactgttgattactgaaggagagtggtggtgtagcggaggggatatgcttcttgagcgcgtagaaatcgtcggttttcgcggtatcaatcgtttgtcgttgatgctggagcaaaataacgtcctgatcggggagaacgcgtgggggaagtccagtctgcttgatgcgctgaccctgcttttgtcgccggagttcgatctttatcactttgttcgcgatgatttctggtttcccccgggcgacatccaggggcgcgaacaccatttgcatattatcctgaccttccgcgaaacggagccaggccgccatcgggtccggcgtttccgtccgcttcagcgctgctgggtgccttgcgatgacgggtatcaccgggtgttctatcgcctggagggcgagctcgccgaagatgacagcgtgatgaccctgcggagctttatcgatggtgaaggcgaagcgttggtgctggaggagattgatgagctggcccgacacctggtgcgtttgatgccggtgctgcgcctgcgcgatgcgcgctttatgcgccgcatccataacgggacggtaccgcactcgccgcagatagagatcaccgcccgtcagctggattttctctcccgcgaactggtcagccatccgcaaaatttatcggacggtcagatccgtcaggggctatcggccatggtgcaactgcttgagcattactttgccgagcaaagcagcgctcagacgcggcatcgcctgatgcggcggcgctcccatgatgaacagcgcagttggcgttatctggatattatcaaccggatgatcgacaagcccggcgggcgcagccatcgggtgatcctgctggggctgtttgccacccttctgcaggcgaaagggacggtgcgcctcgatcgcgacgcgcgaccgctgctgttgattgaagatcccgagacccgtctgcatccgatcatgctttccgtcgcctggcacctgctgaatttgttgccgctgcagcgtgtgaccaccaccaactccggagagctgctgtccctgacgccggtagagcaggtctgccggctggtgcgtgagtcgacgcgggtatcggcgtggcggttggggccgggcggaatgaatgccgaagagagccggcgcattgcttttcacatccgcttcaatcgcgcctcatcgctcttcgcccgctgctggttgctggtggagggagagacggaaacctgggttatcaacgaactggcccggcagtgcggtcatcattttgatgctgaaggggttaaggtgatcgaattcgcccagtccggcctgaagccattgatcaagtttgcccgccggatggggatccagtggcacgtgctggtggacggcgatgaggcggggaaaaaatatgccgcgacggtacgaggtctgcttaataacgatcgcgagctggagcgcgaccatctgaccagtctgccggcgctggatatggaacactttatgtatcgtcagggatttgatgacgtttatcatcgggtggcgcagatcccggataatgtcccgatgaatatgcggcgggtgatcaccaaagccatccatcgctcatccaagccggacctggcgattgaggtggcgatggaggccggccgccgtggcgtggacgctgtgccgacgctgctgaagaaaatgttctcacgggtgctgtggctagcccgcggtcgtgccgattaatctcaccgccgtcgtcatttacggcggcacaaagctctccggcagctaaacaaaacctcattgacgcgaaaaatgggtgtcctgttgccaacgggtttcgatagaatcaccgcctggagcggcagggaaacagcaggaatcggaatatgaaagtgaagggaaaacgcaggaccgtctggtggctgttggcgatcgttgtgctggggctggctatctggggatggcggatcctcaatgcgccgctgccgaactaccagacgctggtagttcgcaaaggggatctccagcagagcgtgctggccaccggcaaactggatgccctgcgaaaagttgacgtcggcgcccaggtcagcggacagctgaaaacgctgcacgtcaatattggcgataaggttaaaaaggatcagttgctgggggttatcgatccggagcaggcgcaaaaccagattaaagaggtggaagcgacgctcatggagctgcgcgcccagctcaatcaggcgcgcgcggagagcaaactggcgcaagtgactctggcccgtcagcagcagctggcgcagcgtcagctggtctcgcggcaggaccttgataccgcggccaccgatttggcggtgaaacaggcgcagatcggcactattgaagcgcaaataaagcgtaaccaggcgacgctcgatacggcgaagaccaacctcgattacacgcggatcctggcgccgatggccggcgaagtgacgcaaattaccaccctgcagggacagacagtgatcgccgcccagcaggcgcctaacattctgacgctggcggatctcagcaccatgctggttaaagcgcaggtctctgaggcggatgtcatccacctcagaccggggcaaaaggcgtggtttaccgtgctgggcgacccgcttacccgttatgaaggtaaactgaaagacattctgccgacgccggaaaaagtgaatgacgccatcttctattatgcccgcttcgaggtaccgaacccgcaggggatcctgcgcctcgacatgaccgcgcaggtgcacattcagctggctgaggtgaagaacgtgattactatcccgctgagcgccctgggcgacgcggtaggcgataaccgctaccacgttcgactgttgcgcaccggtgaggtcaaagagcgtgaggttatcattggcgcccgcaatgataccgacgtcgcagtggtgcaaggtctggaagagggcgacgaagtgatcgtcggcgagagcgcgagcggggcggcaaaatgacggcgctgcttgagctgcgagatatacgtcgcagctatccttccggcgacggcagcggtgaggtcctgaaggggatcaccctcagcatccatgcgggtgagatggtggcgatcgtcggggcctccggctcgggaaaatcgacgctgatgaatatccttggctgcctcgacaaacccaccagcggcacctatcgggtagcgggaaccgatatcgcgcagctggatggcgatgcgctggcccgtctgcggcgggaacactttggctttatctttcaacgctaccatttgctgtcccatctgaccgccgcgcagaatgtcgaagtgccggcggtgtatgccggcagtgaacggcgcgcgcgcctggcgcgcgctcatgagctgctggtgcggctggggctgggcgagcgcgccgactatcaaccgtcacagttgtccggcggtcagcagcagcgggtcagtatcgcccgcgccctgatgaatggcggggaggtgatcctcgctgatgaaccgaccggcgcgctggacagccattccggcgaagaggtaatggcgatcctgcaccagctaaaagcgcaggggcatacggtcatcattgtgacccacgatccgcaggtcgccgctcaggcggagcggatcgtcgagatccgcgatggcgagatcgtccgcaacccgcccgccagccgccagggcggcggactgcgcgcccgtccgcaggcggagccttcggcgtggcgtcagtttaccagcggctttcgcgaagcgctggtgatggcctggcgagcgatggcggcgaataaaatgcgtaccctgctgaccatgcttgggattattatcggtattgcctcggtggtgtcgatcgtggtggtgggggatgccgccaagcagatggtgctggcagatattcgcgccatcggcaccaataccattgatgtatatcctggtaaggattttggcgacgacgacccgcgctatcagcaggcgctgaagtatgacgatttgctggcgatccagaagcagccgtgggtgcgctccgccacgccggcggtttcaaaaagcctgcgcctgcgcgccaacaatattgacgttgccgccagcgcggagggtgtcggtccacagtattttaatgtctacggcatgacctttagcgaaggcaataccttcaatgaactgcagctcaacagtcgggcacaggtggtagtgctcgacagcaatacccgtcggcagctgtttcccaataaagcgaaagtggtgggagaggtgattctggtgggcaatatgccggccacggtgattggcgttgcggatgaaaagcagtcgatgttcggcagcagcaaaattctccgcgtctggttgccctacaccaccatggcgggaagagtaatgggccagtcgtggctgaactccatcactgtgcgcgttcatgaaggctacgacagtgaaaccgcagagaaacagctgctgcgtctgctggagctgcggcatggtaaaaaagatgtattcacctggaatatggacagcgtcttgaaaaccgccgaaaggaccacacataccttacagctgttcctgacattggtggcggtgattgccctggtggtcggcgggattggcgtaatgaatattatgctggtgtcggtgaccgaacgaacccgggagatcggcatccgcatggcggttggcgcccgggccagcgatgtgctgcagcagtttcttattgaagcggtgctggtttgcctggtcggtggcgcgctgggcgtagcattgtcgctgatgatcgcctttattttacagctgtttctccccggctgggagattggtttttctccgctggcgctgctgacggcgtttctctgttcgacgctgaccggggtgctgtttggttggctgcctgcgcgcaacgcggcgcggctcgatccggtggatgccctggcgcgagaataggcggggcgagaaataaaaatgccagtcagaaggactggcattttattagcaggatgtacacaatgaagcaaaagagttatgcagccgtttccgcttccacagggacgatcacgctggcgtgattgccttttggcccctggtgaacatcaaaccgaacggcttgtccggcttttagcgttctgtaaccatccatctggatggtggagtaatgggcgaaaatgtcttcgccgccgccctcagggcagataaaaccgaaccctttggcattgttgaaccacttaacagtacccatttccatacttcgacatccttcgtaaatctttattagtaagatggaatgaaccggtggtggagtgacgagttgttcaattgctcgccaactctcgccactacaatttagagaaatacgaaaacgcgtcaagcgattgaggagggggaacggcgaaaaatgcgtcaaaatttgaagcagttaacgctattgccggggaatgtgacagccgtcgcggatagaagcgatagatgatagttatctatgatctattgtagatttgtgatgagcataacctctggtcatcgacaggcctccgcctgttggcaacagcaaccgatgatgaacactgacgatgagtaagagagattggctggacttcgagcacctggttgacgacgaagttcgtgatgcgattaaaccgccatctatgtataaagtgatattggtcaatgatgactacactccgatggagtttgttattgacgtgttacaaaaattcttttcttatgatgttgaacgtgcaacgcaactgatgctcacggttcactatgaaggtaaggcgatttgtggcgtgtttaccgcggaagtggcggagaccaaagtcgctatggtgaatcagtacgcgagggagaacgagcatccattgctgtgtacgctggaaaaagcctgaatacaggcatgaaaattgggggaggtgcctatgctcaatcaagaactggaactcagtttaaatatggctttcgccagagcgcgcgagcaccgtcatgagtttatgaccgtcgagcacttgctgctggctctgctaagcaacccctcggcccgtgaggccctggaagcgtgttcagtggacctggtggcattgcgtcaggaacttgaagccttcatcgaacaaaccacacccgttctgccagccacggaagaagagcgcgacacccagccgacgctaagcttccagcgtgtgctgcagcgcgccgtcttccacgtacaatcttctggccgcagcgaagtgaccggcgccaacgtgctggtggcgattttcagcgagcaggagtcgcaggccgcctacctgctgcgtaaacatgaagtgagccgtcttgatgtggtgaacttcatttctcatggtacacgcaaagacgagccgagccagtcttccgataacagcggaagccagcctggcaatgaagagcaagccggcggggaggaacgtatggaaaacttcaccaccaacctcaatcagcttgctcgcgtcggcggcattgatcctctgatcggccgtgaaaaagagctggagcgcgcgattcaggtcctgtgccgtcggcggaaaaataacccgctgctggtgggggaatccggcgtcggtaaaaccgcgatcgccgaaggccttgcctggcgtattgtgcagggcgatgtgccggaagtgatggccgactgcactatctactcgctcgacattggctctttgctggcagggaccaaatatcgtggcgattttgaaaaacgcttcaaagcgttgctcaaacagctggagcaggataccaacagcatcctgtttattgatgaaatccacaccattatcggtgcgggggcggcgtctggcggccaggtcgatgcggctaacctgatcaaaccgctgctttccagcggcaagatccgggtgatcggctccaccacttaccaggagttcagcaacatctttgaaaaagatcgtgcgctggcccgccgtttccagaagatcgatattaccgaaccgtcggtggaagagacggtccagattatcaacggcctgaagccgaagtacgaagcgcaccatgatgtgcgttataccgccaaagcggtgcgtgcggcggtagaactggcggtgaaatacattaacgatcgtcatctgccggataaggcgattgacgtcattgacgaagcgggcgcgcgggcgcgcttaatgccggtcagcaagcgtaagaaaacggttaacgtggcggatatcgaatcagtggtggcgcgcattgcgcggatccctgagaagagcgtctcccgcagcgatcgcgacacgctgaaaaacctgggcgaccgtctgaaaatgctggtctttggacaggataaagccatcgaggcgctgaccgaggctattaaaatggcgcgcgccgggctgggccatgagcacaagccggtgggatcgttcctgttcgccgggccgaccggggtcgggaaaaccgaagtgaccgtccagctggcgaaggcgttagggattgagctgctgcgctttgacatgtccgaatatatggaacgtcataccgtcagccgtttgatcggggcgcctccgggctacgtcggcttcgatcagggcgggctgctgaccgatgcggtgattaaacatccgcacgcggtattgctgcttgatgagatcgaaaaagcgcatccggacgtgttcaacctgctgctgcaggtgatggataacgggacgctgaccgataataacggccgtaaagcggacttccgcaacgtggtgctggtgatgaccaccaacgccggggtgcgggaaaccgagcgtaaatcgattggccttattcagcaggacaacagtccggatgcgatggatgagatcaaaaagatctttacgccggagttccgtaaccgcctcgacaacatcatctggttcgatcatttgtctaccacggtgatccatcaggttgtcgacaagtttatcgtcgagctgcaggtccagctggaccagaaaggcgtctccctggaagtgagtcaggaagcgcgcgactggctggcgacgaaaggctacgatcgggcgatgggggcacgtccaatgggacgcgtcattcaggacaacctgaaaaaaccgctggcgaacgaactgctgtttggctcgctggtcgacggtggtcaggtcactgtctctctggacagcgacaaaaatacgctgacttacgacttccagagcgcgccgaagcacaaaccggaagcggcccactaaggcgatatcttcaatgtaaaaaaaccggccaggggccggtttttttttgctgacggcagatgacggcagaaatgaaaagaccgggaattatcccggccttcagcatctgacgccttaggggcgaaaacaatcagcgactacggaagacaatgcggcctttgctcaggtcgtacggggtcagctcaacagtcactttgtcgcccgtcagaatgcggatgtagtttttacgcattttaccggagatatgcgcggttaccacgtgaccgttttccagttctacgcggaacatagtgttaggcaacgtttcaagtacggtgccctgcatttcaatattgtcttctttggccatctagtcctctggggtatcactaccgtagttttgaaccggcaagataatgccgaagttcatcatgtaagtaaagttttacgtatctaccctgaatcattcaccttgccgcaaggcgcatagtcagcgcagcggctacggaaatatgacgggtatgaatcgccgaagtagttttggcgcattgcccgggacacacacggccatgccgcgtgacaggcgcaaacgtaaaggggagtgacagaacgatgggcgttatctgactcttattattcccaaacggcggcggggcaacaggcagaagctactctaccgcgcaattataccatcctgacgcaaaatgtgctgaaaacattttattatccgccaggaaatagcacccgcggcacccaaaatcgctcgggcagtcggtagccgcgtaataccgacagatagtccagataatcgcggcggggaatatccactgcgcctaatgacgcggtatggttgttcagtacctggcagtcaattaatttaccgccgctgtgcgcaaagtcctggcaaaataccagcagcgcggttttggaggcattttctgcccggctaaacatcgattcgccgcaaaacagcgctccctgcgctacgccgtacattcctcccaccagggtattctcctgccagacttcaatggagtgggcatgacccagctcatgcagctggtgataggcgcgaacgatactgctggttatccaggtgccttcgtcacgatcgctggcgcagccctcaatcacttcgccaaaggcgtggttgagcgtgacccggtagggcgaacgctgatgaaagcgcttcatgctgcggctgagatggaattgctctggccaaagtaccgcccgggggtcgggcgaccaccagaggatcgggtcgccaggggaaaaccagggaaaaataccacgctgataggccatcagcagccgcgcggggctcagatcgccgccgagcgccagcaggccattaggttctcgcaaggcgccttccggagaggggaaggcgatagagtgccgggagagctgaaccagacgcattttaacctcaatacgcatcagcaaaaattagataatagaatagcctacagacgctgtttaaactggaagtaccggccctgtttagcgagcagctccgcgtgactaccttgctcaattatctggccgttgtccatgactattatctgattaaaacccgccaggccccgcaggcgatgggttaccatcagcacggttttgtcgcgcatgacatccgccagcagatgcaggatctggctttcggtggccgcatccagaccttctgtcggttcatcgagcagcatcagcggcgcatcgtggagcagcgcgcgggcaatggccagtcggcgcagttcgccgccggagagctgacgcccgccttcgcctagccagccgttaagaccgccatcttgcagcagtttttcgaggcccaccttctcaagggtagcgctgagatgagcgtcatccgcttcaggcgccgccagcagcaggttgtcgcgcagggtggcgctgaacaggtgcacgcgctgcggcactacgctcattgcctgccgcagagtggcttcgctgaggccggagagcggctgattgttgagcagaatctctccctgtgacgggtcccaggcgcgggtaagcaactgcaacagcgtcgattttccgcagccggtccggccaagaatggcgatgtgctctccggcggcaatctgcagggaaatattctccagggcaggggagggctgctgaggatagcggaaggtgacctcctgaagcgttagggccacctgcgctggcggactggcttcatcttcgacaaaggtgacctccggctgctggtcggtaatctgcgagatccgccgcgcggaggcgatcacctggcctaaatgctggaaagcgccagtaaccggcgccagggcttcaaaagccgccagcgcgcagaatacgaatagcgcgatcagcgccccgggctgactattgccgccgacgccgtctgaggccagccagagcatggccaccacggcgatgccaccgattaacagcattaccgcctgcgaaagcgcggtcagctcggcctggcgccgctgtgcatcctgccagctcagctcggtcttttccatttgtgcgcggtagcggtcgctggcgttaaataccatcagctccgcctgaccctgcagccaggcggtgagctgttggcgatactggccgcgcagctgcgtcatactttcgccggctggcttacctgcgcgatagaacagcggcggcataaccagcagggtcgccagcatgataccgccgagcgtcagcgcgagggtgacgtcgagcagacttaatccgcaggtgacgaccacaatcaccaccagcgcgccgaccagcggcgaaatgacccgcaggtagagatgatccagggtgtcaacgtcggctaccacccggttgagcagctcaccctggcgaaagcgcgccagccccgccggagagagggggagcagtttgctgaaggtgaaaacgcgcaggtgctgcagcacgcgaaaggtagcgtcgtggctgaccaggcgctcaaagtagcgcccggcggtacggataattgccgcgccgcgaacgcccgcggcaggcagcatatagttaaaactgtagatcccggcgacgcccaccaccgctgaggcggagaggaaccagccggagagcgtcagcaggccgatgctggccagcagggtcacaatggccagcacgacgccaagcagcagcatccatttatggcgtttatagagcgccagatagggtaaaagtgcacgcatttaaatctcctcctgacgatgggccagcagcgccgagaagaccccaccagcacgggccagcgtggcgtagtcgccttgttcgataatctgtccgtcctgcatcacccagacgtcgtcccagtcggccagcccctcgagctggtgggtgaccagcagcgtggtttgctcactggaggcgtgggtcagggcctgcatgactcgctgttcgctatgggcgtcaaggctggcggcaggttcatccagcagcagcaggcggcacggcaccaacagcgcgcgggcgaccgcgatacgctgcgcctggcctaccgacagacgccccgcctgatcgcctacggcggtatggatcccctgcggcagcagggcgataaactcgctgacccaggccttgtccagcgccagccgaagctgtgcttcgctagcttcgggccacgccagcagcacgttttcccgcagcgtggcggcaggcaactgcggattctgtcctacccagctcagcaggcggcgccagcgctcagcgtccagctcgcgcagctctacgccgttgaccatcagcgacccctcatagggcagaaagccgagcagtgtattcagcaaagagcttttcccggatccgctctggccgaccagcaccacgcgagcgccggcgggcagcgcaaaattaagcggccccgccagaactttaccttccggagatttgatcaccaggtcgcgcgcttccacgctaatcagatcgttgtcatttaacgttttctcgccacgctctacctgggtcagcggcgtttccataaacgttttcaggctgtctgcggcgcccacggcctgagctttggcatggtagaaggtacccaggtcacgtaacggctggaaaaattccggggcgaggatcagcgtcagaaatcccgccatcagcgtgacgcccgcgccatagtggccgaagttcagctcgccaaggtaagaaaagccaaaatacaccgctaccagcgcaatggagagggaggtgaaaaactccagaaccccggaggagaggaaggccagacgcaggacttccatggtgcgttggcgaaaatcctgcgaggcgtcgcgaatattatcggtttcagcctgaccgcgatgaaaaatacgcagggtttccatgccgcgtaggcggtcgaggaagtggccgctgaggcgggccagcgcctggaagttacgccggttggcgtcggcggcgcccatcccgaccagcgccatgaaaagcgggatcagcggggcggtgccgagaaggattagcgcggcggcccagttaatcggaaaaatagtaataacgatcagcagcggtacgcaggccgccagcgtcatctggggcaggtagcgggcataatagtcgtgcatgtcgtcgatttgctcaagaataagcgttgcccagctgccggccggtttgccctggatccacgccgggcctgcctgctggaggcggtcaagaacctggcggcgaatttcatagcgaatatgctgcccggcctgaaagccgacccgctcacgcagccagaccacccaggcgcgtagtacaaagatcagcaccagcagcgtgagcggcagcagcagggcggtcgctggaatattctccatcaccatccggtgcaggatccgcgccaggaaccaggcctgcgccacgatcagcagaccgctcgccacgccaagcaggcgggaaaacatcaaccagcgacgggagataatgctttgctgttttaaccagcgggttaactcttgttgacgggttttattcattgcgcgctttgcaggtgtcgttatcggagtattgggcacggcaatgttacatcgcagcaaaaataaaggcgacttttcgtcgccttctttacctttgttactgacttgtaaagattatttgcaagcgtcagccaaaccgtcgaggtaacgctccgcatccagcgccgccatgcagccggtgcccgcagaagtgatggcctgacgatagatatggtccatgacatcgccggcggcgaacacgcccgggatgctggtctgggtcgcgttgccgtggataccggactgcactttgatgtagccgttctccagctccagctggccttcaaagatggcggtgttcgggctgtggccgatggcgacaaataaaccagccacttccagggactcgacattgtcgctgtttttggtatcgcgcaggcgcaggccgctgacgcccatctggtcgccggtcacctcttcgagggtacgatcggtatgcagcacgatgttgccgcttgccactttatccatcaggcgtttgatgaggattttttccgcacggaaggaatcgcgacggtggatcaggtgtacctcagaggcgatattcgacagatacagagcctcttccactgcggtgttgccgccgccgatcaccgccactttctggttgcgatagaagaatccgtcgcaggtagcgcacgcggaaacgccgcggcctttgaaggcttcttcggaaggcaggcccaggtaacgggcggaagcgccggtggcgatgatcagcgcgtcacaggtgtactcgccgctgtcgcctgtcagacggaacgggcggttttgcaaatcgacgcggctgatatggtcgaaaatgatctcggtttcaaattttgcggcatgctcgtgcatgcgctccatcagcagcggaccggtgagatcgttcggatcgcctggccagttttccacttccgtcgtggtggtcagctgaccgcctttttccatcccggtgatcagcaccggctgcaggttggcgcgtgcggcatagaccgccgcggtgtatcccgcaggtccagaaccaaggataagcagtttactgtgtttggctgtgcccatgagatccccataataattggcatacattgggctgggattgtagggaatttgttgtcgtaaaaaaagagcacagcgattttgttaacgatgtgtgcaatagaagctgccaatgaattggtgattttcccggcaaggaatataactatttctactgtcggtgggacaattataagacgaaaaaatgagaatcaaccagggcggatgatgaatatctggcatcttgtactaaaaatcgatgttttgctttgacaatcacctgtgcttttgcgaaaacattcaaggaagaagaaaagcagtatttagcgtgcggcgaattttcatgcacgcaaatgccatttttatccgggttaacgaaatctacgcatggtgtggacagacgccatgcgtgatgtcggtgactgccgtcaggcaacgggcttctcacgtacccctgggttacccaatgtcgtacgggtgataacaggatgggctctggcagtgaaggctcagagccggaacaggagtagggaaggaatacagagagacaataataatggtagatagcaagaagcgccctggcaaagatctcgaccgcattgatcgtaacatcctgaatgaattgcaaaaagatgggcgaatttctaacgtcgagctttctaaacgggtgggactttctccgacgccttgccttgagcgtgttcgtcgtcttgaaagacagggttttattcagggctatacggcgctgctcaacccgcattatctggatgcatcacttctggtatttgttgagattactctgaatcgtggcgcaccggatgtgtttgagcaatttaacgccgcagtgcaaaaacttgaagaaattcaagagtgtcatctggtttccggtgatttcgactatctgttgaaaacccgtgtaccggatatgtcagcgtatcgtaaattactgggcgagaccttgctgcgcctgccgggcgttaacgacacccgtacctacgtggtaatggaagaagtcaagcaaagtaatcgtctggttattaagacgcgctaacacggaacaggtgcaaactcgacgtagtttgattacactcctgttaatccatacagcaacagtgccggggagacccggcgctgttgtccgttttagcagcaggcaggaaacagcctgatacctggagagcctttcttgagccaggaatacaccgaagacaaagaagtcaaactaaccaaactcagcagcgggcgccgactccttgaggcgatgctcatcctttgctccctcttcgccatctggctgatggcggcactactgagctttaacccctcggaccccagctggtcgcaaacggcatggcatgagcctattcataatttaggcggcgcccccggcgcgtggcttgccgataccctctttttcatttttggcgtcatggcctacaccatcccggtgatcatcatcggcggatgctggtttgcctggcggcatcaggaaaacgacgaatacattgattattttgccgtttcccttcgcctcatcggtgcgttagccctgatcctgacctcctgtggtctggcggcgattaacgccgatgatatctggtacttcgcctccggcggggtgatcggcagcctgctgagcaccacgctgcaacccctgctgcacagcagcggcggcaccatcgccctgttgtgtatctgggcggccgggctgacgctgttcaccggctggtcgtgggtcagcattgcggaaaagctgggcggcggcatcctgtccgttctcacctttgccagcaaccgtacccgtcgggatgatacctgggtcgatgaaggcgaatacgaagacgacgaggaagagtacgacgacgaagaggcggccaggccgcaggaatcgcgtcgcgcccgtatcttacgcagcgcgctggcgcggcgtaagcgtctggccgagaagtttaccaaccctatggggcgtaaaaccgacgctgcgcttttctccggcaaacggatggatgacggcgaagaggtggtgcaatacagcgccagcggggcgcctgttgccgccgacgatgtactgttttccggcgccagcgccgcgcgtcccgcagaggatgatgtgctgttctccggcgccagcgccgtgcgcccgggcgatttcgacccttacgatccgttgttgaatggccacagtatcgctgagccggtaagcgcagcggcggcggctactgccgcgccgcaggcgtgggcagaatcaccggtgggccatcacggcgctgcgccagcttatcagccggaagccagctatccgccgcagcaggcctatcagcctgaacccgctccgttccagcaggctgcttatcagccgccagcggggcaaaccgcaccgcaggcgtatcagcctgagccagcgccgtatcaacagccggtttacgatccgcgtgccggtcaacctgcgccgcaggcctatcagcctgagccagcgccgtatcagcagccggcttacgatccgtatgccggtcaacctgcgccgcaggcctatcagcctgagccagcgccgtatcagcagccggcttacgatccgcatgccggtcaacctgcgccgcaggcctatcagcctgagccagcgccgtatcagcagccggcttacgatccgtatgccggtcaacctgcgccgcaggcctatcagcctgagccagcgccgtatcagcagccaacttacgatccctatgccggtcagcctgcgcctcagacctatcagcagccggcttacgatccgaatgccggtcagcccgcgccgcagacctaccagcagccggcttacgacccgcatgccggccagcccgcgccgcagccgtatcagccggagccagcggcgtatcagccgcaaagcgcgccagttcccccaccggagccagagcccgaggtcgtgcaggaggaagtgaaacgtccgccgctctattatttcgaggaagtggaagagaagcgggcgcgcgaacgcgagctgttggcctcctggtatcagccaattcctgagccggaaagtccgattgccactaaaccgctgacgccgccgaccactgcgtccaaaccgccagtggagacaaccgtagtctctgcggtagcggctggggtgcatcaggctaccgccgccagcggcggcgcggcggcagcaacctcgtccactgccgcatccgctgcggctacgccattgttcagcccggcgtccagcggcccacgggttcaggtgaaagagggcatcggtccaaaactaccgcggcccaatcgcgtgcgtgttcctacgcgtcgggaactggcctcctacggcatcaagctaccgtcgcagcgggaggcggaacagcgcgcgcggcaggcggagcgcgatccgcattatgatgatgagctgctctcggatgaggaagcggatgctatggagcaggatgaactggctcgccagttcgccgccacccagcatcagcgctacggtcatcgctgggaagacgataacgcgactgatgacgatgaggccgacgccgcggcagaagcggagctggcgcgtcagtttgccgctactcagcagcagcggtacgctaccgagcagccgccgggcgccaacccgttctcgccggcagattatgaattctcgccgatgaaaacgttggtcaatgacggcccgagcgaaccgctgtttacgcccacgccggaagtccagccgcagcagccggcccagcgctatcaacaaccggcggccgctccgcagcagggttatcaacctgcgcagcatcagccgatacaccatcagcctgtgccgccgcagccgcaatcctatccgactgcgtcgcagcccgtacagccgcaacaaccggttgccccgcaggggcatcagcctgccgcccctgcgccgcaggagagcctgatccacccgctgctgatgcgcaatggcgataggcgaccactgcaaaagccgaccacgccactgccgtcgctggatctgcttaccccgccgccgagtgaagtcgagccggtggatacctttgctctcgagcagatggcacgcctggtggaagcgcgactcgccgatttccgcattaaagcggatgtggtgaactactcaccggggccggtgatcacccgcttcgaactgaatctggcgcctggcgttaaggccgcacggatctctaacctgtcacgggacctggcgcgatcgctgtcaacggtcgccgtgcgcgtggtggaggtgatcccgggcaaaccgtatgtcgggcttgagctgccgaataaaaaacgccagaccgtctacctgcgtgaagtgctcgacaacgccaagttccgtgataacccatctccgctcaccgtggtgctgggtaaagacatcgctggcgatccggtagtagccgatctggcgaaaatgccgcatctgctggtggccggtaccaccggttccggtaagtctgttggcgtcaacgccatgatcctcagcatgctctacaaggcgcagccggaagatgtgcgtttcattatgatcgacccgaaaatgctcgagctgtcggtctacgaaggaattccgcacctgctgacggaagtagtcaccgacatgaaagacgccgccaatgcgctgcgctggagcgtcaatgagatggagcgccgctacaagctgatgtcggcgctgggcgtgcgtaacctcgcgggctacaacgagaagatcgccgaagccgcgcgcatgggacgtccgatcccggatccgtactggaagcctggcgacagcatggacgccgtacatccggtgctggaaaaactgccgtacatcgtggtgctggtggatgaattcgccgatctgatgatgaccgtcggcaaaaaggtggaagagctgatcgctcgcctggcgcagaaagcgcgcgcggcggggatccacctggtgctggcgacacagcgtccgtcggtagatgttattaccggcctgattaaggccaacatcccgacgcgcatcgcctttaccgtgtcgagtaaaattgactcacgtaccattctcgatcagggcggcgcggaatcgctgctgggtatgggggatatgctttactccgggccgaactctaccacgccggtgcgtgtccacggggcgtttgtgcgcgaccaggaagtccacgccgtggttcaggactggaaagcccgcggtcgcccgcaatatgtggatggcattacctccgacagcgaaagcgaaggcggcggtggcggcttcgacggcggggaagagctggatccgttgttcgatcaggcagtcaactttgtgaccgagaagcgcaaagcgtcgatttccggggttcagcgtcagttccgcatcggctataaccgtgccgcgcgtattatcgaacagatggaagcgcagggtatcgtcagcgagcagggccataacggtaaccgcgaagtgctggcgccgccgccctttgaatgagtgcaaagttgggtaaataagcgcaaaatcagccaattcttctgtcccgccgccgccggcggtcctacagtaggggcagaagaggctcccgcgtcgggagtgacgcacattaaggaagaacaatgaaaaaactcgcaatcacctgtgcattactgtctggtatggtcgtcagccaggtctgggcagatgcggccagcgacttaaaaagccgtcttgataaagtgagcagcttccatgccagcttcacgcaaaaagtcaccgacggtagcggtaacgccgtgcaggacgggcagggagacctgtgggtgaaacgcccgaacctgtttaactggcatatgacccagccggatgagagcgtcctcgtttcggatggtaaaacgctgtggttctataacccgttcgtcgagcaggccacggcgacctggctgaaagacgccaccagcaacacgccgtttatgctgattgcccgcaaccagtccagcgactggcagcaatataatatcaagcaaaatggcgatgattttgtgctgacgccaaaaagcggcagcggcaacctcaagcagttcacgatcaacgtcggtcgggacggcactatccatcagttcagcgccgtcgagcaggatgatcagcgcagcagctatcagctgaaatcgcagcagaacggcgccgtcgacgcagctaagttcacctttacgccgccgaaaggggtgacggtggacgatcaacgtaagtagaggcgaaagtgagcaatctgtcgctcgatttttccgacaacgcgtttcaacctctggccgctcgcatgcggccagaaaatttagcgcagtatattggccagcagcacctgctggcgccgggtaaacccctgccgcgggccattgaggccgggcacctgcattcgatgatcctctgggggccgccgggtaccggcaagaccactctggcggaagtgattgcccgctacgccagcgccgatgtcgaacggatctcagcggtaacctccggggtgaaagagattcgcgaggctattgagcgcgcgcggcagaatcgcaacgccggccggcggaccatcctgtttgttgacgaagtgcatcgctttaataaaagccagcaggatgcctttctgccgcatattgaagacggtaccattacttttattggcgcgaccaccgaaaacccctcctttgagcttaactcggcgctgctctcccgcgctcgcgtctacttactgaaatcgctcaccaccgacgatatcgagcgggtgcttgaccaggcgatgaacgataaaacccgcggctacggcggccaggatatcgttttgccggatgagacccgcagggccattgccgagctagtgaatggcgacgcgcggcgagcgctgaataccctggaaatgatggccgatatggccgaaagcgatgactcgggcaagcgggtgctgatggcggaactgctgaccgagatcgccggcgagcgaagcgcgcgctttgataataaaggcgaccggttctacgatttgatttccgccctgcataagtcggtgcgcggtagcgcgccggatgcggcactttactggtacgcgcggatcatcaccgccggcggcgatccgctgtacgttgcccgccgctgtctggcgattgcctcggaagatgtcggcaacgccgacccgcgggcgatgcaggtcgccatttcggcgtgggactgctttacccgcgtcgggccggcggaaggcgaacgggcgattgcccaggccattgtctatctggcctgcgcgccgaagagcaacgcggtgtacaccgccttcaaagcggcgctggccgacgcgcgggatcgtcctgactacgacgttccggtgcatctgcgcaatgcgccgacgaagctgatgaaagagatgggctacggccaggagtatcgttacgctcatgacgaacccaacgcctacgccgccggcgagcagtacttcccgcaggaaatggcgcaaacgcgctattatcacccgacaaaccgggggcttgagggtaaaattggcgaaaagctcgcctggctcgctgaacaggatcaaaatagcccgataaaacgctaccgctaattgaggcgttgcggtaaggttattacactatttccgtggtcgtagtctgcggccacttttcttttttaattcgataagcacaggataagcatgctcgatcccaatctgctgcgtaccgagccagacgcagtcgcagaaaaactggcacgccggggctttaagctggatgtagataaacttcgcgcgcttgaagagcgtcgtaaagttctgcaggtgcaaacggaaaacctgcaggcggagcgtaactcccgatcgaaatccattggccaggcgaaagcgcgcggggaagacatcgagccattacgcctggaagttaacaagcttggcgaacaactggatgctgcaaaatccgagctggaaacgctgctggcggaaattcgcgatatcgcgctggcgatcccgaatattcctcatgatgatgtgccggttggtcgcgacgaaaacgacaacgttgaagttagccgctggggtacgccgcgtcagttcgattttgaggtgcgcgatcatgtgacgctgggtgaaatgcacggggggctggattttgccgccgccgttaagctcaccggctcgcgcttcgtggtgatgaaagggcagctggcccgtctgcaccgcgccctggcgcagttcatgctggatctgcacaccgaacagcatggctacagcgaaaactatgtcccgtacctggtaaaccaggataccctgtatggcactggccagctgccgaaattcgctggcgacctgttccatacccgtccgctggaagaagaggctgacagcagcaactacgcgctgatcccgacggcggaagtgccgctgaccaacctggtgcgcgatgaaatcatcgacgaagacgatctgccgatcaaaatgaccgcccatacgccgtgcttccgctctgaagccggttcctatggccgcgacacccgcggtctgatccgtatgcaccagttcgataaagttgaaatggtgcagatcgtccgcccggaagactctatggccgcgctggaagagatgaccggtcacgccgagaaagtgctgcagctgctgggcctgccgtaccgtaaggtcgcgctgtgcaccggcgatatgggcttcagcgcctgcaaaacctatgacctcgaagtatgggttccggcgcaaaacacttatcgtgagatctcctcctgctccaacgtctgggatttccaggcgcgtcgtatgcaggctcgctgccgcagcaagtccgataagaagacccgtctcgttcataccctgaatggttctggcctggcagtaggtcgtacgctggtggcgctgatggaaaactatcagcaggctgatggccgtatcgagatcccggaagtgctgcgcccgtatatgcgcggcctcgaatatatcggctaaacttctcactccttcttttaaaagcgcctgcgggcgctttttttacgcccttattgataccgggcaataatccttgccgcgaatgcagtgatactccctttggattaaaccagcataaaaaactaataatatcgcaaagcattatatatatatctatataacgcttgtcagtttattgtgagcaaccaaagcgagtatccatgaaaattaaagcccctgatgctttactggctgctgaggtaagccgccgtggtctgatgaaaaccacggcaataggcggcctggcgctggccagcaacgcactaacgttaccctttacccgactgtcgcatgctgccgatacgccggcgcccgccagtgagaaggtggtctggagcgcctgcaccgtcaactgcggtagccgttgcccgctgcgcatgcacgtggtggatggcgcgattaaatacgtcgaaaccgataataccggtgacgataactatgacggtttgcaccaggtccgcgcctgcctgcgtgggcgttcaatgcgccgccggatctataatccggaccgtctgaagtacccgatgaagcgcgttggtaaacgcggtgagggcaagttcgagcaaatcagctgggaagaggcgttggataccatcgccagcaatatgcagcggctgattaaagagtacggcaacgaatccatctatctgaactacggcaccggcacgctcggcgggacgctgacccgctcctggccgccggggaaaacgctgattgcccgtctgatgaactgctgcggtggctatctcaaccattatggcgactattcatcagcgcagattgctgccggtctgaattacacctacggcggctgggcggacggcaacagcccatcggagattgaaaacagtcagctggtggtgctgttcggcaataaccccggcgaaacgcggatgagcggcggcggggtgacgtactaccttgaacaggcgcggcagaaatccaatgcccggatgataatcatcgatccgcgctataccgacaccggcaccgggcgtgaagatgaatggatcccgattcgtcctgggaccgatgcggcactggtttcgggcctcgcgtgggtgatgatcaccgagaatctggtcgatcagccgttcctcgataaatactgcgtaggatacgacgagaaaacgctgcccgccggtgcgccagccaatggtcattacaaagcttacattcttggccagggcactgacggtatcgccaaaacgccggagtgggcctcgacaattaccggtattccgcgcgaacgcattgttaaactggcgcgcgaaattgccaccgctaaaccggcctatattagccagggctggggtccgcagcgtcacgccaacggtgagatcgccacccgcgccatctcaatgctcgccattctgacgggtaacgtcgggatcaacggcggcaatagcggggcgcgcgagggctcgtatagtctgccttttgagcgtatgccgacgctggagaatccggttgagaccagtatctcgatgtttatgtggaccgatgcgattgagcgcggcccggaaatgaccgctctgcgcgacggcgtacgcggtaaagataagctcgacgtgccgatcaagatgatctggaactatgcgggcaactgtctgattaaccagcattctgagatcaaccggacccacgaaatcctgcaggacgacaagaaatgcgagatgattgtggtcattgactgccatatgacctcctcggcgaaatacgccgatattctgctgccggactgtaccgcctccgagcagatggatttcgcgctggatgcctcctgcggcaacatgtcctacgttatctttgccgatcaggccatcaagccgcgtttcgaatgcaaaaccatctatgagatgaccagcgaactggcaaagcgtctgggcgtcgaagagcagtttaccgaaggccgtacccaggaaggctggatgcgctatctgtatgagcagtcgcgcaaagcgattcccgacctgccggatttcgacaccttccgtcagcagggcatctataagcagcgcgatccgcaaggtcatcatgtggcctacaaagccttccgtgaggatccgcaggctaatccgctgaccacgccttcgggcaagatcgaaatttactcgcaggatctggcgaaaatcgcggccacctgggagctgccggaaggggatgttatcgatccgctgccgatctacaccccgggtttcgaaaactacaacgatccgctgacagcgaaatacccgctacagctcaccggcttccactataaatctcgcgtccactcgacctacggcaacgtcgatgtgctgaaggccgcctgtcggcaggagatgtggattaacccgatcgatgcccgcaagcgcggcattgccaacggcgatcgtattcgcatcttcaacgatcggggtgaagtgcatatcgaagcaaaggtgacgccgcgcatgatgccgggcgtcgtcgcgctgggggaaggggcctggtacaacccggacgcctcgcgtgtggatcaggcgggcagcatcaacgtgctgaccacccagcgtccgtcgccgctggcgaagggaaacccgtcgcataccaacctcgttcaggttgagaagctgtaaggagtaaccgatgacaactcagtatggattttttattgattccgcccgttgcaccggttgcaaaacctgcgaactggcctgtaaggactacaagaacctgaccccggaggtcagcttccgccgcatctatgaatatgccggcggcgactggcaggaggacaacggcgtctggcagcagaacgtgtttgcctattacctctccatcgcctgtaaccactgtgaagatccggcctgcaccaaggtctgtccgagcggcgcaatgcataagcgcgaagacggttttgtggtggtcaacgaagaggtatgcattggctgccgctactgccatatggcctgcccgtacggcgccccgcagtacaatgccgacaaaggccatatgaccaagtgcgatggctgtcacgagcgcgtcgccgaggggaaaaagccgatctgcgtcgagtcctgcccgctgcgggcgttggatttcgggccgattgccgaactgcgcgctaagcacggccagctggccgcggtagcgccgctgccgtcggcgcactttacccggccgagtatcgttatcaaacctaacgccaatgcccggccgtgtggcgataccaccggttacctggcgaacccgaaggaggtgcgagatgggaaacggatggcatgaatggccgctg

SEQ ID NO: 58 - DNA, 320394 bp, Unknown
  source: /note="Description of Unknown: KP2-Mcoc1 Bacteria Sequence"
tgcggcctccacatcgctgagacgttcccggaaggccggggcagcccgcatggatgcgggctgagggccgtgttttgcacggacgctgcctcggcccgacccgaagcctgcagggataagtcgaaggcaccacgcagcggcgatgttgctggccggagcccgggggtacagggggcggcggcgactggccgccccctgtgcgctccctgcgccgtaagagacataacgcagaagactaaccgggagcgcaatgtgcgctgaagccacagataacataaaagacttcccggcagggctttgccttcccccctactcccggagggagagggaaccgtccagcagcgccgaccgggcaatacccgaagatggcacattgccagccatctgattccctgtgattaatgttggtccagccacgccagcgcctgctcgcccgcctcgtccatcggcaggtagaccagcaggcgcgagccgttgcgcggcgccgaataccagtacatctgctgcaggctgaatcgcccgagctgcgggtggttaaaatgtttaatctggttttccacgccgcgcacctcgtagcgctgatgccacagcgcttcaaactccgacgaggcggcgaaaaagcgcgccagtttgttttcccacgccggatcgccgcggtgctcggccatcgcggcgcggaaataggagacgaaggtcggcagcacatcgcgattttcgatccggctgcgccaggtctcatgggtcagatagagataaatgcagttgcgatcttcttccgggagggtggcgaaatcgatgcccatcaggcggcagaagctgtcgttccacgccacaatatcaaagttcggtttctgaatgctggccggctgcggcatcaggctgtccagcatccggcgggtccctgggctgatgccttcgcacaccgtcacctgggtggcttccggcggggtcagcccggcgagcacgaacagatgccgggtctccagcggactgcactgcagggcattcgccacccccaccagcaccgcctccgacggattcacctcccgcccctgctccagccaggtgtaccaggtaacgccgacgtcggcgagcatcgccacctcttcccggcgcagacccggcgtgcgccggcggcccacccggggcaaccccaggcgctgcggatcgaggctttcacggcgggcgcgcagaaaggcccccagctgtttgcgtcgatcgtccggcacggcgatcgtcgactcccgttgcggcatcgtggtcatcacccctccagcatagtagtgccaataccagtatagacaggaactggtacccgtttaatttatcggtaatgctacgtcggtctgctgaatgacgcaatggagaatcccatgaatacgtctgctgtttcacccggccgcgccggtctgttgctgctgctgagcggccagatgctgccgcttattgatacctcgatcaccaatgtggcgctggacgccatcacccacaccctggcggccagcgccacgcagctggagcttatcgtcgcgctgtacggcgtcgcctttgccgtctgcctggcgatgggcagtaagcttggcgataactatggccgccggcgcctgtttatgtggggcgtcgccctctttggcatcgcttccctgctgtgcgggatggcgaacagcatcggcgccctgctggcggcccgcaccctgcagggcgccggggcggcgctgattgtgccgcagatcctcgcgaccctgcacgtcaccctcaaaggccccgcccacgcccgggccatcagcctgtatggcgggatcggcgggatcgcctttatcgtcggtcagatgggcggcggctggctggtgtcggcggacatcgccgggctgggctggcgcaacgccttttttatcaatgtgccgatctgcctgctggtgctggctctgagccgccgctatgtgccggaaacccgtcgcgagacgccgtcgcggattgactggcagggcacgctgtacctcgcgctgatcctctgctgcctgctgttcccgatggccctcggtccggagctgcactggccgctgtggctgcagctgatgctggtggcggtcctgccgctgctgttcgccatgcgtcagagcgccctgcgccagcagcagcgtggcgaccatcctctgctgccgccgcgtctgctgcagttgaccagcatccgcttcgggatggccatcgccctgctgtttttcagcgcctggtccggctttatgttctgcatggcgctgaccatgcaggaggggctggggatggcgccgtggcagtccggcaatagctttatcgccctcggcgtggcctattttatttcggcgctgtatgccccgcggcttatcgcccgctacagaatggggcggatcctgctgaccggtctgacggtgcagatcgccggtctcctgctgctgtgcgccaccttctcccgcttcggcgtcgccaccaacgccctgacgctggtccccgccacggcgctgatcggctatggccaggcgctgatcgtcaacagcttttatcggattggcatgcgcgatatcagcgccagcgacgccggggccgggagcgcaatcctcagcaccctgcagcaggcgaccctcggtctcggaccggctatccttggttcgctgttcctggcgctggcccgtcgcggcggcggaaactatccgcaggcgctgattgattttctgctggtcgaggtggccatgatgctgttgctgggggcgatagcgctgtggctgcgccatcatctcaaccgacagccggcgacggtggcctcgtaataccggcggcggtaatttgcataatagctatccagcggtcatcatacccgctggatattcaggagacgttatgcaggaattaatatcgcaaattgccgccttaggaatcgaaataacccccacccgctcgctgatgattatcttcggcattatcttgttcaccgccgtggtcgtgcatctgatattgcacaaagtggtcctgcgcgcatttgaaaaacgggcgctggccagcagccatctgtggctgcaaatcatcacgcagaataaactctttcaccgactggcctttaccctgcaggggatcatcgtcaacgtccaggcggtgctgtggctgcaaaaaggcagcgaggccgcggaaatattaaccaccgtggcccagctgtgggtgatgatatatgccatgctgtccttcttctcgctgctggatgtcattttaaaactggcgcagaaatttcccgccgcctcacagttgccgctgaagggcatattccagggaattaagctggtgacggcgattattatcggcattctgattatttcgctactgataggccagtcgccagcgatcctgattagcgggctcggcgcgatggccgcggtgctgatgctggtgtttaaagatccgatcctcggtctggtggccggtattcagctctcggccaacgatatgctcaagcttggcgactggctggagatgccaaagtacggcgccgacggcgcggtgatcgatatcggcctcaccacggtcaaggtgcgcaactgggataataccatcaccaccattccgacctggtcgctggtctctgactcgtttaaaaactggagcggcatgtcggcctccggcggccgccgcatcaaacgcagccttaacatcgacaccaccagcattcatttcctcgatgaacaggagcagcagcgcctgatccgggcgaagttacttaaaccctatatggattcacgccacgaagagataagcgcctggaaccagcagtacgccggggagcaatcgatcctcaatgagcggcggatgaccaacgtcggcaccttccgcgcctatctgcaggagtatttacgccatcatccgcgcatccgccaggatatgaccctgatggtgcgccagctggcgccggatgccaacggcttgccgatcgagatctactgcttcaccaacaccgtggtatgggcggaatatgaggggatccaggcggatattttcgaccatgtcttcgccgtggtggatgagtttggcttacgcattcatcaaacgcccaccggcaacgatattcgcgcgctgaccggcgccttctcccgctgatcctcagacgctggcgcggtctatcacgcgccagtccatcatcacccgctcgacggcagcgtcgggatcgtcgatgcgtttcatcagtagagacaccgccgtacggccgatcgcccgggagggctgttcgacggtggtcagctgcggggagaccacttccgccagctcggtgccatcgaagccgatcaccgcgatatcctccggcacccgcagtccggcctgggcgatagcccgcagcgccccggcggcgagggagtccgaaacggcaaacaccgcatcgggcttctcgtcttgcgacagcagttgctccatcgcccgtttaccggccgccgcgctaagatcctgcgcgtaggtcacctgctgatacgccagaccgtgcacgtgcagcacgcttttatagccgcgctcgcgcagacgggcatagcgatagctgaggtcgtgattaatgagcgcgatgcgtcggcggccgctatcggccaaccgggataccgccccctgagccgcctcaacgtcgttaatcccgacgcaggagatgctgccggtgtcggcatactccgcgcactgcacccagggcgcgtcgccaagcatggtggtcagttccggcaggctggagagcgcgttcatggtaataatgccgtcgaccattttgccggagagcagctgcaggcccgaggtcgagcgggccagatccgacccggagttacacagcagaatgcgatagccattcttctccgcctcttcttctatccccttcaccacctcggcgcaaaaggggttagcgatattggagaccatcaccaggatcatattgctgcgggcggttcgcagctgacgcgccagcaggttcggctgatagttgctctctttgatcgcctgcagtacgcgctcacggtttttggcttttaccgtatcgctgttgttcagcacccgcgacaccgtggccaccgagacgccggccagacgagcaattttctgaatagacataaaccctgcacttcctgcgatagaggtggatcctgcaggctatcataaatgacctctgattggcctgccagcctggcgcgaaagcgtagctcagcgagacggtgtcccgggaaactattaataatcagggcttctctcccgccccgttaacgcgcatccttttgccgtttcatattctcattagcgcaggaggcgcaacagaccgcctgcgccccattttttcttttatgattaaggatgatatccccatgaggctctccaccgcggttctcgccctcagctgtgccctggcaacgatcaccggctgcacctcgtcaacatcgtcaccggaacgccatgcctacgccttcgtcgcccaccgctccgattttgtcggcggcaacttcaccgtcaaccgccaggaaaattaccgtttaaacctgccgacctttacggcgatgtatgcccgcggacagcaggataaagccgctggcatgagcgaaagtgatgcccgccgcaccgcggaagccatcaaacagcaggcggcgcagggcacccgcaccgagcacgccttcaccggcaatgccagcgacaaatgggataatgcgatggaaaataaagatgccgtcctgttcggcaacgagctctccggtgcctatctcgacggctatcttggggtgaaataatcctgcgccccgcctgcgctcagcgttcgacgctgacccagcgctgttcctgatggcttttgacgatcgcctcgatgatgtacatcacatcggcgccgtcgtcgaaagcggcgaagcgccggaccccggccgccggcatcttcccggcgcgcaccgcctgataaaaatgccccatcatatttttaaaggcgtccggccagccctcaatatggccgccggggtaatgggcgctgtcagcgatttccggccgcagcaggctcgggtcatcgctgagcaggcgatccggctgctcgcggtggccgatccacagccgctggggcacttcctgatcccaggccagagaacagaggctgccgttaatctccaccgccagacggtttttccgcccggcgctcacctgagagaccataaagctgcctttgctgccatcgtcaaaacgcaacagcaccgagccaaagtcctcggtatcgacaggccgcgtttcatatgcctgcgcctcgtgaacggcgctgaaggtcgctttgccattgaccggcgctttacgcgttggccagacgatagacagatccgccatcacctcgacaatccgccgaccggtcataaactgcacggtatcgcaccagtgggagccgatgtcggccaccgtccgcgacgcgccgccctgcgccgaatcgacccgccagttgtagtcggtctccagcagcatccagtcctgcagatagctgccgtgggccgcgaagattctgccgacctcgccatggcggatcatcgccgccgcctgctggaccatagcgaactggcgatagacgaagctgacgccatgcaccacgccggcccgggcggcaagcgccaccagctcccgcgcctcccccgccgtcatacacagcggtttttcggagaagacgtgcagcccggcggcgaggatctgccgattaatctgggcatgtagatggttgggcgtacagttatgcaccacctgcagccccggatgggccagcagcgcctccacgctgtcgtaggcatgggcaatgttcagcgctcgcgccttgcgctgcgccgcctcaaggcggctgtcgcacagcgccaccacctcgacatctcccagccgccgcagcgcctccagatgcgccgggccaataaaccctgccccgataatcgcgacctgaatcatgttattccctcccgccggcggcaaagtcatcgaaggcccgtccggcaacgggaatgatatggcggcggataaactcgctgccctcgcgcgcgccggtctcactatccttcaggcagcactcccactccagcaccgcccagccggcaaaatcatattcggtcagcttactgaacacccctttgaagtcgatctgcccgtcgccgggagagcggaaacgcccggcccgctgctgccagggctggtatccaccgtagacgccattgcgcccgttgcggcgaaattcggcgtccttgacgtgaaacgctttaatacgcgcatgatagatatcgatataggtcaggtagtccatctgctgcagatgcaggtggctcgggtcatagagcatattgcagcgcggatggttatccaccagcgcaagaaaacgctcaaaggtcacgccatcgtgcaggtcttcgccggggtggatctcatagcagacatcgaccccctgctcgtcgaagaggtccagcagcggccgccagcgccgggccagctcggcaaaggcctcatccagaagcggctgattgtgcggcggccacggataaaaaaagggccatgccagcgccccggaaaaggtcgcgtgcgcctgcagccccaggcggccagaggctaccgccgcctggcgcactttctccaccgcccagcgctggcgcgcctgcggatcgccatgcagcgccgccggggcaaaggcatcaaacgccgcgtcatacgctggatgcaccgccaccagctgcccttcaaggtgagtggacagctcgctgatcaccagcccatgctccgccaggatgccgctgacctcgtcgcagtaggtctggctcgccgccgcccgctcgacatcaaaaatcgccgggtggttgcaggggatctgcaatgccttgtaccccaggccggcggcccactgcgctatccccgccagggtgttgaacggcgcctgcggcccgataaactgcgccagaaaaatgcccggtcccttaatcgttttcataccccctcctgaaaaattagtgcggctctttctcgttgtactggaaagagaaaaggaaaatcagcgcgataaccgcggcggccaccgccgggatccaccagaaggtcacccaggcctgaggcacgctctggccggccaccagatggttatacagcgcgccggagatctgcgagcccagcagcatgccgatcccgtaggtgaacatcacaatcatgctctgcgcctggccttttaccttctcgcccgccacgcggtcggtgtagataaagccaacgacaaagaaaaagtcatagcacacgccgtgcagcaaaatgcccagatagagcaggaagcgcccctcctcgctgactccgagagcgaaaaaggcgtagcggacgaaccacgccgccatgccgatgagcagcatgtatttcaccccgaggcgacggaacagcaacgggatcaccagcataaagacgatctctgacatctgaccgaacgacatcgcggtgctgacatctttgacgccggcatccgccagatacgacgcggtataggcgtaataggtgcctaacggcacggaaattaaggtggcgcagagggagaaaatcaggaaatggcgggttttcagcagcgcgaaggcgtccgcgcacagcaggtcgcgaaactgaaccggcatgcctttggccggcgccggggtgtgcggcagcgtcaggctgtagagcgccagcgcgaccgaacagagcgccgccagcgtgaagatgccggtggtatcagagataccggtcaccccgatgcagatcccggcgataatccagccgatggtgccgaacacgcggaccaccgggaaggttttatcgacattggccaggctgtggaaggcgatattgttggtcagcgccagggtcggcatatagcacagcgtatagccgaacagcaggccaatcagcagggcgccgttctgcgccaccagcgcctgcgggacaaaccacaggatcgccgccccggccaggtgcatcaccgccatcaccttctgcgaggcgaaaaagcgatccaccagcatccccagcacaaagggagacaagattgaggcgatcggcccggcggagaacgcatcgccgatcagcaatgacatctcatagcgggtcatcaccagccccagggtcaccgaccagctgccccagataaaaaactgcataaacatcattaacgacagccgcggcaccagaaaacggtggctcacgcgaacactttcccgaccttctgttgttgtgaccatgttgctcgccctcagaaaagtaatcgattacaaaaccactcaaaacaaaagtaatcgattacaaaaagaagatcgccaggcaaatgcgccgcctgcgaagaggatcacaataaaaaggcaggcagccccgccggacggcggggcatctcgcttacgccgggcggcgcagcagtttgaaggcgataaacaggaacaggatccacaccggcagcaggatcgccgacagacgcatgccgtcgatagtgcacatcagcgccaggatcagcccaaggaaagcaatgcagaagtagttgctggcgggcgccagcagcgctttgaacttcgattcgcgccctttgcggcgctgggcggcgcggaacttcaggtgcgccatacagatcatgatccagttcagcagcaacgtcgccaccaccagggccatcagcagccccagcgcttcatgcggcagcaggtagttcagcaccaccaccagcgaagtgataattccggagagcagcagggagttcaccggcacgccgcgcttgctgacgcgggcgagaaatttcggcgcattaccctgcaccgacaggccgaacagcatccggctgttggagtacacgccgctgttatacaccgacagcgaggccaccagaatgacgaagttcagcgcggaggccaccaggttgctgtccagattatggaaaatcatcacaaacgggctgctgtcggatttgatctccacccacgggtagagcgccagcagcaccaccagcgaaccgatatagaacagcaggatacgatagaccacctgattgaccgctttgggaatgctcttttccgggttttgcgcttcggcggcggtgatgccgataagctccagcccgccgaaggagaacatgatcaccgccagcgacagaataagtccgtgccagccggtggcgaggaagccgccgtgtttccacagattgtcgaacccggctttgctgccgccgtggccgccgaacagcatccacaggccgaaggcaatcatgccgataatcgccagcaccttgatcagcgcgaaccagaactccgcttcgccatacaagcgtacgttgaccaggttgacggcgttaataatgatgaagaaagccgccgcccaaacccaagtgggcacgtcgggaagccagtactgcatatagatcccggcggcggtcagctccgccatccctaccagcacgaacatcacccagtagttccagccggagagaaagccggcgaacggcccccagtacttataggcaaagtgggcaaaggaaccggatactggctcttccaccaccatttcgcccagctggcgcatgatcagaaaagcgacaatcccggccacggcgtagcccagtaagaccgccgggccggccatttgaatcgcgggaccaatgccgagaaacaggccggtgccaatcgcgccgccaagggcgataagttgaatatgtcggttctgtaaaccgcgatgaagcgtcgggccgctctcttctacggcatccgacgacgttgacgcgtctttcacgtcgttcccctgtgtgtttttgcgaaggggcaccttttatcacttaggggggattgtcgcaagttgcgtggggcgagcgtcagccgcccgccccgctttttttagcgtcagaagtcgtagctcattgagacgcggacggtacgcggatcgccttcgaacaggtaagtaccggtatcgtcaatgccagaccagtacttctcgttggtcacgttggtcaccccgacgcgccagatcatttcgttctggtcggcgttcagacgcatacgatagcgcaggcctaaatccagggtggtgtagctatccagcttcttggtattggccgcatcggcatactgcgagccgctatgattgacgcgcgcggtggcggtcaggccttccaccggcttgatgtcatattcggcgccgagtaccgcgtagaagttagccaccccgatggcatctttaccgtcggttgcgccttcagcggttttagtctgtttggcatccagccagacggtactggcgttaagacgcagtcccagcatcggctcgccaaagacgttcatctctacgccgcggttacgctgctcgccatcgaggccgtaattgccagcggtatcggaaatggcgttcggttttttgatttcaaacagcgccagcgatcctccgatcgtaccgtagtcgatcttgacgcccacttcgtcctgcttcgagtgcgcgatcccggtactctgcccggcattggccgccgtcgtcggcgccacagagcccggctgcagcgcttcggtatggttagcatacagcgacagctgctcccacggcttgtacaccaggccaaacgtcggcatccagcggctttgggtataacgcgaagaggtatcttccagcccggtggcgttgctgtagttgcgcacaaccactttctgatgacgagcggcggcggtaaacagcactttatcgttaaagaagccgagggtatcactcagcagccagccctgcgtacggctgcgcgaggtgaccagcggatcgtggtagttgccgccaaaataggcgttatccggcatcgccacatcatggttgtcaaagatattagtggtcgggtttctggccgacatccgccaggcggtcgcatcggtatgcacctgcgccgcatagccgaggttcaccttatgcgaaatcgcgccggtattgaaatcgccgcgtaccccgcccatgccgctgatcgcgtcgataatgcggttagtatccaggcggcccaccgtcgcatcgccgtttttattcagaagcttcggcgcgctgtaggtaccaatttcatgcgaatgctggccgccgagggcgctgtataccgtccagctatcggtcaggtcatattctgccttcgccatgccgaactcgctttcaatatcgctatagccccacttctggctgtagtttttgctgttgtccggcagcgccggaacgaaatccacgccgctgatattgacgcccatcgtaccgccgtggaacgttttcttctgatagccgaaatcgagcgaggagcgtaaacggtcgccgcggtaatcaagccccagcgaagccagcgtggtacggcgtttatcattatcgatagcgccttcaccctcgcggtgcaccaggttgacccgggcgccgaactggttgttgtcgccgaaacggcgccccaggtcgagggtgccgcccacctgagaatcagaggtatagtcgacgccaacgcgtgcggtcggcagatcttccgcccgcttcggctcgaggttaatcatcccgccgacgccgctgctggccgcgccgttaagcaggctgttagcccctttgaaaatttcaacgcgctccagcatctgggtgtccatcacctgacgcggcaccacgcccgccaggccgcccatcgtcatgtcatcgccatcgagcttaaacccgcggattcgataggtctcggcgaaattgccgtagccctgtacggcctgcacgccagcgtcgttactgacgacatcggcgatagttttcgcctgctgatcctgaatcagcttcgaggtatagccgatgacgttaaacgggacgtccatcgctttttgttcgccaagcatccccagacggccgccgtgggcgatctggccatcgaggaatgccggaaccaccaggtcgccgccggatttaaaatcgctggtttcgttagcctcgacgatgagggtctcttcgccaggctgcttcgcggcggcagcgtccgcggccatcgccgtttgactggcggcgccgatggctaaggccagcagcgttttacgcagcgggaaggatgaatagtgcgtggtgtgcataatttgccccatggatgaggataaatgaatcaaagggcccgtcgccggacccgttatttttattgcgcgttcaggtcgatacgtacgacgctgtccgggcctttagtggagtggtctttattgaagggctgtttgacggtgacaaacagcgtctgaccatcggcggaaagcagcaggctgttgggattggccggcagcgcccagcttttcttcagcgtgtagcggctggcgtcaaggctgatgaccttgccggattcacgctgtgaaatataaatttcgtggcgtttcttattgaactgcaccgccagcgaatcgccgacgtcgagctgtttaagcagcttgccgctgtggatatccagcaccagagtggttttcgctttcgagttgtcggtcacgaacagacggccggtgtcgctatcttcggccatattaagcagcagcgccggcttgtcgcccagcggcttccagcgctgttcaatgcgttggttacgcgggttgatcaccagaatttcaccgctgccgttagcggcgtacacgcgaccggtttgcgcggagtagtgcaggccggtcatccacttaccggtatttttaatccgcgttttcagcttcagggtagtggcgtcaaccacccagatttgcgccgggtcggcgaccgcgccaacgtagagagtattattcagcaacagcagctgacgggccccataagggcgacctttttcattgcgctcgctgaacagcaggcggttttttaccttgccggtggcggtgtcgatagcgctgatgccgccgtccagcgaattgctgacatacagcgttttaccctccgcagagagctgtaaagcgaagtttttcagatcggtatgcgtcaggccgatggtattgagggtgtgcggatccagtgtgtagaccgccccaccctgcacatttttaaagccttcggcgctggcgacgtacagcgcatcaccctgcgggcttaacgccatctcgtacagcccttccgctagctggcgctgcagcggttgcgccacgttagggactggcgagtcgacaaccggttgggaaacggcagaggaatgaggcgtcgcgcagccgcttaacgccgcgctgatggccagcgtcaacgccggaagtgtgtatttcattggatcaaccctataaaaaatcaatgacccgatggacgcgcagcggccgatattgtgtgtttccagcctgctgtctttacgtcaccctacgccttcgcgactcttagtgaacgactcactggcgcagctcgaaccttgccaaaattacgaatgaaaaagagaatgagaaccatactcattatctaatgtcaaacaagtcctggcgggcaaaaaagataatctgctgattttttttacggcaatggcggattaggaggggaagaaaggatccgtgacgggaaaagcgtcccggaagcgatgccgtgcaccgcccgggttgcgggccagaaggcacacaatgtgttgcctatctggcgcaaagcgacacatgacagcgctatgtcgctgaacggcgattaatatcgcaccatcaccgacttcagctccgtataatcatcgataaacgcgctgccgaattcgcgcccgatgcccgagcccttcatgccgccgaacggtaccgccgggtctaggaaggtatgcatattgacccatacgatgccggcctcaatcgcctccgagtagcgtagcgcctgacgaatattatccgaccagacgctggccgccaggccatacggtgaggcattcatccgcgccagcgcctcttcttcactgcgatagccgataaaactgcacaccggaccgaaggtctcctcccgcatcagggtgctctcttcgctgcgcactttgaccgcggtcggctgcaggaaatagccctcccccggcagcgcttcgccgccgcagacgatggtatcgccctcgtcgcgggcggtctgaatgagccgcaaaactttgtcatactgctggcggttggccagcggccccatcagcgtccgttcatccagcggcgaccccggcgcaaaagcgctgagcttgtctttcagcagcgccagtaccgcatccagttttccctgcggcagataaaaacgttccgcagcggcgcaaatctgcccctggttcaggtagccagcttcaataatgccgttgaccatcgcctccggcgtcaggtcatcgaggaacagcgcggcgtttttcccccccagctcaagggtcacccgtttacctgacgcactggccgactgctgaactttttcaccggtggccaccgagccggtgaagctcaccttggcgcaggccggatgcgtaatcagccgctgggcaatctcgccgccggcgccgttgaccacgttaatcaccccatccgggatacccaccgcttttgccagctccgccacgcgcagcagcgtcagcggcgtatattcgctcggcttgaggacgatggtgcagccgcagaccagggccgccgccagcttccagatggcaatcatgatggagaagttccacggcacgatgccaaccaccaccccaagcggctggcggcgggtaaaggcggtatatttctccccggccatcgatggcagcgagacatccagcgtttcaccggtgactttccccgcccagccggcgaagaagcgcaggaacgccaccgactggtccagctcgagcatccgcgccagcgtgatagttttgccggaacagagactttccagctgcgccagcgcttcgcgatgctctgccagcgtgtccgccagcttcagcagcagcgcgccgcgcgccagcgtcggcatctcgcgccactgactaaacgcctggcgggcgctctccatagcgcgatccgcctggtcactatccgccgcggtgaccgcggcaatcgcccgcccggtcgccgggttgatcaccgcgaacggcgcgccgcggcccgcctcacgttgaccggcaataaactgcccgtgcggctggcgtaagaaagcggtcacttccgccagtaaggttatctcgctcatcgtcagcacccgtttttcagcaaagttaacccatcacagcacggcttcccgccgcagcctatcgttctaaagaacgtcattcttccggacgatattcaacgcccgcgcggcgtgctgtgatgagggtcttgagccaggcaagaccacagggtaacgcgatgaacatcaagatcgatgcgctgaactactacggcgcgacgaagaaatatcacctccatttcccggcgctacgggaagatattgaagccgatgtggtaattatcggcggcggcttctctggcattaacaccgcccttgagctggcggaacaggggatcaccaacgtggtggtgctggaggcgcgccatctcggctacggcggcaccgggcgcaacggcggccaggtgatggccggtatcggccacgatatcgaagcggtaaaaaagcacgtcggcaaagaggggctggagacgctgtttaaaatcgccaacctcggcgcgggcatcattcgcgaacgcatccgcaaatacaacatcgacgccgatttcgtgcccggctacggctatctcgcctataaccagcgacagcttaaaacgctgcgccagtgggagaaggagtttaaagccgctaccccggatgaagagatcgaactgtataccggaaaagaggtgcagcaggtggtgggctccgaggtctactgcggcgcgctgaaacatatgggcggcggccagatccattcactcaatatgctgctcggttcggcgcaggccgcccactcgctgggggtgaagattttcgaatcctcaccggtagtggaagtgaattacggcaaacaggtacaagtgcgcaccgcgatgggcagcgtcaaagccgccaaactgctgtgggcctgcgacagtttcctcaacaatatggagccggagatctacaacaagacgctggtcacttactcctaccaggtgtcgaccgagccgctctccgatgaactgatcgagcgcatcagcccgctacgcggcgccttcagcgatattcgcccggtaattaactactaccgcgtcacccgggaaaaccgcctgctgttcggcagcgccacccgctttgtggagtatacgccgaacgatttcgccgcctggaatcgcaccttgctggcggaggtcttcccctatctcagggatgtgaagatcgattttgcgtggggcgggccgatggcctgtagcgccaatctgttcccgcagatcggcaccctacgcgatcacaacaacgtcttttacgtccaggggtactccggcttcggcgtcaccccgtcgcacatcgtgtgcaaaatcctcgccgaagggatcaacggcggttccgaccgctatcgcctgctgagcagcatcccccacgcgaccatccacggtcgtgacagcctgcgtctgttattagtcacggccggaaaactgatgcatcaaaccgccggtttctggaaaggccggagttaaccaggagaacgctatgcacgcttttaaacttaaacacccggtacctgatctgcagccgatcggcagcgtcagcctgctcggcgcgacgccgaccgccggcgacccgcaggtagcgggcgcgatgatctacggcgagccgcaggacgcctttacctgcggactgttttcgtccactgaggggagctttaccatgacctatccgtttaccgagcacgccaccgtgctggagggcgaagtggagctgaccgtcgccggcggcgagccgcagcgctttgcgccgggcgacagctggtttgttaaacagggcaccgaagtggagtggaaaattctgacgccgcgctttgtgaagcactacctggcgaacgtcgagacccgctaacaaactgataatgcccggcggcgcattacgccttctccgggctaccaaatcgcgcagcgctgtagccccggtaagcggcagcgccaccggggggtttgaggccgccaacaccggcagtttcagtcagcatggtgaataaattaaaggcaggccgcacggaccgtaggccggataaggcgcagccgccatccggcagaaacaggcgcaacgtggcaagacggatggccccggttttcggggtcatattgtttatccgccgcgacattcatcgactgcgtcacagaatcatgcgccgccctccaccttccggacgatattcgttgagcaggatgcccgcctaaattatgactatccgggagtggcgctggctattccctgccctaccccattattgtgcagaggttgactatgtttagtaacagactcgccagccatcttgagcgcggcgtcgtcggcttcccgaccaccctcgccagctccgtcgggctgatcatggccagcccggtgatcctgacggtcaccagcggcttcggcatgggcggtgataccttcgcgctggcggtgctgctggcctttattatgatgcaggcgcaggtcaccacctttgccgaggcggcgacgctcattcccaccaccggttcggtgtacgactatatctcctgcggcatgggccgcttcttcgctatcaccggcgcgctgtgcgcctacttgatcgtccatatcttcgccgggacggcggagacgatcctggcgggcattatggcgctggtgaacttcgagtcgattaacgcccagatggccgctcaccagaatacctggatggtgggcgtcggcatggtggtgattttcggcttgctcaacgccatcggcgtggaaatcttcggcaaggtcgaagtgatgctgaccttcggcatgtggaccacgctgaccattttcggcctgtgcggcatttttatggcgccggtgactcatctttccggctggttcggcacgccgctgaacgttagcgatatcaacggcctgttcggctatatcggcatggcgatgtttatgttcgtcggttgcgaactggtgacgccgatggcgccggagatcaaacaggcccaccgcaccataccgcgggcgatggcgctgggcctgctgggggtcgccagctgcatgtttatctacggcgcggcgatcaaccgccaggtggagaataccgtgctcgacgcggccaacaacgtccatctgctggatacaccgatggcgatcccggccttcgccgaacgggtgatgggccacgccggccagtactggctgggggtcgggctactgttggccggctgcgccaccatcaatacgctgatggccgccgtgccgcgtattatctacggcatggcgctggacggcgcgctgccccgtttcctgacctggctgcatccgcgctttaagacgccggtgatcgccattgccatcggggtggcgatcccctgcctgcacgcctggtatctgaacggcgatctggaccgcatcgtgccgctgatcctcgccgcggtctgcgcctggggcgtcgcctatctgctggttactctgtcggtggtgatgctgcgcattcgccgcccggacctgccgcgcgcctaccgctcgccgtggttcccgctgccgcagattatctccagcgtcgggatcatcatcgctatcgtcaatatcacgccgcccgggatggacagccgccaggtgctggtgccgttcggcataatgctcggcctgaccgccgcttacgccctgttctggacggtgtgcgtgcagcgcgtcaatccgttcaagccgctggtagtggaagaggtggtggagcgcgccatcaacaattatgaaaaacagacccgcggggagatgacgccagatgtcctccgtcccctggtttgaaacgccgttaatgaacgcggtgcagcgcgatctggcgggctggcccagtgaaaagctgagcgaacgcagcgcgctgctgcgcttgaacgacgccaccgccgtcaccttcagcgtgcgtcagaagcggctgtttatggccagcattcacagctgcgagtttgtcgtcgaggggccggtgacccggcccgctcgcggcaagatccgcgcccaccaatccggctggctaaaacgcctgccaatccgctttatcggcagtaaagagagcgcggaactcgctggctatctcaacggttttcctaatctccagcagaccttaagcgagctggactaccgccgcttttcgttgacctttgacgatagcggctggcgctgcggcattgaaccctgggccgccagcgaagtggtctgtaaaatgccgccgctgcgccgttatctgcggctggaagcccagcagcggatgctgctgctcagcgtgctggcgatgattaatcaggcggtaagtcagtggatgcgcggtgaaatcgcagaagagaaagcattgacttccccgccatcaccgcggggaagctgaggtggtttatagcaaaccaaactgctgcgccagccgatcgatggcctggcgctggaactgcgcgaacgtggcgcgcggctgctgctgttgaataaattccagcagcggatcctggacctcagtgcggatgccgctcagggcttccatcaccgccaggccgcagaacggcacgtaggattcggcgtagccgccctcgtgcaccatcaccagtttcccgccgcacaggcgatccgccgcctgctggacctgttcggtcatcgcccggaagctatcgctgtgcagctgcatccgcgctaatggatccatggcgttggcgtcatagccgcaggcgataataatcagctccggctcaaaacgcgccagcgccggaataacgatagtttccagcgcatagcgccagctgtcatcccccgccccggccaacagcggaatattgatgttgtaaccttcgcccgcgcccacgccgcgatcgtcctcgccggcgtagcccggcgggaagcagccgtcctgatgcaaggagatagtcagtacatcgtcgcgctgcaggtagatatgctgggtgccgttgccgtggtgaacatcccagtcaatgatcgccaccttgcccagccccagctgcgctttcgctcgctcgacggcaatgggaatattggcgaggaaacaaaatcccatcgactggtccggcaggcagtggtgtccgggcgggcgcgacagcgaataggcgttatccagctcccccttcagcaccgcttccaccgccgcacaggccagcccggcggaaagacaggcgatttcataactgcccggccccagcggcgcctctttgccgagcatgccgccgccgttatcgcttatcgccttgaagcgctccagatagctgtcggggtggatccgccgcaggtcctcaaggctcgccggcgccgcgctgcgcagcgccagctgcggcgtcagcccggagacatccatcaggtttttcatccgccgtttggtctctggcgattcagcatgaccgccgccggcgggcggctgtacccacccgcccaccggcagcgtcaccgcgtgcagaccggtactgtgccagaaacaacgttcatcaaagaagaaaccggtttttcttttcactctatcctcccgtgggctaagccttcccggcggcggacgccgccacaattaaaatcagtgacagcagcgcgcagacgcctgccgccgccagcagcgggtcggcgctggcgaagtgttgcagtaaggcccccgcaagcgccgggccagccgccatgccgccgccgatcaccagattgatgctgttcatcagccgaccgctgttatcgagcccggccacgcgggcgagaataaagggcagcacgaaggtccaggtgaacttaaacagcagcgccgcgatggcgtaacgcaccagcagcggctggccgatcagcagcccaacgctgacgatcaacaggccgtagcccagccacaccggtaaacgatcggcccgccgggtgccgcgcagggccgcgccgccggcgccgataatgccgcaaaccgtcgccgccgccagcaccagaccgacctgcgtcgggctcagccccgccgcgctgccgatggtgccgataaaggtccacacggcgctgaggctgatatagaaagtgagcaccgccagcacagccagcgcctgacgccacagcgccgtcgacggctgctggcgggagactgaaagcggttgaaagcgcggagggaaagcggataccagcggcaaacagcagagcatgatggcggcgaggatcagatacaccaccttcaggccaaaggtcgcgaacaggccgggcagcgccagcaggccaagcatccctaacagcagttgcccgagcacccagaaggcgtagacccgcgacgggttcggcgttccggccgcgcagctgatgcacaaaatcatcaacgtgccgcccgccagcgaggcgataaagcgcgccgccagcagcgtctcgtactgggtgaccaccgccgaggcgaggttggcggccagaaacaccaccccggccgtcagggcaacccgccgccagtcgaggcggctcatccaccaccacgccgggagcgtcgccaggctcatcgcccccagctccgctgagaacagccagccgatctgcccgggttttagctgccattcgctggccagctgcgccgccaccgccggcgcggtcatcagaatacccggcgcaatagcggcaaaaatcacgatcgccgccagcaaacgcagggacaccatcagcccggcgggccgggaaagcgcattatcagtgagaggtgtactcgacatcgtagggcgtgctccggtcaaaaaagcctccccccggaggatcctccagggagtgatacccacaggcatcaggaaaacgccgtgctgccacggcgcgcgcgggatgcgaaagtcagattacagatgcagcgtacgctgagcggccggcatccaggttcgggaaaccagttcggtacgattgaccacttcggtcttggcgaaaatattgcgcaggtgcgtttttaccgtcgagagcgagatatccagctggcgggcaatcagcttattgctggcgccttcgcgcaccatgccgacgatttcccgctctttcgccgtcaggatggcgggcagatcatcttcttcctgcaggcagtcgcgaatggccagctctaccagcggcagcaccgcctgggcccgctggcgctcttcgctggagaaaggcacgtcgcgcatcagcgagataccggcgacgatccgccgctcgcggcggataaagatctcggtcatgtcgcgcacgttattcggcaacataaattcatgatagtaatgccggttgcggtcgcagagccgcggcgtcatcgccgccacggtggtgttctggtggctaaagtgcgacggcagaagcggatccagcggctggaagttttccagatattgttggtgcgtattatcggaaatattatgcaatatatagttttcgggttttaaacgattatttactcgataaaacaccgctgaagttagtggaattaactgggaaatagtctgtaaacaacgggctattatcgcatcattacggctggcttttaacaaagcagacatgatagggcctccccgtcgagatgatggtacatgacacatggatgactactgataattgaagcatacatttcacatttaagtaacacaatcattaacatattaacaatgtgatagccgttacaaaattttcagcaatacattgttatataaagcatttaaaaaacaccccggccatgctttacgatagcggcgttaaaacataaacaaataagattaacacccggcgtacctgcccctggtgataaaaaaaccctattcccgacgcgtgattctcatcctaaagaacgatggatttttgttttttttcacttatacccttaacaggatgcaattaattttcgccgcggcttaatcatgtgattacgccagacccgctgttgccaaaataatatcaacagcaccggtcattaaccgaggataagccgatgctgaatatcgccgccctgcgccagcagcaaattccgctggccgctgagccgcgctcgccggtgccgtttcatattctgatgaagccgattggccccgcctgcaatctcgcctgccgctattgctattacccgcaggacgaaacgccggtcaacaagatggatgacgcgcggctggagcagtttatccgccgctatattgccgcccagcccgccggcgcgcgggaaatcaactttgtctggcaggggggcgagccgctgctggccggcctgagcttctacaaaaaagcgctcgccctgcaggagcgctatgcccccgacggcgtgactatcagcaacagcctgcagaccaacgggacgctgatcaacgacgcatggtgccgactgttccgcgaacatggctttattatcgggttgagcctcgaaggcaacgaagcgctgcaggactaccatcgtccggataaacgcggccggtcgacctggtcggcggcgctgcgcggcattgacctgctccatcagcatcaggtggactttaatctgctggtggtggtgcataacgagatggcggcccacgcggcggcgatttatgaccggctggtcagcctcggcgcgcgctatctgcagtttcagccgctgatgagcgaaggcgcggccctgcgcgaaggataccagctcagcgccgataactggggacgttttatggtcggcatctggcgacagtggcggaagcgctgcgatagagggcgggtgttcgttatcaatatcgaacaggcgtgggcgcagtatttcactcataccagcggcagttgcgtgcacagcgcccgctgcggcagcaacctggtgatggagcccgacggacagctctacgcctgcgaccacctgatcaacgccgaacatcggctgggccgcctcgatgagcagacgctcgccgccgcggtcgacgcctcggtgcaactgccgttcggtcagcagaaaagtctgcgccgcgaatgccagacttgctcggtaaaaatggtctgccagggcggctgcccggcgcatctcaacgccgcaggcaacaaccgcctctgcggaggctactaccgcttctttagcgacatcctcgcgccagtacgccccttttcccgcgaccttaatggcctgaaggcctggcgggccgcgtttgttgggactgcgcatactgcgtagcgccttaccctgatgatatccccctctgaacaggagagtcagtcgtgaacaaaaaagccatggccgcggcggtcagcatgatcctcgccggtggcgcgcacgccgcgcagcaggagcgtccaaacgtcatcgtgattatcgccgatgatatgggctactcggacatcagcccctttggcggcgagatccccacccccaacctgcaggcgatggccgagcagggaatgcgcatgagccagtattacacctcgccgatgtcggccccggcgcgctcaatgctgctcaccggcaacagtaaccagcaggctgggatgggcggcatgtggtggtacgacagcaccattggcaaggaaggctacgagctgcggttgaccgaccgcgtcaccaccatggccgagcgctttaaagacgcggggtataacaccctgatggccggtaaatggcacctcggttttgttcccggcgccacgccgaaagatcgcggctttaatcacgccttcgcctttatgggcggcggcaccagccactttaacgacgcgataccgctggggaccgttgaagccttccacacctactacacccgcgacggcgagcgcgtctccctaccggatgatttttactccagcgaagcctacgcccgccagatgaacagctggattaaagcgacgccgaaggaacagccggtcttcgcctggctggccttcaccgcccctcatgatcccctgcaggcgccggacgagtggattaagcgcttcaaaggccagtatgagcagggttacgcagaggtctatcgccagcgcatcgcccgcctgaaagcgctgggaattatgcatgacgataccccgctgccgcatctggagctggataaagagtgggaggcgctaacgccagagcagcagaaatatacggcgaaagtgatgcaggtgtatgcggcgatgatcgccaatatggacgcgcaaatcggcaccctgatggagacgctgaaacaaaccgggcgcgataaaaataccctgctggtctttttaaccgataacggcgccaacccggcgcagggtttctactacgaatctaccccggaattctggaagcagttcgataacagctatgacaacgtcggccgcaaaggatcatttgtctcctacggcccgcactgggccaacgtcagcaacgccccctacgccaattatcacaaaaccaccagcgcccagggcggcatcaataccgactttatgatctccggtcccgggatcacccgccacggtaaaatcgacgcctcgacgatggcggtgtatgacgtggcgccgacgctatatgaattcgccggcatcgatccgaacaagtcgctggcgaaaaagccggtgttgccgatgatcggcgtcagctttaagcgctatctcaccggcgaagtacaggagccgccgcgcggcaactacggggttgaactgcatcatcaggcggcctgggtcgatggcgaatggaagctgcgacggctggtgccgcgcggcctcaccgccggcgacgcgccgtggcagctgtttaatctgcacgacgacccgctggagacgcatgatgtcgcggccgaacatcccgatcgggtcaaagccatgagcgaggcctacgaggcatttgctaagcgcaccatggtcacccgggcacagggcaagatgatcgactacgtcggcatcgacagcaaaaccgggcgctatctggcagtcgaccccgccaccatgaagccggtgcctgcgccgcaggcgatccctgtgagcgagatccattaaccaccacggctatcgttcttccgggcgatagccgggacctgacgcgctttttaaggtaatcggaaaccccattacaggagagtgcggatggcgagagtcgtggtaattaccggcggtggaaccggaattggcgccgcctgcgcgcggctgatgcgcgccgcgggcgaccgggtgtttattaccggacggcgcgaagcgccgctgcaggctgtcgccaatgagaccggcgccacggcgctggtgggcgatgccgccgacggcgaggtgtggcgccagcggctgctgccggccatcctcgaccagaccggcgggattgatgtcctcatctgcagcgccggcgggatgggcaacagccccgccgccgagaccagcgaccgccaatggcgcgaggcgctggacggcaatctcaccagcgccttcgccagcgttcgcgcctgtctgccttcgctgattgcccgccgcggcaatgtgctgtttgtcgcctccatcgcctctctggccgccgggccgcaggcctgcggctacgtcaccgccaaacacgctttaatcggcctgatgcgctccgtcgcccgcgattatggcccccagggggtacgcgctaacgccgtctgtcccggctgggtcacgacgccgatggcggatgaagagatgcacccgctgatgcaggcggaagggctgtcgctgactgaggcttatcagcgggtgtgccgcgacgttccgctgcgccgccccgccagccccgaggagatagccgaggcctgtcagtttctctgttcaccgcaggccgccatcatcagcggcgctacgctggtcgccgacggcggggccagtatcgtcgatgttcccactctggcgtttgcctaacgccctactctgttcaggagccctatgacttcagaagccgtatttatccaggtcggcgcgctggccgatggttttgcgccgcacggtaacctgctggctaccgccagcctgcccgcaggcgaaaactttaccttttatgtcgccgggagcgagccgcaacagctggttatcgaagatgagcagacgctaagctggaacggcaagcgcgccccctggcgggcgaccgccctgcgcccggacattctgtttatcgacttccttgacccggagcgggatagcgccagcattagcgcggtatgcaacctgacgcagcgcaatgccacgctggtatacggccagctaccggacgaagccgccgcgcggctggacgccttcagccgggtagaacaagggttgccgctgaccgcggttgaggtccgtttcgtcttcgcccgcctggatgcccagccggggccgttgccgggctttaccaccgcgctggtcggcatgcgcaatcagtacacctatagcccgaccgagcgctatgagcacatctatctcaacgataatttttacgcctggcagtgtctggacggcgtggaaaaggggctggcggatgtcgatcgctgccactatgtgcaggtggcggaggatctctatttgttcgtctggcgggagaaaatcattcccacgctgggggtgatcctcatcgatctgcagcagatgcgcactgacggcaagatcatgggctatcagggcagcgatttcggcgccctcagcaatttcccggtcggcgccagcgcgaagatcctcaacgtcacccgccatcaggaatagtagggcgccgccgggcacgctttcaggcaccgcacccgtcatttcgccgggtggcggctgcgccttacccggcctacggtccgtagcagccagccgttaacttacccactagtgcgactgaaactgccggtgttgcggcctcaacatcgctgagacgttcccggaaggccggggcagcccgcatggatgcgggctgagggccgtgttttgcacggacgctgcctcggcccgacccgaagcctgcagggataagtcgaaggtaccgcgcagcggcgatgttgctggccggagcccgggggtacagggggcggcggcgactggccgccccctgtgcgctccctgcaccatgactgccataacgcagacaattaaccgggagcgcaatcggcccggaagtaacatagaagctgtagccctgctaagcgcagcgcgaacagggacatttccggttgcgccgttattttgccgggtggcggctggcgccttacccggcctacggtccgcgtcatgtttagccttcccccctctccccgccgggaagagggattgcctcaggcgctggcgccgtccagccgcgccacttgctccgcgctcaggctcagcgccgccgcgcgggcaaaactctccacctgagccacgctggtggcgctggcgatcggcgcggtccccccttcgcggccgatcagccacgccagggccacctcagccggcttcgcgccctgctcgtccgcgaccgccgccagggtatcgataatccgcatcccccgcggattcaggtacttaccaatcccgcttccgcgctggctctgtgtcagatccgacggctggcggtacttaccggttaagaaccccgaggccaggctgtagtaggtcaccaccccgatatcgcggctgacgcagagatcgcacagcgcgccttcaaacgcagagcggtggtagaggttatattccggctgcagcacctgccacgcaggcaagccgcccttacgcgccacctccagcgcccccgccagctgcatcgcatcgaggttagaggcccccatcgcgcggatttttccggcctgctgcaggctgtggaaggcctccagcgtttccgccaccggggtttgcggatccggccagtgggagaagtagaggtcgatataatcggtattcaggcgacgcagagagtcgtcaaccgcctgttggatccaggctttgctgagccctttatggccggggaggccgagatcggagccgactttggtgaaaattttgactttatcacgcatgccggggcgcgcctgtagccagcggccgattatggtttcagattcgccgccctggttgccctccgcccagcgggaataaacatccgccgtatcgatagcgtcaaaaccgtggtcaacgaaagcatcaagaagagcaaaactggttttttcatcgatggtccagccaaagacgttgccgccaaagactaatggggcgatggaaaatccggttttgcccaaaggacgtgtcatcatgccgagtactccttagcttatattctgcttccctcaggtaaccacaggggtcaggagaggaggtcgattggataatcagaaaaggaatcttacggcgggcgctccacgcccgcaggtacactctgacattatgtcccggaataaacatcaaagctaaaatatttgccagctaattttttataggtgccgtcggcaagaatcttcgcaatcgcgccgttaatttcctgacgcagcgcctcatcgtctttacgcaaacctatcgccgccccggcgccaaacagcgtatcgtcctgcagatggccgccgacaaaggcgaattctttaccctgcggctgctgcaggaagctgtagtcggccatcatcccggagagcaccgcgccgtcgatgcgccccgactccaggtcacgcaccacgctatcggccccctggtaggccacaatgtttatcccctgcggccgccagtgctggttaacatacgtctcctgcgccgagccctgctccacgccgatggttttgcccttcagctgttccggcgtattgccttgcagggtatttttacgcgccacgaggaacaccggcccgttatacaacttgtcgctaaaggcaatctgcgctttgcgcttctcggtcatatacatcccggaaaggatcgcgtcgaatttacgcgccttcagcgccgggataatgccgtcgaaattgctttccacccacacgcatttcgcctgcagctgctgacaaatggcgttgcctaaatcgatatcaaaccccgccagcttgccctgcggatctttccattcaaacggcgcgaaagtcgggtcaacgccgaagcggatctcctttcccccttcggccagcgccgacgtcgacgccattaatgccagccatagcaacagtgattttttcattcgcgttcttctccagagattagcgacagtgtttttccaccagacgggcgaacagcgtcgcgccgatggtgataatgtcatcgttaaagtcgtagccggggttgtgcaccatgcaaccgcccttctctcctttctcgccattgccgagcaggaagtagctgcccgggcgttcgcgcagcataaaagcgaaatcctcgctggcgttcatcggcgagaccgactccaggaccccttcgcggccaaacacctccagcgccagcgcccgggcgaaatcggtctcttcaggactgttggttaataccggataggagtcgtaaacctccactacgctgctggcgccatagcttttggcggtaaagtcagcgagctcgtgaatacgcttgatcagcaggtcgcggatttccggcttcatcgcccgcacgctcagctccatcaccgcgctctccggaatgacgttggaggcgataccggcctggaaggtgccgacgctgaccactgccgtttcccccggcggcacgttgcgcgccacaatgctctgcagggccatcaccagcgccgcaccggcgacgatcgggtcgacggtgcgctcggggtgggcgccgtggccgccgtagccggtaatcgtgattttgacggtgtccgccgaggccatgaagttgccggcgtagaagcccagcttgcctacaggcaggcctggcatgttgtgcaagccaaagatgcgttcgcaggggaactgctcgaacaggccgtctttaatcattaaatccgcgccgccgatagcctcttccgccggctgaaaaatcagatgcaccgtgccgttgaactgacaggccggcgaggcgatatatttcgccgccgccagcagaatggtggtgtgaccgtcatggccgcaggcgtgcatttttcctggcgccgtgctggcccagggtaaaccggtggtttcctcgatcggcagggcatccatatcggcgcgtaaaccgatggtgcgcggagaatcgcctttgctcaggctgccgaccacgccggtcttgccgagaccgcgcgtcacctgatagccccattccgtcagcttgctggcgaccagttcgctggtattaaactcttcaagacttaattccggattggcatgtaaataatgacggatagaaatcatttccgcttccgtcgctttaatttctggaattacataatcactcatgccgctctccgggaaataaattaaggacttatcacggtatcgcgatgaaaagtttatgcaagcagcatttctaatacctggaatggacgcatcttatttaataattcactcatcacagcgcaatgaataataaaaatagtgcaattaaaaaataaaagtttatttttttgaggatttcccgttatttaccctaccctgcacggccacatccagcgttatataaaataaacgggcaggcaattacagaggcttttccttctcgcaatcgttgcgctggcgggctgcagcgcgccgatcgccgccgcttccagcggcgtggcgtcagataccgcctcgttgtcctcgaaggtcaacgtttatcatctgaccgaaaaagaactgtccacccaggcaacgatcaatggttataaatactggccggatgctgcgctggatccgtagctttccgcgagtgcgccatcgccggatcaggcttttcctgacccggcgtcgcggagcagcgcatttagtggccgagggcgccgctcaccagaatcgaggtgatgatcccggtcgccgcggcgatcagcacatagttaccgtcgatataggaccagtgatggccttccggcgggggcggcaggccgcggtcgctccagtcgcggacgcgatattcatcgccacggaacggcgccggagccgggtggcctttgcggaaatcgttcccgcgccaggcgaaatggtcctgctcatgacgtgccagatcgcgtttgtcatggccgtcgcgatccgggccacgctggtcatggtcgccctgatgatgcgcgtcaggtccgccctgcggtgcatgcccgtcatggtccggaccgttctgccacaccgtgggttgccccggacgatggccgtcgttcgggccatcggcaaaggccgggacgctcagcacacaggataaaattactgccagagaaatcatctttttcatggtacacctcctgattcagctcctttgtaccgggcaaatgtgaagaaagagtgagtaactggttaaccaggacgattcctggcatcggcagttgctgtgctgcgcaacagccaggctgcgggaggaaggacaataaaaaaggccgctttcgcgacctttattcagacaggttaaaggacttattcagtcactttattttttaattcttcggcgccggttttggttttatcccagcccttttccgcaccggatttggtggcattccagcctttttcactgacctctttggtcttatcccaccccttctcggtgccttctttggtcttgttccaggttttctgcgcgccttcgctcacctggctgccgacgctgtcctgcttgccttcggcggcgtgtttcgccttcagctgctgctcttcgccctcgtgctgggcctgatgcagcttctctttagcggtgttggcgttggcattcgccgccgcgacggtatcatctgttgcatgtgttgtcgcagcaaaaaccggagccgcaaccagaatagccgataacgcaatcattgcttttttcataatatcctctctcacgtgtcgtgttatgagtcgcattcaggatggcacaacgaaccggggatgacattaggaattagcctgaaaaacgtcttcgacctccagccttggcagaaaatgctgccgccgcgcgcgccctgtcggcgttggcataatttccaacatgtttgttacattttatgaaatttgcccttgatatacttgccgttgacgtttactcgagaataattctcagaatcattatatttataaattggcaaacggaactcattttatggcaagaaaatcagtaagatcgctgttacttactgcgctgctcgcgacgcccctcctcagctatgcaacccaatatcccctgacggtcacggaccttgacggccggcaggtcaccctcgccaaagagccgcagcgtattattttgcaggatggtcgcgacattatgaccctcgccctgctggaccgggacaatccgtttaaacggctggtggcatggaataatctggcgaaaaagcaggatgttgccacctggcagatgctgaaaacgacgtggccgcagtcggccacgatccttgacatgggcttcagcgataaagggaacgtcgatcttgaaagcgtcatcgcccgtcagccggatctgatgatcgcccagctgcgcgccaggccagcgctgatggagagcggcgtcatcgacaagctcagcgccctgcacgttccggtgctgtttgtcgactatgagatcgacccggcgaaagataccgcccccagcatcgacctgctgggcaaagtccttaaccgcgagagccaggccaaagcctttaccgattactatcgtcagcagctgcagacgattcgccagaaaaccgcggccatcacgccgaaggccaacgtcttcgtggaagcgctggccggcaacagcgacgcctgctgctttactcatggccacagcggctggggcgggctggtagaggcggtcggggcgaacaatatcggttcgcagctgctgccgggcgcctccgggttcgtctcgctggagaaaatcatcagcatgaagcccgacgcctggatcatgaccggctcgaagcgcggcaacagccaggtgctgcccctgggttatgcggttaagccagaggcggtgaaggcccaggcgcagacgctgctggcgcggcctggggtcagccagatcccggcggtacaggaaaagcgggcctatggcgtttatcaccacttctataaccacccgtggaatattgtcggcatggaatacctggcgaaagatatctacccgcaggctttcggcgatctcaacccggatgagacgtaccattatatcgtgcgccatttcaccgacctgccggaccagccgttcgtcttctcctggcagcagagcgagtaatccggcatgcgtttaacctccgactccgtgctcgacgggctgcccgccgggacctctggcgtgatgaatgattatcgccgtatcgtgcgtcgccgtctgctgctgatcctcctgctggcgctgttgattgtcgcgtcgctgctgctcgattttatgctcggcccctccggtctgccgctgcagaacctgtggcagacgttaaccgatccggccagcgccgatccgggcacgcgcgccatcgtctgggatatccgtctgccctatgcggtgatggcgattatcgtcggtctggcgctgggactggccggcgccgaaatgcagaccatcctcaataacccgctggccagcccgtttaccctcggcgtctcctcggctgcggcgtttggcgccgcgctggcgattgtgctcggtattggcctgcccggtattcccggccagtggtttatctcggccaacgcctttatcttcgccctgctggctgccctgctgctggacggcatcacccgctggacccaggtggccacctccggcgtcattctgttcggcatcgcgctggtctttacctttaacgctctggtctcgatgctgcagttcatcgccaacgaagacacgctgcaggggctggtgttctggaccatgggcagcatcgatcgcgcctcctggagcaaagtcgccatcctgttggtcgccctggcgctggtgatgcccctgtcgctgcgcagcgcgtggaagctgaccgccctgcggttgggcgaggaccgggccatcagctttggcattaacgttcgccgtctgcgcctgaccacgctgctgcggatcagcattctgtcggcgctttcggtggcctttgtcgggccaatcggctttatcggcctggtggcgccgcatattgcgcggatgctcttcggcgaagaccatcgcttttacctgcccgccagcgcgctgatcggcgccctggtgctctccctggcctccatcgcctcgaaaaacctgatccacggggccattattccggtggggatcgtcacttccctggtcggggtcccgttctttttgagcatcattttacgtcatcgggggcaggtatgagcgaccagacattatccgggctgtcgctgtctcacttcagcgccggctaccccagacgcaaggtgatcgagaacctgacggttccccatctgccgcgagggaaaatcaccgcgctgctggggccaaacggcagcggtaaatcaacgttaatgcgggcgatggcgggtctgggcccctgccgcggcgagctgctgctggagggggaaaatctgctgacgcagccgttctcacgtcgcgcagagcaggtggtctatcttccgcagacgctgcccgccggcgtgcatctgcatgtgctggagtcgataatcgttgcccagcgcgccgccggaggacgccacagtccgcagcgccaggaggaggtgatggcgctgctgcgacagctggggattgcccatctggcgatgagctacctcgatcagctctccggcgggcaaaagcagctggtgggtctcgcccagtcgctgatccgccagccgcgcctgctgctgctcgacgaaccgctcagcgcccttgacctcaactaccagtttcacgtgatggatctggtgcgccgggagacccggcggcgcaacatcgtgaccctggtggtggtgcacgacatcaatattgccctgcgtcacgccgaccacgtgctgatgctcaaggcgggccagctgctcggcgacggcaccccggccgcggtcatcacccccgagactctggcggccgtctatggggtgcgcgggcgtattgaaccctgttcgcagggggtgcggcaggtgattattgacggcctggtggacagcgaggcctgaccgcggcgcggggcggttcgtccgccccgcgcccgccggcttagtgatcgagatagatatagttttcccagcttttcatgcggatcaggatcttcctgatcagcgacagctctttcaggtgatccgagtagaccgccgcctcgagggtggccccctgcggcagagcgtattcggcaaaacgcggatcggtcaccttcagcaccaccagcgcccggccatgggtattgagcgcgtctgtggtcagcagtttgccctgcccctggaactggctctcgccaatcgccggcagcacgtcggccacttctccgcgaaagacggtgcccgggatagccggaaacatcagctccgcgggctcgcctttgtgcagacgctgcagggcgttctggcgaaatgccgcgacgtactcccgcgaggcggcgccctccaccggcacaaaggtcatcagcgggatcatccccagcgcagtggacatggtgcccggccgtaagccgacggtactgacatagccatcctccggggcgcggacgacggtgttctccagctgaaactgcgccttttgcagctgcgccagcagggaggccacggtggtgtttttgcccttcaccaccgagtccagcgcattacgcgcctgaaccacctttgcctgagccgcgctgacgctggcttcatcggctttccacgtctgcagacgggtatcaaccatttgatcggagaaggcgccctgggcatggccctcccgatagcgggcatactcccgccgcgactggtcgcgctgggccaccgcacggctcagctcggcctgcgcctggcttaacgccgcgtttaaggagagcgcatcctgactggctgcttttatctgcgcctgcagatcgtccactttcgcctggaagggcgtcgggtcgagggtaaacagcacatcgcccttatgcagcatctggttaggcttcaccggtacgctctgcacccggccgcgtacctgcgacacaatcggcacggtgcgaaacacctggttaccgacgtcggtataagggaagttgtagttcatcccgaagatcaccgcgccaatcagggcgataccgccgagcaccgccgtcggtacggtccacttattgagcgggatgcgaaaaactttaaacaccacgatgcatagcgcggcgtaggtcagcaacattaacgtttccattattttgcctccttcgctttcagaacgtccacctcgcgctggacctgttccagctgctggaccaccgtttccagacgctgatgcagcgcctgctgctcgtcggcaatgtggcgcatcccccatccgcggtcttcgcgccacagcgtcgcccagatccataacaagggccacagcgcgtggagggtaaataagctgacccaaccggcataatgaatcgcatcctgatgaggatgacgccgctctttggcgatttcataaggaatatcgtgaataacaatcacgccataaaaaagtattaaggccacggcgatcagaatggccagcgccacatagtccagggtcataaaataactccagagtgcaaggttaaataaataaaacagccagattcaggcgtaacggggccgggggaaaaagcgcgcttagcgctttccctggcggtaatagcaacgtgatggcgtgaatctgccgaatcggatttagaatttctcaggaatatgacggtcgatggagatcagcttgccttttttcaccgtgatatatcccccctcgcgcagcgcggccagcacctggtacacatagctgcgcgagagattggttcgtttaataataaatgccgacaggctctcatgctgacccccatcaatttcgccgcgatataaatagcgcgacagcatcgatttaatggtctgaaagctggtctggctgccgcgttcatagtgggcatcaagggcaaatatgcccatataggccaggatcgtggtcagctcttgcatatagcccggcgacgaatgaaagaatattcgctcaaaatcgctggcggttattttcgccagctggcactcgcccagacactgataatagagcgcgaccgacggacaataatgttccagtaatcctaacggcatatgcgcgataacaatcccgaccaggttctgctcatcgccaaaggccaatgtcatttgcccctgcagcagaaagtagagatagcccggctgcggaataaagccctggtctttgcccaaactcagcgtttcactgcaggcgatcaccgccggcagatgtgtagtcagcgtcagcttctggtaccgatcgtaaatatcgccaaaactggggttcatcgcgctacgcactcctttacctttggccaccgcggcggggctaaccgcgacctggtgaactatacctaagcgggtggggaaggaaaagtccagatctggagtggcgaaatattccgcctggctcacattttttaccctcgcctccctgtttcgtgacccaatcgttccgcttaccggtgggctgtgctttaatgagctaaaccggtttaataaagtttagcttagaggagcttgtcgtatgaatggaaaaatctgggtactcggcgatgcggtcgtcgatctcctgcccgatggagagggccgcctgctgcaatgccccggcggcgcgccggccaacgtggcggtcggcgtggcgcggctcggcggtgacagcgggtttatcggccgcgtcggcgacgatcccttcggccgttttatgcgtcacaccctggcgcaggagcaggtggatgtgaactatatgcgcctcgatgcggcgcagcgcacctccacggtggtggtcgatctcgatagccacggggagcgcacctttacctttatggtccgcccgagcgccgacctgttccttcagcccgaggatctcccgccgtttgccgccggtcagtggctgcacgtctgctccatcgctctcagcgcggagccgagccgcagcacgacattcgcggcgatggaggcgataaagcgcgccgggggctatgtcagcttcgaccccaatatccgcagcgacctgtggcaggatccgcaggaccttcgcgactgtctcgaccgggcgctggccctcgccgacgccataaaactttcggaagaggagctggcgtttatcagcggcagcgacgacatcgtcagcggcatcgcccggctgaacgcccgcttccagccgacgctactgctggtgacccagggtaaagcgggggtccaggccgccctgcgcgggcaggttagccacttccctgcccgcccggtggtggccgtcgataccaccggcgccggcgatgcctttgtcgccgggctactcgccggcctcgccgcccacggtatcccggacaacctcgcagccctggctcccgacctcgcgctggcgcaaacctgcggcgcgctggccaccaccgccaaaggcgccatgaccgccctgccctacagggacgatcttcagcgctcgctgtgatccccttgggccggttaacggcccactttgctggcgacatcacaattcttaaaccggtttagcaatttttattttcaccgcgttaccgacatgtttaccatatcaactaaaccggtttagcaaaaattagcacactcactgatttacctttggatgtcaccaacatgtataaaaaacggaagttagccattcttattgctttgctaaccggcaccgccgccgcccatgggcagacagacctgaacagcattgaagcgcgtctcgccgccctggaaaaacgcctgcaggacgccgagacccgcgccagcactgccgaaagccgcgccgcctcagcggagcagaaagttcagcagttaacccagcagcagcagcaaacccaggccaccacccagcaggtggccaggcgcaccactcaactggaagaaaaagccgaacggcccggcggttttgagttccacggctatgcgcgttccggggtgatcatgaacgactcggccgccagtaccaaatccggcgcttatatgacccccgccggggagaccggcggcgccattggtcgcctgggcaaccaggccgacacctatgtggaaatgaacctcgaacataaacagaccctggacaacggggcgaccacccgtttcaaagtgatggtggccgacggacagaccacctataacgactggacggcaagcagcagcgatctgaacgtgcgccaggcgttcgtcgagctgggcaatctgccgaccttcgaaggcccgttcaaaggctcgaccctgtgggccgggaaacgctttgaccgcgacaacttcgacatccactggattgactcggatgtggtgttcctcgccgggaccggcggcgggatctacgacgtgaaatggaacgacagcctgcgcagcaacttctcgttatacggccgcaactttggcgatatcgccgacagcagcaacagcgtgcagaactatatcgtcagcatgaataactttgccggcccggtgcagatgatggtcagcgggatgcgggcgaaagataatgacgaccgccaggacgcgaacggcaatctggtgaaaggcgatgccgctaacaccggggttcatgccctgctgggcctgcacaatgagagcttctatggcctgcgcgacgggaccagcaaaacggccctgctgtatggccacgggctgggcgccgaggttaaaggcatcggctccgacggcgcgctgcgcccgggggccaatacctggcgcttcgccagctatggcaccacgccgctgagcgatcgctggtttattgccccggccgtgctggcgcagagcagtaaagatcgttatgtcgatggcgacagctatcagtgggccaccctcaacctgcgtctgattcaggaagtgacgcagaacttcgccctcgcctgggagggcagctatcagtacatggatctgcagcctgaaggctacaacgatcgccatgcggtcaatggcagcttctacaagctgaccttcgccccgaccttcaaggtgggcagcatcggcgacttcttctcgcggccggagatccgcttctatacatcgtggatggactggagcaaaaaactggacaactacgccaacgatgacgcgttaggcagcaacggattcaaatcgggcggcgaatggtcgttcggtatgcaaatggagacctggttctgacggcaaccggggcgacagggtaaataacacataaatataaggttcgcggcgcctgccacggctggcgccgcccacgccatatcatcatgcatttagagggtactatggattttgaacagatttcccgctcactgcttcccctgctgggcggcaaggaaaatatcgccagcgccgcgcactgcgccacccgcctgcggctggtgctggtcgacgacgcgctcgccgatcagcaggcgattggcaaaatcgacggggtgaaaggctgctttcgcaatgccggacagatgcagatcatcttcggcaccggggtggtcaataaagtctatgccgcctttatccaggccgcaggcatcagcgaatcgagcaaatccgaagccgccgacctggcggcgaaaaagctgaacccgttccagcgcatcgcccgcctgctgtccaacatcttcgtgccgattattccggccatcgtcgcctccggcctgctgatgggcctgctggggatggtgaaaacctacggttgggtcgacccgagcaacgctctctatatcatgctggatatgtgcagttcggcggcgtttatcattctgccgatcctgatcggctttaccgccgcacgcgaatttggcggtaacccctatctgggcgcgaccctcggcgggatcctcacccatccggcgctgaccaacgcctggggcgtcgccgccggcttccacaccatgaatttcttcggcatcgaagtggcgatgatcggttaccagggcaccgtcttcccggtgctgctggcggtgtggtttatgagcatggtcgagaagcggctgcgccgcgtgatccctgacgcgctggacctgatcctcactccgttcctgacggtgattatctccggctttatcgccctgctgctgatcggcccggccggtcgcgcgctcggcgacggcatttcgtttatcctcagcacgcttatcagccacgccggctggctggcgggcctgctgttcggcggcctctattcggtgatcgtcattaccggtatccatcacagcttccatgccatcgaggccggactgctgggcaacccatcgattggcgtcaacttcctgctgccgatctgggcgatggccaacgtcgcccagggcggcgcctgctttgcggtgtggtttaaaaccaaagatgccaaaataaaagccatcaccctgccgtcggcgttttcggcgatgctggggatcaccgaggcggcaatcttcgggattaacctgcgctttgtgaaaccgtttatcgccgcgctggtgggcggtgccgccggcggcgcctgggtggtgtcgatgcacgtctacatgaccgcggtaggcctgacggcgatcccggggatggctatcgtgcaggccagctcgctgctgaactacattatcggaatggcgatcgccttcgccgtggccttcgcgctctctctgacgctgaaatacaaaacggacgctgaataatgtcattaccgtcacgtctgcctgcgatcctgcaggccgttatgcagggccagccgcaggcgctggccgacagccattatccgcaatggcatctggcgccggtcaacggactgctgaacgatcctaacggcttttgccaggtcgccgggcgttaccacctgttttatcagtggaacccgctcgcctgcgaccatacctataagtgctggggacactggagctctgccgatctgctgcactggcggcacgaacctatcgccctgatgccggatgaagagtatgaccgcaacggctgctactctggcagcgcggtcgagttcgagggcgccctgactctgtgctacaccggcaacgtgaaattccccgacggcgggcgcaccgcctggcaatgtctggcgaccgagaatgctgatggcaccttccgcaagctggggccggtgctgccgctgccagaaggctataccggccatgtgcgcgaccctaaagtgtggcggcaggacgggcgctggtacatggttcttggggcgcaggatgtgcaacagcgcggcaaagtgctgctgtttaccgccagcgacctgcgagagtggcgcctggtaggggagatcgccgggcacgatgtgaacggcctggcgaacgccggctacatgtgggagtgcccggatctctttccgctggcggacacccacctgctgatctgctgcccgcaggggctggcccgcgaagcgcagcgctttctcaatacctatccggcggtgtggatggcaggccgcttcgacgccgaacgcgggatcttcgaccacggcccgctgcacgagctggacagcggatttgagttctacgcgccgcagaccatgcaggccgatgatggccgccgcctgctggtcggctggatgggcgtccccgacggggacgagatgcatcagcccacccgcgcgcagggctggatccatcagatgacctgcgtgcgtgagctggagtggcaggctggcactctgtatcagcgtccgctgcgcgagctggtcgccctgcgcggggaagcccagggctggcgcggacagaccctgcccctcgccccgatggagctggcctttgacctttcccccgacagcacgctggggctggactttgccggcgccctgcagctcaccgtcaatcgcgacggtctgcgtctgtcgcgccgcggcctgcagacggcggagatgcatcaccgctactggcgcggcgaggcgcgacgcctgcggatctttatcgaccgctccagcgtggagattttcatcaacgatggcgaaggggtgatgagcagccgcttcttcccgggctatccggggcagctcatcttcagcggtgcgacgccggtggcattctgccgctggctgctgcagccatgcatggtagaataagcgttttgctttcaggctcccgggtgctgatgaaaaccaaacgcgtaactatcaaagatatcgccgaactggcgggcgtctccaaagcgaccgccagcctggtactcaacggtcgtggtaaagagctgcgcgtggcgcaggagacgcgcgagcgcgtactggcgatcgctcgtgaacagcactatcagccgagcattcacgcgcgctcgctgcgcgataaccgcagccataccattggtctggtggtgccggagatcaccaactacgggtttgccgttttctcccacgagcttgagacgctctgccgggaagccggcgtgcagctgcttatctcctgcaccgacgaaaacccaggtcaggagagcgtggtggtcaataacatgatcgcccgccaggtcgatggcctgattgtcgcctcttgtatgcacagcgatgccgactatcagaagctcagcgaacagctgccggtggtgctgtttgaccgctcccccagcgacagcgccctgccgctggtgatgaccgactcggtcaccccaacggccgagctgatctcccgtatcgcgcctcagcatgcggacgagttctggtttctcggcggccagccgcggctgtcgccgtcgcgcgaccggctggcggggttcacccagggcctggcccaggcggggatcacgctgcgccctgagtgggtgatcaacggcaactaccaccccagctccggctatgagatgttcgcggcgctctgcgctcggctggggcgtccgccgaaggcgctcttcaccgcggcctgcgggctgctcgaaggggtgctgcgctatatgagccagcatcatctgctggattccaatattcatctcgccagcttcgacgatcactatctgtatgattcgctttccctgcgcattgataccgtgcagcaggataatcgccagctggcctggcactgctacgatctgctcagccagctgatcgacggtcaggccccggagccgcttcagcgctacctgcccgccaccctgcagattcgccatccctgacggcgcggttggcaattagcgttttcgcctggcgcgcgccgcctgcctcagcgccagcagcgcgctggcgagcaccgcgccaaggccgatcgttaccggccagcggtaagccaccagcaacgagggcaatccaccatccggcgccagcatcaccagattccagcccgccagccccgcgttgccgttcagcgcccggcttaacatccgctgatgcggggcgaatggctgaatggtctggtagtggctgccgaacagcgagggctgcatctctcgcgggaactgcgcctgcacctgggccagcacgctggccggcagcgcgtgcgatgccgccagcagatgcccgtcgccattcaccagcagcagctgataatgccgctcccgggcgagggtctggagagcggcgcgcatcgccgccagcggccaggtcgcttcccgctgcggcgccggaatgttcatccgccgctcaaggcgttccgccacccactgcgcatcctcctccagctggcggatctgcctctcacggtaaacctctctggccggcaaattcatgccccgaccgagcgccaggatcgccagccccgcgagcagcgtgacgataaggcccctttttcccgctagccagcgcggcgagaatttgccaaaggatggtgtattcatacgactccagaaaccgcaggccacgcgtggcccctgacgaatggacaacggaagtggcgaaactgtacaggatgcgcagcgcgggcaaaacagacaggcggagcctggcggggagtattttgtttatttctggacaggacgggcggcaacgacatccttcgccgttgccgcccgttgataagattagtgttttttccggttgcgacgcatatcgatggttaccgccgcaacgataatgatgcctttaataatatcctgcacataggcatcgacgccgacaaaggtaaaaccgcttttgatcaggccaaggatcatcgcgccaatcagggtgccggtaatgcgccccactccgcccattaagctgctgccgccgatcaccgcggcggcaatcgcgtccagctcgtaggacatccccatactcgactggccgctgctgacgcgcgccgccagcaccacccccgccagtccggagagcgccccggcgatggtgtagacgatcaccagatatttattcacgttgatgccggacactttggccgaggtcatgttgccgccgatggcatacacatatttgccataccgggtatgcttcagcgcaatgtgaaacacggcggcgatcacgaagaagataatcaccggcatcgccccctggcctatcgccgtaaagctgtcggagaggaagctgatcgggttgccctgagtgtaatactgcgccagaccgcgcgccgaaaccctcatcccgagggtggcgataaacggcgggataccggtccgcgtcaccaggaaaccgttggtcaggccgcacagcaggccgacgccgatccccgcgcaaatggggatcaccgccggcaggttgaccagcgccgggaacattggcgacaggctatcggaggttggcgccaggctggccgccaccaccgccgcaagggcaataaccgagccggaggagaggtcaatcccggtggtgatgatcacctgggtgacgccgacggcgatgatgccgataatcgccacctgcagcacaatcagcaccagccggttggtattgagcaggaacgactggtcgcgaacataccagccggcgatttcaaaggtcagggcaatcaccagcatcaccacaaagatgccggtatctttcggcattttatgccgcaaattagcgaagaaggaggaaccctcgctggccggagccgccgttaatttcatattactcattctctttgcctcaatgggatgccaacgacaaaatggtttcctggtcggcttcgtctttttccaggatgccggtgatacgaccttcatgcatcaccatgacccgatcgctcatgccaaggatttccggcagttcagaggagaccataatcaccgccaccccccgattcgccagttcactgataagatgataaatctccgccttcgccccgacgtcgataccgcgggtcggctcatcgagaattaagattttcggttgcgctaacagccagcgcgcaatcaggactttttgctgattccccccgctgaggttattaataatttgatccatcgtcggcgttttaatattgagccggcgtatttgctccatgcagtcttcggccattttcacgtgctggacaaaaccgctcttgccgatatattccggcattttgacgatactcatattttccagcaccgacagcaccagaaacaggcccgactttttccggtcttcggttaataatgccatccccttttcaatcgccacggagggggaatcgatggtcaccggcgccccgtcgatcagcacttcgccgctgtcgaagcgctccataccgaacaggctttccatcacctcgctgcgcccggcgcccaccagcccggccacgcccaggatttcgccacggcgtacgctaaagctgacgtcatggaacacgccctgacgcgtcaggttgcgcaccgtcagcacctcttcgccgatggtgttattaaatttcggaaacagctgggttaattcgcggcccaccatctgggtgatcagcgactgccgggtaaattcggtggtgtttttgctccctacccaggtgccgtcgcgaaagacgctgatctcatcggtgatggcaaagatctcatccattttgtggctgatatagatgatcgctttcccctgggcgcgcaggtcgcggatgatggtgaacaggtgagccacctcgccttcggtcagcgccgaggtgggctcatccatgatcacgatatccgcgttccatgagaccgctttggcaatctccaccatctgctgggcggcgatgctcaggtcgcccaccagccggtcagcggttaagcggatattgagcttatccagcagcgcctgggtctggcgggtcagctgaccgtggtcgacaaagccgtacttcatcggctcgcgccccagccagatattctccgccaccgtcatatgcggcaccagattgagctcctggtggatcatcgagatccccgagcgcagcgcatccatggtgtcggtaaactccaccggctcccctttcacgcgaatcgaccctttatcggggcgatagataccgatcaggcatttcatcagcgtggatttaccggcgccgttctcgcccatcagggcatgcaccgttcccggacgcccgcgcaatgagacattatcgagcgccttcacgccggggaagaacttactgataccttcggcttcaagggcaaaagcgttcatacatccacctccgtaccacaggttggccaggactatttctgattacggttggtaaattcagccatgttctctttggtgatcagctgatacggcacgtcgatgattttttccactttctcgccgttcgccagcttgatggccgcgtcgactgcgccttcaccctggcctttcgcatcctggaagatggtggcgatcatcttgccgctcttcagcatctgcagggcatccggggtgccatccacgccagcgatgagaatatggttcgggtttttgcccagcgcctgcagggcgccgatcgccatttcatcgttgttggaggcgatggcctggatatcctcaccgctggtcatccagttgctgaccacgtccacggcgtcattgcgggtaaatttcgcggtctgcttctggacgattttgatgttcgggtatttcgctaccacctcttccacccctttggtgcggtcgcgagtggattcattcgccaggtcgccgagcaggatcgccacattgcccttaccgttcatcgctttcgccagcgcttccatctgcagacggccggcgagaatggagtcagatcccacataggccatcttgtcggtcagctccgcttgcggacggcggttcacaaacaccagcgggatcccggctttggtggcctgatccatgatcggtttcaccgcgttggtatccaccgggttgacgataatggcgtccaccccctggccgataaagttctgcacctgctgcagctgctgggagacatcccctttcgcgtcctcgatctgcgatttaacgccatcttttttcatctctttttgcatcgaggtacgcaggatcgtcaggaagttatcgtcaaacagcgccatcgagacgccaatggagacatcttttgccataaccaccgcaggcagcatgcaggctaacaaagaggcaacaatcgttttcttaatattcatagttgatccttgattttgtaggtacgccggtgaatgaaacaaaatgaaaaattaatttcagttacgttgcggcaaatgtctgctggtatatcgacgacgctgcggcacctctcgcactccatcgtgatctaaatcacaaataacggctgttttatcatcactattttgaaacatcagtccatttacgccgcaacctggatttcagaccatttatttcattaacaagaaatttgaaacttttataagtaaataactgaaatgaaaattttaaaactatgcagtaacagaattttgacagacatctaacattgccgcataaatgagcgaaaaatgagaagcagacaacgctttgaagcgatccctcccggcggggttggcatttacccgccggggaaatccgtgttgtcaggaagggaggcgccgtacgccttagtccacgttctcggcgctgtagaggataaagtcgactttaccgtcggcataggtttgcggctggtagccggactccagatggcgcagcatcaggtcgatcgccagctgggcgtgctggcgggtgttctgatcgagcgttaacgccaggctgcccttcgccagctgctgccgggtggtgttgtaacgctcatgggtgatccagcagacgtcgccttcgcggcggtggcgggccagcgcctcggcaatctgggtattgccaagcccggtgttatagatcccaacaatattccggctgcggcacagggcttgctccaccaggcgggtgatctgctcccgccgctcctcgcccgccagcacgtcgctgagctgcaggtggggaaagcgctggctcagcacctcgcggaacccctgaatgcgcaggcgatgcgcgctgtaatcttgccggccgctgaccatcagcacctcgccgggccgcggcgtcattctccccagcattaaccccgccgtgcggccagcctgcagctgattgatccccacgtggcagagtcggtcggcgccgggcaggtccgtcgccagggtgatcgccgggacgccagcctcccggcagcggcgcagcgcgtcgtgcaccgcgggatggtcattgccgaagacgatgatcccctgacgctgctggcaactacgcgcaatgcgccgggccagcgtcgtcggctgcgactccgggacaaaggtgcggtgcaaggtcagacggcgatagccgaggctatccgccacggcggcaaaatcctgcgccagctgcggaaagaaaaacgagtcattgctgctgagaaagacctcaacctgccagggaaagcggtgctcctccggcaggatccgcttcagccccgcctcgcgcgccgcctgcagcactttgcgcgtggtctgcggcgatacgccgccgcgctcgttcagcacccggtcaacggtggccacgccgacgccaatctgtctggccagcatcgccagtgaaatatttttcatcgcccctctcttcatgatggaaatccatcaaaacggcagtgtcagtgagtttagcaaaccgattatggtggcagcgtcccctcgccattctggagaaaaaaatgatctgcaaacgttttgccctggtaggcagtggttttatcggtcaggttcatgccgccagtcttgctcgtcatgaaggaagtgcgctgacgatggtggccgatgccgccccggagcgcgcccaggcgctggccgcccgctatggcgcccgggcggtgaccgtgagcgaggcgatccatagcgacgccatcgacgcggtgctgatcgccagttcaaccccgtcgcatgccgaactgctggaagccgccgcccgggcgggcaaggcagtctattgcgaaaaaccgatcgacctctccctggcgcgcgcccgtgaggtggtggagcgggtgctccccctgaacgtgccggtcactgtcggctttaaccggcgcttcgatagcagccatcagcagctccgccgccagctggagcaaggactgatcggccgggtcgagctggtgcagatggtctgccgcgcctccagcatgccgccgctcgactatctgcgcagctccggcggccagatgcgcgatcaggcgatccacttcttcgatctcctgcgctttctcactggcgatgaagtgcgcaccgtagcagcgatgggcgcggcgctggccctgccggacattgccgaatttggcgatgtcgacacctccatcctgatgatgcagatgcgcggcggcgcgctggcgcagttggacaatacccgccgcaccggccacgggtacgatgaacggatcaacctgctgggcgccgaaggcgcgctggagtccggtagccagtcgccggcgggccctaccctgtggcgcggcaatcagcgcattgagccgggcctgtggccggactggttcagccgggtacagggatcttattaccagcatcttgacgcctttattcgctccctgaatggtgaaaccgtcgccgacctgcccggcctgctggacggcctgcaggcgcaggccattgccgaagcggcggttcagtccctacagcatggccagtttgtcgccgtcgatgactgtcgctgagcgggtgcgaggcaaccgctatctagcgcagtacctgcctttatgccgggcggcggcaacgccttgcccggcctacataacacaggcattaatatgctttaatatcaaacggttgcatagatatcccaggcccgcgcaagcgcagcgccgccgggcaacagacatcaggcatcgtacgcgtccttttgccgggcaatggcagatacgctcgcgctatctgcaaaccaatgcccggccggctccttagcgttcttcgttaaacaccgcgcccacctggcgccgcacctcatccatcacctgcagattctgcagcacccgactgagcggccgcagcggcgagtcctgcaacccctgtccgatgcaccaggcaaaatgctccgcctgccagaacagctggtcgtagcgattgcgcggctcttcccagcgcagcacctgcccgccctggctggcggcgagcgtgaagccgccgggggcgtaaaactggccgtcgatcgtcagggtcgcctggcgtccggccaccaccgccccgcccggcgtgttgctgaacaaagtggtgtttaacaacccctgcatcccgttctgccagctaaacagcatcgacgtctgaccgttcagcccctccgccgtggcgctgccgcgggcgacaatctcctgcggcatgccgcccaccatcagcgcaaacgaggtcacatagctgccgaggtccatcatcggcccgccggcaagatcggcattgaagatgcggtgctcgggggtgaaatactcgccgtgatcggccagcagggtatgcaggtcgccgagcgccccatcctccagcagctggcggatcacatcatatttcggcgcgtaatcgcaccacattgcctccagcgccagcttctcctggcgggcggcttcggcctgcagctcacgcccttcgccgaggttgagggcgaagggcttctcaatcagcacgtgtttacccgccttcagcgcctgcatgccgtcgggaaagtgatggttgtgcggcgtcgcaatatacaccgcatcaatatccggacgcgccagcatctcctccacctggccgtaagcctgggggatcccccattccgcggccacccggtcggccttcgcctggctgcgggaagccaccgccaccacctgctgccggctgtaggttttcaatgagtgcacaaagcgctcggcgatccagccaggaccgataatgccccagcgcaggatgggaatgctctgcgccgccgggcggcgcggggttggtaagtgtgacggaaacatagcggctccttagtctttaaccacgttcacccagcgacggctggccatcgaggcttcaatcgccgacagcacgcgctgattctgcaaaccaaattcaaagttgggatagcagtcgccctccccgcaaatcccctgcaccaggtcatgcacttcgatcaccttgacgtcaaaatagcccagcccgccgccgccaaaatcgaagccgaagaagccggcataggccgggatctggctcccggcatacagcgtcttaaagccgcggtcatgtttgtcatcgttgaagcgatacacctgcagctcgttaaagcgctccccgtccatatacagcgtgccttcggtgccggagacctcccagaacacgccgaagatccgcccggcggcgatgcgcgaggcctcaatcacccccgcggcgccgctgtcgaaattgaccaggcactgaacctgatcgtcattttccacttcccgccactcggcatcggccgcgacccggctggcatacccggcatcggtttgcggcaccggacgctggcgcaggcaggtttgcgcgctggcggtcacttcgcggatcccgcccagcaaaaactgggcgacggacagggtacgggcgccgaggtcgccaagcgccccgctgccgccgagagttttcgagcagcgccaggaccagggcaggttcgggtcgttataaaacccctgatcaaaggtgccgcgaaagcgcaccggttcgccaatatcgccccgggcgataatctgctttgccagcagcgccgccggcgttttgatgttgttaaaagccaccatggtcttcacccccgcgcgccgtgccgcctgcgccatctcctgcgcctgctgctcattgaccgccagcggcttctcgcaatagacatgtttacccgccgcgatcgccgccattgccattgtgtagtgcagatggttcggcgaggtgatatccaccacatcaacctgcggatcgtttaccagctcgcgccagtcgccgtaggccttttccgcccccagtttcgccgcgtggcgttcggccatcgcctgatcctgatccgccagcgcgtagagatgcgggcgcttgggcagatcgggatagaacatcgccgcgcgacggtaagcgtcagcgtgtgcctgccccataaaacctgagccgataaggccgatatttaaccgcgcgctcatgatgcgtactcctctgacgatgaaggggaagataaatggtgcgccagccaggcataggcgcggctggcggtggccagcggcggcgccatcgccgggtcctgctcggcttcgataatcagccagccgcggtagtcgctgtcccggacaaagtcgaggatcggcgcatagtcgatgcagccgtcgcctgggatggtaaacagcccggcgcgcaccgcctcgttaaagctcaggttttcccgatatagacgccccagcacctgcggacgcacgtctttcagatgcagatggcggatacggtggccatatttgtgcaatacgcgcgggatctcgaccccggcgacaaaggcgtgcccggtatcaaacgccagcccgacgttgtcatgggtgtgagacagaaaccgctccagctcgtcatcgtgctccaccagcatcatcagatgatggtgataggccagctggaggtcatagtcgcgcagcagcaggtcggcaaaggtattcagcttgtggcaatacgccgccaggctgacgcggcttaacggcggcgagagcgaaataggctcatcaagcggggtttcacctggcagttgcccgcattcgccgtaaaccatcaccttcgcgccgagctgccggaggagctgggcgtgctcccgcaccgcctccagctccgcttccacgctgcggtcggccagcatgccgctgtaccagccggacgccaggcgcaggtcggccgccgccagcagcgggcccagggttgctgcctggcggggaaatttccgtcctaactcaatgccctgatagcccgcctcccgcgcctcgcgcaggcaggtatccaggggaatatcaccgcctaaatcctcgagtacatcgttggtccagcacagggggctcacgccccaccgcagttgctctgtcgccatcttgttctcctttccaccctgtggtcttgtctggcgtcactataagcaggtgacgaccgacgatgaaaacggagaaatgatggaaatccatcattgcgctggcggtatattcgctatttcaggtaaccctgaaaaataaatggaaataatgcttgccgccggcttattttgcggataaaaattactggcttaataacccgctccagaggttatccctttcattcgaaatatgatgatagcaatatgaaaacaactcaacaccgcaccagcgcgggcttttgccgcacgccaaggacaggcctgctgttatttgcctgaatgacacatagccgcttttaaaacatcaaataattaacattctctctgcaataatatgacaagcagtgggaaggttggcttgcgaaataagcatgaaactttgatgttttactaataaataaccccagagcctcttgctaattacttatcaggactggttgggttattttattctgacgccaacgggagaatacaccaacgtgtatccctctctctggcccggcacgccgctatcgcgatgagaaacaataagatgaataagacctggcttttcaccaccctgaccctggcgctggtcgccgccgcgccggcccacgccattagcgcgaaataccgggaacagcttgaacgttccggctgcacgcagatgaccgacgggatcacctgcgatattcataaaaccaaagccgagaatgccgccgccgcacagcacgccgatagcggcttcggcccctgggtgggcacctggtatgtttatacggagtatggcgataaaattgatgagattaccgtcaccgctaaaacggtgaaaacccgcggccatctggttgaggcggcgaaagccagccagggtaaactgaccttccgggtgaaaagctcagcctttacgctgaacgacgcctttaacggcgtatgggcaaacggcagccagcgcggcacgttgcaaaaagtcctgtaataacatcgctctgccgacaggccggggataatgcagggagaacctcccggcgcaggccgggagggagtgcaacggattacttctgcggacgcatggccgggaagaggatcacgtcgcggatggtatggctgttggtaaacagcatcaccatgcggtcgataccgatacccagaccggcggtcggcggcaggccgtactcgagggcggtcacgtagtcttcgtcgtagaacatcgcttcgtcatcgcccgccgctttggcgttcacctgatcctggaagcgctgcgcctggtcttcggcatcgttcagctcgctgaaaccgttaccgatttcgcggccgccgatgaagaattcaaagcggtcagtgatttccgggttgacgtcgttacggcgcgccagcggagaaacttccgccgggtattcggtgatgaaggtcggctgaatcagatgcgcttccgccacttcgtcaaagatttcggtaactatgcgtcccagcccccagcttttctctacctgaataccgatagattccgccagcgctttcgccgcgtcgaagttatccagatccgccatgttggtttccggacggtgtttcttgatcgcttcccgcatggtcagtttttcaaacggcttgccgaaatcaaacacctggtcgccatacggcacttcggttttgcccagcaccgtctgcgccagggtgcggaacagcgactcggtcagttcgatcaggtctttgtagtccgcatacgccatatacagttccatcatggtgaactctgggttatggcgtaccgagatcccttcgttgcggaagttacggttgatttcaaacacgcgttcaaaaccgccaaccaccagacgtttcagatacagttccggcgcgatgcgcaggtacatatcgagatccagggcgttgtgatgggtaatgaacggacgggctgacgcaccgccagggatcacctgcatcatcggcgtttcgacttccataaagccgcgggccaccatgaactggcgcatggtggcgaggatctgcgaacggatacggaacgtatgacgcgactcttcgttggcgatcagatccagatagcgctggcgatagcgaacttcctgatcctgcaggccgtggaatttatccggcagcgggcgcagggctttggtcagcaggcgcagctcggtgcagtggatcgagagttcgccggtttgcgttttgaacagcttgccgcgggcggcgatgatatcgccgaggtcccatttcttaaactgttcgttgtagacgccttccggcaggtcatcgcgcgccacgtacagctgaatgcggccgccgacgtcctggagggtgacgaaggaggctttgcccatcacacgacgggtcatcatccgaccagccaccgcaacttcaacgttcagggaagcgagttcatcgttgtccttcgcatcgaattcagcatgcaattggtcagaggtatgatcgcgacggaaatcgttggggaaagctacgccctgctcacgcagcgcagccagtttttcgcgacgagctttcagttcattattaaggtcaatggcctcatcggcaccttgtgcttgttgttcagacatatggattcctcataaccttgctttcaaactagcttcgataaattgaaccaggtcacccttccgcgcggcctgtctctgggaagacaccagagcacaatcttaacgatcctggattcactccaagctgatctcactcagctatggcttcagtaacggtattttttatcgttggcctccgcgcatgccagaatatcctcctcctgttcactaagctgtgcaaggagcgacttcgcgctccgctgttgaggtaatgcccccggtcgcgctgcgcttaccggggctacgaatcgcagcccggacaaggtgtttacgccacgagccgggacgagcgtcaggcgccgccgccggtaatttcaccggcagccgcacgacgtttgccaacgctacaggccgcggcaaaggcgataatgaccatcaccgccacgcagccgagggtccattcgcccatctgcgcgaagaaatgctgataggcggcaatcgccgtatcgctgatttgcgattcggtggtttgctgggcgaccacgcccgccagccagttggccaccgcgccggtggccagcatatagatcccggtcaatacgccggtgacgccgggcatgttcagacgggtgatttgcgccatcgccaccgggtcgataaacagttcggcaaagcccatcatcgccagcccggcgaccatcatgcccatcgaggcctgaccgtcagccgcgccatggcgggcattgagcgccagcagcataaagccgccgcccatcagcagcaggccgaaagaaaatttcagccagacgcgcagcacagaacgcacgctgccttccgggcgcatcagccacgccagcaccacgccggccgccatcaccgctatcgcgttaactgactggaacagcgcggtcggcacgtcccagttcagcagacgacgattgacgaagtggtcgataaacaggctaatcgagctcccgccctgctgcgccagcacccagaacagcgttccggcgagcatcagcaggacgatctgccacagcgcgcgtcgatgctccggggctttgatcatgatccgcgccaccatctgggcagcgaacaggcagacgatcgccagcagatagccggaccagttgttttgcagcagcagcgtgaaaaataccggcgccaggcagagcatcaccagcagccagccccaggtcggcagcacgaacttcaccgcccgcagcgccggtttatcgacgccgcgggtatgccggaagtggcggctgccgcttaagaaaatcatcaggccgataaacataccgatccccgcaagggcgaagccgatatgccagccgtaccactgcgccgccagtccgcaggcgatgggcgcggcaatcgagccgacgttgccggcggcgtacagcagcgagaaaccgccgtcgcgacgcgggtcgtcgtgagcgtacagttcgccgagcaggcagctgatattggatttaaacaggccgtagccgcagatgatgatcgccagcgcgacgtacaaactccatgcggaggtcgactcaacgcccagcaccacatggccgagggtcatcaacagcgccccggcaattaccgccgtgcggttgccgagcaggcggtcggcaagccagccgccgagaataggggtaacgtaaaccagagatgcgtaagcgctgaacaggctgatggcgtggctgtcgtcgaagccaagctggtgggtaaggtaaaggatgagtaaggcgcgcatgccgtaaaagctgaagtactcccagatctggatcgcaacgatgtagtaaatcgcgcgcggctgtgagggtgttttcatgtgttctccttgcagcgtgaaaaagggaagtggcaagccacttccctggtgtgcgtctattacttgttattctcttctttcagcactttaacggtgtaacgaccttccgcctgacgataggcgccgtggatatcggtttcgaagcctggatagtgggcgccgatttcgcacagcatctgcaggaactccagcaccggacggctctcttcggtgatcatctcacccggcatcaccagcggcactcccggaggatacggcaggatcatgttggcgttgacgcggccgaccatctcttcgagatacacttcttccgtctgaccgtgcagctctttctggaacgcggcatacggggtcatcaccatcgatggcagcacttcaaacgcgcggaacatcagatccggcaggttgtgatgctcaatcagtttgtgaatgttctgcgcgaggtcctgaatacgcatgttttcatagaattcaggatcttcacggtacagcgacggcagcatgtttttcacccgcaggttcaggtcgaacgcgcgtttgaagtcggtcagcgcacgcagcaggctcagcgctttagtcttatcgataccgatactgaacaggaacagcaggttgtacggaccggttttctctaccacgatgccgtgttcgtcgaggtatttcgctacgatgcttgccggaataccgaagtcatccatggtgccgtctttcttcatccccggagtcagcagcgtgactttgatcgggtcgaggtacatgtgttcattatcgatgtttttgaaaccgtgccatgcgctgtcggaacgcagcggccagcattcaggaccatcgatatgctccggctgccagacgtcgaagaaccagccgtcagactcgcctttcagacgtttgatctctttacggaacttgatggaacgttcaatagagccgtcgatcagacgcttaccagcgttccccttcatcatcgccgccgcggtttcggtggaggccacgatcccgtagtgtggagaggtggtggtgtgcatcatgtaggcttcgttgaaggtctcttcgtttacgtcgcctttcacatggatcatcgacgcctgggagaacgccgccagcagtttgtgcgtggactgggtttcataaatcactttcccttcgacgcggccgccgctcatcccgcatttgccttcatagatcggcgagaagttggtgtaaggcacccacgcggagtcaaagtggatggatttcacatccagggttttcttgatgaagtcggtgttgtatagcagaccatcataggttgagttggtgataaccgcgtgtaccggccaggtcgcattcggcgtctctttcacacgcttggcgatagtcgcgtgctggaattcgctctgcggaataccgccgaggataccgtaggcgttacgggtcggacggaagtagatcggcgtaatgtcgctcatcatcatcaggtgagtcagcgatttgtggcagttacggtcaatcagcacggtgctgccggccggcgcggagtacatgccgacgattttgttagcggtagaagtaccgttggtcaccatgtagctgcgttctgcgttaaacacgcgagcgatatactcttccgcttctttgtgcgggccgctgtggtccagcagggaacccagttcagaaaccgaaatggagatatcggatttcatggtgttggagccaaagaaatcgtagaagatgctgcctaccgggcttttctggaacgcggtaccgcccatgtggcctggggtacagaaggtatatttaccttcacggacatatttgaacagcgctttggtcagcggcggcagaatggtgtcgatgtattcgtcagtgttctgtttgattttgttcgcgatatcttccgcagcgcccagcgcatattcgaagaagcgaacctgcatgcgcagatcgttcaggctaacgtccagagtggagtaggtgttagcgaacgcatacagcggcatgtactcgttcattttgctgatttcttcgcacagttcgagattgtatttatcccagtcgaagatcacgccgcacagacgagagttgttttcaataagttttaataagtcgtcacggtcgttcgggtagacaatacggaagtccaggcgttcgagagcacgatgcagttcacggatgggttcttctttgaagtaaacccccatgtgattcatgattgcaataacgttcatagtcaaatctccagatgtagaaagcccctcccgtcgcgtgatgacaggtgatggaaggagcctcaggaaaacgggttgctgattagtgcacgttagcggtggtgttgttatccgatgcgttgttctggcgctggtgcattttgcgaccgtagaacatcaggataatcaggctaacgatgaaagtgccggccagttcgaaggagcttgcgcccatcagcgcgatgaagcagaacacgcaacccagtaccgaacaaatcaggctaacgaagttacggatgttgatgccttcgaaacgaatcaggtcaacacaggagtagaagtaaggcagcatggtcagcagtaccgcgataccggtcagttcgccgaacaggtcagaggctttaccaccggcggagttcatcagggtaatcagcaccatcagcgcggtcattttcactgcggccagcagcaggccttttttcggaataccgttgttatcaacttcgccatacactttcgggaagttaccgtcgttggcggcacgtacaccggcctggccaaccagcatcatccacgagcccagagaagtcaggcaggcaaaggcggtgaaagcggataccatcggtgcagcccagccgccgaggatggtagaggcgctaattgcgaacggcgcaccggacgcggccatctgagaagcaggatacataccggcgataacctgagtcgcggcgatatagacgataccggccatcgcagtgcccagcatggtagccagcggcacggtacgtttcgggtttttcaccatcccggtactcacggcggcggattctacgccaacgaaggcccacaggcagagcaggatacttttaataaccgcgtggctatcggtggtgctggaggtattccagttcgcctgataggtagcgacatcaaaccagtgccagccgacgaccgcggtcatgactaccggaataagcaccagtaccagaccaatagtggtcagacggctgacccaggtcccgccgagcatattaacgaaagtaaagatccacacgatggcaatacaggcaatacctgctggcaccgggttatttaaaattgggaagaacgtagagagataagaaactgcggtaatcccgatggccaggttaccaatccagtttgcatgataataaaggacaccggtctggaaaccgaatgccggagatatttcgccagcgtaggcaataggaccgccctgctgcgggtttttagtggccagtcgggcataaacataagccagagacatcgcaccaataattgaaatcacccagccccaaatggcaataccaccgatgctggccaggttcgcaggtaataatgcaatcccgctccccatcatattaccggcgacgacaccggtacaggcaaatagcccgatcttcttggcagaactcatggttgtttttctcctaagtttatttgggaggtacagatcatgatacagaaccattaattgacccgaccaactgccaacaagattactgatttgtacgagataagtcctaaagataaagtgatataaaaacaaacatcagacaaatgatattttgacctttttcgcttaacatataaacatgacaacagggtgtcagaaaaagataaacatcgttgtattacagcaacttacaagaagcagggcgtgttatctgactgttatttaaagcctcctgaatgctaaataaaaataacaacaagaggcttcatgagaaacataaatttaacctcaccatgcccaaaaccttgcacatgatgagggtttacttattctgaagagagaaagttgtcgagatatggaacgactcggttaaccgacgtctggaaaaccccattttcaatccagtacagggtatcttcgccaggacgtaaattaaacgccgtgatgtaagaatcggcagccagacggttctcacctttcatctcatagactttgcctaacagcacataatttagccatgacatctctaaatcaatcgcactattaattgcggtatttgcttcgtcgactttgcccttccccaatgaatccaccgcttttatttgataataaatcgccatgtcttttatacccggcatcgcccctacccgctcgacttcactgtagagggcggccagctgtttatcgtccagcggctgttgcgaatggcgcaatacatccaccagcgttttttcggcataggcgtaaataaaatccggcgcccgcttaatcacatcatccagcaggctactggccttacttaatgaatcgacgtcgcccttcattaacagctgatgcgactggtagaaataggttaacgccacgctttgcgagggctgatattgcctgagcatcgcctgcattcgcgccggccacggctgcgccagggcatccgacaggctgttcatcagatcgttctggatggtcagctggttatcgttggtcacaaagtagcgcttatccagcatcgtcgagctgtcggcgttgtccaccagctggaccgacataaagcactgctgcgcccgatagtggcgctgattgacgaactcgatggtcagcgttttcccggagctgctcggctcattgatgttgtagtccgttttgtcatgcaccataaaggtcgagaaggtgttcagcgaggtggtgatcaggctggccagtcctacggcgtaggagtgctgcgacgaccagttagcgcaggagttgccattcaccaggtggatatcgatatcgcgcggattgagcagcagacgcgccttgttgaccggcggccgcgattccatgctcgacagcgccaccagcgccacgcaggtgcccagcgccaacaggaacagcccccacaccagggcggtagtgaggcgcttgcggcctgacggcgcgctggccacggtaggagccggtggcggcgcggcggcatcagggagagggacagagacgtcggatggcgcaccggcggccggcggcgcaggaacggcggtcgacggcgcaggaacggcggtcgacggcgaaggcgtcagcgcctccatcgacggggctagctcctccccctcttcggtgcaccagatcaccggcaccgtgagcttatacccccgtttgggtaccgtcgcgatgtactcaaggctaacgtcgtcgccgtctttgagcgacttgcgcagttcagaaatactctgcgtgacgacgtggctggtcacaacgttccgggtccagacgttttcgataagctcgtcccggctaagcacttcccccggatggcgggcaaaaaagaccagaagatcgattaaacgcggttcaagggtaagctggcgccccttcctgctgatttggtttacagagggggttaccagccattcaccgacgcgaacaacaggttgtagcatacaagaaagccccagacaaaaagggaaaggcgcgatgataacacatttgtcctacctatttttgccaggggtcacttcctcaggcattaggccggaattggctctttattaacaataaaaagcaataattcattaacatcgtgatcatgaaatctatatatagcgataaaaacgcatttccgctgccgctattgcctaaggcaattccgatagcagaaaaaaataagcccggaggcttaacgcgctccaggctcagtgcgttgcgcgccgatacggcacgctttaaaaaaggttatttatacacttccgctgtggcttcaaagttagggccatgctcacgcgcagcggtgatcacgtagtactttccgcctttctcatcggccagcttggagagctgatcgtgcagatcggaaggcgaagagaattcgccaccggacggccccaccgagatcggcccgactttggtcagtttgaagtgtttcacttcttctttggtaatcaactgcgcggcggaggcgccaaatgcaacggcggaaagggctaacgcgactatcacttttttcatcctgcaatctccttggaattagccttcagtcaggccctttcagtatagacggcgatttactgagcgtgctaccgatgcgcttattttttggccgaggcgttcagtaacgcggcggtaccccttccgggcgggtcttaaagcgccggtgcagccacatgtattgctcgggcgccatcaggatgcactgttcgataatctgattcatccaggccgccgtaacctcggcgctcgccagcggcggcgtgcgctccggcgtcagggagatcaattcataccccatgccgttgggcttgcgccgcggaacaaacggcacaatcgtcgccccggacattttcgccagcatccaggtaccggtggtggtcgctgcctgttcgacggcaaacagcggggcgaagacgctgctggccggaccgtagtcatgatccggcgcgtaccagagaatttccccctcttttagcgccctgaccatccctttcagattttttcgatccagcatggtcttgttagagcgcaagcgtccccaggtttgcagccagtcaatcagcgggttatcgttaggacggtagacgccaattcctggggtaaacatgccgtacattcgcgcacccatttcgagggtcagaaaatggataccgatcagtaaaatgccctgcttttcttccagaagctccaccacctcgttaacgccgctggtctcggtccagcgcgctacccggtgcgtcggccagaaccaggccatgccggtctccatcagccccatgcccagcgattcaaagtttttcaccagcagcgcctcgcggtcggcggcgctcatctcgggaaagcagagttcgagattacgtctggcaatccgcgcgcggcttttcatcacccgcattgccagccgcccaagcgccgttcccagacggtagatcaccggatacggtaattgcaccagcagccacaaaaagccaattcccagccacaacagccagtaacgcgggtgcaacagcgcgcgggaaaatttgggtaaatttgacatagtaatcctgttaattcactcaataatagctgagcaaaaaccgcgaaataaagtagcggatcctgcacgtagtatttttccaattcgtgcggtaatactcaatcacaaagcgcgttattataagccgattccaggataaattcagcccttacgctggggactactctattattagacgcaacgcgtaaaatttcctgtttaatgcataaataaataaacctaacctctacggctcggccaattgtcgataaaatagccagtacatttgcctcagcctctcgaccaatacctcttttactcacgctttattatggcgatagcgaacgcaaacagtccgtttcgcccggtttgacacggccagcatgcggttatttgtgactggggcaaaggttaagcatcgacattgcggatccttttcccagatatgctacgtttacagcgctcattcgacgcaagtgcctttgccgacgtcgccgctttcagaagccatagtgagaaggaactatgacaatgaattatcaattagtgaagcaagtcagagaaaataacccattaagaaaaagcttcattgaccttgccgttaagacttttgacctgtcttttgaagagtggtatcagcaaggttactggaccgacgcctatatcccctatgcttttgtcgaacgcaataaagttatcgctaacgcttcggccaacatcatcgacctgcgctggcagggcgagccccggcgttatattcagattggcaccgtgatgaccgaaccggaccaccgtaataagggattagccggccagcttatccatcacatcctgcaggactggcagcaggaggcggacgccttctttttattcgccaatcccaccacggtggatttttaccccaaatttggcttcacccgcagcgaagagtatcaatatattatgccggtctccccgcgagccggtgattttcgtaaactggatatggacagccctgacgatgtcgccctgctccgccattactatgaaaaatccaacccgttctcaccgctgcgggtggagcataactttggcctgctgatgttttactgctcagcctttatgaagcattttgtctattactcggcaaaaaatgaggcggtggtcatcgccatgcaaaacggtccggtgctgatctgctttgatctattctgcgacgtgggcaagagcctgtcgacgctggtcaacgaactggccgatgaccacgtttaccaggccatcctcggttttacccccagtgaagaccggctcggcgagtatgagaagatagagggagaagatatcctcttcgtctatgaccagaaggaaaacctgtttaaagacaggaagttgatgtttcctttactggcgcatgcctgacggcgccgcgccgccaggcagatcagttataagtcaccacgaaggtcgcgctggcgttcgcttcgcccgcagtcactgcgggcccgttgaccgctcgccgcgtcgggagacgtaatcccgatagccctcgccaacgtaaatctgccgtggccggtagatggtcagcggcgcctggtgcatctcgttccagtgcgccacccacccgaccgtccgaccgaccgcggtgaccaccgcaaacattgacgaaggcagattcatcgctttaaggatcaccgcggtatagaaatccacgcttggcgacaggccattgtccacaaaataggggtcggtcagcgccacgtcctcaagggccatcgccacctgcagcaggcggtcggacatgcctacctccgccagcacccgatggctggtttcacgcaggatatcggcgcgcgggtcacggtgacggtagcgcgagttgccaaaacccagccggcgaaatgcctgcggatcgcgcttcgcctggcgcagaaacgccggaacctgatcgacgctttcaatctcctccagcattcgcatgctcgattcatttgctccgccatgcatcggcccccacagcgacgccagcccggcggcgacgcaggcgaataagttcgccccggaggagcccgccgcgcgcaccgtagtggtcgaggcgcactgcccgtgatcggcatgcagcaccaggatctggttcatcgcctgctcgataaccggattgagaacgtatttttccgccgggatagcaaacagcatctgcaggaaattaccggcataggagagatcgttgcgcggatacgccgcgggttgctcaatggtgtacttgtagctcatggcggcgatagtgggcattttcgacagcagccgggtggcggccagcgcccggtgctgcggattttccacgtccaggacgtcatgataaaacgccgccagcgcccccaccagggcgcacatcagcgccatcgggtgcgagtcgcgacgaaagccgctgcacatgcgggctatctgctcatggaccagagtatggcgggtgatggtctcgcgaaaggtttgatagctggcctcatccggcgcgtcaccgttcagcatgatgtaggccacttcgagaaaatcgcactggcgagccagctgatccaccggatagccgcggtgcaatagcacgctgttttccgtatcgatccacgagatcgccgactggcatccggcggtattggcgaagccggggtcatagctgcagaatccggactgatttagcccgcgcatgtcgactcccaccggcccccgcgttcccgacacctgcggcagggcgatgggcggttgttgtccggcaaaagaaagcgttaacggtgtagtgctcatcctgttagtcccccagcaagcttatcagcgacccgaagtcattcttcaggcggaaagaccaacataaccaatgtgatgcagcttattcattgatgtcatcactataaccctgacaaagaggatattttgctggccttcacggggaaacaggccgtctttccccagcccaccgccggatagcggcacaaatcgccaaggataaaggcgatcatcgctgtcaaaatttacgttgagtaaagaaaggatgaagaggagctaccatgaattttgtgctgtcgatgacccttatctgcatcgccatcgcctggctgatgatgagcctcctgccggtgtagatgcaccgctaaccgccacgccagtggtctggataacccctccttcaattgatttccgccgtggtcttcgcctctgaggtttcataagagccatataagaagtactggttgcatatcaggctgttgcgttttcccgccgaggggtaggctaaaggcccactgttaaggaggtgatatgtctggactgatcaatccacatgcggccccggaagaagcagcctatgcgctgctgattgagctcgttcgcgcccagcgcgtgccgcaatatgaaggcgaaatttccggcctgctggcgatgtacgacgaagccgttaaacactttaaagagaaagagaccgagcgttaggcgtggacatcgtggtgcgagaaaagcgtgacgcctgcggaagccgcgcaggcgttggctggatagcggcttgggtcatcagctgccgcggtaggtagagtatccgtactgactgagcagcagcgggatatgcagtttttgattttgctttgtgacattaaaaataaccggaatcaccgggaagaacgtattcatattttggcttttaaaatagtcaccggttttaaacgtcactttatacacccccggctccatattctccgcctgcggatagagcgatttaatccgcccatcggcatccgttttaccggtggcgatatgctgccagctctccccctgctgtttatccagctcaatctgcacccccggtgaagggagcccggtttgctgattaagaatgtgtacgctgagcgtcccctctggcgccgccagcgcgctgaagctgagcagagaaattacggaggcgataactaatttcataatcgtgaccttattgggcaagtgaaagtgccctaactatagtcagcgcggcggggaaaaaaattaaactttttgttatcagtttgagttgatgggtactgtctccacacacaacacgctgaaccggtttcctcgtaagaagaggaagtgtcttatgagtaggtagccccgtgctcttagtaacaggatacggtgacactaagtctatcaggcaggggaaatagatttgctgggttcaaatatcacaaggtaaaaagatatacgccgtggcctctgccgcctctaccagaacagtgcttactgcaaatgggctgcagtattcgaaataatcatttaatattatttaaactactattccagtgtaagtaatcacctggttcagatattgatcgttatcattgattctcttgtcgccacgccttaaccatctcctttgttacctctttcttgtagcaaataggtgagtacccaccagctttgctccaggcactgcggccaccgcacgagctgccgttccgggcggtattgaagggacaggcacaagtaccggggtaggatgcgacagagtcatcaataatcctttgactgacctgatcatcgcttaaggaattcgatttggcgatggaaatatctgatgcaaagacgcacacaacagcgaatacggagatggcgacgaatttgatgttcattcggatctttccaggtagtggatgaacatcgagggtatgctttcaaatagtgttcaatattgatctataacaactgtacttcacgccagcttaaaatgcgatatttaacccagtcagacagaacctaaagctataatgactattagcctgttaccggcaacatattttcacattcctgcagagcgcttattctgcactcagctataaccagcattaaccattctgttcgatattacagagcagtaatgctgtactctgactggccatcgtccgacagatactacaagacattagaatcatcgaaatggtccgtcgatatgctcacctggcacctaaccatttaactgagcacgcacgtcaaattgactcaatttttgcaaatttttgcagaagatgtcccaaatatgtcccacaaggaaaaatcagcgactggaggaagttgataagtgattgattattaaatggcacgccctacaggattcgaacctgtgacctacggcttagaaggccgttgctctatccagctgagctaagggcgccctgagaagcgagtgcttcgcggagtgaaacgcgtggaattatacggtccacgtcggttgagtcaatccattttgccaggaaactgcggggcttatacgacgctggcgaaatatcctccaccaactgtacaagaagcataccgccgggcctaatgcgcgcgtaaatcgactcagtggccaggcgcaacgcacttataaccatgtaataactatggccataacaggctaaattagcctcagacaggataaaacagcaaacgaggactgacagcgaggcccgcttctgacaaaatatcctcatccccctttcgtaaagatacagatggaatcctctctctgatggcagcaaaaattattgacggtaaaacgattgcgcagcaggtacgctctgaggttgcggaaaaagtgaaggctcgcgttgcggccggaaaacgcgcccctgggctggccgtcgtgctggtcggcagcaacccggcctcgcagatttatgtcggcagcaagcgcaaagcatgtgaagaagtgggcttcgtctcccgctcttacgatctcccggaaaccaccagcgaagccgagctgctggagcttatcgacactctgaatgccgataagaccatcgacggtattctggttcagctgcccctgccggcagggatcgataacgtcaaagttctcgagcgcatcgcgccggataaagacgtcgacggcttccatccttacaacgttggccgcctgtgccagcgcgcgccgcgcctgcgtccgtgcactccgcgcggtatcgtgaccttgctggaacgctacaatatcgacacctacggcctcaatgcggtggtcattggcgcctccaatatcgtcggtcgcccgatgagcatggagctgctgctggccggctgcaccaccaccgtcacccaccgctttacaaaaaacctgcgccatcatgtcgaaaacgccgacctgctgatcgtcgcggtgggcaaaccgggctttattcctggcgagtggattaaagaaggggcgattgtggtcgatgtcggcatcaaccgtctggaaagcggcaaagtggtcggcgacgtggtgtatgaagatgccgccgaacgcgcgtcctacatcaccccggttcccggcggcgttggcccgatgaccgtcgccaccctgatccagaacacgctgcaggcgtgcgaagagtatcacgacgttgaggaggcctgagatggcgacattttccttaggtaaacatccgcacgttgagctgtgcgatctgctgaagctggaaggctggagcgaaagcggcgcccaggcgaagatcgccatcgccgacgggctggtaaaagtcgacggcgcggtggaaacccgcaaacgctgcaaaatcgtcgctggtcagacggtgagctttgaaggccagagcgtaaccgtcacggcctgacaacgaaaagaaaaacgcccgcttttgcgggcgtttttttatggcttacttccggcgccaggtggtgccctgcgggccgtcttctaacacaatccccatctcgttaagacggtcgcgcgccgcatccgccgccgcccagtctttcgctttgcgcgcgtccagacgctgctggatgagcgattcgatctccgccacttccgcgtcgtcaacctgcgcgccgctctgcaggaacgcctccggctcctgctccagcagacccagcaccgcagcaagcttacgcaggtgggccgccatggcgttcgccgcggccgcgtcctcggttttcaggcggtttacttcacgcgccatatcgaacagcaccgaataggcttccggggtgttgaagtcgtcgtccatcgcctcgataaagcgtgcttcgaaggcttcgccccccgccgcgtcgacggatttgtccgtcccgcgcagcgcggtgtacagacgctccagcgccgaacgcgcctgcttgaggttctcttcgctgtagttcagctggctgcgatagtggccggacatcaggaagtagcgaatcgtctccgcatcgtaatacttcagcacgtcgcggacggtaaagaaattacccagcgatttcgacatcttctcgcggtcaaccatcaccatgccggagtgcatccagtagttgacgtattcgccgtcgtgggcgcaggtggactgggcgatttcgttttcatggtgcgggaacatcagatccgaaccgccgccgtgaatatcgaagtggttgccaagctgcttgcagttcatcgccgagcactcgatatgccagcccggacggcccgcgccccacggcgacggccagcttggctcgccctctttcgacatcttccacaggacgaagtccatcgggttacgcttgacgtcaaccacgtcgacgcgcgcccccgcctgcagttgatcgagatcctgacgcgacagcaaaccgtagttcgggtccgtcggcacgtcgaacatcacgtcgccgttatctgccacgtaagcatggcctttggcgatcagctgctcggtgatctcaatgatctccgcaatatggtgcgttgcgcgcggctcgctgtcgggacgcagaatattcagcgcgtcaaaatctttgtgcatttcggcaatcatgcgatcgaccagcgcgacaaagctttcgccgttttcattagcgcgcttaatgattttgtcgtcgatatcggtgatattgcgcacgtacttcagcttatagccgagaaaacgcagatagcgcgccacgacgtcaaaggagacgaaggtacgtccatggccgatatgacagagatcgtaaacggtaataccacacacgtacatgccgacttccccggcatggataggtttaaattcctctttctggcgcgtcagtgtattaaaaatttttaacatcgaagattccgtgtagacgtgtgtgggtaatgaagtctctataatacccataattcagaccggacgcagcacacattgcaaggtgcatcgacccccgcggttatgctataacacccccctatatctcacccgacaccgggtgctggcaccacactcatcggaacaggatgcaaaaatggttactttccacaccaatcatggcgatatcgtaatcaaaacgtttgacgacaaagcgccggaaacagttaaaaacttcctggactactgccgcgaaggtttctacgacaacaccattttccaccgtgttatcaacggcttcatgattcagggcggcggttttgaacctggcatgaaacaaaaagcgaccaaatctccgattcagaacgaagcgaacaacggtctgaaaaacacccgcggcacgctggcgatggcccgtactcaggcgccgcactctgccaccgcgcagttcttcatcaacgtggttgacaacgacttcctgaacttctccggcgaaagcctgcagggttggggctactgcgtcttcgcggaagtggttgaaggcatggacgtggttgacaaaatcaaagcggttgccaccggccgcagcggcatgcaccaggatgtgccgaaagatgatgtgatcatcaaaagcgtcaccgtcagcgagtaattcgtggcgacactttttattgcagatttgcacctgcaaacagaagaaccggcgatcaccgccggttttctgcgttttttacagggcgaagcccgccaggcagacgctctgtatatccttggcgatctgtttgaggcatggatcggcgatgacgatcctaacccgctgcaccaacaaattgcctcggcaatcaaagccgtcgtcgacgccggcgtgccgtgctacttcatccatggcaaccgcgattttctcgtcggccagcgctttgcccgccagagcgggatgatcctgctcgccgaagaagagcgactggacctctatggccgtgaagtcttgatcatgcatggcgacacgctgtgcaccgatgaccaaggctatctggcgtttcgcgccaaagtccacaccccgtggatccagcgtctgttcctggccctgccgctgtttatccgccgtcgcatcgccgcccgcatgcgcgccgacagcaaagccgccaacagcagtaaatcaatggaaattatggatgtgaatccacaggcggtagttgacgcaatggagcggcatcacgtgcagtggctgatccacggccatactcatcgcccggcggtccatgaactgcaggccaacggccaacccgcatggcgtgtggtacttggcgcctggcacagcgaaggttcgatggtcaaggtgacgccggacgacgtcaaactaatccactttccgttctgattcctgcgcgagcacaattccgaaagcgccttttgcccgggcgaaggtgcgcgcttccccccgccctgcatgctagtcttccacaacgtcactctcaaggaacgagcatgagcaggaaaaagtggagtcagccgctgacgtggggaatgatcatcgcgatcctcaatccgttaggggtaagttatatcgccttaatcggcgtcgttatcggcaacacgctgacgtttgtctggtgtgcgatgctggcgtgggctatctatttttatgccatttatttgctctgcacccgccctcacgatagccggctggtacaaatctatttactgcttatgggcaccctgatgctcccgtgggggttagtgctgcttatcacctgtatcatgagggagataaaggtcaatcaggcactcacgccatcacctccaggcgagacaaaagacggctaaccatgcgcacgcaaccgttttccttgctggcagttcatgctattctctgtggcctctaaagcagtgtgaaacacacccacaggagttttaagacgcatgtcttcccgcaataattcggcgcgtatcgccatcgtgatggggtccaaaagcgactgggctaccatgcaatttaccgcagaaatccttgatgccctgaacgttccgtaccatgtcgaagtggtctccgcccaccgcacgcccgataagctgttcagctttgctgaaagcgccgaaagccacggttatcaggtgattattgcaggagcaggcggcgcggcgcatctgccgggcatgattgcggcgaaaaccctggtgccggtgctcggcgtaccggttcagagcgcagccttaagcggtgtcgacagcctctactccattgtgcagatgccgcgcggcattccggtcggtaccctggccatcggcaaagctggcgctgcgaacgccggcctgctcgccgcgcagatccttgcccagcacgatgctgaactgcaccagcgcctgagcgcctggcgtcaggcgcaaaccgatgaagtgctggataatccggatccgcggggtgcggcatgaaacaggtatgcgtgctcggtaacggccagttaggccgtatgctgcgccaggccggcgagccgctgggcatcgccgtttggccggtcggcctggaagccgacccggaagcggtgccgttccagcagagcgtcatcacggcagaaattgaacgctggccggaaaccgccctcacccgcgagctggcccgccacccggcgttcgtcaaccgcgatgtcttcccgattatcgccgaccgcctgacgcaaaagcagctgtttgacaagcttggcctcgccaccgccccgtggcagctgctggcggataaaagcgagtggccggcggtgtttgctcgccttggcgaactggcgatcgttaagcgtcgcgttggcggttacgacggccgcggccagtggcgtctgcgggaaaacgagatcgatcagctaccggccgataactacggcgagtgcatcgtcgagcaggggattaacttctccggcgaggtatcgctggtaggcgcccgcgctcatgacggtagcaccgtcttctacccgctgacccgtaacctgcatcaggacggtattctgcgcgccagcgtcgccttcccgcaggccaacgctcgccagcaggaacaggcggaaagcatgctgacggcgatcatgaacgagctgaactatgtcggcgtgatggcgatggagtgcttcgttaccgccgaggggctgctgattaacgagctggcgccgcgggtgcacaacagcggccactggacgcagaacggggcgtctatcagccagttcgagctgcatctgcgggcgattaccggcctgccgctgccgccgccggtggtcaacagcccgtcggtgatgatcaacctgatcggcaccgatcttaactacgactggctgaagctgccgctggtgcacctgcactggtatgacaaagaggtgcgcccgggtcgtaaagtcggccacctgaacctcaccgacagcgataccgatcgcctgagcgcgacgctggaagcgatcaagccgctgctgccgccggagtacaccagcggcctgttgtgggcgcaatcgcagctcagctaagcccttcgtgccggggatttgatctatccccttccccggcacaccttgaggcgcgtacaatcccccccttgctgtaaagctcatttctgttttgacttcagaggataccccatgaccaatgggacggattatcgcgccattctcgccagcgatacgccactgattgacgtacgcgccccggtggagtttagccaaagcgcgatgccggcggcgatcaacctgccgctgatgaatgatgaagaacgcgccgcggtcggcacctgctacaagcgccaggggccggaagcggcgctggcgctcggccataaactggtccagggtgacctgcgcgccagccgtactcaggcgtggctggaagcgtgcgcccgttacccgcacggttacctgtgctgcgcccgcggcggccagcgctcgcatatcgtccagcagtggctgaaagaagctggcgtggattaccccctgatcgtcggcggctataaagcgctacgccaggcggcgatccaggccaccgacgaactggtgcagcgcccgatcgtgctgattggcggctgtaccggcaacggcaaaactcagctggtttgctcgcgcccggacggtatcgacctggaagggcttgctcatcaccgcggttcttcattcggtcgaaccctgcaggatcagcatccgcaggccacctttgaaaaccacctggcggtcagcctgcttaaaaaagccgaacagcagacccgctgggtgctggaagatgaaggccatatgatcggcgccaatcatctaccggagagcctgcgcctccgcatggcgcagtcgccgctggcggtggtggaagatccgtttgacgttcgcctcgaacggctgcgcgaagagtatttcgatcgcatgtatcgcgactttatcgccgcgtatggcgaagagaaaggctggcaggcatacggcgagtatctgcatcacggcctgtttgccatccgccgtcgcctggggctgcagcgttttgctcagctcactgaacggctcgatgaggcgctggtgcagcagcagcgcaccgccagcaccgaggcgcactttgcctggctggtaccgctgctggaagaatactacgacccgatgtatcgctatcagttggggaaaaaagccgggaaaattctctttcgcggcagctggcaggaggtcgcagcctggctggcgaagtaatcgcatgctctattgtcccggcttgcggcgtaaacgccttagccgggctaccggtcggcgcgatttgtagccacggtaagcgcgcgcgaccggggagttgtgaccgcttagaagtcgtagcgcagacggaccaggttcatatcgccaaggttgtcggtgctggaggtaaacacgtgttcgtagtcaacgcggaaaccgtaatccagctggaagctaatccccagaccgttatcgatacgctggtagttgcggccgttcacatattccagacggtcgcccataaagtacggctgaatagatttaacagcgtattgattgatcgggaatttatagcccgcaaaatattcaatcccccaggcgtcaccggcaaagtaattatgcacatcggttttcttggtggtgaggaagttctgataccagccgccgccgaaggagaaggtccagttatccggggtccagctcatcgcggtaccgacgatattctggtcataggttttgctgtcggcgcttgacgggtcgcgcatttcggcgcgggtgtagttccacgcggtaccccaggtcagatccttcatgatgtggtagtccgcgccaacagaaccaccgcctttacgcttgtaacgcaggccgttacccggcaggtattcgctgtcttcgaacagataagagccgtaaagatcgacatcacctacagttttcttatatttcagcatattacgtgaacgataggagccatcgtaatcgccattaataccgttccccggggcctgaccgatcatatcgtagtcccagatatcggttttcacccccaccacatcatagtaaatgctgttctgctgcccgtaggttaacgtaccccaggtatcgcttttcaggccggtatacagcatgcggcgggtggtattgttcgcgccttccgcgtagtggttatcccagtcaaacagcgccggaatgttcacgcccagctcatagtagctgatccagctaatatcatcgaacaggtagtaatccgccgcgaagcggaagcgggtgccgccgtcaaaaccgttacgcttataggagcctttgtcgccatcgccggtcatcatgttgaactgcggccggatactgccgccgacggtaaagttaagccggcttaacggatcgcccgcctgcggatcttgtttcagcagcgtaatctccgcgtgggaaggcaatgacgttaacgctaatgctgcgccgatcgagatcgccagcgcttttattgtgtgtgccatagtttttccttgattaataagccaccttatattttccagttgaatattaaccgcgaatcagcatagcgtgttgttgggtttttaatgttttgtgctcttaaaaatcaatgatttatcaatttgtgcgtttaaaataaaagcgccgccaaaaacggcggcgcatcatcaaaatgcaatattcttactggctaaactggcggaatagcgcttttccttttaacagacgcagccccagcccgccgccgcacagggataacaacaccgctcccgtcagcggcagcaacacccacaggcgccagtccggcgcccagggaaaatcaaagactttcgtctgcagcatcgccagcgccacttccgcgcctatcgccgccaccaggccggaaaccagccccagcagggcaaactccgcccacagcgtagcgcgcagcagcgattttccagcccccagcgtgcgccagaccaccagctcctgatggcgttgacgcataccgacctgcacctgcgccagcaacagcagcacgccgcaggccgtcaccaggcctaccatcacctccagcgcccggctgacctgggagagcacctggccgacctgacgcaggatggcgccgatatccagcatactgacggtgggaaactcgcggttcagctgggtcaacatcgcgggaccgttatcccagcggaagctggtgagccagctctgcggctgcccgtccagcgccccggcggggaaaataaagaagaagtttggccgcaggctctcccagtctactttgcgcgcgctgctgaccttcgcgctgaactcctgggtatcgccggtaaaggtcactgtatcgccgatctttatccccagccgctgcgccagcccctcctcaatcgatacctcgcccggcttcggcggccagctgccggccaccagcggattatgatccggacgctgttcgctccaggtgagattaagctcgcgattcagcgcttcgtctttgttcccgtccgtggattgaccgttgatctgcgtcagacgggcccggacgatcggatagaattccgccgcccgcgtctggtgttcggcgaggaaggtcttcaccggcactatctgctcaggggcgatattgatcagaaagtagttcgggctctgcgggggcaactgctgctgccagcggtcaagcagatcgccgcgcagcaccaacaggagcgccagcagcataaacgacagggaaaacgccgccagctggctgagggtcgaccacggctggcgcagcaggcggttcaccgccagacgcagcggcaaggctttgagcgtcaggcgtttgagcagccacagcaatccccagcccaccaggccgcacagcagcgccagcaccaccgccccggccagcaccgaccacagcagcgggctgccgcccagcagccaggccaacaggcccaccaccacgacgctaaccgccgggatccagattttcaacggccagacgttagccaccacatcctgacgcagcactcgcagcggcagggtcgccagcagcagtcgatagggtcgcaggcccaccagcagggaaatgacgcctgtcgccccgatagcccacagccacggccaaccgctggcagcgggtaacgcggcgggcagcaccggtttgagcaccagcagcagcagacgctccagtgccaggcccgccaccccgccggttatcaccgacagcgtcaacagcagcagccattggccgacgataagcttgcgcagctgcgaccttccggcgcccagcgtcttgagtatggcgaccagatcatagcggctgcggcagtagtggctcatcgctaccgccactgcggcgacggccagcagcagcgtcaacagcgcggataacagcaggaattgctgcgagcgctcaagagatttgcccagcgcgctgtcgtcctgttcaaggccaatccagcgatgttccgggccgagcttcggcagcagccactgctcataattggccagctgttcagcgtcgccggcgaacttatatcgccatgcgacgcgactgccgggctgcacggccccggtttttgccacgtcggccatattcatcatcagtcgcggcgccatctggaaggggttaaaccccgcatccggctcctgaatcacctccccggcaatgcgcagcgtggcatcgccaacgtcaatcgtatcgccggttttcaggttcaggagcgccatcagccttggcgccagcagcacgctccccgcctgcggcttcagccccggcggctgcgtctcgagggtgccatacagcggataacggtcgtccaccgccttaacgtccgccagctgcggcgtatccccggcgaacgtcatggtggcaaagctcagctgctcgccgacggtcagccctgacttccgcgcctgtgcgatccactcggcgggcacctcgcgcgaactgcgcagcgtacggtcgccggccataaactcacggctttgctggctaaggcctttctccatccgatcgcttatcgaccccagcgccagcacgcaggccacggcgaggcttaacgccagccagacgatcagcagcgacggcgagcgccattcgcgccagaaccagcgggcgatcatgcttcctcccgcagctggccatccaccaggcgcagacggcgatcgcagcgcgccgccagcagcggatcgtgagtgacgaggatcagggtggtgccgtgttcgcgattaagcgagaacagcagatcggcaattttgtccccggtctggcgatcgaggttgccggtgggctcatcggcgaacagaatggccgggcgcccgttaaaggcccgggccagcgccacccgctgctgttcgccgccggagagctgcgccggcaggtggtgcaggcgtttgccaagtcccagctgctcaagcagcgcgcgggcatcgccccggctctggctatcgctggcgccgcgcaacagcgccggcagctcgacgttctccagggcgttgagcgtcgggatcagcataaacgactgaaaaacaaaaccaacgtgctgcgcccgcagcgccgcccgcgcctcttcatccatccggtgcagcggtttgcccagcatcgatacttccccgctgctgccatcgtcgaggccggcgaggatcgccagcagggtcgatttaccggaacccgactcgccgatcagggcgatggtctgccgcggtttgacaaccagctcaactccggtaaggatggagagctgatgctccccctgaccgacggacttcttaagatgatgaacttcaagtatgttttccgctggcatgtgcctttcctgttgttgttcctgtttacctgccgcgcgatggcggcggacacgctgctgatcctcggcgacagcctgagcgctggctatcggatggcggccaacgccgcctggccggcgctgctcaatgagcagtggcaggcgaaaacgccggtggtgaacgccagcatcagcggcgatacctcgcagcaggggttggctcgcctgccagcgctgcttaagcagcaccagccgcgctgggtgctggttgagctcggcggcaatgacggactgcgcggttttccgccgcagcagaccgagcagacgctgcgcaccattattaaagatatcaaagcggccaacgccgagccgctgctgatgcaaattcacctgccggcgaactatggccgccgctataatgaagccttcggcgcgatttacccggccctggccaaagaattcgctattcctctcctgcccttttttatggaggaggtctatctcaagccgcaatggatgcaggacgacggcattcacccaaatcgcgacgcgcagccgtttatcgccgactggatggctaagcggctggctcccttagttaatcatgactcctgaacgccaggggtcgctgacaggtaaagttatgcaaaaaacggttttagtgacaggctgttccagcggaattggtctggaaagcgcgctggatttaacccgccagggctttcgcgtgctggcggcctgccgcaaagcagaggatgtcgcgcggatgcaggatctggggctaaccggtattttgctcgatctggatgacccgcagagcgtggagcgcgcggcagcggaggtgattgcgctgaccgataatcgtctctacggcctgttcaataacgccgggtatggcgtctatggcccgctgaacaccatcagccgccagcagatggaacagcaattttccgctaactttttcggcgcgcatcagctcaccatgctgctgctgccggcgatgacgccgcacggcgaagggcgcatcgtgatgacctcctcggtgatggggcttatcgccagtcccggccgcggagcctatgccgccagtaaatatgccctcgaggcgtggtccgacgcgctgcgcatggagctgcgccacagcggtattcaggtcagcctgattgaaccgggcccgatccgcacccgctttaccgataacgtcaaccagacgcaaagcgataagcccgtagaaaatccgggcatcgccgcccgctttaccctcgggccggaggcggtggtggaaaaagtgcgccatgcttttaccagcgataaaccaaagctgcgctatccggtcaccctggtcacccacgcggtggcgctgcttaagcgcctgctgcctgcccgcgcgatggacaaaattatccacggctgagttgaagcgcggaatgccgcccccatgtaaaacagaaatcgactaacgagaaatgcccatgtccgaacagaatattgtcaacattagcgaagcgaacctgcagcagacgctacagcagtccatgaacgttccggtgctgttttatttctggtctgcccgcagtcagcactgcgaacagctgaccccggtgctcgagcgcctggcagcccaatacaacggccagttcacgctggcgaaggtcgattgcgacgccgagcagatgctcgcctcacagtttggtctgcgcgccatccctacggtttatctgttccagaacggccagccggtggatggttttgaaggcccgcagccggaagaagcgatccgcgccctgctggataaagtcctgccccgtgaagaggagctgaaagctcagcaggcgctggccctgatgcaggaagaaaaatacgccgatgccctgccgctgctgaaggaagcctggcagctgtcgaatcaggaaagccagattggcctgctgctggcggaaacgctgattgctctacaccgttccgatgaagcggaaagcgtgctgaaaaccattcctctgcaggatcaggatacccactatcagggtctggtggcgcagattgagttgctcaaacaggccgccgacaccccggaaatccagcagctgcagcagcaggtggaacagaatccggaggatgcgcagttggcctcccagctggcgctgcagctgcatcaggtcgggcgtaatgaagaagcgctggccctgctgttcagccatctgcagaaagatttaggcgccggcgatggccaggcgcgcaagatgctgcaggagatcctcgccgccctcggtactggcgatgcgctggccgccaaatatcgtcgtcagctctattcgctgctgtactaatccgttgccttccccggatagcgctgcgcttatccgggctacgcgaactatgcggaacgtagcctaagtagcccgggtaaggcgtgaacgccgcaacccgggatcgttcacgggcgctttttcagctgcgtcaccactagctgatggcgggcgttgaagaacttccggtaggtcagatagccggcgataatcgtcgacaggctggcggtcgacagcagcataaaggtcaccatgatctggtacttaatcgccttcaccgggtcaataccggcaaaaatcagccccgacatcatcccaggcaagctcaccagaccgaccgttttcgccgaatcgacggtgggaatcaatgacgcgcgaatactctcgcgaatcagccgcgctgaggccatcttcggcgtcgcgccgaggctcagtttctcctgaatctgctgctgctcgctgctgaagcgctggcccatattgttgtagcacagccccaccgccaccatggcgttcccggccaccatcccggcaatcgggatcacctgcatcggcacgaaggcgatcgagccagaaaacaccagtaccgccagcgttagtccagcgccagtagtgatggcgataaacgacgagataaaagctttgtcgatatatttactgcgcttcttcgcattccacgccgcgttaaagcagataaacagcaccatcaacagcgtcagaaccgcatgattgacgttaaagatatatttcagcacatagccgacgattatcagctgcacgatcgcccggcaaatactccagataatatctttttccagcgccagcttttcccgatagctgaccagaatagcgatcagcaccagcaccatcgacagcgccagcgattcgttcgtaatgttatgcccgttcatgctgtacctcctgcatatttccgccggcaggttgcagcgtaatcacttcatcggcatgcgaaatttcattgcgatcgtgggtgacccacagaacagcgacctgtttttccgttgcgtagccatgaataatttcattcacattctgtttattactttcatccagcgcgctggtaatttcgtccagcagcagcacgcgcggcagaaattgtagattgcggatcagcgatacgcgctgcttttccccgccggagagttcgttaatggatttttccagcatattttcgtcaaggccaaagcgctgcaggtcggccagcagcgcctgcggatccggttgtttattgcggatctgccacggaaaaatcagattatcgtaaaccgaatcaccgaacagggccggcgtctgcgcgcagtaagagacctgttggcgatacctttccggcgacagcgtcgcgacatccgcatcgtcgaagaacaggcgcccggaggttgggctgagcagcgaggcgataatcttcagcaaggtacttttcccgcagccggaagggccggtaatcaacttgaattctccggcgcgaagctgaaaactaatattgtgtaaaataacggcgtcgtcggtcttaaaccccacaccgtcgagacgcaaaagcgcgttattttccttcatgagtcttcctgattattttctgaaacaccgctagtttaccgcactttcctttctccaggatgaggagaaagatatactcagtttaaacatgcgctatttccttgtagcgccccgccaggcaacaagacaggaggtttttgatgctgatttttattcctatccttattttcgtcgcgctggttattgtggccgcggcggtgaaaattgtcccgcagggctaccagtggacggtggagcgcttcgggcgttttacccagacgctgcagccgggattaagcttagtcgtgccgtttatggaccgtatcggccgcaaagtgaacatgatggagcaggtgctcgatatcccctcgcaggaggttatctcccgggataacgccaacgtcaccatcgacgcggtctgttttattcaggtgatcgacgcgccaaaggccgcctacgaggtcagcaatcttgagcaggcgatcgtcaacctgacgatgaccaacatccgtaccgtgctcggctcaatggagctggacgaaatgctctcccagcgcgacagcattaacacccgcctgctgcatatcgttgacgacgccaccaacccgtggggggtgaaaatcacccgcgtcgaaattcgcgacgttcgcccgccggcggagcttatcgcctcgatgaacgcccagatgaaagccgaacgtaccaaacgcgcgtacatccttgaggccgaaggggtgcgacaggcggaaattctgaaagcggaaggggaaaagcagtcgcagatcctcaaggccgagggcgaacggcagtccgcgttcctgcaggcggaggctcgcgaacggtccgccgaagcggaagcccgcgccacccaaatggtctcctcggcgatcgcctcaggcgatattcaggcgatcaactacttcgtggcgcagaaatacaccgatgcgctgcagcaaattggcgccgctaacaacagcaaagtggtattgatgccgctggatgccagcagcctgatgggatcgatcgccgggatcagcgagctgatcaaagaaggcgctggcgatcggaaaaaatcatgatcggcatgatcctcgcacacccccatctgttctggctaagcctcggcgggctgctgctggcggccgagatgctgggcggcagcggatacctgctgtggagcggcgtcgccggcgtggtgaccggcgccctgacctggctcctgccgctgagctgggaatggcaaggcacgctgtttgccgttctcaccctgctggcggcgtggctgtggtcgaaatggctgcgcaagcgcgtcaaaacgcagcgcccggccgatgcccagctcaaccagcgcgggcagcaactggtgggccgccgcctgacgctggatgccccgctggtgaacggccgcggccacgtccgcgtgggcgatagctcctggccggtgattgccgatgaagacttcgcggcgggcagcaaggttgaagtgattgccgtagaagggattacgctacgaatcagacccgccgtccgttaagcctgcgccttgcgatggcagcagccggaaagattatcgataatcgggcactccgcgctgtcgtcgccggggcaggattcggccagcgccagcaggtgcgcgcgcatattttgcagctcgcggatatggttctcgatatccgccactttctccagcgtgcgttttttcacatcggcgctgtgccgcgacgggtcgttgaacagggccaccagctcgcggcactcttccaggttaaaccccacctgccgcgcctggcgcagcagcgtcagctcatcgagatgctgctgactataggtgcggtagccgttttcgctccgcaacggcggcgtcaccagccccttctcttcataaaaacgaatcgctttgctggttaagccggtttttttcgccacatcgctaatattcattttttctccttgaccttccccttgctggaaggtttaaccttcttaatactcgatgaaagagtgggtctggtcaatcgttgaccggaaaattattcaggagttatttatgtctaacactatcgacctgacgctggatggcctctcctgcggccactgcgtcaaacgcgtgaaagagagtctggagcagcgtcctgacgttgagcaagcggaagtcaccctcactgaagcccatgtgacgggcagcgccagcgcgcaagcgctgattgataccgttaaacaagccggatacggcgcggagctcagccacccaaaggctaaaccgctggcagaatcatcaatcccgtcggaagcactgacagcggccactcctgagcttccggcagcccatgacgaagatgacagtcaacagctgctgatcaacggcatgagctgcgccagctgcgtctcccgggtacaaaacgcgcttgccgcggtgccgggcgtctcacaggcacgggttaacctggcggaacgcacggcgctggtgatgggcagtgcgtccgccgcagaattagtgcaggcggtggagaaagccggctatggcgcggaggcgatcgaagacgatctgcaacgccgcgaacgtcagcaggaaaccgccctcgcgacgatgaaacgttttcgctggcaggcgattgtcgccctgctggtcggcgtgccggtgatggtctggggcatgatcggcgataacatgatggtcagcgacgacaaccgttcgctgtggctggttatcggccttgtcaccctcgccgtcatggtcttcgccggcggccacttctaccgcagcgcgtggaaaagcctgaaaaacggcaccgccaccatggacacgctggtggcgctcggcaccggcgtcgcctggctgtactcgatgagcgtcaacctgtggccgcagtggttcccgatggaagcccgccatctctattacgaagccagcgcgatgattatcggcctgattaacctcggccatatgctggaggcccgcgcgcgtcagcgctcctcgaaagcgctggaaaaactgctcgacctgacgccgccttcggcgcgggtcgtcacgcccgagggcgagaaagatctgccgctcgcggaagttcaggccggcatgacgctgcgcctgactaccggcgaccgcgtcccggtcgacggcatgataagccagggcgaagcctggtttgatgaagcgatgctcaccggcgaaccggtgccgcagcaaaaaggcgatggcgacgccattcacgccgggaccgtggtgcaggatggcagcgtgctgtttaccgccagcgccgtcggcagccagaccacgctggcaagaattatccgcatggtgcgccaggcgcagagcagcaaaccggagatcggccagctggcggataaaatctccgccgtatttgttccggcggtggtcgtcattgcgctgattagcgctgcgatctggtacttcttcggcccggcgccgcagatcgtctataccctggtcattgccaccacggtactgattatcgcctgtccgtgcgccttaggcctggcgacgccgatgtcgattatctccggcgttggccgggcggcggagtatggcgtgctggtgcgcgatgccgatgcgctgcagcgcgccagtgaactcgacaccctggtgttcgataaaaccggcaccctgaccgaaggcaagccgcaggtggtggcggtgaaaactttcgctggcgttgatgagcataccgcgctgcgtcttgccgccgcgctggagcagggctcaagccatccgctggcgcgagcgatccttgataaagctgccgacggcccattgccggaagtcagcggcttccgcaccctgcgcggccttggcgtcagcggcgaggcggaaggtcatcgtctgctgctcggtaaccaggcgctgctcaacgagcagcatatcaataccgcggaggtggaaagcgagatgacagcccaggcctcacgcggcgccacgccggtgctgctggcggtggatggtcaggccgccgcgctgttcgccatccgcgacccgctgcgcgaagacagcgtcgacgccctggcgcgtttgcatcggcagggctaccggctggtgatgcttaccggggataaccccaccaccgcgaaggctatcgccaaagaagccggcattgatgaagtgatcgccggcgtgctgccggacggtaaagccgatgccattaagcgtctgcagagccaggggcacaaagtggcgatggttggcgatgggattaacgacgccccggcgctggcccaggcggatgtcgggatcgccatgggcggcggcagcgatgtcgctattgaaaccgcggcgatcaccctgatgcgccatagtcttcacggcgtggccgatgcgctggcgatttcgaaagcaacgttacgcaatatgaagcagaacctgctgggcgcgtttgtctacaactcgctgggtatcccgattgccgccgggatcctctggccgctgaccggcaccctgctcaacccggtggtcgccggcgctgcgatggcgctgtcgtcgatcaccgtggtgagtaacgccaaccgcttgctgcgctttaaaccaaaagagtaaacgccgtcagatgaaacgggcgccgacgttgttcggcgcccgtttttttgccgggacaagaaaagcccgccggaagggtgacgtgtatcaccatatgcgctagcatgaagtcctcacacttcggagcgcgtatgggcctgttaaaccggataaaaatgctgtggcgagccgccgtcggctcgtcttattcctggcctgcgatggatatcgtcctgcccggcgaacgctatttgcacctcgtcggcagtatccatatgggcacccgcgacatggcgccgccgccggcgaagcttctgaaaaaaatacgccaggccgatgcgttaatcgtcgaggccgatatcagcggcaatgaaaccccgtttagcaatctccccacttacccaccgctggcggaacgcctgagcgatgcgcagctgagcgagctagaggcgcgaaccggcgagctgggcctgtcggtcgggctgttcgacagccagccgctgtggcaggtggcgatggtcctgcaggccacccaggcgcagaagctggggctgcgaccagattacggcatcgattatcagttgctgatggccgcccgcgagagcaacatagcggtgatggagctggaaggcgccgacagccaaatcgcgctgctgcgcgagctgcccgacggggggatggcgctgctggaggatacgctgacccactggcgcaccaacgcccgtttactgcaggtcatgatcggctggtggctggagcaaccgccgtcgcgcggcgcggtatcgctgccgacgacctttagccagtctttatatgatgtgctgatgcaccagcgcaacctcgcctggcgcgagacgctgctggccttgccgccggggcgctacgtggttgccgtcggcgcgctgcacctgtatggcgaagggaatctgccggatatgctgacataaaaaaaatggccaatattgctattggcccgtcaaagaggaatttcatcattattattatcccgggatttgcatcccggatcgtctgattgtcgctcaaagtgaccatcactgccaacactattgcgcaagatggtactattttttagacaacctgcgggcgtattctgacgtcacgcaaaaccggttggtaagaaggatagctatgactcccgccgttaaattactcgaaaaaaacaaaatttcctttcagatccacagttacgatcacgatcccaatgagaccaacttcggagatgaagtggtgcgcaagctcggcctcaatgccgaccaggtttacaagaccttgctggtcgccgtgaacggcgatatgaagcatctggcggtggccgtcactccggtcgccgggcagctggatttgaagaaagtggcgaaagcgctgggcgctaagaaagtcgacatggccgacccgatggtggcgcagcgtatcaccggctatctggtgggcggcatcagtccgctggggcagaagaagcgcctgccgacggtgattgacgccccggcgcaggaatttgccaccatctatatttccggcggcaaacgcgggctggatattgagctggcggcgagcgatctggcgcagcttctcgatgcgaagttcgccgatatcgcccgccgcgattgataaaactatcccggatagcggcgcacgcgccttatccgggatacccaactcgtagccccggtaagcgtagcgccaccggggaaatagccaacctgaagcccaggcttactgccagctcacctcgcctttcggctcataggcggcggcatccagcggcgagttcttctcgatatactctttcagcacttcggcatcgataaagccggtattcacatacccgggtttatcggcgatgttcggatagccatcgccgccggtggcgttaaagctcagcgtcgccatccgataggtcttcgccggatccaccggttcgcctttgattttcagatcgttcagcttaccgtctttggccacgaaactgacgttggcaaactgcggataagcgccggaatccggcttcatctgcgcgacggcggtcaggtaatccactacctccttgccgttcatatcgacataggtcagcacattgccgaacggctggaccttcatcacatctttgtaggtgatatcccccgcctcaatggagtcgcggatcccgccgccgctcatcaccgcgaaatccgcgttactgcgcgccatttgcgccgccagcagcaggtggcccatattggtctgcacaaagcgcactttactgcggtcgccctccagatgaccattcacgctgccgattttgacctgcagctgcgccttgcctttgttctggaacggcgtcagcagcgacatcatctgcgggttctcggcgatctgcggcgtatacagcacccgctcgctttggccgttatcgtaagtcacttttttcttcaggttcaccgggatcagctgatagtgcaccagcttcatctcgccgttgcggaactcaaaatcggcgcggccgacgtatttgccccactcatgcgcctggacgatccagatgccgttctgacgatccggagcgcacggggtgcctggcacataatcgacctgctttttattttccgccgccatgcataccggatcctgcgaatgaccgccgacgatcatcgccagcgatcccgcaggtaaactccgcgccatttcaacgtcgcccggcgcgttagagccgtggttgccattgtcgtaatggcccatatgggtggtggccaggatcacgtccggcttttcattctgctgcagctcctggataaccagcttcgcctcttccgccggtttgcggaattcgatatcggtgaaatattccggattgccaatcttggccgtatcgtcggtggttaagccaatcaccgcgattttcagcccaccgcgcttaaacaacgcccagggtttgaacagccgttcgccggtgcttttctgataaatatttgccgacaggaacgggaacttagcccacttttcctgctggcgcagtacgctcagcggattatcgaattcatggtttcccaccgccatcgcgtcgtagccgatcaggttcatgccgcgaaaatcgggctctgcatcctgtaaatcagactccggtacgccggtattaatatcgccgccggataacagcaggacgcttcccccttccgccgccacctctttacggatgccatcgaccagcgttttctgcgccgccaggccatattcgccgtagtcattgcgccagaaatggccgtggtgatcgttggtgtgcaggatggtaattttataggttttatcctgctcataggcctgtgccgacaggctgcccagcgataaagcggcgaatagcgccagcgctacgctgtgtttgaaataatgcatgcttcactccctgacttaatcccaagtgccgaaagtatagcgagttagtcgcgttgacaaatatgttttcagaattgcgacttccttcaaaccttatcaacaggtatgttagtcggataataattctacccgtcatacttcaagttgcatgtgcgttggctttcctcgctcaccccagtcacttacttgagtaagctcctggggattcgctgcgtcgccgccttcctgcaactcgaattatttagggtatcaacctgcattctctacaacaaatagaactcgctgaagtgaacctatgacaaccaaccaatccgctcaacccttgtccggccccgctgcgccgccgcaaaaagcacgcacctcgtttggcatcttaggcgcgatcagcctgtcccatttgcttaacgatatgatccagtcgcttattctcgctatctacccgctgctgcaggcggagttctcccttaccttcgtgcagatcggcatgatcaccctgaccttccagctcacctcatcgctattccagccggtgattggctacatcaccgataaacgctcgatgccgtggtcgctgccggtgggcatgtgcttcaccctctgcggtttgattctcctcgcgctggccggtagcttcggcatggtgctgctggccgccgcgctggtaggtaccggctcctcggttttccatccggaatcatcccgcgtggcgcggatggcctccggcggccgtcacggcctggcccagtcgctgttccaggtgggcggcaatttcggcagctcgcttggcccattgctggcggcggtgatcatcgccccgtacggcaaaggcaacgtcgcctggtttgtgctggccgctctgctggctattgtcgtgctgtcgcaaatcagccgctggtatgccgcgcagcatcgaatgaataagggcaaaccgaaaccggccatcgttaatccgctgccgcgcaagaaggttattctggcggtaggcattctgctgatgctgattttctcgaaatatttctatatggcgagcattagcagctattacaccttttatctgatgcataaattcggcttaacggtgcaaaacgcccagcttcatctgtttgccttcctgttcgcagtggctgccgggacggtaattggcgggcctgttggcgataaaattgggcgtaaatatgtgatttggggttctatcctcggcgtagcgcctttcacccttgttttaccctacgccagccttgaatggacgggtattttgacggtgatcattggttttatcctcgcctcggccttttctgctattctggtctatgcgcaggaactgctgccgggacgcatcggcatggtttctggcctgtttttcggcttcgcctttggcatgggcggccttggcgccgcggtgttaggcctgctggcggaccataccagcattgatctggtttataaaatctgcgccttcctgccgctgctgggattcctgacgatattccttcctgataaccggcaaaaagcctgattattcggcggccaaagtgcaaccttggccgccgttaacccttgtgtcatcagcctgttccacgatttccccccgccattttcccttctgtgccttttcatcggctaattgcatttttttgcacaactcaagaattattcataaacaaagtgaacgtttttgtcataaactattacccggacagggtagcaaaatggaccgatacaccactggaaaggagacggaatgcaccacgcaacaccgcttatcaccaccattgtcggcggcctcgtgctcgcttttattctcggcatgattgccaataagctacgtatttctcctctggtgggatatctcttagcgggcgtgctggccggacctttcacccctggctttgttgctgacaccaaactggctccggaactggcggaacttggcgtcattctgctgatgttcggcgtcgggctgcatttctcacttaaagacctgatggcggtaaaatcgatcgccatccccggggctatcgcccagatagccgtggcgacgctgctgggtatggcgctctccgccgccctcggctggtcgctgatgaccggcatcgtctttggcctgtgcctctccaccgccagtaccgtagtgctgctgcgcgcgctggaggaacgacaactgattgacagccagcgcgggcaaattgccatcggctggctgattgtggaagacctggtgatggtcctgacgctggtcctgctgccggcgattgccggtatggcggagaaaggcaacgtcggcttcgcgtccctggccctcgacctcgggatcaccattggcaaagtggtggcctttatcgccattatgatgctggtcggccgccggctggtgccgtggatcatgtcgcgcagcgccgccaccggctcacgcgagctgttcactctgtcggtgctggccctggcgctgggcatcgccttcggcgccgtggagctgtttgatgtctcttttgccctcggcgccttctttgccggcatggtgcttaacgaatccgagctcagccaccgcgccgcccatgacaccctgccgctgcgcgacgccttcgcggtgctgttcttcgtctccgtcggcatgctgtttgacccgatggtgctggtccaacagccgctggcggtgctggcgacgctggcgattattatctttggtaaatccgcagccgcctttttccttgtgcggatgtttggtcactcgccgcgcaccgcgctgaccatcgccgccagcctggcgcagattggcgagtttgcctttattctcgccggcctgggaatggcgcttaacctgctgccgcaggccggacaaaatctggtgctggccggggcgatcatctcaattatgctcaacccggtgctgtttaccctgctggaaaaatatctcgataaaaccgaaaccctcgacgagcagacgctggaagaggtcctggaagacgagaagcaggtgccggtcgatatctgcaaccacgcgctgttggtcggcttcggccgcgtcggcagcctgctgggcgagaagctgatggcccaggggatcccgctggtggtggttgaaacctcgcgcacccgcgtggatgagctacgcgagcgcgggatcagcgcggtgctcggcaatgccgccaatgaagagatcatggagctggcgcatctggactgcgcccgctggctgctgctgacaatccctaacggctacgaggccggagagattgtcgcttccgcacgggaaaaatgtccgaatatcgagattatcgcccgcgcccattatgatgacgaagtggactacattatcgatcgcggagccaatcaggtggtgatgggcgaacgggaaattgcccgcgccatgctgcggcttctggaaacgccaccggccggcgaagtggtcaccggctgatgtactgccctctccccgccgggagagggacgcgcttaccgatcccagtacgcctcttccaggctgtcctcacgctccggcaggccgcgagttaaacgcggcgagtgctggttcagcacctgatagctcacgcggttggcatatttacacacctgcgccagcgaggagtaggtcagccatttgcatttgtgcttgctggagttggggacgttattgcggtggtagttattggcggtgatgtcatgcagcagcgccgccagcgcgccgtcgcctgcgccgttggtgttcatgatcttctcggggccgcccatatagggagcgatatgggaatatatgcgcagcggattaacgcaatcctggtgacgcatcgcgcggctgaattcaaactggttaaactccgggatcgcccccggcagcagcggatgctgggttttacgcttcgcctcttcttcggtgaagcccgccatatacaggcccgccgggccggcggtgcacagcaccaggtcgacccagtccagcgccttattcgccgctgacagcggatcggcaaagccggtcagcgcttccccttcctcttcgttcattgccagaatagagacatgctcctgcaggaactcctgccaccacgccgggttatcggcaatcacgtatttggttccgagggttaacaccaccggcacatcgtgctttttggcatactcaatagccttcatcgtggcgtccggcatcggctcgcccggcttgcagcggaccaggtaagaggtcagcaccagcgccgaggcgccggcgatcaccgcttccggaatgctttcgggacgccgcttgttcatgtggcccgggctgatggcgaaggtgcgctcgccgctgtcaccgatcagggtaaagcagcggccaatggcgccgtcgacgccctgcagatagttcagatcggtgcggctggaggtattgcacaggtaacgataggcgtagccgccgatttcgatattgctgcacatcacgccaagcagcaccgagcgatcgtccgccagcaccgagtagttgtgcatggtattgccgatggtgccgccggcaaactgatgggtaatgagattgttgcgcaccagctcctggtacagcgcctcggcgacgtcatcttcaatcaccagcgaatggcccgcgctcaggccgtagcgcacgataaacgcctcatccactttcgcttcgatatccaccagcgtctggtcgataccgaccacccaggagacgctggattcattctccggctgaatttgctgcagcagcggatcgcgggcgttaacgggaaaatagtgtttagatttgcgtttaccgggaaatttcatagtggcgcttaaataacagggaacaagcgggaaatagtagcatattccccgccctgcgcgcgatcagcgataaggcgccgtcagattgaccatcatctcaatatgcgctgcgtccgcattaagcgccggaatatattcatattgcttgccgcctgcttcgaggaatatttcccggttctggacggcgatttcttccagcgtttcgagacagtcggcggcaaaccccgggcacagcacctgaatatgcttcgtccctttctcgccgagcatctttagcgtttcatcggtgtacggcgtcagccagggttcccggccaaagcgcgactggaaagtcatcatcacccgctccggcggcagccccagcgcggaaaccagttcccgcgtcgtatcgcgacagcgctgaggataatcatcgccctggttggcatagcgctgcgggatcccatgataggagagcagcagcagatccggttccccatggacagcgaaggaagcgcgcacgctggccgccagcgcatggatatagtccggatgttcggcatagtcgcgaataaacgagatacccggaatggcgcgctttttcgccagaatccgcgccagttcgtcccagacggcggccaccgtcgagcaggaatattgcggatacagcggcagcaccacgatgtgctccaccccctgcgccagtaagtcatccaccgcgctggccagcgacggtgaaccatagctcatgcccagcgccaccggggtatccggcagcctggcagccagcgcctgctgctggcgacgactatacaccatcagcggcgatccctcttccatccacacggactgatagagcttcgccacgcgcggggagcgaatcggcagtatgacgccgcgcagcagcggccaccatagcagacgagacgtatccaccacccgtttgtcgctgagaaattgtcgcagatagcgcttcaccgccccgggggtgggcgcatcgggagtgcctaaattggccagcaagatacctgttttcgtctgatgcattaccgcctcttaaccatttgaatcgcagccaattgtagctgaaatggcactaaacggaaccaatcatagcaaaaggtagaagtgagaggagttctcatcctgccgcagcaggatgagaaaaggctttatcagccgaggattttttccagttcggcgcgcacgtcagctaccgctttggtgccgtcgactttggcgtatttggtgttgcccgcctgcgcttctttggtgtagtagccgatcagcggcgctgtcatctgatggtattctaccagacgcttacgcacggtctcttcctgatcgtctttacgggtggtcagctcttcgccggtcacgtcgtctttgccttccaccttcggcggattgaatttgatgtggtatacgcgaccggatgccgcgtggacgcgacggccaacgatgcggtcgacgatcagttcgtccggcacgtcgaattccagcacgtaatcaacggtaatgcccgcctctttcatggcgtcagcctgcggaatggtccgcgggaagccgtccagcaggaagccgttacggcaatcttcctgggcgatacgctctttcaccagcgcgatgaccagctcatcggtcaccagcttgccagcgtccataatgtctttcgcttgcttaccgagctcagagccggattttaccgccgcgcgcagcatatcgccggtggagatttgcggaataccgtatttctccatgatgaactgagcctgagttcctttacccgcgcccggagcgccaagcagaataatacgcattacgaaaatcccctcaaaagtcgattcaatttttcaaaaacgctaaaccataccaccagaacggcgatggctcaaggaaggcggtgcggctgaaacggttaatggtgagatattttatgcaatccaatgtgaaatgccccgcctgagcacatcgctcagacggggcatttatcccgttcccggcgtcgcgtcgctcggccgggctactcgttcaggttcgcgtcaggaagccagcagctggttcatacggcggataaactggttcggatcttccagcgtgccgcgctcggccagcagcgcctgatccagcagcagttccacccattcgccgaactgggcgtcgtcctgggtatcggccgcgcgtttcaccagctgatgcgccgggttcagttcgaagatgtatttcacttccggcgccgcctggcccgctgccgcgaacagcttcgccatctgagtgctcatctcgtcggcgtcggtggtgacgatcgccggggtgtcggtcagacgatgggtcagacgcacctctttcacccggtcgccaagcaggtttttcacccgctcaacgaacggctccagcgctttttcggcttctttggtggactcgtccacttcatccgccagcttgtccagcgactcgtcggctttagcgacagactggaacgctttgccgtcgaactcggtcaggtagctcatcatccactcgtcgatgcgatcggagagcagcagaacttcaatccctttcttacgcagcagctcgaggtgcgggctgctcttcgccgccgcatagctgtcggcagtgatgtagtagatcttctcctgaccttctttcatccgcgagacatactcttccagcgacacggtctgcgcggaggagtcggtatgggtggttgcgaaacgcagcagtttggcgatcgcttcctggttgctcggatcttccgccgggccctctttcagcaccaggccgaactgtttccagaaggtttggtatttttcagcgtcgtctttcgccagcttatccagcatctgcagcgcgcgtttggtcagcgcggtgcgcaggttgcgggtcacgctgctgtcctgcaggatttcacgggagacgttcagcggcagatcgttggaatcgatcaggccgcgcacgaagcgcaggtagttcggcataaactgctcggcgtcgtccatgatgaacacacgctggacgtacagcttcaggccgtgtttatgatcgcggttccacatatcccacggcgcctgcgacgggatatacagcaggctggtgtactcctgcttaccttccacgcggttgtggctccaggtcagtgggtcgctgtagtcgtgagcgatatgcttataaaactctttgtattcgtcgtcgttaacttcggatttgctgcgggtccacagggcctgcgccttgttgattttttcccacgaaatcacggtttcgccgtctttctcttcccgtttttcaatctcaaccggcagcgcgatatggtcggaatacttgctgatgatagagcgcacgcgccagtcgttgaggaaatcatcttcgccttcgcgcagatgcagggtgatttcggtgccgcgatcggctttggtgatatcagctacggtatattcgccttcgccggcggattcccagaacacgccgttttccggcttgtcgcccgccgcacgggtacgcacggtcactttgtccgccacgatgaaggccgaatagaagccgacgccgaactgaccgatcagctggctatccttcgcctggtcagaacccatcgattcgaggaacgctttggtgccggatttggcgatggtgccgagatggtcgataacctcttcccggttcataccgataccgttatcggcgatggtcagggtgcggttgtctttatcaaacgaaacccgcacgcgcagctcgccgtctccctcatacaaatccggctgcgacagcgcgcggaaacgcagcttatcggccgcatcagaggcgttggaaatcagctcacgcagaaagatttctttgttggaatagagggaatggatcatcaggtgcagaagctgttttacttctgactgaaaaccacgagtttcttgtcctttcatctgattcaacctcaacaatgccattttaaatgggtaaaaaaccgttgagtgggagatggggacagcggggaaatttttcaagcggaggcggcgaaggccgcctccatttgttcagaaagtaatcttgtggcgaccggccagggagtgggacagcgtggtgccgtcgaccatctccagctcgccgcccaccggcacgccgtgggcgattcggctggcgtcgacgccatactgcgcgcacagctctgcgatgtagttggccgtcgcctcgccctcaacggtcgggttggtggcgaggatcacctcggtgatcgactccgcctccagccgttgctccaggcgatcgagcccgatgtcatcaggcccgatgccgtcgagcggcgacaggtgccccatcagcacgaagtagcggccggaatactgcccggtctgctcaatggcatagatgtccgccggactctctaccacgcagatctggccgttttcctggcgacgcgggttgctgcagatattgcacacctcctgctcggtgaaggtgcggcaatcggcgcagtggccgatctccgacatcgcacgcgtcagcgcctgcgccaggcgcatcccgccgctgcgatcgcgctgcagcagggtaaacgccatgcgctgcgctgacttcgggccgacgcccggcagacagcgcagcgcttccataagctgagttaacagcgggctggtttgcatcagaacggcatcttgaagcctggcggcagttgcataccggcagaaacggaagccatcttctctttctgggtctcttcgatacggcgcgcggcgtcgttgaacgcggcagccaccaggtcttcgagcatctctttgtcgtcttccagcaggcttgggtcgatctccacacggcggcagttgtgcgcgccgttaatggtcactttcaccagacccgcgccggattcgccggttacttccagctgagcgatctcttcctgcatcttctgcattttttcttgcatctgctgggcctgcttcatcaggttacccaggccgccttttccaccaaacataggcttctctctcagtcagtcatcgttaaaggtactgaatgccagtcagactggcattcaaatggggcgaatactctcttcatccagatcggcgtcgaagaaacgacgcagggtctgaatgttattatccgcgataatggcttcgcgcgcctgcgcgagcttctcttcataaatagcctgccgccactccagcggcgtacgcatcgcgggattatcgtcttccacgatggtcaattcaaccggcgtaccgtacaacacccccagcgcttcagccagcttttgctgcgcgctggcggaattgaggtggcgctggctgggacgcagatgcagacagacgcggctgccctcctgctctttccacgcgttgagcgccacctgctcgaccagcttcggtaccgccagctggctcacttccgccgcccagctgtcgcgctcgaccgcttcttcggcgagcttggccgccagctccggcgtcttctcatgctccagcgcctttttcagcgctttgggcgtggcgacttcgactttgctctcttccaccaccgtcgtcgccttccagcgataggcctctttcttcgccggggcctgctccagcgcggccgcggccggacgagcctggacgcgctcggtaatcgaactcagtcgctccagcgcagcgttattcaccggccgcgcgcgggaagcggctgccggttcactcttttttggggtggttgctccctgactgcgctgcaggtggctgcgggccgccagcacctggctggtggtcggcggcaaactctgcggcgactgtggcggcggcgcggcgggggcaaccggctgacgcggcgcgggcgcggcggcctgtgccggctgcacctccggctccggcagcggcttacgcggatgaaacgccagggcacgcagcagcgtcatttcgacgcccatccgccggtccggggcgtaaggcagctctttgcggccaatcagcagcgtttggtagtagagctgaacgtcgccgggcggtacggttcgcgccagttcgcgcatccgcacttcgaccgcggccatgtcggcgcccagcgccgaaggcgacagctgaaccatggcgatgcggtgcagcaggctctgcatctcgaccagcagcgcctcccactcgacgccgcgtgcggcggcgtcattgacgcccgccatgacccgctcgccgtcggcagcaaccagcgcttcaatcagcgacagcgcctgatcgtcatcaagggtgccgagcatggtgctcaccgatgcggccgtcagctgcccttccccactggcaatcgcctgatcggtcaggcttaaggcatcgcgcaggctgccatcggccgcccgcgacaacagctgcagcgcgcggggctcaaaggcaatctgctcttcgccaagaatatgctccagctgatggcggatctgttcaacgtccagcgccttcaggtggaactgcaggcagcgggataagatcgttaccggcagcttctgcggatccgttgtcgccagcaggaatttgacgtgcgccggcggctcctccagcgtttttaacaacgcgttgaagctgtgacgcgacagcatatggacttcgtcgatgagatagaccttaaagcggccgcgggccggcgcgtactggacgttgtccagcagatcgcgggtatcttcgactttggttcgcgaggcggcgtcaatctcaatcagatcgacaaagcgcccctgttcaatttcccggcagttatcgcacacgccgcagggggtggcggtgatgccggtttcacagtttaaccctttcgccagcagacgggcgatggaggtcttcccgaccccgcgggtaccggaaaaaagataagcgtgatgaatgcgccctaacgacaagccgttcgccagtgcggtcagcacatgttcctggccgacgacgtcagcaaaggtttgtgggcgccatttacgggctaagacctgataactcatgggctggctctgaaacgctggaaggtgaaatcacgaaggggtcatgctatcacagccccgcccgatcggcgaggctatgtggagggatttgcttagtggcccgggaacggcaccagacagtagcagtggatccccagcttctccaggcgctgttcgccgcccagatcgaagagattgataatgaaagcggcatcgtgcacttcgccaccgaggcggcggatcagtttgaccgtggcgtcgatagtgccgccggtcgccagcagatcgtcaaccaccagcactttatcgcccggtttaatggcgtcaacgtggatctccagctgatcggtgccatactccagctcataggtctcggcaatggtttcacgcggcaacttacgcggcttgcgtaccggaacaaagcccacgcccagcgccagcgcgaccggggcgccgaacaggaagccacgcgcctcagtccctaccactttggtaatacccgcgtctttgtagcgctcggtaagcagttcaatgctaagcgcgtaggccttcgggtcttccagtaagctggtgacatcgcggaaaagaatgccaggttttggataatcctcgatactctggatgctgttcttcagatattcaagctgctgtgcagttgcggtcataagtgtatgcctgattgaaacggtattacccacgggcgtgcaaaaggggccaaagaaacatttgtttaacctttgaccaggcttgcccgcgctcgaaaacgccagaatttactggctgtcggcaacaattgcaacaggcattattgcgcatcagtgcttttgttgctttgcgtcaaccaccggaatgcgccacataaagatcagcagacaggccagaatgaccaacagcatgatgcgcacccacgtaagcttaaccagccatagcgaaatagcaaaagtcaccacgatcatcgcaatggcgcgcggtttagcgccgcgaggcatggcgcggtactgttgccagtggcgaagatagccgccaaaccaggagcgatacagcagccactggtgaaagcgcggcgatgagcgggcaaagcaccaggcggcgagcagaataaacggcgtcgtcggcagcaacggtaagaagacgcccagcgtacccagcgctaccgccagccagccgataatggttaaaataacaggtggcataatgcgaatcgttatcaaacagatgaggctactgtagcacagttggctgacggaaaatggagggggttggtgaaaactgctcaacttttacaaacgctgaacgaccagctgagtgagctggccgcgctggtggcgccgctggcggagcacgcgaccctcagcccgcgctttgaccgccagctcttccacacccgcagcacgctgatgcaggcctatctggcggaagcccaacacaactttaaccagctccgccaggccgtcgagcgccagcagctgccgcaggtggtctggattgccgagcgtctggcggcacaaatcgccgcgctgcgccgtgaaaccgccacctggtccttgcgcagttgggaccacgcgtcgccaacgttgagccgctggcagcgccgtcgcctgcagcatcaggagtatgagcgccgcctgctggcgatgcgcgaccaacgccagcgtcagctggcgcaggcgaccagccttgacgagcagcagcggctggggaaagaagttgaagcctacagcggccggttggcgcgctgccgacaggcgctggacaagattgaaaacgtactggcgcggctgacgcgctaacaggagagcccgatgtcgctggaaaatgcatccgatgaggtcaaactggccgtcgatttaatcatgttgctggaatcgcatcagatcccggcgcaaaccgtgctgagcgcgctggaaattgtccggcgggattatgcaaacaagttaaaaaacgcggaaagcgggtcgcaaaacccagagaagtaggatgttgtctccggcagtgtgctggcagtctggtcctctgcgcatgacgccactggagacaatattgatggaaaaagtcagtcaaaccccacacgacgcggtgtttcgccagatgctcatgcatcaggcggtcgcgaaggattttttgcagttgtacctccccgcgccgtttctggcgatctgcgaactggattcgctgcagctggtctccggtagctttgttgaagaggacctgcgcgccagctattccgatatcctttactcactgcgcacgcgtcatggaccgggctatgtgtacgcgctgattgagcaccagagtaccccggacaagctgatggcgtttcgcctgctgcgctatgcgctggccgccatgcagcgtcatctggacgccggccacgacactctgccgctggtggtgccgattctgttttatcacggcaaagtgagcccctggccctgggcccgcaactggcaacagctattcgccgatccggcgctggcgaaggcgctctatagcaatgattttccactggtggacctcaccgtaatgccagataatcagatcgcccgtcatcggcggatggccatgctggagctgctgcaaaagcatatccgccatcgcgatctggccgagctgcaggtgccgctgattgcgctgatgacgcaaggctatctgacagaagcgcagctgaatacgctgctgcgctatatgttgcaggcgggaactacggaacatccgggggcgctgatccgcactctggcggcgcagtcgcccaggcataaggagctgatgatgaccattgccgaatggctggaagagaaaggccgtaaacagggacagcaagagggtgagcaggaagctacccgcagcatcgccgccagaatgctggcgcgcggcctcgaacgtcaaaccgtgcaggagctcaccgggctgagcgatgaagaactcgccgcgctggcgccctgatacagcaggggcggctttgcgccgcccctcttcgatcaggacgcggtggtgggcgccagatcgtcgcctttcccgtcccgtttcacttcggtgacttcatcgcctttttcattgcgcagatgaacttccagctggttaaaggcaatgttgatgtcattctcccggcacaggcggtcgatggcgcggttgagctcatctaccgtgtagctgcgatcgcgcagttctcgaacatacagacgcagttcatgatccagggtactggccccgaaggtggtgaagaaaaccgctggcgccggctcctgcatcactttcggatgatcgtgcgcggccttcagcagcacctctttcaccttatccaggtctgagccataggcgacgccgaggcggatcaccacccgggtcacggtgtcggagagcgaccagttgatcaagcgctcggtaacgaacgccttgttcgggataatcacctctttgcgatcgaagtcggtgatggtggtggcgcgaatacggattttgcttaccgtccccgagaaggttccgatagtgaccgtatccccaatgcgcaccggacgttcgaacagaatgattaggccggagacaaagttaccgaagatctcctgcagaccaaaacctaaaccaaccgacagcgcggccgccagccattgcagtttatcccaggagacacccagcgccccgaataccgtcatcgccccgatagcgataatcgcatagttgagaatggtggtgatggcgtaggaggtcccctgacgcatgttgagccgcgacagcaccagcacctccagcaaacccggcaggttgcggatcagcgcccaggcgaccattgacgccacaatggcgaacaacaaactgcccatcgtcacgctgcgcaccacgctggcccccgcctcggtaccgttgtagtgccagagggtaatgctgtcgaggtaggcgaaaacggtgatcaaatcagaccaaatcgcccagaacatcactgcgaacagcgcgaccatcaccaacatggtgatgcgcagcgtctgctggttgacctgctcgagagcgatagttggctcttcctgcggctcggcgccttccgccccttccttcaccagatgttgacggcgcgccagcgcgcggcgccaggcgatacgccgcgccgccacgctcaggccgcgcagcaccgtctggtacagcaggttccagatcatcaccagatacacggtctcgatccagcgtcccgccagacgcagcgtcgtgtagaagtagccggttgccgtcagcaccatcagggccaccggaacgatagacaacaccgtgatcgtcagcagacgcaggctgtgcgactctttatcgcgccagctttcccggcacatcggccaaaccagcaccgcgatcagcagtaagttgaagaaaatcaccaactgccccagcacgtcgtccatcaggttcagcggcgacagttcggaaatcaccgaccagaaattcagcggcagcagcgccaggctgacgcgaacaatctgccgccgccagtggctggtcaactgcgccggcatattaaagtggttgaccgcgacgccgttcttttccagcactttccagcacaggccaaacaccagccagaacatagccagctttttactgtacgcccacagcagtccgctaatatttaactgcatggtgagtaagatcagaccgatagccagaatcaacagcaccaccggtaaggcgcggatcagatcgatcaggatcgccttcggcgtatgcaactgggtatcgttgcgcagctgtcccacctgggaagcaagctttgcctgataatccttgagccactgcagacgccagcggatgaggccggcaatcaacagcagcggtaaaccggccaggaaagcgacaaacaccgcaggccacgctttttcccagttcacggtgattttcatcgccttaaactgacctttcagcgcctccgggaaggccttaatccactcccagtccatcggtttattgctgttcacccagaaaatttgctgggtcagaatttccttcagactgctcgagacgctcatcagctgctgctggttgatctgcaggttgatggccatcatcagctggttacccaactgtttgttgaactgatcaagcagttcgcgacgcatgtcgatcacttccagtagcgcggcgtggacttcatcgttcacttcgctgctgtgcccctcctccagtttggcgacaaaggcatcgctctggaacagcgcgtcgcgctgctggttcacctcaaactgttcaagccgcaggtcggcgatgcggttggtcatatcctgcagctcatccgccgacggtaatgtctgttgctgttggtaaagaatacgcgacagcagcaggctcccccgcagaactgaaatttgctctttaatatcccgttcagactgcagcgcgcggtcgagccagttcttgacctggatattgcgctgcaccagctggttaccgttctctgttgcctggatcagcttctcgctgagctgatggttaatatccagctcctgcttgaccagcgggttggcctgaatacgcgccgtttcgtcgggggtaaccgcctcctgggcggttttctcggtcagggtcagccgtttgctgttcacggcctcctgcagcagctgtagctgatgctccagccggttgctccaggcggtgacgtagtcacgctgcttctgcagggtatcctgcaggatagtgttgccttcgaggctcttgcgctgttgctcgatctgcgcgttgagcaatgcctgttgagcctgcaacagcacctgctgggtcgggcgtagggtctcgtcgcccaccgaggtgccattcagacgattgcggatctgctgcagctgctgggaggcgttgaacatcgcattttgcacgcgttccggctgcgtttgcagggaaaccagttggctgttataggtcgccagatcgttttgcgcattctgtagatcgtccagcgtctgggtgacgcgcgactccagctgacgcagggagagcgtacttagcgttttgcgcgtcgcgtcgtcgttcgggacatcgctcaggttattgaggctctccaccgcctggcgcagcttcgccggcgcctgctcgacctgctgtcgcagctgtgccgtctcgcttttgatacgctcgattttatccagcgtttccagcgtctgagtcagatcctgctggaccagtttgtcctgcggagtcagttctttttgcttgtttaacgtattgagctggctctgcacctctgcccgatcggggagatccgcggcgcggccctggactgggctgaaaaggccaataaaacagagcagcgtgataataaagatgaacgtggcgcgttgcctggagatcgtgtgcagcatagttaatatgaatgaatgcaaatgccggagaataccgggggtcgtcgcaagcgcgcagaatagcacttctcagcgctggcgaatagcggcggacggcgctaaaaattcacgcccatccgcgcgctacctttaagctgacaagctctccgggccgcgtagcgtcgggcagaattgatacatctccagcagaatagcgacgtagtcccgcgcttccgcatgcaggtcgaacgaatcgggggcaaacagccagttttccatcagcccggaaaggtagctgcgcattaacacggccgcccgccgggtgagtaaattggcgggcagcagcttcgccgcgatgcattctttcaaggtctgctcgatacgctcataactcgccagggagagctgccgctgggcctgctgcaccacggtcatttcaccgacgaactcacacttatgatagataatctccatcattaatcgtcgacgttcttctgtcactgtcgcttcaagaacatagactagaatctccctgataactgagagtggatcgttggggaattttgcccgatactcaatttcgagatcgctaatactggcgtctgacagctcccaaatttcgttgaataaatctgatttattcttgaaatgccagtagatagcccccctcgttacacccgcagcttttgcaattgttgccaacgaggtagatgatacgccttgctgcgaaaacagacgcagagcaacatccagaatcagttgccgggtttcacgtgcctgttgtttggtttttcgtgccataggttaatgactttacagaggttacgtttacatacatttgtgaatgtatgtaccatagcatgaccataatagaaagactgtagtgggtttgtggttgtttgagccactgaacattttgaaattggacactcgaggtttacatatgaacaaaaacagagggttaacgcctctggcggtcgttctgatgctctcaggcagcttagcgctaacaggatgtgacgataaaccggctcaacagggagcccagcacatgccggaagtcggtattgtgacgctcaaatccgcacctctacaaataaccaccgaactgccaggccgcaccagcgcctatcgcattgcggaagtccgtcctcaggtcagtggcattattttaaaacgtaacttcgtggaaggtagcgatatccaggccggcgtctccctgtatcagatcgatccagccacctatcaggccagctatgacagcgccaaaggcgacctggcaaaagcccaggcggcggcaaacatggatcaactgacggtcaagcgttatcagaaactgttgggcaccaaatatattagtcaacaagactacgataccgccgttgcgacggcgcagcagagcaatgcggccgtggtcgcggcgaaagcggccgttgaaaccgcgcgcatcaatctggcctacaccaaagtcacctcgccgatcagcggccggattggtaaatccgccgtgaccgaaggggcgctggtacagaatggtcaaacgaccgccctggcaaccgttcagcagctggatccgatctatgttgacgtcacccagtcgagcaatgatttcctgcgcctgaagcaggagctagccgacggccgcctgaaacaggaaaacggcaaagcgaaagtggagctggtgactaatgacggtcttaagtatccgcagtccggcacgctggaattctcggatgtcaccgtcgatcagaccaccggctcaatcacgctacgcgctattttcccgaacccggatcacaccctgctaccggggatgttcgtccgtgcccgtctggaagaagggattaaccctgacgccctgctggtaccgcaacagggtgttacccgtacgccgcgcggcgacgccagcgtcatggtagtgggggaaggcgataaagtcgaagtccgccaggtcactgcttctcaggcgatcggcgataaatggctggtcactgacggtctgaaatccggcgatcgcgttatcgtcaccggcctgcaaaaaatcaaaccaggtgtgcaggtaaaagcgcaggaagtagcttctgatgataaacagcaagccgcaggcaacgcgccatcagaacaaaccaagtcttaacttaaacaggagccgttaagacatgcctaatttctttatcgatcgccccatatttgcatgggtgatcgccattatcatcatgctggctgggggattatcgatcctcaaattgccggtggcgcaatatccgacgattgcgccgccagcaatttccattaccgccatgtaccccggtgctgacgccgaaacggtgcagaacaccgtaactcaggttatcgaacagaatatgaacggtatcgatcacctgatgtacatgtcctcaaatggcgactccaccggtacggcaaccattacgctgaccttcgaatccggtaccgatccggatatcgcccaggttcaggttcagaacaagctggcgctggcgacgcctctgctgccgcaagaagtacagcagcaagggattagcgttgagaaagcgtccagcagcttcctgatggttgtcggcgtcattaacaccaacggcaccatgaaccaggacgatatttcggactacgtggcggccaacatgaaggatccgattagccgtaccagcggcgtcggcgacgttcagctattcggttcccagtatgcgatgcgtatttggatggatccaaacaaactgaacaacttccagcttacgccggtggatgtgatcagcgccctgaaagcgcagaacgcccaggtggccgcgggccagttaggcggtacgccgccggtgaaaggccagcagcttaacgcctcgatcatcgcgcagacgcgtctgaccaatacggaagagtttggcaacatcctgctgaaggtgaaccaggacggttcccaggttcgtctgcgtgatgtcgccaaaattgagctgggcggcgaaagctatgacgtagtggcgaagtttaacggccagccggcatccggtctgggtattaaactggctaccggcgcgaacgcgctggataccgccaacgctattcgcgctgaactggcgaagatggagccgtttttcccgtcggggatgaagatcgtttacccgtatgacaccaccccgttcgtgaaaatttctattcacgaagtggttaaaacgctggtggaagcgatcatcctggtgttcctggtcatgtatctgttcctgcagaacttccgcgccaccctgatccccaccatcgcggtaccggtggtcctgttaggcaccttcgcggtgctggcggcgtttggcttctcgataaacaccctgacgatgttcgggatggtgctcgccatcggcctgttggtggatgacgccatcgtggtggtagagaacgtcgagcgcgtgatggcggaagagggtctgccgccgaaagaagcgacgcgtaaatcgatgggacagattcagggcgcgctggtaggtatcgctatggtgctgtcggcggtatttatcccgatggcgttcttcggcggctcaaccggggccatctatcgccagttctccatcactatcgtttccgcgatggcgctgtcggtactggtggcgttaatcctgacgccggcgctgtgcgccacgatgctgaaacccattcagaaaggcagccatggcgcgaccaccggcttcttcggctggtttaaccgcatgtttgataagagcacgcaccattacaccgacagcgtaggcaacattctgcgcagcaccggtcgttatctggtgctgtatctgatcatcgtggtgggtatggcatggctgttcgtccgtctaccgagctcgttcctgccggacgaggaccagggtgtattcctgagtatggcgcagctgcctgccggcgccacccaggagcgtacgcagaaagtgctggatgagatgacgaattactatctcaccaaagagaaggataacgtggaatccgtgtttgcggttaacggcttcggtttcgccggccgcggccagaacaccggtatcgcgttcgtttcgctgaaagactggagccagcgtccgggtgaggaaaacaaagttgaagcgatcaccgcgagagcaatgggctacttctcgcagattaaagatgcgatggtcttcgcctttaacctgccggctatcgttgaactgggtaccgcgaccggctttgacttcgagctgattgaccagggcggtctgggccacgaaaaactgacccaggcgcgtaatcaactgtttggcatggtggcgcagcatcctgacgtgctgaccggcgtgcgccctaacggtctggaagatacaccgcagtttaaaatcgatatcgatcaggagaaagctcaggcgctgggcgtctccatcagcgacattaacaccacgctgggcgcagcctggggcggaagctatgtcaacgactttatcgaccgcggccgcgtgaagaaagtgtacatcatgtccgaagcgaaataccgtatgctgccggaagatatcggcaagtggtatgttcgcggcagcgatggtcagatggtgccgttctctgctttctcgacctcgcgttgggaatacggttcgccgcgtctggaacgctacaacggtctgccgtcactggaaatcctcggtcaggccgcgccaggcaagagtaccggtgaggcgatggcgctgatggaagagctggcgggtaaactgccttccggtatcggctacgactggaccgggatgtcttatcaggagcgactgtccggcaaccaggcccctgccctgtatgccatctcgctgattgtcgtcttcctgtgtctggcggcgctgtatgagagctggtcgattccgttctcggttatgctggtcgtccccttgggtgtggttggtgcgctgttagccgccaccttccgcgggctaaccaacgacgtttacttccaggtgggtctgctgaccaccatcggcctgtcggcgaagaacgcaatattgatcgttgaattcgccaaagacctgatggagaaagagggcaaagggctgattgaggcgacgcttgaagcagtacgtatgcgtctacgtccaatcctgatgacatctctggcgttcatcctcggggtaatgccgctagttatcagctccggcgccggctccggtgcgcagaacgccgtcggtacaggcgtaatgggcgggatggtgaccgcgacgatcctggcgatcttcttcgtgccggtgttctttgtggtggttcgtcgccgctttagcaaaaaatcggaagatatagagcacagccatcaggttgagcatcattaatcttcactcctgaacaaagggccgctaccgcggcccttttttatcactggctggcaaggcacatattgccattgtttatttttcgttctgcatttaatatatattgatatggcgcaggctatttttagcagcttgttcaacaactcgggatcggcaaacactcatttaccaggaataatcctactatcattatccacgggtcggcggtttctgaacgcgacagctgcctgccttaaaccaatgattcataagatttctctatttctccggctgtgggccagcgcctgcgaaattaattcgtctatttttaagataatttctcgctgataattgtaatttttcgtaatagcacgatgaaatctgttggagagtggattatagttaaatcagcaggattactcagttagtgtcaggtcagttagtcgtgttcatcccacaacggtgtttgctagtcgtcgtttaaaccactcaaaaggggatgcgttatggacgaatactcgccaaaaagacatgatattgcacagctacgctttctctgcgaaacgctgtatcatgactgccttgcaaacctggaagagagcaaccatggctgggtcaacgacccgacgtcggctgtcaatctccagttaaatgaattgatcgagcacattgccacattcgctcttaattataaaattaagtatgcagaggataataagctgatcgctcaggttgacgaatatctggacgacacttttacgttgttcagtaactacggcattaactctacggatttgcaaaagtggaaaaaatccggtaaccgactatttcgttgctttgtcaacgccagccgggaaaacccggccagtctatcgtgttagaattattacaatcaaaaggtggaattatgtctgataagccattaactaaaacagactatttgatgcgcttacgtcgttgccagacaattgacacgctggagcgcgtcattgaaaaaaataaatatgaactgtctgataatgagctggcggtattttactcagctgccgaccatcgtctggcggaactgaccatgaataagctatacgataaaatcccgacttctgtctggaaatttatccgctaatttacgcgtattacgtggtctgctggccggacggtacgggtcagccgccatagggtatctttgtgatagacatcacatcattcagccaacagcaaccctgtaaccggtttcttttttatactgctacggccatcaacagtcaggtataaggaagacccatgagtgaagaaaaacgcaaaatgatcgccggtgagctctatttatctggcgacccaacgcttcgcgccgatcgcctgcgcgccagacagttgttgcaccgttataatcattccgccccggatgaccaggaacaacgtcagcatattctggccgagctgttcgctcgcgccggcgatgcgtatatcgagccaagctttcgctgcgactatggttataatatttttctcggcgccggtttttacgccaattttgactgcgtgatgctcgacgtctgccctatccatattggcgataactgtatgctggcgccaggcgtccatatttataccgccactcatccgctggacgccgatgcgcgtaatagcggccaggaatacggcaagccggtaactattggccacaatgtgtggattgggggtcgggcagtgatcaatcccggcgtgaccattggcgataatgcggtcattgcgtccggcgcggtagtcaccaaagacgtacctgcctgtaccgtcgtcggcggtaacccggcgcagatcattaagcgccttccgccgacaaatccgtaactgttatgcttttctgtaactgatctgttactttctccgcagaatattgcaacataaaatagccttcaggctgagcctgccgcgcctggtccgccgggcgcggcaggctcattgcagaattcgaggaccaagatgacagaaatacaacgcctgctgattcacaccattgacgaactcaacgtccaggaaaaacgcgataatcgcccgcgttttagcatcagttttatccgcaaccatccgggactgtttgttgccatgtatgccgcgtttctggcgacgctggtggtcatgctgcgctctgaaacgctggtagactcggtctggttgctggtggtgctgttcattctgttcaacgcctttttcttctttgacgtctatccacgctatcgctacgaggatatcgatgtcctcgactttcgcgtgtgctacaacggggaatggtacaacacccgctttgtcccccggcagctgatcgaccgtatcctgcagtcgccagacgtcgatagcgagcagaaggcgcagctcaaaaagatggtcgccaccaaaggcgagctctccttctacgatgtctttaccctcacgcgcgccggtgctgcgcaataaggcgatttagggtccgcagcgccgggagatagcgagaagcagaggtattgccatacccaagcaccagtccgctccgcgctcgctgcgggtcgagatagaaatgacttaacgcggcgggcgccagctgaaactggcgcgcctgctgcgcaagcgtccggtcattaacgccctccatcgccaccgtcaggtgcatcccccctcccccgccgagaacgtcgcacggcacggttatctcttgcgccagcgcctcgcgcagctgttgctgacgtttacggtacaggcggcgcatcgctgccagatggcgcgcatagtgtcccttctcgataaagctggccagcgcccgctgttcagcacggtgtcccccgcgcagcagcgcgccaatggcgtcctgagcagcatccgccagcgcgggcggcataaccataaaaccgatacgcaacgctggaaacagcgttttgctgaaggtgccgagatagaccaccggggcatcaggcaccattcccagcatcgccgggatcggttctccgctatggcgaaactcgctgtcgtagtcatcctccacaatccacgccccgtgccggcgggcatattccacgagcgccagacggcgcccggcgctcatgatgctcccacagggatactggtgtgaaggagaggtgaaaatgagccggggcggctccgcgacgccgttggcaatacacatcccttcatcgtcgacagccattcctctgacccgcagccccgcccgctggaagccactcctcgcccccaggtaccccggttcttccagccacacgctgtcgcccgggttggtcagtagcgaggcgcataagttgacgccttccagcgcgccttcggtaatgacgatctgccggatatcgcaccggatgccccgggagagcgccagatgacgagcgatagcctctcgcagcaaaggatcgcccgcggcttcgccataacccagcagcgcgctaccatcttcgcgtagcacgttatccatcagtcgccgccacagcggcagcgggaaatagtttaccgccggcatgcctggcgtaaatgccagcgtcggtgagtcgcggcgcatcgcggctggcagcctttgcagccgctcaggaagcacgacgggcggcatctgacccgcctcctggcggcaggaggcgagtggtgccacctgcgttccctgacggctccgtgtcaggtacccctccagcgccagctgttccagtgcggcattgaccgtattccgcgacaggtgtagccgttcggccatcacccgcgatccgggtaaacggcagcgggccgtcagggttccctgcaggatagcgtcacgtaaggtgtggtaaagggcgcgctgtaaggtttcgaccgtgcggttccgcatcccctgcgtcaacagcgtaaaaaacccctcgtccggtatattcatattgcctcctcgtggccccataaaaacatactctaatggcactttttatggaaccagcgagcgcgtacgctgcctgtaaatccccaataaggaaaccgcaatgtgcgaatataatcagtttggccaggcgctcggcgtcgcgctgcctgactggcagccgcgcccctggccgacacgacaggtattacagggcagccgttgtcgactcgaaccgctgactcttgctcatgccagcgatctgttcgccgctcaccagctggcgccagacgcccgcagctggacgtggctgctgcgtgaacctgagaacaaccttgcagaattcagtgcctgggtggagcaggtcgccacgctggcagacccgattcattttgccgtcgttgaccagcagcgagggaaagcggtcggctcgctggcgttaatgcgtatcgatatcgctcacggtgtggtagaggtggggcatgtgcatttttcaccgttactgagccgaacggccatggccaccgaagcgcactggctgttgatgcagtatgtctttgatacgctcggctaccgtcgctatgaatggaaatgcaacagtcttaatatcccatcagcccgggcggcaaggcggctggggtttcagtacgaaggacgttttcgccaggcgctggtgagtaaaggacacaaccgggacacggactggttttcggtgatagacggcgaatggccggagctggataacgccatgcgccaatggctggccgccgacaattttaccgccgacggccaacagcgccgctcgctggagagtttccgttaacggcgttttttgcgcccctgcaccgctttgaagcgggggttgctcttacagataacgtacagccgccctttgcgtttaaccagctggcaatccgggtggcgctgtttagcgctacgtaatgagttgacgacctgcatcatgctttccttttcgcatcaataaagccgccgaagcgctggcggaatcgggctgcactgccttcattggcgaaggttttttgtttgcccgtgtagtacggatgcgatttcgaggagacgtcgatcgtcacatacggaaaagtttcgccatcgagttcaatcacgcgatcggtgcggatagttgagccgactttaaaatactcattcgcgctggtgtcgtgaaacaccaccgtacgatagggaggatggatatgggctttcatgatgacctctttattacgttataacataacaataaggttacgccctgctgtgacaaagatcaaccctgctcaatttaagggtaaggtgataaggcgagtttccccgcctttggcgtcagggtgccagacggtgggcgatggcgcggagctgttccgcaatggcctgtagatcttttccctgctcgattcgggcgccgctggaatggcgtatcaccaggcgcgccggcagaatggatgaggtatgaggcgccccgctggtgctggcgaggatccgccgcaccgcctctttcccctgcaggtcgaggtcgagcgacacggtactcagcgccggatagaaaaaggagctttcgtaggtatcgtcatagccaataaccgacttctcacccggcaccgccacctgatgctgatggaaggcgctgagcacccccagcgccatctgatcattacccaccagcacagcgctgaaattaggcgtttcgcgcagcatctgcagcgcgccggcgtagccgctctgcgcatcccagttgccgtgcaggacggtcaccggcttcagaccgtaaccatccagggtctccagccagctttttaaccggagtttggccgagactgagctgtccggccccgccagcagggcgatctcccgatgccccatctcatagagatatttgacgctggcccgggtgccgtccgccgggttaaacgaaacgttaaacacggagctgtagggatcaacgtcgagaaacaggcagacgatatcatcgttgtcagcagcgattttctgcgcctgttcggtctccagcggcacgttgataatgactttatccacccgctgagatttcagctcattgatggaatcctggatgctttggttgacgctctcatcgatcatcgaaatcagaacctggtaaccttccaggttggcatagcgttttaccgctgccgccacctgggaaggcgcatgccaggccagagaaatagtcaccagcccgaccgtctggctctccttccccaccagctgctgcgccagccggtttggcacatagcgtaaggcctctatcgatttctccaccttgcgacgcgtcgcttcggatacattagctgatttgttgagtaccctggacacggtctggtaagagacgcccgcatggcgtgcgacgtcttccagagtagcgcttttagacttcatggtccggttccttatgttgttatcccatgattgtaacaggggccatttgaaaaaacgctcaccgccacctctcactgcaaaacaatagcgataaaagtattacgttcacaatacaacgaattgtgaatcatctcacccatcgcaacaaaaaccaccgtgattatttgcagttagtcacacaataatcatatctcatttgcctgaagttacatttaggcattttatgacaccagttatgtgaacgtaatacaaaacaataagaggatagagatgaacactacactgcgcgccctttcagtcgcgttagccgctgcgctaatcgctccttccgcgtttgcggccaccgccgcgatcccaacgatcgatttccatggctatatgcgcgccggggttggggtctccggcgacggtagcgaagcggaatggcaaaaaaataagctgggccgtttggggaacgagtcggatacctacggcgagctggagctgggctctgaggtctataagaaagatgacgtcagcttctatctcgacagtatggtcagcatggtctccgacggctctaacgataatgaaaccacgctgaacgatgatgcacagttcggcttacgtcagttgaacctgcagataaaggggctgatccctggcgatccgaatgcggtgatctggggcggtaaacgttactaccagcgccatgatctgcatatcatcgataccaaatactggaacatttccggctccggagccggggtggaaaactacaccctcggcccgggcgccgtctcgctggcctggatccgcggcgatgccaacgatgttgactatcgcgtcgatggcgacagcaacgtcaatatcaactatatcgatttacgctacgcgggctggaagccatgggcgggctcgtggaccgaattcggtatcgactacgcgatgccaaacaccaccaaaaaacaggatagctacggcggactgtacgatgctgacaacggcgtcatgctgaccggtgaaatcagtcaggatatgctgggcggctataacaaaaccgtgctgcagtacgccaacaaaggcctggcgcagaacatggtctcccagggcggcggctggtacgatatgtggaactacgtgaacgacgccaccggttatcgcgtgattaacaccggcctgatcccgattacagagaagttttctatcaaccacgttctgacctggggctcggcggatgacattaccgactataccgacaaaacgcggatgctgtcgctggtcgcccgcgggcagtaccagttcaccgactacgtgcgcctgattggcgaagtcggcggtttctatcagaaagacagctacaacaatggcaccagctacaaacaggccggtgagaaatacaccattgcgttgggcctggcggacgggccagactttatgtcacgtccggaattacgcatttttgcttcatatttgaatgattccgaagatggtaaaccgtttgaagaccagacggcgaataatacctggaatttcggcgtgcaggttgaggcctggtggtaatcgcgcacggctaagactcatacgttatttttatctcctgctgtaagactgttaattatcttccggtaaactttattgccactgctgtctttgtcttattttcgggataacctgctttcaggttatcccgttttatttatttccgggcggcaaaatgttcatccagaagctgacgcagcgcatcggactgtttaccgaaaatagcatgcacctgctgaccaagaataataacccctagcgcgccctgctgctgtaatgcttcggagtccacggccgcaagatggcgaacgctaacccgcagacgggtaatacaggcgtccacttgcgtaatattcgcttcgccaccaaaggcctgaataagcgcctcgatttgctgtttttccgcctcgcttaatggctgtgccggacgcgctggggagaaatagtgcaggaaggattttaaactcaccataataaactccaggtttaagataaaaaaaagcctgctcgtcagagcaggcgtggagaagaagaaattacgcgtgacgacggagaatacggcaatcccatgccgacagggtcagaggagccgataccgccgcgtcggtcaggcaatcccaatacccttgcggcagggtcagggtatggttttgcgcgctgtagttctgcaggaagataaatgcgttgtcaccgtcggtgcgcgcagtcgccaccacgccgggtggtaactccgtcgctatcgcccgcggcagggccagctccttgctcagggcggtaaagaaatcgcgctggaaggctaaatcgttgcgggaggccacatgccaggctttgcctttcccgaacgcgttcaccgtcacagccggccgtccggcataaaaatcatcccggtaggtggccagcgcctgggcgctctcgatatggatcagttcgcagagatggcgcacctgataagggccctgcagaccgcactgattcccggcaagcccctgcaccagattaaactcgccgtcattcaggcagtcgatctcttccgcccagatccccagcagattgcgcagcgggcccgggaagccgccgagatagcagagatcggactcattgacgataccggtccagtaggtggtcaccaggtggccgccgttggcgacaaacgcctccgcccgaccggcaaagccgtcgcgcaccatatataacatcggggcaatcactaactgatacggcgttaaatcgacatcggcgtcaatcacatcgacggcgatgccctgctcccagaacgggcggtagtgctcgttgaccgtcttctcatattccatcccaagattgcgcggcccctgggcgtcatccagcgcccagcggttctgctggtcgaagataatcgctactttcgcctcggtgcgacagcccctcacctccggcagcttgctgaggatctcgccgagctggcagacttcgcggccaatgcgggtatcaatatgtccgacgtggtcgaccactgcgccgtgaaatttctcaaccgaaccgcggcttttccgccactggaaatactgcaccgagtcggcgccatgcgccaccgcctgcagcgaggaaagaatatgcattcccggcttcttcagtttgctggtcggctgccagttggtggcgcccggggtggactccatcagcacaaacggtttgccgcccttcaggctgcgcatcatgtcgtgatacatcgcggtgtaacaggccagcgcggtttcgtctttatcgcggtgccacatcggatagctgtcccaggagatgaaatccagcgcctccgccagctgccagtagtcgtaatcgtagaaatactccataaagttggtagtcaccggcagggaggcattcgccgccttcagcggagcaatttcatggcggcagaaatcagtcacctgagcggtgttaaagcgatgccagtcaagattgagaccgtggatcgacatctcgccctgcggcgcaggcgattcaatctgcgaccagtcagtataggtatgactccagaaggtgctccaccaggcctggttgaggttctccagggtctggtaacgcgccttcagccagtcgcgaaaacggttctggcagagatcgcaatggcattcaccgccatattcgttggaaatatgccagcccagcaccgccgggtgtgaggaataacgttctgccagcagggtattgatttgcagggttttctcgcgatagaccggtgacgacatacagtggttgtgacggccgccgtgcagggccggcacccgatcgcgccccacccgcagaacctgcggatagcgctgcgacatccacgccggacgcgcgccgctcggcgtggccagaaagacatgaatgccggcggcatacagtttatcgaggataatatccagccaggcgaaattaaataccccttcgcgtggctccagtttcgcccagctaaatattcccaccgacatcacattgcattttgcctgctgcatcatggcaatgtctttatcaataatatcggggtcattctcccattgctccggattataatccgcgccatgcagcagcgtactaaccttcggatgtaaaggtgcaaatttattcataataaacttcctgaaaaagacgacaaaaaattaattaaaaacttttaccgacggcaatacttttccctggcaatcaaatagcgcctgattttcacgtgcattaccctctttccactcgtcgtggatatatttcatccccgccggggtggcccaggtatttcccggcacggcaatccatgtaggctcccaatagaaaatacctttgccacgctggtctggcacatcaaccaccgcctgcattaaatcgtgaatatagttatattgcccctgtacgctggcgggatatcccccatccttttcctcttttgcctggaaactattttccgcgttatcgcagttggccagggtataggcataggccgcctcgacgacgatgacgtctttgttatagcgtttgctgatgtcatccatattggccttcagggcgctgatcgggccattccagtaggtgtacatcgacagaccaatcacgtcatacggtacatggcgcttgtcgatctcatcaaaccaccagcggaaggtatcgttcttggtcccttcggccagatgcagcatgattttcacctgctcgccctggcgcaggttctccttcaggccagcgatagccgcgttcagcaggccagccagccggtcgaactcgccgcccccctgcccccagcttttcccttccggccacaggatgccgccgttgatttcgttgccgatctgcaccatatccggcaggacgcctgcctgcttaaagcgggcgatggtatcgcgggtatagtcatgaatcgccgttttcagctgcggataatccatcttttcccaggctttcggcttgaactgcttgccgggatcggtccagaaatcgctgtaatgaaaatcgagcagcagtttcatcccctgggctttcgcccgtttcgcgagggtcagggtggtggccaggtcgttatttccgccgccatagccctcaccgctcgccgattgcggatccacccacagacggaggcgaacatagttgacgccgttctctttcagaatagcgatcggatccttgcgctgattattctgatcgtagaacgtcgccccgtgcttttcggcgtccagcagcgtggagatatccgcgcctttgataaagtccgccggcatgccctgaaacgcgcgggttgcaagcgcgtccgcggccagagaagaggtggagaaactgcatgccagacaaaccgcaagccatgcgggtgtgaatcttttcatgtgcttatcctttagtactgcccgaggtcaggccggacacgaagtatttttgtagcgccaggtagaggatcgccaccggtacggcgatcagcaccgcccccgccgcgtaggtggtgtagctggcacccattttttgcgccaccaggttatacagaccgataggcagcgtgtatttatccggggtacgcaggatggtgctggagaggatgaaatcccccagcggcccagtgaacgagaacagcgccaccaccgcgaggatgggcctcgacaacggcatgatgatctcgataaagatgcgaaagctgctggcgccatccatgcgggcggactcatccagatctttggggatcgcgtcgagataccccttcatcagccaggtattcatcgggatcatccccccgacgtagatcagcaccagcgccaaatggctgttaatcaggccaagcagttgcgacaggacaaagatggcaatcagcgcggaaaactgtgggatcatctgcagcagcaggaacagcatcagcccgttctgccgccctttaaagcggaagcgggagaaggcgtaagcggtaaagctaacgctaatcagggtcagcaccatagtcaggaagctgattttcatcgagttccagtaccaggtgaggtaattcacattgccattgaacagatcggcatagtgctggaacgacacattttccggaatgattgaggtactgagcaggctattgccggcgttcagcgacgccccgaccgtccagaccagcggatagataatcaccactgagaccagaataaccaccagccaggtgagagagagccggatccacttttcgcgtttaatactgggtgattgagccatgttgcttcccttacgccatgtcgtcatttttgaaggatttggtggcgcggaactgccacagcgccaggccgacgacaaagatcgacagcaggatcgtgatggtcgccgcgatggcgtactgcgacgaagacatcgtcagcttatagatccacgacaccagaatatccgtcccgccggcgttagagcctgccaccgcagggccgccgttgttgaacaggtaaatgatattgaagttattaaagttgaaggtgtactgggtgatgatgatcggcgcgatcgcatacagcaccagcggcagggtgatggtgcgcagacgggtaaaggcgctggcgccgtccatcgtcgccgcttcatacagatcgtccgggatcgcctgcaacacgccggtggtcatggcaaagacaaacgggaagccaagccaggtctgcatcatgatcagcgccgttttggtccagaacggatcggtgagccatgccttcggactgatgccaaaaaaggacaggatcgcgttgttgatgaccccgaaggagtcgttgaacataccggcaaaaacgagaatggtgacaaaccccggcaccgcccacggcaaaataaagatggtgcggatcagcggcttaaagcgcagatctttttggttcaccagaatcgccaacaacacgcccaccgtacactgcagggtggtcgccagcagcgtccacaccacggtccactgcagcacatccaggaaagtggagcgccagatggagagggtgaaaatattaataaagtttttcagccccacccagtccaccagcttcgccggcggggtgtggtacaggttgtagttggtgaaggcgatggcgaaaccgaacagaatcggaaagatcaccacaaacaccagcagaataaagcccggggtgatcatcaggtacggaaagccgtcgctcagcagcatctggtactgcttacgcacgctgttgagggcgatcccctcatcgcgttttttgccgttgagccacgcatcccgcagcgagagaaaatagatcagcacgccgaaagcgacgatcagcacgctgataatcccctcggctaacaggaagatagagttatcccgcggtacctcttcacccagggtatataacccccacaacccctcacgcaggaaatcataaaaaatccccataaagctgctcagcagcaccaggaagaccagccctttcagccactggcgatgataaaactgaccgaaacccggcacgattgccagcagcaggccgcaccatgcatggcgcccgggcccgcgtgcgtcgctaaaattttcgctggaatggatgctcacactcgactccttctacaaacgggaggtccccctcccgctcggtgacttcacgtgacggtgaattactgattgctggcctgcatcgcttcgatctgcatcgtgatctgtttcaccgcgttatcgagcgcggcctgcggcgcctgcttaccggtgaggctcagttcaagcgcggcgttggccggcccccacacttcccccatctcgggaatgcccggcatcgccaccgctcgcgccgactggatggcgacggcgctggccttttggtcgtttttaatcaccggatcgtcaatcatcgccttcagcggcggaatttcgccagtggcgacatagcgggctttcacatactgcggctggttgatgaactcgataaactgttgcgccagcgctttgtctttactccaggtcgatactacatagcctttgacgccgaggaaggagctcatcggcttgccgtccggcagggtcggcaggggcgccacgccatagttaatgccagcggcttcatacggctggaaagcccaggggccgttgatcaccgccgccgcttttttctcggtaaacagggaatcgatggcattcagcccgttatcgccgaggatccccgccggaaagaccttctcggcatagaattttttcaggaaggtgacggcttcgacggcgccgggggtattgagacccacctgctgcgggttaaagccgccgctgtcgtttttagcaaagatatagccgcccatcgggccaatcgccccccagctgtaatagatctggtcaaacttggcgagcaggccgtatttgttctgctcgcgctgggttttcgagtagtccagccaggcctgcaggctgtccagcggcttgtcgatcaggtccttgttgtagataagcaccagggtttccaccgccttcgggatcccatacagcgcgttgtccatgcggaaggcattgatggaggctggcgtaaaggcatcctgtttcgcctgatcgacgctgagcggcgagagtagtccctgaaccacggcgccgccgagctggtcattcgggatcaccagcacgtccggcccaatgcccgccgggccgtcgaggcgcagtttttccagttgctgggcgtagggcatctcctggagattgaccttcacgttgtactgcttttcaaaatcgctaaccgcggttttgatgccagcggattttttaatgtcctcccagacgttgagctgcccggcggcatgcgcctgcaggctggcgagttgtcccgccgccagggtggtaaggatcagtgcagcaagcgtgttctttttcattatcaacctcatgtgaaggtataacaatttaatggtttttatttgaattccgtctgccagttagaaaaataaatcttttcaaactgccgtattatttggaaaacatgttctgatgcgcttttgttatacgctacgctttgatcgttgataaaactaccataagctgccagttgtgtgatcatccttgcagaaatgaaacgtccctgtatggcgcaaaatccgcggaagttatagtcagggcatgattttactgctgttgaacatcgtcacaccgatttgttacacgtaatacaaatcacactcaacatagcgataagccaacggcaaataacagctactcactccggggaatgtggatgtccaatatacgactgaggaatgtcaccaaaaggttcggcagcacggtgacgctgcaccaggtcaatctcgatattgaagatggcgagtttgccgtcttcgtcggcccttccggttgtggaaaatcgacgctactgcgcatgattgccgggctggaagaggtcagcgaaggagaagtactgatcggcgatgaggtgatgaatgatgtcgtgcccgcccgccgcggcgtggcgatggtcttccagtcctatgcgctctatccgcacatgacggtggcagagaacatgggctacgggctgaaggtgaataaagtgccgaaaacggagatccgtcgccaggtggaaatggtggctaaaacgctgcagctctcgcacctgctggatcgtaaaccgaagcagctctctggcggccagcggcagcgcgtggccattggccgggcgatcgtgcgtaatccccgggtatttatgttcgatgagccgctctctaaccttgatgcggagctgcgcgtcgatatgcgcctgcatattgcccgtctgcaccaggagctgaagaccactatggtgtatgtcacgcacgatcaggtggaggcgatgacgctggccgataaaatcgtggtcatgaactacgggaaagtcgaacaaatgggttcgccgatggcgctgtactacaatccggtcaacaaattcgtcgccggctttatcggctcgccgaagatgaactttctgccggctatcgtcagcgactggcagccggaacgcttaacggtcaccctcgcgcaggaccatcagctggccctgaatatcgccacccagccgctgaagcccggcgctgcggtgacgctggggatccggccggagcacctcaccccggaaatcaccaccggtaccgtggtggagtttcaatgtgaagtggtggagcgtctgggcaacaatacctatctgttcggccagtgctacggccacgacaacgtcaaggttctgctgcccggcgacgtccatttccgcccctggcagaaaattaatctggctttcgatgagcgcttctgcatggtgtttgatgagaacgacctgcgcatcagcgctgatatcccggcaccggatgcacactagctaacatattgctgtcatctgcgcagcgtatgctgcgactgaatgccggaacacaccctgcccggcattcacaccctcatttttattctgctacatcggaatcatccttctctcccggcatcgcagcctattgtgatgccggctttttccccaaacgacgcgttttctcccgctgcgcccgaattatctttcgcatatactgatgacacccggcgaacgataaggacacaggcatgaggacccggcatctgatggcgctgtttacaggagtgctgatactggccatcatcctgcccatttcactcagcatctggcaggcggcgcggcaggccaaaatgcagttctatcgtgaactggatgactattccaaccgtatcgtcgttcggacgctgcaggttgccgaccaggcccgggaagcgttacgagaggctgacgcacacaccgccgcctcctgtagccctgaacatctgcttacgctccgccgcatcgcctatacccatcgctacattcaggaagtgctctggctgcgtgattccgtgccgcaatgctcctccctggaagaccatagcgtcgcggtcaccttccccccgccggaccacattgcccccgacggctatcgcacctggctgacctcaattaacgatcttggcctcgatcatcagatgacggccatgggcagccggcagcacatggtgatgatcgaccccgtctcctttattgatgtcgttcccgccagcgaagagaagatccataccatgctgtttggcctggaccaccagaaaatggtgatcagcagtcagccgctgccggcgaaagtctggcaacgcattaaagatccgcatgtggatatgcttactctggataacacagtctaccggatccagcgcattcccgagctgggctctggcatcgtaacctggtcttcaaccttgccgctgcagcagcgcattcgacagcagctgttcttctggctccctgccggcattttcaccagcctgctcgccacctggctgctgctgcgtctgctaaggcacctgcgctcaccgcgcaacagcatgctggacgccctcaattccgaagcgattcaggttcactatcagccgattatttcgttgcaggacgggaaaattgccggggcggaggccctggcccgctggcagcagcccgatggcacttttttatcgccggatatctttattcccctggccgagcagaccgggctcatcacgcagctgacggaagatatcgtcaggaaaatttttgccgatctcggcccctggctgcggcagcggccggaagtgcacatctccatcaacctgtcggtagatgatttacgctcgcccaccctgccgacgttgttgcacaatcagctacagcactgggggatcgccgccgaacagatcatccttgaaatcaccgagcgcggttttgtcgacccggagacgactatgccggtgatcgctcactaccgtcaggctggccatcggatctcgattgacgatttcggtaccggctactccagcctgagctatctgcagaaactggacgtcgacacgctgaaaatcgataaatcttttgtcgataccctcgagtaccggccgctgacgccgcacattattgaaatggccaaagcgctcaatctggccaccgtcgccgaaggggtggaaaccgaaagccagcgcgactggctgcgccagcatggcgttcagtacgcccaggggtggctttacagcaaagcgctgccaaaagagcagttcattctgtgggcagagcataacctccatgcgcattaagcggcgggtggcttgagcggaacgtcagggggcgctacttcagataggatttaatcacctgcatcaccgtctccagatccgcttcgcgctgcgtctcgtcaggctctttcaccacatggtcggtaagatgcccctgaataacctgcagcatcatgccgttgaccgcgccgcggatcgccgccagctgctgtaatatttcagcgcactcatgctcgcgattaagcattttctctaacgcggtactctgcccctgaattttcttcagccgggtcagtaacatctttttgtgtcgaactgtatgtgacattgcacgatccaccgtttcattctgtccgggattaccgacctgcgtggtcagcaacgcctgccagcataccatgatcctttttattagccgctttatctactggggggtagtattttactactgggggggagtaggataatcgcacttttggcaaggatcccgatatgaacgatttcacttcccttctgcagcagggcaatgcctggctgtttatacccagcgcaatactgctcggcgcgctgcacggcctcgaaccgggccattcaaaaacgatgatggccgcctttatcgtggcggtacggggaacgttaaaacaggcggtactgctggggctggcggccacggtttcccatacggcggtggtctggctgatcgccatggccggcctgtggtttggccgcggctggaacgcccaaacctctgaaccctggtttcagctggtctcagggattgtcgttgtgctgattgcctgctggatgctctggcgcacctggcgcgaatcgcagcctcacacgcaccatgagcaccaccatgaacatgagcaccaccatgaacatgatcaccaccatgaccatgatcaccgccatgaccatgatcaccgccatgaccatgatcaccgccatgaccatcaccatgcgtcctcatccgccgcgccgctggtggcggaggagtggcaggacgcgcatcagcgggcccatgctcaggagatcaaccggcgctttgatggccgccaggtgacgaccgggcagatcgtgctgtttggcctgaccggggggctgatcccctgcccggcgtccattaccgtgctgcttatctgtttacagctgaagaaattctcgctgggcgccacgctggtgctgggctttagcgttggtctggcgctgacgctggtggcttccggggccatcgccgccctgagccttaaacatgccacccgccgctggccgtggcttaacgacctctcgcgcaaggcgccctggttctcaggcttactgattattgtggtggggatctacatgatgcttcatggcctgagcggcctgtaagcgatgaaaggccctctccgtgatgaagagggcgatgggttaattcaggagactatttcccggggagggctgaccgcgttgcggctgacgggctggctgaaccacggtaggcacagctggatcagcggcccaatcgacagcgcgtagatgacggttccgacgccaaatttgccccccagcagccagccaatcagcagtacggaaagctcgatcgccgtccggataccgcgcagtgaccaaccagtgcgagcatgcagaccggtcatcaagccatcgcgcggcccggggccaaagcccgcgccaatatacatcccggtagcgatagcgttcagcacaatcgctcctaccagcagcgcactgcgcgccaccagcgactccagcggcggcaggacggccagcgtggcgtccgccgctagtcccagcacgatgacattgctcaccgtgccgagccccggcatttgccggatcgggatccacagcagcagtaccgccgcgccggtcaggataatcaccgtaccgaaactgatccccagctgtttagccaccccgagatggaaaacatcccacggatcggcgccgagattggcatgcacgaagagcgccgtggacacgccgtaaagcaccagaccaatatataactgcagcaggcgacgaagcatattttttcctcaacatcattgcgaatgccctcatcatcagcaaaaatggactgataattaatggccagttttggaaaagtggatcgctatgtcagcccgacgctttggaacccaatcgctggtacgcctgctcggcaactggcaggagaccagctcacgcacgccgctatggcgccagctggcggaagcgctccgcctgctgatccttgatggtcgcctgacgctgcaaacgcgcctgcccggcgagcgcgagctggcggcggccctgaacgtcagccggaccaccatcgccagcgccctcggccagttgcgggaggagggctttctctacagccgccaggggagcgggtcacgcattgttttgccggaacgccccgccgatcttcctctgcctgccggcatctcatctacgcttaatctctctactgccgccctcagcgccgggccggaggtccatcaggccttccagcacgctatgaccctgctgccgccctatctcgcacagactggctatgaccagcaggggctgccggtgctgcgggaggcgattgcccggcgctacagcgaacgcggtctgccgacgcggcccgatgaggtgatggtggtcaacggcgccctcagcgccttcgcgctgatcctgcgcctgttcaccgggccgggcgatcgggtggttattgacgcccccacctatccgatggccatcagcgccattcagggcgcctcctgccgccccgtcggggtcgcgcttccgcagcagggatgggactgcgatggactggcggcgactattgcgcagactgcgccgcggctggcgtggctgatgccggattttcacaaccccaccggacgctgtatggatgcccccacccgccagcgggtcgcggacatcgccgccaggacgcgaacaacgctggtaatcgacgagaccatggccgacctttggtataacgcgccgccgcccccgccgctggccagctttaatcccgatgccgcggtgctcaccattggttcggccgggaaaagcttctgggggggactacgtatcggctggatccgcgccagcgcgcgggccatcgcctcgcttattcaggcccgcgattcgctggatttgggtacgccgctgctggagcaactggcctgctgctggctactggaaaatgccgccacactgctgccgccgcggcgggatatgctcaaggcgcgccgggacatgtgcgaaactctgatggcggaatattttccccgctggcggttttcgccaccggaaggtgggctctctttttgggtggaacttcctgacatgctggccaccctgttctctgcgcgtgcggaaagccaggggatccatatcggcaccggtacgcggtttgggctggaaggggcgttcgatcgctatttacgtctgccgtttacgctgccggatgaagcattgcgccgggccttctccacgctacaaccgctgtggcaaagccttgctgaacagaaggaaaatacacgtttgcgaaaaataatataagaaaatagcgacgggctgacttcagcccgtcaaatgaccttcatccatgaggtatatgagatgtttttataaaattgcctggctatcctgccctctggttatggcaacccaatgacagaaagaaggcaatttcattaatgctggcgcggaataggaaaccctttcagggaaataataaagccatcttcatcttttttgattttagcgccggtgtcacaccagtcggaagcaatgcgaaagaactcatcactaccgatattccagttcaggcggacgtgttttacgtatcctgagcgcaacatatcgcaagcttcgctatagttgctggctgtagagaattgttgtttcattttttcttcttcagaagttttcttaatgctttgatttctttaggggtaagtggcgtcgcttcctcttcggtatgctggctgtcaatgtcctcttccgtcacccccgcctcacctgctgactcctccagctgaaaagccagctgcagcagcttttccgttgccgttcccaggttctcgttattaacttccgcataatgacgcaacttttcttttagctctgcgtcaatttttacattcaaaaccactgtggtcatagctacgcttcccgtgcaataaaatcatcataattaatacacgaagttaacatgctgatccagagatatattttacagcatgagcctggcaacaaattcccatcagtaagatgcgctttatttatgacatgcaaatgacattaatatttcagtagtatttcagatttatgacaagtaaatattatggaataaaagaaggggggtttaacaacaaaaactaatatgcgatctttatcagaaattaattattgcaggaataaaaaccggacaaatataagggaaacaccaggcgggagaaatgggtgggggccctgccagctacatcccggcacacacgtcgtctgctctggctgcttccttccggacctgacctggtaaacagagtagcgttgcgggagaaccaacagagcccccattgagagcgttagttgcctaacgcgctggcgcattatccctgctgacctggtgaattgcaagctcacaccgtccgcctgctggtttattgcgcaataacgcgaataaaaccagccactcacggtcagcctgtgagattgcgagcctgcgctcagcacacatccgggttatccaccatacttatcctcttcgtcctcttttatcaccagtacattgtctcgacggtaatcgaatgactgactcatcaccacagaccatcactctgcctttacctgctattgaagggatgaccatcgcctttcagggcgtaaactacctgcgtcctgaaaaaatgctcgacttcgcgaccatcagtcccgcgccggtgcgggcggttacgccgctggcgctgctctattccaccgtcggcgtgctgcgccaggtggagctacgcaagctgccggtctatatcagcggtcgggtggtgtaccctatctcgtcgttaaccatgccgggcctgcgcgcgaggctgatcatcaacgccacttcgcagcggttgaaatttcttgaaagtctcatcgccagctcagcctcggacaatgtccatggcatgcagatcctcggcctcgctctgacgttcaccgtcgaacaggccgcctgacccaggccggctgtacagctcctggcttagcgcttatgctgacgttttgccggtaacaggacagaaaatggctccgcacgacacatttccccaacgcgtctggcacatcgtggcgtcgataccggaagggtatgtcacgacctacggcgaggtcgcccggctggcaggttcaccgcgcgcggcgcgccaggtgggcggcgtattgaagcgcctgccggaagggtccaccctgccatggcatcgggtggtcaatcgccatggcgatatctccctcaccggccccgatctacagcggcagcgtcaggcgctgctggccgagggtgtgcaggtctccggcagcggccatatcgatctccagcattatcgctgggtttattgaaggcaaaaaaaagcccccatccgggggcgtagcgagcttactgggcgacaggaacggcggtctgctggaccggaaccagcgtcaggtcggcatgagtgccgccctggtttattaccgtctgcacggtatcggtaataaacatcaactggccgttaaccgtgatcgccgcgcttagcagaatgcgagcgttcggttgaatatctgccgggttgtaaggcagcgcaaagttaaatggcgcctgtttgccttcggtacgcaccgctttttgcgacaatacgcgggctggcgcatctgccagagaagcatccgacagggtcaccgtcagtaccgcatccggcggtaaagcgattctctggcggatattaatcgtccccgtgacgctcggctgctgctgcgccacgctcagcgtcgcgataccgtaagggtcgggcgcggccgcctgcgtcgaagaattgttcgagtggtgattagcacaggcggtcagcgtcgcggcgacggctaaggcactaaacatataggcaaatttcatgatgttctccttatcatcccttaatacccaggaggatgttccgccgcttcgccggcaggaactttcgtgtcgtcaataagtgtggcacagatctcagatttgttcctgttaactggtcgttattcagattattacacccatcggaccacttgcgattccaggttatacttggccacattacgcgcgctgcgccgctattgttaattgaggataagtatgagtcaggcactctctaacctgctggcattattagatctggaaaaaattgaggaagggttgtttcgcgggcagagcgaagacctggggttacgtcaggtttttggcggccaggtagtgggtcaggcgctgtatgcggcaaaagagaccgtgcccgttgagcgtctggttcattcgtttcacagctactttcttcgccccggcgatagccagaagccgatcgtttacgatgtggaggtgctgcgcgacggcaacagcttcagcgcccgtcgggtcgccgccatccagaacgggaagccgattttctatatgaccgcctccttccaggcgccagagaatggctatgagcatcagaaagcaatgccggccgccccctcccctgacggcctgccttcggaaaccgatatcgctcgcaagctggcgcatctcctgccgccgcaggtgaaagacaaattcctctgcgataaaccgctggagatccgtccggtggagtttcataacccaatgaaaggccatatcgccgaaccggtgcgccaggtctggctgcgcgccaacggcgccgtccctgacgatctgcgtattcatcagtatctgctgggctatgcttcagactttaacttcctgccggtggcgctgcagccgcacggcgttggtttccttgagcccggcatgcaggtcgccaccatcgaccactctatgtggttccaccggccgtttaatattaatgaatggctgctttatagcgtcgaaagcacctcggcctccagcgcccgcggcttcgttcgcggcgaattctacacccaggatggcacgctggttgcctcaacggttcaggaaggggtgatgcgcaaccgcaacgcataaaaaaagcctcccggacgggaggcttttcgctatcaggagagaatggcttttttatcaggcgttataggcgttttcgccatggctgttgacgtccagcccttcgcgctcctgctcttccggcacgcgcagcccgacggtcatatccgccactttgtagccgatgaacgccacaacgccggaccagaccacggtgatggcgatactttccagttgcaccagcagctgatggcccatggtgacgccttccgcataaccgacgccgcccagagaagtcgccgcgaagataccagtcaggatacagccgacgatgccgcagacgccgtgaacgccgaagacgtcgcaaggatcatccacacgcagccagcgtttcagcgcagtcacgccccagatacccgccaggccagaggcgataccgacgatcagcgccccgccgacaccgatataaccacacgccggcgtaacgccaaccagaccggcaattgccccggagcaggcgcccagcagtgaaggtttgccgcgcagagcccattcgccaaaggtccacgccaggatagccgcagcggtcgccacgacggtgttaacgaacgccagggccgcaatttcattcgctgcgctggcagagccggcgttgaagccgaaccagcccacgtagaggatagcggtgccagtgaacaccatcggcaggttatgcggtttgaacgcttctttgccgaagcccacgcgtttgcccatcatataggcgccgaccagcccggcgaccgcggcgttgatgtgcacaacggtgccgccggcgaagtccagcgcgccatgggtcgccagcagaccgccgccccaaaccatatgcgcaatcggcacgtaggagagtgtcatccacaccaccacgaagatcagtaccgcggagaaacgaatacgttccgccagcgccccgacaatcagcccgacggtgatgcaggcgaacgagccctggaaggccacgtggatatactgatagaaggtgcccatcagcgctttcagctcaatatttttcagcatcacccagtcaaagctgccgaagaagctgccgccggtgccgaaggccagggtatagccataaatcacccacaatacgcagaccaggccaaaggtgacaatcacctgagtcagcatggacagaacgttcttaccgcggatcaggccgccgtaaaacagcgcaatccccgggatagtcataaacagaaccagcgcggtgcaaatcatcataaacgcgttatcggctttgtccgccaccgcaggcgcggccatcgccagccccggcagaagggctaatgcccccagacccgatttcattgttgccattttcattgtttcgttccccatcactgtgtggtctggaaattacagtgccgcttcgtcagcttcgccggtacggatgcgaatgacgcgctgcaattcagcgacgaaaattttgccgtcgccaatttttccggtgtaagccgctttgctgatgacatcgatgacttcatccagctgatcgtcggcaatcgccacatcaatcttcacttttggcagaaagttgacgctatactcggcgccgcggtagagctccgcgtgacctttctgacggccaaatcctttgacttcagtgaccgtcaggccctgaatgccgatggaagacaaagcttcacgcacgtcttccagtttgaatggtttgattaccacggtaaccagcttcataagtcccctccagtcagtattcggtaatggccgcagctaacacgatggatataaagcaagggctatgccagaaatgaaaaaaggccgcaaagcggccctttgatggcaaaaaacaggggacaggtcaggcaatatcctgcgcaacggcgcctggcgcgcaaaaatgcaccacaacggtgcatttgatgtaacgtttttgcaccatcgcaggccgcccagcgttccctgcctgctggtggtgcatcaggcgctgagcgactcctctctggcgctggccgccagctcttcgccggccagctgcagctgatacatctgccagtagcggcctttcgccgccagcagctgctgatgggtgccccgctcgacagcctgacctcgatgcagaaccaggatggtatcggcctccacaatggtcgacagccgatgggcaataaccacgagggtggtatgctggcggaccttcgccagcgcctgctggatcgcctgctcggtaccggagtcgatgtttgccgtcgcctcatccaaaatcagtacctgcggggtgtccaccagcacgcgcgccagcgccagcagctgcttctgcccgacggagagattattgccctgctcgcccagttgggtgtacagcccatcgctcatgctgcgcgccaccgccgccagctgcaccgcctccagcgcttcccaaacctgcgcctcactgatgtcccggcccagcgcgacgttggcgtaaaaggtatccgccagcactacgggatcctgttgcaccatcgcgatgccccgacgcaacgcgctgtggctgagggatgcgagcggtcgaccatcgatgcggatctcgccgtgggttaacgggtaatagcccatcatcagactggcgagggtactttttccgctgccggtatgtccgaccagcgccacgaagctgcgggagggaatatccagcgtgatatcctggagaaccagacggtccccccggtaagcaaaggagagatggtcaatttccacccgaccgctgctcagcggcgcgtcatccgcaccccacgcctggcgcgggcgatccatcagctcgaaaacgcgctcgccggcgaccaccgcctgctgcagcatcgactgctgggtggtcagctcgataagcggctcgttaaggcgtccaagatagctgataaacgcgtacaggaccccaacctcgatcgtgcccaccgcgctaaagccgaacagcatcagcagcccgcacagcaccagcgaggaaaaaaggctcagcagcgggcgcagcagaaaaccgtccaggcgcagcgtctgcatccgcgccagatagtgggcatagctggcctcgcgcatccgttcgccaaagcgcgcctgctggcggaactgctggatgacgcccatgccgttgatcacttcgttgaagccatcgttgatgtcggcaagccaggcgcgcacccgccgcacgatcggcgtgctatagcgctgatagataatcatcacgatcagcaccgccgggaaaatcgtgatcgccaccagcgccatccgccagtcgaggctaaacatcgccaccagcatcgcgccgatcagcgcggcgctgcgcagtaccgtagccaccaccgtcacgtacagatcgcgaatgacttccgtatcgttggttacccgtgagataagctgcccaaccggctgggtatcaaactcgctgagcggctgatgcagggcggcatccatcacgtcgctgcgcaactgctggacgacgccgaccgcggcgcggttaaacagcagcgactggttatagtgcaggagcgccgccagcagctgcaggccgatataggctaccgccaggccggccaccagcttcagcggcagcgtatgtttcgccaccatgttgtcgatgaaatagctaataagcagcgggccgctcacttccgccgccgccgcaatccacatcatcgccaccgcgatggccaacggcttgcgccacggtgaaccataggccagcaggcgtttaagcgtcggccagagttcagtaaagctacgcatccagggcctcctcttgcgtctgcggaacctcgtcgagcgcggcctccagctgctgatatcgatacatgtcgcggtaccagccgggctgcacggccagcgcctcgtggcggccgcgctgggcaatatgcccatgctgcagtaccaaaatttcactggcctcagtgagcgccgacaggcggtgggcgctgataatgaccgtccgcccctccccccactggcgcaggttatgcaggatctggtgctcggtgcggccatccaccgccgataaggcatcgtcgaggatcaaaatttcggcctccagcagcagggcgcgagcaatcgagatgcgctgtttctggccgccggagagcatcacgccgcgctcgcccacttcggtctcgtagccctgaggcagacgcagaatgtcgtcatgcacgctggccagttgtgcaacccgctcaatctgcgcctgcgtcgcgtccggttttcccagcgcgatattattggcgacggtatcggagaataaaaatggcgtctgattgaccaccgccaaccgggcgcgccagctgtcgagctgcagaatcggcagcggcagatcgtgaaagcggatctcgccgtgagtgacgtcaaaatggcgctgcagcagcgccagaatggtgcttttgccggcgcccgtcggcccgcagatgcccagcatttgccccggctggagagtaaaatttacctgctccagcgaaggtttgctcgcctgcggatagatgaaatcacggatagcaacctgcaggacgccgcggcctgccggcaccgcctcggtcccgtcatccaccgccggcgcctcttcaagcatcgtgcggatacgaccataggccgcgctaccgcgctccacgatgttaaacatccacgccagcgccagcatcggccagatcatcaggccaagatacatcacgaagctggtcagctggcccagggtcaggctgccgtggatcaccatccagctgccgccgccgatggccagcaggttagcggccccgatggcgatatagatggtggggtcgaagcgggcgtcaatgcgtgccacgcgcatgtttttcgcgccggtatcggcagcatcggcagcaaactgcgccgactggcgatcctccagcccaaacgccttaatcatgcggatgctggtcaggctctcctgcgtgcgatcgttgaggctggaaaaggccgcctgagcaacgcgaaaacgttcgtgaagcgcatcgccgttgcgtttgatcgccagggccatcagcggcatcggcagcagcgccagcagagtaagctgccagctaatctgcgtcgacattacaatcaataccgcacagcccatcaccagggaatccacgagggttaatactccttcgccagcggcaaacaccacccggtccacgtcattggtggcgcgggcgataagatccccggtgcgatggcgcaaatagaacgccggatgctggcggctcagttgccggtaaaaatcttcccgcagctcaaccgccaactggtaagaagcaccgaacaacagcacgcgccagacatagcgcagcaggtagaccatcaccgcgatcagcaccagcgcgccgatccacatccacaccttctccgcggtgtaatgttgttgcgtcacgccgtcgaccacaatgcccaccaccttcggcggaataagctgcaggacggcaataatgaccagcagggcaattgcgccaagatagcggcgccactcccggcggaagtaccagctgagttgagcaaataatcgcaagcaataaaatcctgattttgtaatgggttacggcgcaataccgttattcgacaggcaaggcggtggtatattttatctgttccatggcaaaactcgaagtgacatccgacagaccaggcacactgttcactaaacgtttataaaagtcgtcatagcgtttcatatcagccacctgcacccgtagcaggtagtcatactcccccgccatccgccagaagccgagcacttccgccatctgcgtcacttcgctcacgaactgacagtaccagtcgctgctatgatgctgagtcttgatcaggacgaacgccgtcagccccagccccaccttttccgcgtccaacagggcgacgcgcccgcggagaatgccctcgtcttcgagccgtttcaggcgtttccagcagggcgtggtggtcagattaacggcatcggccagcgcctgcaaagagagggtgcaatcttcctgcagtagcgccagcagcttacggtcaattttatctagcattgggcatcctcagagaaaattttgctctcataatggtaatccacaggttaaatggcaacaatttttcctgcgctttccgctaagctaggcacaaaatgacaaacaggaaatcacgatgaatagcgcctgggttaaacatgccattagcgaaatcaacgcggactatcagcgctccgccgacacgcacctgatccgtctgccgctgcccgcttttccgggcatccacctgtatctgaaagatgaaagcacccaccccaccggcagcctgaagcatcgcctggcgcggtcgctgtttctctatggcttgtgcaacggctggatcaaagaaggcacgccaattatagagtcctcctcagggtcaaccgccgtttcggaggcctatttcgcccgcctgctggggctgccgtttatcgctgtgatgccctcctgcaccgccagacgcaaaatcgaacagatcgagttctacggcggacgctgccattttgtgcagagcgccggcgaaatctacgcggcttccgaaacgctggcccgcgagctgaacggccattatatggatcagtttaccttcgccgagcgggccaccgactggcgcggcaacaacaatatcgccgacagtattttccgccagatgagccatgagccgcacccgcagccgtcatggatcgtcatgagcgccggcaccggcggcacctcagcgaccattggccgctatattcgcagccagggctacgagacgcagctgatggtcgttgatccgcagaattcggtgttcctcgattactggcagacccgcgacgccagcctgcgcagcccggtcggcagcaaaattgaaggcatcggacggccgcgcgtcgagccgtcgtttattcccgacgttgtcgatgagatgctgcgcgtgccggatgcggcgagcgtagccaccgccctgtggctggaaacgcagcttgggcgcaaggtcggcgcctcgaccggcaccaatatgtggggcgtattgcagctggccgcgcggatgcgcgaggaaggtcgcaccggctcgatagtgacactcctgtgcgacagcggcgagcgttacctggaaagctattacaacccgcagtgggtggcggacaatatcggcgatattgcgccctggcaggcggagatcgccggtctggtcgaaaggcgataaaaaaagccagatagaagcctatctggcttgctggaagggtctctctattcgggggaataaggaagatcaggattatccagccaatgagttaaaaaatgggagactgcctgattccggcagtcgccaattaccggcagatgcggcagctcggctatcagctgcggcatcgcgttgcccatgatgaacccccgcccaacgctgcccagcatctcgcggtcgttcatcgcatcgccgaaggccatgcactcctgcagggtgaagcctaactgctggctgagcaccgccagcgccgcgcctttattgcagccaaccggcagcacctccagacagtccattgccgagcagcagagaaatgcgcgatcgcccagcgtctcattcagctggatccgcagacggcgcaaatcgtcatgatcgccgcagaaacagatcttggtgacatgctgcgccgacatacgctttagatcgcacagttgatagtgaaagccgctgaatacatgcgcttgcaacaattcaggccttgcctggccggtaaaccagccgccatcgttaaagacgtgcatgctggcctgggtatcccatttgccgtgcagcaccgcttccgccgcctcgggagcgagatcctggcgataaagctcctccccttccagcgaatggatgcgcgtcccgttgccggtgatcagaaatgcatcaagggaaaattcgccaatcacatggtgcatctccagcacatggcggccggtggcgaaggtcaaggtgatatcgcgctcacgcagccgtttcagcgcggaaagcgtcttttctccaagacgatggtccggcatcagcagggtgccgtccatatcaaatgccgccagttttgccatggtatattccccgatgtgtgatgggcttcgcttgtgttgcagtatcacctgggatatacggaagtaatagtgaatagatattattaattgttccgggtttacagcggcccggtggacgacggcccccatgcgactcttacaccgtttaaatcaataccagcgcctatggcaaccctcagccggggcgccgcagcaggtcaccgtcggcgaactggcggagcgctgtttttgcagcgagcgccacgtccgtactctgctgcgtcaggcgcaggaggccgggtggctaagctggcaggccagctccgggcgcggcaaacgcggacagctcttatttcacaaaaccccggaaagtctgcgcaacgagatgatggagcaggcgctgaacaacggtcagcaacaaaccgcgctggagctggcgcagcttgccccggtggagctgaaagccctgctccatcccttcctcggcggtcagtggcaaaacaatacccccacgctgcgtattccttactatcgcccgctggagccgctgcgtcccggctttctccccggccgcgccgagcagcatctggccggacaaatctatgccgggctgacgcgcttcgacgaaggcgacaatatgccgatcggcgatctggcgcaccactggcaggtctccccggacggcctgcgctggcatttttatatccgctccacgctgtgctggcacaatggcgatacggtggaaaccgcgcagttgcgacagcggttactgctgctgcttgagctgcccgccttgcggaccctcttcgccagcatcagccgtatcgatgtcacccatgcccagtgtttaacaataaccctgcatcgccctgactactggctgccgttccgcctcgccagctactgcagcgtgctggcgcatcccgacgatccggccattggctgcggaccgttccgcctgaagcggtttagtccggaactcgtccgcctggaaaaccatccccgctaccacctgcagcatccgctgatccaggcggtggagtactggatcactcctcagctctttgaccgcgatctcggcaccagctgccgccatccggtgcagatcaccatcggcgatcgcgaagagctgcataatctgcgtcaggtcagcaaccgtatcagccttggcttctgctatttgaccctgcgccacagccctcggcttagcaaagcgcaggcccagcggctggtgtcgataatccatcactcgtcgctactggatacgctgccgctggaggaggatctgattacgccaagccatgaggtgctgccgggatggtccatcccgcagggaccggcaaacaacgcggtaccgctgccggccaggctcaccctgctctatcatctgccggtcgagctacatgcgatggccgaacagctgaggcaacgtctggctctgctgggctgcgagctgacgctcctgttccacgacgctaaaaactgggaaggctgccagcatctggggctggccgacctgatgatgggcgaccgtctgatcggcgaagcgccggagtacgccctggaacagtggctgcgctgcgatatgctgtggcctaatttgctgaccggggcgcaatatgctcatctgcaggcgacattagacgcggtgcagtctcagcccgacgctcgcagccgcaacgatgcgctgcgcaacgtatttaacagcctgatggaagacgccatcatgacgccgctgttcaagtataactatcggatcagcgcgccaccgggggtcaatggtctgcgcctcaacgcccggggctggttcgacttcgccagcgcctggctgccggcctcgtcgacgtgagagagctggtgatggagggcgtctggcgctaccatatcgcctttattcatttagtcaggaattgccatgaaacgcgccgtagttgtcttcagcggaggacaagattcaaccacctgtctggtgcaggctctgcaacagtatgatgaagtgcattgcgtcacttttgattatggccaacgccaccgcgcggaaatcgacgttgcgcgcgaactcgccctgaaactgggcgccgtcgcgcataaagtgctggacgtcactctgctcaacgaactggcagtcagcagcctgacccgcgataacattccggtaccggactatcagcctgatgccgagggcattcccaacacctttgtccccgggcgtaatattctgtttttaaccctgacggcaatctacgcctatcaggtaaaagccgaagccatcatcaccggcgtgtgcgagaccgacttctccggctacccggactgccgcgatgagtttgtcaaagcgctgcaccacgccgtcagcctggggatggcgaaagacattcgctttgagacgccgctgatgtggctgaataaagccgagacctgggcgctcgccgactactggggtcagctggatctggtgcgccgggaaaccctcacctgctacaacggcattaagggcgatggctgcggccagtgcgccgcctgtaacctgcgcgcaaacggactcaaccagtatctggcggacaaggtcggggtaatggcggtgatgcagcaaaaaaccggactggcgcaggcataatctccggggatcgatttaccggagctttgactcaaattccccggtggcgcgatgcttaccggggctacgggttcatcacctgccgtgggccagccactcgcacgacggttgtcagcgcaggttcatctggtcaagtttcgcacgcaattccccttccagcggcagcgccttctgggttttcaaatcgatacaaacgaaggtaatcagcgcatcggccactacttcgccattggggttgagggtgaccacctggcttagggtgccgcttttgccgttgagttgctccagtttgctgctcaccgtcagcacatcgcccagtaccgccggacgacgatagttaatattgatattcaccaccacgaaggcgatgtttttctccatcatccactgaaacgcggggctgttttccaggccgtcccagcgggcttcctcaaggaactccaggtagcgagcgttgttcacatgctggtagacgtccagatgatagccgcgaactttaatttgtgtctgcatagcactaatgcctttctgttattgttgcttatgaggtaagaggtcacaccacttgatgcaacctctttatcctggcaaaaaatcaccgctgtgcaaggtctggcataaaatttacagcgtcagatgggctaaattgcgctccaccaacgcgctccccattcccgggacctgcttcagatcatcaagggttttgaacggcccgtactcttcgcggtagctgacaatggcctgggcttttttcaatcctacgccattcaacgcctgcgccagctgttcggcgctggcgcggttaatgctgacctttgtcgccccgttgtcagactcgccgggcaccgcttccgccttcgccgaagaggacgcctgcacattttctttattcaccgccgctttgccgctggcgggtgccgccagcgccccctgtacccctaccgcaaaaaccagaacgcccgcggccatcagtgcttttattccatatttcatgctgatatctccttgtgtgtagacagcaaggtcacgatagcgtcagtgcggatggtcgacaaaaggcaaatcacagaaatggaaagggccgcgaaagcggcccttgaggattacatcgtgttgctcatttttgcgagacgacgcgaaattactgctgctggtcgatgctgtcgccgagcttaattttcgccgccttgcgcaggttgctcatcagcgcttcgaaagcgatttgggcattgttctgggtgatcccctgaaccatggccttcttctgctcttccggcatgctgccggctttcacctcatccagcgctaccagcaccacatcgccttgcatattgctgcccacgccgtagaccggtttaccctgctgcggcagcggcagggtaaatgccagctggctcagcggatcctggccggtacgagaaagcgtctgcggcgcgccaaagctcaggccagccgccttcatcgcttcatcgcctttgccgtctttcagcgccgccagcagcttgtcggcctccagtttcgcctgctgttccgctttattgtgcttaacgatatcgctaacctgtgccttcacttcggcaagcggcttcaccgcctcggctttgtgttcgctaatgcgcagaacaaaagcgcgatcgccgtcaacggtaatgatatcggagttgctgcccggcgcgccgttctcacccaccagaccgccgttgaaaatagcgtcagcgaccggtttaaagttcagctcctccggcaggttatcgcggccaaaccagccggtttctacgaccttcagcccggcgacctgcgctgcgctcgccagcgattcattatcgttgctggccgcatcgctcaccttctgctgcagcgcgtagtaagcatccaacgctttttcctgcttcactttcgccgcaatgtcattacgcacgtcagccagcggcttcacctgcgccggctggacgtcgtccagacgagctaccaagaagccaaccgaggatttgatcacgccagacagctggcctttctctttcagcccggcatctttcagctcaggcacggtagaggcatcttccatccaccccatatcgccgccgttgcgggcagagataatatcggtcgatttttctttcgccagcgtggcgaagtccgctcctttttgcagctcggccagtaccgctttcgcatcggcttcagttttggtctgaatcacgctgtagcggttgcgctgcggctgagtgaactgatccttgtgctggtcgtaccatgactgaatctcgtcgtcagagacgctctcctgcatgctggcggcatccattttgatgtagctgacgcggaactgctccggcgccataaaacgggcctgattctgctgccagaaggcgttgatttcctcatcgctggcggtctgttttgccgccagggcatttacgttgatggtcgcttcgcggaccacccgctgttgagataccagcgccgccagctgatcggactcgcccggcagcatgaagtcggtacccgcaatggcgttaatcagctgctgcgtggtcagctggttacgcagcgcctgggcgtactgatcggtggtcatccccatctgggcgacaataccgctgaaacgctggttgtcgaacttaccgttcgtctggaacgcctgggtctggaagatcgcctgcttcacctgctcatcgctgatgctgaggcccagctcgcgggcatactgatccagaagcgactcatcgatcaggcggttcagcacctgctggcgcatggttttcatgtagttttcgttcgccgccagctcggagaattgatcgccaagctgctgctgcatacggttacgttcgctggcgacggcgttttcaaactgcccacggccaatctcctggccattcacttttgcggcatagtttttgccaccgccaatcaggtaaccactcaccccggtcaaaatgaacgagacgataatgataccgaaaataatcttgagcacgacgctgttggcggccgtgcgtaggttgtccatcatggtgtaacaacgctccgctgtagatgactttagctcgcgcagcatagcacgtgatggccgccgcgcgtgaggacgtattttgacaagaaaacagggtgattgtcagcccacaagtggcgataaacacacataaagtggtctgaaaaggcaataaaaaaggcacatctcacgatgcgcccttgtacttcgtcacattccctgacgggaaagccgatcagttcaccgcgtctttcagcgctttaccagcacggaagcccggcacttttgcggcagcgatagtaatttctttacctgtttgcgggttgcgaccagtacgggcggcacgttctttaacagcaaaggtaccaaaacctaccagcgcaacgtcatccccagcctgcagagattcagtaacagaagcgattaaagcatctaacgcacgtccagctgcagctttagaaatgtccgcacccgcagcaattttgtcaatcagttgagatttattcactgttctcttcctctctttataatttatatcgcacctgagtccttcatagtgcgaccgcgcagcagttatatcaggactgtcatgcccttacaacagcagttgtcgatgacccccctgccagcgatctaagttagctacacaaaaaaaggctggcaagtccgaaatgacttaccagccctatttttattagcgcaatttgcgcagaatcactatttcgcgttcacaacctgcatgccgaacggttcgttctgcagcgcaagtgtcagaacttcctcgattcgtttcaccggatggatatccaaatcggcgataacgttatccggaatttcttcaaggtcgcgtttgttctcatcaggaatcagaacagtcttaatgccgccgcgatgcgccgccagcagtttttccttcagaccgccgatcggcagcacctgaccacgcagagtgatttcaccggtcatcgccacatcagcgcgtaccgggttaccggtcaggcaggagaccagcgccgtgcacatggcaatacccgcgctcggaccatccttaggcgtcgccccttccggcacgtgcacgtgaatgtcacgcttctcgtagaagtcggcgttaatgcccagcttatcagcccgcgaacgtaccaccgtcagcgcagcctgaatcgactcctgcatcacctcgcccagcgagccggtgtaggtcagcttgcctttgcccggcacgcaggcggtttcgatggtcagcagatcgccgcccacttccgtccacgccagaccggtcacctgaccgacgcggttctcactatcggcgcggccatagtcgaagcgctgtacgccgagataatcatgcagattctcaccgttaatttcgatgtgtttcagcgatttatccagcagcagttgcttaacggccttgcggcacagcttggagatttcacgctccaggctacgtacccccgcttcccgcgtgtagtaacgaataatgccgataatggcgctatcgtcgacggtcagctcgcctttcttcagcgcattacgttcgatctgcttcggcagcagatgacgtttggcgatgttcagtttttcatcttcggtatagccggagagacgaatcacttccatacggtccaacagcggcgccggaatgttcatggagttggaagtcgccacgaacatcacgtcgctgagatcgtaatccacttccagataatggtcgttaaaggccacgttctgttccggatccagcacctcaagcaacgcggaagccgggtcgccgcgcatgtcggaagacattttgtcgatctcgtccaacaggaacagcgggtttttgacccccactttcgccattttctggatcagtttgcccggcatcgagccaatgtaggtccgacgatgaccgcggatttccgcttcatcgcgcacgccgccaagcgccatacgaacgtatttccgtccggtcgctttggcgatggattgacccagcgaggttttacctacccccggcggtcccaccagacaaaggattggccccttgattttgttcacccggctctgcaccgcgagatattcaaggatgcgatccttcacgcgctccaggccatagtgatcggtatcgaggatctcctgggcctgacgcaggtcttttttgaccttactgcgcgcattccacggcacctgcaccatccagtcgatgtagccacgcacgacggtcgcttccgcagacatcggcgacatcatcttcagcttctgcagttccgcttcggttttttctttcgcctctttcggcattttcgccgcgtcgatcttacgcttcagcgcttcgttttcgtccggggcgtcgtccatctcgccgagttctttctgaatcgctttcatttgctcgttcagatagtactcgcgctgggatttctccatctgctttttgacgcggttgcgaatgcgcttctcaacctgcagcagatcgatttccgattccatcatcgccatcagatattccagacgttcgttaacgtcggacatctcaagcacagactgcttgtcagccagcttcagcggcatgtgcgccgcgatggtatccgccaggcgcgccggatcgtcgatgctgttcagcgacgtcagcacttccggtgggatcttcttgttcagcttgatatagccttcaaactggctgatagcggtgcgaaccagcacttcctgctcgcgttcgtcaatcgccggcgagtcgagatactccgctttcgccgagaaatgctcgccattatcagacagcgcagaaatgcgagcacgctgcagcccttcgaccagcaccttcacggtgccgtccggcagcttcagcatctgcaaaatagacgccacggttccaacggtgaaaagatcgtttacacccggctcatccgtcgacgcttctttctgcgcaaccagcatgatttttttatcatggtccatggccgcttcgaggcaacggatagatttttcccgccctacgaacaggggtatgaccatgtgcggataaaccaccacatcgcgcaatggcaatacggggatttcaatgcgttcagaacgctcaggattcatagagctctctcttagtttaaagtccgccaggtagccgacgacgccacactccactgcatcgtcgttaatatgtaatccagtatatggggatgtattccacacattcaacggcgggaatgcaggaaaaataaaaggggagataaaatcccccctttttgttaactgcttgagtgaaatggttaattattcaccagatgcctgctgagcttccggtttgccgtagatcagcagcggtttgctctgaccggcgataaccgactcatcaatgaccactttttcgacatcttccatcgaaggcaggtcatacatggtatccagcagcgccgcttccacaattgagcgcaggccacgagcgccggttttacgcgccatcgctttcttggcgatagcgtccagcgcttcgtcgcggaattcgagctctgcgccttcaaggctaaacagcgcctgatactgcttggtcagggcgtttttcggctctttcaggatctggatcagggcttcttcgctcagctcgttcagggtcgccactaccggcagacggccgatgaactccgggatcagaccaaacttgatcagatcttccggctcgacctgagccagcagttccccttcgctcgctttgtcggacttcgcttttaccgtcgcgccaaaaccaatgccggagccggtttccacacggtgggaaatcactttgtccaggccagcgaacgcgccgccgcagataaacaggatcttggaggtatcaacctgcaggaactcctgctgcggatgtttacgcccgccctgcggcggaacggcggcaacggtcccttcgataagcttcagcagcgcctgctgcacgccttcgcctgacacgtcgcgcgtaatcgacgggttatcggatttacgcgaaattttgtcgatttcgtcgatataaacgatgccgcgctgcgctttctgcacgtcgtaatcgcacttctgcagcagtttctgaatgatattttcgacgtcctcacccacataaccggcttcggtcagggtagtggcgtccgccatggtaaatggcacatccagcaggcgcgccagcgtttccgccagcagcgttttaccggaaccggtcggcccgatcagcaggatgttgcttttacccagctctacaccattgctggtatcgccattgcgcagacgcttgtagtggttgtataccgcgaccgccaacaccttcttcgcctgttcctgaccgatgacgtagtcatcaaggtggtggcgaatctcgtgcggcgtcggcagcgcgctgcgctcgcggtgcggcgccacttctttaatctcttcgcgaatgatgtcgttacataaatcaacgcattcgtcgcagatatacacggatggcccggcgatcagcttacgcacttcatgctggcttttgccgcaaaaagagcaatacaacaatttgcccgatccatctttgcgtttatctgtcatgagtccaaacctctttttaagttctttgtgccgcacacgacgacgcaaatgccattctcaggcgcaagccgccatatagcgttgtgccgcccttcattagtatatacacaaaatccttcgcgctacatcgagccggtagcgaagccaccggccgcaagcctgccagacaagcggccgaataaaagccaaccgctcgcacagacgtggcgagaaggatgaagcgtaaagcggcacccttgcgccttgggcatcaattacgatgggtcaaaatagagtcgaccagcccgtactccacggcttccgcagcagacaggaagcggtcacgctcggtgtcacgctcaatctgctcaagagactggccggtatgatgcgccatcagctcattcatgcgtcctttcaccttcaggatttcacgggcgtggatctcaatatccgtcgcctgtccctgatagccgcccagcggctggtggatcatcacgcgggagttcggcaggcagaagcgcttgcctttcgccccggcggtcagcaggaacgcgcccatagaagcggcctgccccatacagatggtgctgacatccggcttgatgaactgcatggtgtcataaatcgacatcccggcggtgattaccccgcccggagagttaatgtacaggtaaatatctttttccgggttttccgcttccagaaacagcatctgcgccacgatcaggtttgccatgtggtcttcgacctggccggtcagaaaaatgacgcgttccttaagcagacgggagtagatatcaaaagaacgttcaccacgtgaggtctgttcaatgaccatcggcaccagggccatatggggtgcaaagttgtctcgttcgccactgtatgacatttccgtctcctggagtaattttaaaatacctgctgcactgattgtaaccttacggacggattatcagccacagtttctatccgctgaatgcgtcaccgcctcttcaatacgcgtgcgattgcggatgcagttgcctcccccggtaatggggatggtgttgccatatttcaagcataacaagcttttgctgtaacgctatcatggttaatgcgttttcgcaccgtgcctgtggctatcattatcttaaaaaaaaacccgccgcctttcggcaacgggtttttgctcgaaccttaaacgatagcggcgaaattacgcctgctggttcatcagttcgttgaaggaagtggctttttcagacactttggctttcgccagcacggcttcaacagcctgctcttccagcgccacgttgcgcatgttgtccatcagctctttgttcttgctgtagaactcaacgacttcagacggatcttcgtacgcagaagccatctcttcgatcagggcttttacgcgctcttcgtcagctttcagctcgttggtgcggatcacttcgcccagcagcagaccaacaacgacgcgacgtttagcctgctcttcgaacagctcgcgcggcagttccagagcctgtttctcgttgccgccgaaacgctgagcagcctgacgacgcagcacgtcgatttcgctgtcgatcagggcagccggaacgtcgatctcgttggctttaaccagaccttcgatagcctgagacttcacgcggttacgcacagcgcctttcagctcgcgttccatatttttacgcacttcagcgcgcaggccagcgacggaaccatcttccacgccgaaacgtttgatgaactcttcggtcagctcaggcagttcacgctcttcgactttcttcagattgataacgaacttagccgctttacctttcaggttttctgcgtggtactcttccgggaaggtcacgtcgatggtgaactcttcacccgctttgtggcctttgataccgtcttcgaagcccgggatcatgcgaccctggcccatcgccagtacgaagtcagaggctttgccgccttcgaactcttcgccgtcaacagaaccggtgaagtcgatggttacgcgatcttcagcgtcaaccgcgccttctttttctttccaggtcgcctgctgcttgcgcagagtttccagcatggtatcaacgtcagcgtcggtgacttcaacaaccggtttttcaacttcgatcgcgtccagaccctgcagttcaacttccggatacacttcgaactctaccgcgtaggtgaagtcttcgcccagtttgtattcgcccggaacgtagttcggcgcgccggccggattgattttttctttgatgatcgcgtcaacgaaatgacggctcatcaggtcgcccagcacgtcctggcgaacggaagcgccatagcgctgagcaacaatattcatcggcactttgcctttacggaagccgtcaatgcgaacttttttcgctacgttgaccagctcgcttttgacagcattctcgatgctgtcagcggcgatagtaatcgttacacggcgcccaaggccctgagtggtttcaactgaaacttgcatcttgttacctcaaaaaaatcacagtgctcggtcaactctggaagcgcgtgtaggtggcttcgcagaaccgggatgccctcttcaaatcagaaacacattccctgtcgtcagaatcatcccgaagacattcatatataagacgcggcattatagcggcatcacttttgtgagtcgagaacggttgtcgcctggtgctgcggcatttttcacatttcccgctcaaatttgcccgcaaaagcgctgactttgcgcattttccaggcaaaacaaaacggcccgtaggccgtttttgctaaatctgcaagcaacatactggaaaagcgccagcggttgcaaatgggatttctaagcgatactccctgcgccgcggcacggcggcgaagcaaataccgtatcctgtaatgcttcccattctttaatcgtgtaggtgtgcagcgccagggcatgcaccgtattcgacagctcctcggttagcgtgccgtagatcatacggtggcgattgaggaaacgctcgccagtgaagcgatcgctcactaacaccactttaaaatgactttcagagcccgcagggacgttgtgacgataactttcatccacgacttcgagatacatcgggtcgaacgctgctctaagttttgcttcgatctgttcacgtatcatcatgaattttctcctccgacaacgctgagatgccgccactccatttaaatgttagccgcttttaccgcttccattaggagaaaacaacaaaaaattagcattgttctgatattttcattcaaaagtatcacgtttactggctctggtcgccagatccgtcggggaacgagccattaaccgtggcgggacgctcagaaaaccgccagcacgatggatttacacgcgttgccacttccccttgccgttggcaatgctatgatggcggtaattttccttataacaacaccatgcgttgagacctgaacatgcttaagaagattcttttcccgttggtcgccatgtttatgctggcaggatgcgccacgccgccgaccaccattgaagtatcgccgaaaatcacgctgccgcagcaggatccaagcctgatgggcgtgaccgtcagtatcaacggcgccgatcagcgtccggaccaggcgctggcgaaagtgacgcgtgataatcagctggtcactctcaccgcctcccgcgatctgcgcttcctgctgcaggaagtgctggagaaacagatgacgtctcgcggctacatgattggcccgaacggcgcggtcgatctgcagatcatcgtcaacaaactctatgctgacgtctctcagggtaacgtgcgctataacatcgccaccaaagccgatatcgccatcatcgccaccgcggcaaacggcacgaaaatgaccaaaaactaccgcgccagctactccgttgaaggcgccttccaggcctcgaacaaaaacatcgctgatgccgtcaacagcgtcctgaccgataccatcgccgatatggcgcaggacaccagcatccacgatttcatcaagcaaaacgcgcgttaatgctatcgcgaacccggcctccgccgggttcgtgctttatgctatgtccagtcattacttacgcatttttcagcagccgaaatcagccattttgctgatccttggcttcgcctccggtctgccgctggctctcacctccggtaccctgcaggcctggatgacggtggaaaatatcgatctgaaaacgatcggttttttctcgctcgtcggccaggcctatgtctttaaattcctctggtccccgctgatggaccgctacacgccgccgtttcttgggcgtcgtcgcggttggctgttgaccacccaggtattactcctgctggcgatcgcggcgatgggctttcttgagccggtcacccaattacgctggatggcggcgctggcggtggtgatcgccttctgctcggcgtcgcaggatattgtgttcgacgcctggaaaaccgacgtgttgccagcagaagagcgtggcgccggcgccgcgatcagcgtgctgggctatcgcctggggatgctggtctccggtggactggccctgtggcttgccgaccgctatctcggctggcaggggatgtactggctgatggcggcgctgctggtgccctgcattatcgccacgctgctagcgcccgaaccgagcgacgttatcccggttcccagatcgctcgagcaggcggtagccgaaccgctgcgcgattttttcggccgcaacaacgcctggctgattctgctgctcatcgtcctttataagcttggcgatgcgtttgccatgagcctgaccaccaccttcctgatccgcggcgtgggatttgacgctggcgaagtgggaatggtgaacaaaaccttaggcctgtttgccaccattctcggcgccctgtacggcggcgtcctgatgcagcggctgacgctgtttcgggcactgctcattttcggtttgctgcagggggtctctaacgccggctactggctgctgtcgattaccgataagcacctctattccatggcgaccgcggtattctttgaaaacctgtgcgggggaatggggacggcggcatttgtcgcgctgctgatgacgctatgtaataagtcgttctccgccacccagttcgcgctgctctcggcgctctctgcggtcggtcgcgtatacgttgggccgattgccggctggtttgtcgaggctcacggctggtcgaccttctatctcttctctgtcgttgcggcggtgccggggattgccctattgctgctgtgccggcaaacgcttgagcatacccaacgtaccgcaagctttatgccgcgtagtgagttcccgcaggcctatgcgctggcgctggggatcctgactctgggctgcctgctgctcgcggtgtggctggcgctgctgatcctcaacgcgctggattatacgtcgttctccttcctgtccggcctgctggaggttgccgcgctcaccgccgtcggcgggattttgttcggcggcctgcttgactatctggcgctgcgtaaaacccgcctgatttaaggatccagcatcattattagccgttgtaattacgaaacgtaattataacggcttattaacgcttttatattgtccgccgcgctatttgttgttttgtgcgtttttgatttctggaaattattgacagttttcgttcgattctttaaataatttaaccgattcagctccgggaattttatttttcgttttcacaatgtcttttatttgataattaaatgttaaacaattgttctaatttatgggtggttatgcccattagccgctaagcactccttttcttatccctttcgttatcaatcccgcgaaaatcaggctttgcaagcgattaagtaacactacgttacatatgtgacaaaccaagcagaagccgctaacacagaactgacagagatccaatcatgtttacagtaatgcaaccttaccgtaaaatgcccatacactttaaacgccaccagatcccgtggaattgaggtcgttcaatgagactcaggaaatacaataaaagtttgggatggatgtcattaatcgcaggtactgtattactcagtggttgtgattctgcactccttgacccaaaaggacagattggactggagcaacgctctttgattctgacggccttcggcctgatgatgattgtcgttattcccgccgtcttgatggcagtaggatttgcctggaagtatcgcgcgagcaataaagatgcgaagtatagcccgaactggtcacactccaacaaagtggaagctgtggtctggacggtacctattctgatcatcctgttcctggccgttctgacctggaaaaccactcacgcactggagccaagcaaaccgcttgtccatgacgagaagccaatcaccatcgaagtcgtatcgatggactggaaatggttctttatctatccggaacagggtattgctaccgttaacgaaatcgccttcccggcgaacgtaccggtacacttcaaagtgacctctaactcggtgatgaactcgttctttattccgcgcttaggtagccagatttatgcaatggccggtatgcagactcagctgcacctcattgctgacgaagctggtacttatgacggtatctccgctagctacagtggcccgggcttctcaggtatgaagttcaaagcgattgccaccccggatcgggcgactttcgatcagtgggttgcaaaagcgaaacagtctccgaactccatggactccatggccgcgttcgagaaagtggctgtgcctagcgaatacaacaaagtggaatatttctctaacgtgaaaccggatctgttcaaagatgttgtgaacaaattcatgtctcacgagagcatgaacatgtctaaacctgaaggcgagcacgctgctcacgacgggatggaaggcatggacatgagccacgcggaaaccgctcactaaggggccgaggaagaaaacgatgttcggaaaacttacactggatgcagtgccctaccacgaacctattatcgtggtaacggtggctgcgattatcattgggggactggcgcttctggcagccatcacttacttcggtaagtggtcctacctatggaacgagtggctgacttctgtcgaccacaaacgtctcggtatcatgtacgttatcgtggcaatcgtcatgctgctgcgtggctttgctgacgccatcatgatgcgtagccagcaggtgctggcttcggccggggaagccggcttcctgccgcctcatcactacgatcagatctttaccgcccacggcgttatcatgatcttcttcgtggcgatgccgtttgttatcggtctgatgaacctggtggttccgcttcagctcggcgcgcgcgacgtagccttcccgttcctcaacaacctgagcttctggttcaccgttgtgggcgtgattctggttaacctgtctctgggcgttggtgagttcgcgcagaccggttggctggcctatccgccgctgtcgggaattgagtacagtcctggcgtaggggttgattactggatttgggcgctgcagctctccggtatcggtactaccctgaccggtattaacttcttcgtgaccattatcaagatgcgcgccccgggcatgaccatgttcaagatgccggtattctcctgggcatctctgtgcgctaacatcctgattatcgcctcgttcccaattctgaccgtcaccatcgcgctgctgaccctggatcgttacctgggcacccatttctttaccaacgatatgggtggcaacatgatgatgtacatcaacctgatttgggcctggggtcacccggaagtgtacatcctggttctgccggtgttcggggtcttctccgaaatcgccgcgaccttctcgcgtaagcgtctgttcggttacacctctctggtatgggcaaccgtctgtattaccgttctgtcgttcatcgtttggctgcaccacttcttcaccatgggtgctggcgcgaacgtaaacgccttcttcggtattactaccatgattatcgcgatcccgaccggggttaagatcttcaactggctgttcaccatgtatcagggtcgcatcgtcttcaactcggcgatgatgtggactatcggctttatcgtgaccttctccgtaggtgggatgaccggcgtgctgctggcggtaccgggcgcggacttcgttctgcacaacagcctgttcctgattgcgcacttccataacgttatcatcggcggcgtagtgttcggttgcttcgcaggtctgacctactggtggccgaaagcctttggctttaccctgaacgaaacctggggcaaacgcgctttctggttctggatcatcggcttcttcgtggcgtttatgccgctgtacgtgctgggcttcatgggtatgacccgtcgtctgagccagcagatcgatccgcagttccacccgatgctggttattgcagcttgcggtgcggcgctgatcgcctgcggtattctgtgccagctgattcagttctacgtgtctattcgcgaccgcgatcagaaccgcgacctgaccggtgacccgtggggtggccgtacgctggagtgggcaacctcttctccaccgccgttctacaacttcgctatcgttcctcaggttcacgaacgtgatgccttctgggaaatgaaagagaaaggtgaagcgtacaaacagcctgctcactatgaagaaattcatatgccgaaaaacagcggcgccggcatcgtgattgccgccttcgctacggtatttggtttcgccatgatctggcatatctggtggatggcgatcgccagcttcatcggcatcgtagcgacctggattattaagagctttgacgaggacgtggattactacgtaccggttgcagaagtcgaaaaactggaaaaacagcatttcgatgagattaacaaagcagggctgaaaaatggcaactgatactcttgcgcatactgcccacgcgcatgaacacgggcaccatgatacaggaccgatgaaggtattcggtttctggatctacctgatgagcgactgcattatcttcgctacgctgtttgctacctatgccgttctggtgaacggcacggccggcggaccgacgggcaaagatattttcgaactgccgttcgttctggttgaaaccgcactgctgctgttcagctccatcacctacggcatggcggctatcgccatgtacaaaaacaacaaaagccaggtggtttcctggctggcgttgacctggttgtttggcgccggattcatcgggatggaaatctatgaattccatcacctgatcatggaaggctttggtccggatcgtagtggcttcctgtccgcgttcttcgcgctggtcggcacccacggtctgcacgtgacctccggtcttatctggatggcggtgctgatgttccaggtttcacgtcgtggcctgaccagcactaaccgcacgcgtatcctgtgcctgagcctgttctggcacttcctggacgtcgtgtggatctgcgtgttctcggttgtctatctgatgggggcgatgtaatgagtcattctaccgatcatagcggcgcttctcacggcagcgtgaagagctacatgacaggatttatcctgtccatcatcctgacggtcattccgttcgccatggtgatgagtggctccgcctcgcatgcggttatccttggcaccattctggtgaccgctgtggtgcagatcgtggtacacctcgtgtacttcctgcatatgaacagcaagtccgatgaaggttggaacctgaccgcatttatcttcaccgtaatcatcattgcgatcgtggttgtcggctccatctggattatgtggaacctgaactacaacatgatgatgcactaagagcggcgagtatgtttaagcaatacctgcaagtaacgaaaccaggcattatttttggcaacctgatctccgtgatcggcggtttcctgctggcctccaaaggccacatcgactatccgctgttcgtctggacgctccttggagtatccctggtggtcgcctcgggttgtgtattcaacaactacatcgaccgggacatcgatcgtaagatggaacggacgaaaaaccgggtgctggtcaaagggctgatctcgccagaagcttcgctggtgtacgccaccttgctgggtattgctggcttcatgctgctgtggttcggcgctaacccgctggcctgctggctgggggtgatggggttcgtggtttatgtcggcgtctacagcctgtacatgaaacgccactccgtctacggcacgctgattggctcactctccggcgctgcgccgccggtgattggctactgcgcggtcaccggtgatttcgacagcggtgcggcgatcctactggctatctttagcctgtggcagatgcctcactcctacgccatcgcgattttccgctttaaggattatcaggcggcgaatattccggtgctgccggtggtgaaaggcatttcggtcgccaaaaaccatattacgctgtacatcgtcgcctttgccgtggcaaccctgatgctctcgctgggcggctacgccgggtataaatacctggtcgtggcggcagcggtcagcgtctggtggctgggcatggcgctgcgtggctataaagtggccgatgataaagtctgggcgcgtaagctgttcgtcttttctatcgtcgccatcaccgcgctgtccgtgatgatgtccgttgactttatggtgccggattcacatagtctgctggcttacgtgagataattacgcactcccgtacgatctaaagccccgtatttacggggctttttctttcctgtttcatcatcgctttctttctcatttcatacttccctcccctcttccgacgctttcccgctatctttcatatcaaaaaatgaggaaaaattgagccagcacacaccgggcatcactcgcgccgcacggtcctgcgatgctacctttcgccggggctcttgcccctttgggaaataatcactacaaggaattgcaatgaaagagttaacactgaacgaaatggagtatatctccggtggctttaatctgttcggcgcagccagcggcttcgccagctttgtcgccaactctggcgtcggcttcacctcttttgttctgacctccggcaccgcatttgcctccttcgtcggcgacagcgcgatggcgtttggttccttcctgaccggacagtcaaactgggaaacctttgtgaccgccggaaaggaaaactggggaagctttgttaacaccgccggcaacagctggaatactttcgtgaataacgcggccagcgactggaacacctttctgaccaaagcgtcggcctaagcgacgtctatcttagggcagcgccactggctgccctgtttaacccaccagcatcgcctgcgcgctgtagagcagatcgaggtgatcgcggcataacgcttccagcgaagtgcgcgattgatgactggtcagactcagcgccccccaccaggtcccttccctgtcggttaacggcaccgccagcaccagcatgccaatctcaaactcctgctcaatggtggcgtatccctggcgccgtacctgggcgattttctccatcagcgacgcaatatcggtcaccgtatagggggtacgttgttcccgggttatgcgctgcaggacggtctcacactctgcttccggcagcgaagccagccacaatcgccccccggcggtacagaaaatgggcacccgctccccaagccgcaccgacgtagagttgaacggcgtatgccgactgcgggcgatatagaccagttcatcttcatccaccacccccaccgaggcgtgctcttcggtccggctggcgatgtattcgacaatcggccgtaccatgcgaggaaactgcgccgaatcgacataggcctggccaagccgcagcgtctttggggtaagccagtaatagcgcccgtcggtttgcagatagcgctcatgcaggagcgtcagcagaaaacgtcgcgcggcgctttgcgtcaggccgctcattttcgccgtctgggcgacggtgagctttgggcaggttttggaaaaaagctgaattagcgccagccctttttgtaaaccgacgatcagatcgcgtggatgaatggtgttttgcatattcgctcacatttttgcaacatcattatcgatttcctgcgattatcgcagcgatggtgcgattaacaaccaacatgtccgaattctgcgttgtcgctcccagcttccactgaaatactttcacaacattcatttaacaaatgaggtttgaaatggtcagtggaactacccaggttgtcgccgtgattggtcatccgatcgcccaggtgaaatcaccggataacttcaaccgctactttgccgaacagcacatggacagcgtcatgatcccggtggatatcgtcccggacgcggtggccgcctacctcaacgccctgcgcggctggcagaacatgaccggcgtgctggtgacggtgccgcataaacaacgcgccgccgcgctggtcgacgacctcacgccgcgcgcccgccgactcaacgccgtcaatgtgatccgcaagctggcggatggccgcctgcagggcgatatgctggacggcgtcggctttcagctcgccgccgaggcgcagggttttcagccggcaggtaagcaggcgctgctctccggttgcggcggcgtcggcagcgccatcgcctggggactgtgcgaggcggggatccgtcggctggccctgcacgatcaaaccccggccacccggcagcgcctgcatgaccttctggctgaggcctttccggcggtgcaactgagcgcgctgccagacaccctttacggcctcgatctactggttaatggctcaccggccggcatggccggatttgatgagctgcctctaccgcaggcgcttctggatacgctcgacagcaccactcatgtggccgacgttgtcaccgccccggtgatgacgccgttgctcactttcgccgccgcccgtggttgcaaagtacagaccgggccggaaatggcgctggcgcagatgaggctgatgggccagtttatcggcgccatcccgcaggctcagggagcggcggcatgaagagctgggatgtgatcgtcatcggcagcggcgcggccggttttgccgccgcggtcaccgcctgctgtaaagggctgtcggtgctgatgctggagaaagccgaccagttcggcggcacctcggccatctccggcggcgccgtgtggctgcacgataccgaccaggcgcgcgccgagggcaaaagcggtagcgccgaggcgatgaaaacctacctgcgaaccattatcggcgagggccagtaccgcgaagatcttgccgaagcgtttgtcagcgccgggcgggaagcgctggcctttctcgagcgtgagggggcagtaaagtacagcctgcgtccgctctcgcccgattactatccggatgaacccggcgcagtcgacgtaggtcgtgcgctggaggtggtggagtatgacggccgtgaactgggggacgcgtttcgcgacctgcgttcaccgccgccggggatgctgctgtttggcgggatgatggtcaaccgcgtcgatattcaacattttctcgacatgcgccgctcgctgcgctccctggcccattgcacccgactgctgctgcgctatgcccgcgaccgggtgaagtaccctcgcggcacccgcctggcgatgggcaatgcgctgattgcccgcatggcgactacggcgctgcgtaaaggcatgagcctgcggctgaatgtcaatgttctgacgctgtgcgaagcgcaaggcgcggtccgcggggtggagattgagtatcaggggcaaaaagagacgctgcacgcccggcgcggggtggtgctggccgcaggcggcttcgccgcgggcgcgctggcggcgcgctatcggccacatacccgcgagcatttcaccatgtcgccgccggccaacgatggcgccgcgctgcatctcgcggcggcgcttaacgctcgcgagggagccgatcgggcctccaactttttctgggcgccggtatcggtgctgacccgggccgacggcagcgaggagcgcttcccccatctggtaaccgatcgcgcaaaaccgggcgtgattgccgtcaatcagcgggcggtacgcttcgtcaacgagtccagttcctatcaccatttcgccagcgcaatgcaggatgcagcggaaaatgccccctgttttttactctgcgacgcccaggcgatgaagcgttatggcctcggactggcgcgcccggcgccggtcaataatgacgccctggtcgccgctggctatctgcacaaagccgataccctggccgcgctggcgcaacagcttggtctggatgcccaaaccctgagcaaaacggtagcccgctacaaccgcgacgccgcgcagggcgtggatcgggaatttgctaaaggcggcaacagctataaccgggcgatgggcgatccgggccatcagcctgacgcctgtaatgcccccctgctcagcgcgccgttctatgccatcaaactttataccggcgatctggggacctcacgcggcctggtcaccaccgccgatgcccaggtcgtcaataccgaaggacaccccatcccggggctgtacgcggtgggaaacgacatggattcgctgatggccggcacctatccgggccccggcatcaccctcggcccggggctgacgtttggctatctcgccgcctgccatctggcacaacactccacccactaatcaggaaaacatcatgatctacgaaaaacgcacgtacaccatcaatccgctgaaaatggccgactggctggcgctgtaccaaagcgatgccctggcggtgcaaaccgaccatctcggccagctaatcggcttcttttttaccgagatcggcgtggtcaatcaggtagtgcacatctgggcttatgaaagcctggacgatcgtctggtgcgccgcgcgcggatggcccaggacgaacgctggcagaccttctcgcgtaaaaatcgcgaactggccgccgtggaacgcctcgagtcggtgctgatgcgccccaccgctttttcacctctgcagtaaggagtccaacatgagcgggcctgtgaaggtggatgtgctggtggtcggctccggcgccgcggggctctctgccgcggtgactgcggcgatgcacggcgccagcgtcatggtggcggagaaagcgtcagtgctcggcggaaccagcgcctggtccggcggctggctgtggatcccccgcaacccgctggcgcgggcggagggcatcgacgaagcagccgacgcgccgctgacctatctgcagcatgagatggggggcgaagccgccgatattcgtctgcaaaccttcctgcgttacgggccggagatggtggaatttttccatcagcggacggcggtgcagtttctctcgggcagcgccatgccggactttcacccgtcgccgggtgcggcgaacggtgggcggtcggtcaccgcgcaaccctacgatggccgcctgctcggcgactggctccatcgcctgcgtccgccactggaaaccattagcctgggcgggatgggcatcgccggcggcgcggatatggcgcattttttcaatgccacccgctcgccgcgctccgcgctgtatgctgcccgccgcctgctgcgccacggctggcagcggctacgcgccggacgggggcagcatctggtcaatggcaatgcgctggtcgcccgtctgctgcgatccgccctcgacgccggcgtgcgttttcagctcaatgccccggtggtccggctgctgcagggtccgccgggcgtgtccggcgcggtgttgcgcagcgacggcggggagattcacgtcgaagctggcgccgtggtgctggcctgcggcggttttccccacgatcgccagcggctggcgcaggtggtgccccacgcggcggagggttacggccatttctccgccgcaccgccggacaatcagggcgaggggatcaggcttggcgaatccgtcggcggccagttcgacacttccctgcgccacccgctggcctgggcgccggtgtcccgcgtcactctggccagcggccagcagctaatgtttcctcatctggtggagcgcgccaaacccggggtgatcgccgtcctgcccaacggcaaacgttttgttaacgaggccgactcttatcatgactttatcgccgccctgctggcggccacacccgcgggcgacacgccgcaggcctggctgctggccgatcgtcgcgcgctgcgtcgctacggcctgggccacgccagaccgttcccgttcactcccaccgcctggctgcgtaccggctatctgcagcgaggaaacaccctggcggagctggcgaagcagtgcgctatcgacgccaatgcgctggcggaaaccgttgaacgctttaaccacttcgccagcgctggcgaagacgtcgattttcaccgcggggcatcagcctataaccgcgcccagggtgaccatcaggtgacgctcggaccgctgcgcgaagggccgttctacgcggtgcgcattctgcccggctcgctgggcaccttcagcggattgcaaaccgacgaacacgcccgggtgctggatgaacagcagcagccgataccgggtctgtacgccatcggcaacgacatgtcgagcgtgatgcgcggctattaccccagcggagggatcaccctcgggcccgccatgaccttcggctatctggtgggtaaaaacctggcaaaaaaaacaaatataaacaataacataacttgatttccacgaatggatgcaccctaactctcttcacctgcaactgtaccggagccctttatgaacaagcgtaccctatcgctcgccgcgctgaccctgctcgatgtccctccccccgaacaggtgcggattgcggccagaaccggttttacccacgttgggctgcgactgctccccgccacaccgaccgacccggactacgacatgctgggcgataccccggccgtccgggcgacgctcgccgcgttgatggaaactggcatccgcgtgtcggacgtggagatcgtccgcctgacccccgggtttaccctcgacgatcggctgcagcgttttatggagaccgccgcgcgtcttggcgccggacaggtgttagtcgccggcaatgatgacaaccttcagcgcagcgctgacaacctcgccatcctcgccgcggccggtcgtccatttgggctgaccatgaatcttgagccgatgccctggactcagttgcgcaacatcgccgcagcgcaagcactaatcgccgccagcgggcgggaagacatcggcattctggtggacgctctccatttctggcgcgcgggagaatcgctcgccgccctctccagcctgcccgcgcatcatctcaactatatgcaactctgcgatggcgcggcgcagaggccggagagcgagcaggaacttatccgccaggcccgctcggcgcgcaacgtgccgggggaaggcggtctggatctgcatggtctgatgtcggccctgccggcgacgctgccggtctctctcgaagtgccgcttgacggcgagcaaggcgccctgccgcctcttcagcgggcgcagttactgtttgatgccgcgcagccctacctgcgcgcctgcgcataaggaatacgctatgacacagactcaacgcctggatgtcagagagttaataaatcgtaacccgctgagccgatttcagaagctgattatatttctcggcttttgcgtcatcgctctcgatggttttgatatcgcgatcatgggctttatcgccccgacgctaaagctggaatggggggtaagcaaccaccagctgggtctggtgatcagcgccgcgctgatcggcctcgcgctgggggcgattttctccggcccgctcgccgactggctgggacgtaagaaaatcatcatcaacagcgttttcttcttcggtttctggaccatcgccaccgccttctcgcacaacgtagaacagatgatgttctttcgctttatgactggcctcgggctgggcgccgcgatgccgaatatcgggacgctggtgtcggaatacgccccggaacgccagcgttcatttattatcaccgtcatcttttgcggcttcaccttcggcgcggcggcgggaggattttcggcatcgtggctgatcccccagtttggctggcactcgctgatggcgctcggcggtattctgccgctgctgtttgcccccctgctcatctggctgctgccggaatcggttcgttttctggtgatcaaacaagcgcccgcggcgcgcatacgcgccattcttaaccgtctctatcccggacaaatcagcgacaacgtgaggtttatcctgccggcgcagccggcggccggcaacgcgatgcgcattgtcctctcccgccagtacggtttcggctcgctgatgctatggctggtctactttatggggctgttcctggtctatatcctcggcagctggctgccaacgctggttaaagcggtaggaatgaccgttagccaggcggccatcatgacggcgatctaccaggcgggcggcaccctcggctcgttgtttgccggctggctgatggacaggatcaacccccatcgcgcgctgggtataatctacgccgttggcggcctgttcaccatggcgatgggctacgccgcgggcagctttgccttgctctgtatgctggcgtttatcagcggcgcctgcctgaacggcgcgaataccggcatgaacgccctctccgcccgctactaccctacacaggcgcgggcgacgggatccagctggatgcacggcgtcgggcgcatcggcgccattctcagcgcctttgccggcgccgagatgatggcgctcaacctgccctttgaaagcgtctttttgatcctcggtatcccggcagccctcaccgtcgcaggcctggcggcgaagggcatctttgcggccggtcatcctcccgtcgcttcaacttcccccgcgtctgtgcgcggagcgtcatagcggcatctggtccccggtgcaatcggcggattgcaccgccttcagcagctaataaagaaaatttatttcatattttgttgaaacgaaaaaacgcccgcaacaatctggacgactccggcaggcgatatcccgccctcaccttttcaaccaagcgcaaaagaaactatcgctaattcgatccccctcgcatatatggataataaattccacaacacaattgaaacagaacaaacatttccttaagttgaagtcagtctatccggatgcgcgttgccgcaggcgtcggcattgagcgcctcagagtgcaaatgatttcaaaaaggagagcaccatgttaaacggcctgaaacccttatcccgttccctgcgctggggcatggtcggcggcgggggaaccagtcagatcggctacagccaccgctgtgcggcgctgcgtgacaatgtttataccctgctggccggcgcgcttgacgtcgatgccgagcgcgggcgcgcgttcggtgagcaactgggcatcgcgccggagcgctgctacgccgactaccagaccctgtttcgcgaagaggcgcagcgccctgacgggatcgaggtcgtctcggtcaccaccccgaacaatacccatttcgccattaccaaagcggcgctggaggcgggactccacgttatctgcgaaaagcccctctgctttaccgccgaagaggcgcgcgagctggtggatctgagcaaaaaacagaacaaaatcgtcggcgtcacctacggctatgccggctatcagatgatccagcaggcgcggcagatgattgccgatggactgctcggcgagatccgcatcgttaacatgcaattcgcccacggcttccataaccaggccgtcgagctgcaggcagaatccacccgctggcgagtaacgccgaagtttgccgggcccagctatgtgcttggggatctggccacccatccgctgtttgtcgccgagaccatggcgccgcagctcaatatcaaacggctgatgtgctcccgtcagagctttgtttcctcccgcgcgccgctggaagataacgcctttgtcctgatggaatatgacaacggcgcggttggatccatgtggaccagcgcggtcaacagcggcgccatgcactcgcaaaaagtgcgcatcgtcggcgaaaaagcaagcatcgaatggtgggatgagcatcctaaccagctcagctatgaggtgcagggcgagccggcgcgcattctggaacgtggaatgccctacctgtcgccgaacgcgctggcggatgaccgcattggcggcggccatccggaagggctgttcgaagcctgggccaacctctatcgccgctatgcgcaggcgattgacgccacggaccgcgacgatcgcgccttcctgcaagacttctggtatccggacgtcgaagccgggctgcacggcgtctattgggtagagcagtgcgtcaaatcggctgacgctggcagccagtgggttgactttactttaccttaattttccccctcgccagtggagtccccctccactggtttattgatttttaccaacttgtcgcatcgcgcaacagccccgtaatatctgttaaacaaacatttatttacgcttcttaccccccgccgctacactaggcgcagtttttatattgaggtggtaatgaacgataacaaaatgacgccaggggaactgcgcgcgacctggggtttggggactgtattctccctgcgcatgcttggcatgtttatggtcctgccggttctgaccacgtatggcatggcgttgcagggtgccagtgaagcgctgattggcctggcgatcggtatctacggcctggcgcaggcggtgttccagatccccttcggactgttatctgaccgtattggccgtaagccattgatcgtcggcggcctgcttatcttcgtgctcggcagcgtcatcgccgcgctcaccgactccatctggggcatcattcttggccgcgccctgcagggctccggcgccatcgccgccgcggttatggccctgctgtccgatctcacccgcgaacagaaccgcaccaaagcgatggcctttatcggcgtcagcttcggcgtcaccttcgccatcgctatggtgctggggccgattgtcacccaccagctgggtctgcacgcgctgttctggatgatcgccatcctggcgaccgtcggcatcctgctcaccctgtgggtggtgcccaacagccataaccatgtccttaaccgcgaatccgggatggtgaagggctgctttagcaaggtgctggcggagccgcgcctgctgaagcttaactttggcatcatgtgcctgcacattatgctgatgtccacttttgtcgccctgcccggacaactggaggccgccggcttcccggccgccgagcactggaagatttacctggtcaccatggttatctcgttcatctcggtggtgccgtttatcatctacgccgaagtgaagcgcaagatgaagcgcgtcttcctgctctgcgtcgccatcctgctgattgcggaaattgtcctctggggcgccggaggctacttctgggagctggtggcgggcgttcagctcttcttcctggcgtttaacctgctggaagcgctgctgccgtcgctaattagcaaggagtctccggcgggctacaaaggcaccgcgatgggcgtctactccaccagccagtttctcggcgtggcgattggcggcgcgcttggcggctgggtcgatggtttctttgattcgcaaaccgtgtttctgctgggcgccctgctggcgatgctgtggctgctggtggccagcaccatgagcgagccgccgtacgtcagcagcctgcgggtggaggtgccggacggcgtggtggtcgacagcgcgctgcaggcgcgtctgctgagcgccagcggggttcatcaggcgctggtggtacccgaggagcgttcggtgtatatcaaaatcgacagcaaggtcaccaaccgcttcgagatagagcagctcatcaaaggggtataaaaaaagcggggaattccccgctttttgctgtctgcccgccgccttagtcgcggaagtttttgaactggaacggctgtcccagatcgccaccgcgcaccagcgccatcaccgactgcagatcgtcgcgggacttaccggtcacgcggatctcttcgccctgaatctgggcctgcactttcagcttgctgtctttgatcagtttaacgatcttcttctgcaccgcgctttcaatgccctgcttcagcttcgcttcaacaaaccaggttttaccgctgtgcacgatatcttccggtacgtcgagggaggtgccttcaatgccgcgcttgagcagcttggcgcgcaggatatccagcagctggttcacctggaagtcagactcgctcagcactttaatggtcttgttggcgtcgtttaattcaaaagtggcttcaacgccacgaaaatcaaaacgcgactcgacttcgcggctcgcgttgtccaccgcgttacgggcttcctgaagatcaacttcagagacaatatcgaaagatggcatcttttcctctccttccgtttcttttgcgttgcataatacctgcaacgcggcataactcaacttgttatcccggaagcttagctgattacgcaacgctcgcgctattttccccgtgatgtccgacgatgcgaaaagcgacgagatagactttagccatcagcgcctgggatagcggcagatgaggaggaacaatgaaagtaaccgtactgggatgcggtgcgctgggacaactatggctgaccgcgttgtacaaacagggacatgaagtccagggctggctgcgcgtaccgcagccattctgtagcgtcaacgtcattgaaaccgatggctcagtgttcaacgaatcgctgacggccaacgaccccgattttctcgccagcagcgagctgctgatcgtcaccttaaaggcctggcaggtgtcgaatgcggtaaagcacctggccgggatcctgccggacaccacgccaattgtgctgattcataacggcatgggcaccgtcgaggagctgcgcggcgtgaaacagccattgctgctggcctccacgacccaggcggcgcggcgcgatgggaatgtcatcatccacgttgcccagggcaccacgcatatcggaccggcaaaaagctacgagggggactacagctatctcgcagaagttctgcagagcgtgctgccggatgtcgcctggcataacaatatccactcggccatctggcgcaagctggcggttaactgcgtgattaaccctctgaccgcgctcaaagggtgtaaaaacggcgatctgcgcgactatacgcaggaagttgcggccatttgtcgcgaggtggcggcggtgatggagcgcgaaggtattcatacctcggcggaaaacctgctattttatgtcgaacaggtaattgaaagtacggcagaaaatatctcttccatgctgcaggacgttcgcgcccagcggcatacagagatcgactacatcaccggttttctgctcaaccgcgcccgcgcccacggcgtcgccgtaccggaaaacgcccgcttatttgaattgatcaagcgtaaggagaatgaatatgagcgcgtcggcactgatttgcctcgcccctggtagcgaagagaccgaagcggtcaccactatcgacctgctggtccgcggcggagtaaaggtgaccaccgccagcgtcgccagcgacggcagcctgaccatcgtctgttcgcgcggcgtcaaactgctagcggatgcgccgctggtcgaggtggccgatggtgatttcgatatcatcgtcctcccgggcggtatcaagggcgcagagtgcttccgcgacagcccgctactagtggaaaccgtccgccagtttcatctctctgggcgcattgtggccgccatctgcgccgccccggcgaccgtgctggtaccccataatctgttcccgatcggcaacatgaccggttttccggcgctgaaggaacatatccccgccgagcagtggcaggataaaagagtggtctgggatccgcgggtgaatctgttaaccagccagggtccggggacttcgattgatttcgccctgaaaatgatcgatctgctggtggggcgcgagaaagcgtatgaggtcgcctcacagctggtgatggccgctggcatctataattactacgaagcctgatagccggtccgcgccgcgggctggcaccccttttcctgaggagtcgcagcatgtcccggagcgcaaccgattctcgcgatcttgttatcagccgcctgctcagcgcgcccgcccaagccctgtggcgcgcgtgggccgacccggcattactccgaacctggtggtgccctaagccctagcaaaccgaggttctggcctttgattttcgcgccggcggggcctttcacaccgtgatgcacgggcctgacggtgaacgcagcgataaccccggctgttttcttgaggttatcccgcaacaaaaaatcgtcatgacctcgatgctgacggcggattatcgccccgccgtttcccccttcgcgatgacggccatcatcacctttgccgatgaacaggtcgggtgtcgctatacggctacggtgctgcatgccgatgatgaaacccgcgagcagcatgagcagatgggatttttcgagggctggaatatcgtcatcgatcagctcaatgacctggcgctgaccctgcgctaatacactcccctgccaatagtaaaaaggccttccatcagggaaggccttttgcatcataacaatctgttacgggcgataaactttcacgttgctgaagccctgctcgcgcaaataaagcgcctgcagacggctcatcaccccgcgctcgcaccacagcagccaggttttgctctgatcgagatcgccaaatttggtgcttagcttgtagaacggcagggaaacaacttcaaccccctcgaccttcagcggcttgtcttcctgctcgtcgatggagcgaatgtcgaggatcgcgtcattggcgccaaagccggtcacggtttccacttccaccaccgtctcttccgtctgctgggcgatctcgcggatatcgatattgctcgcctcttcaaccactttatcaaggatgctgaaatcgaagtgttcttcttccgcttcaatcttcgccttcaccgccttcacggtcggactcttggagatcacgccgcaatattccggcatggtgcgggcgaaatcttccgtgccgatctcacgcgccaggtcgatgatgtgctctttatcgtgcgaaatcagcgggcgcaggatcagagtatcggagacattatcgatcaggcgcaggttagtgagggtctgactggagacctggccgagcgcttcgccggtgaccagcgcctgcacgccatagcgttccgcgacttttgacgcggcgcggaccatcatgcgcttgagcacgacgcccatctggccgtcgtccactttttcaaggatttcgccgactactggctcaaagttaatcgccacaaagcgaacgcggtgtgagctgccgaagcggttccacagataatgcgcaacctggcggacgccaatctcatgggcggcgccgccaaggttaaagaagcagtaatgaacgcggcagccgcggcgcatcagcatgtagctggagacgccggagtcaaagccgccggagatcagcgacagcacatcttcctgggtgccgatcgggaaaccgccgatgccttcatagcggcctttcaccagaagcaggcgatcgttttcaatctcgagattgacagtgacgtccgggtcggtcagcttcacgcgcgccgtttcaatatgctgattcagaccgccgccgacgtagcgttccacttcaattgaggtgaattcatgtttgccgcgacgcttcactcgcacgcagaaggttttgccttccagcgcctcgcgccacagcggcagcgtctgctcgaaaatatcgtgcagcgaggtgaacggcacgtcttcgacttccagaatatggtggatgccggggatacgggtcagcgcatcgcgaatagccgggcgttgattttcatctttcgcgcgaacttcgatatgatcccaatgacggacgacggccagcgtctcatcatagtttttgagaacgttacgaatgttcccggttaagattttaatgaagcgcaaccgcacagattggcttttgatggtgatttccgggaacaatttaatgataaacttcatagcgacaatagttcgttggcaagcccgacggggctataagcaaaagttgtaaagcagcgcacaccggtgcctgcatcctgggcgcggagtatatcaccattgcgcgttatttgcttacacgcgtgacttcgttaccatacccggtattgccgtcgcgacataacaagagtctacattcactatgccaaagaaaaatgaggccccggccagctttgaaactgctctgggcgaactggagcagatcgttaaccgtctggaaagcggcgatttgccgttagaggaagcgctaagcgaatttgagcgcggcgtacagctggcgcgccaggggcaaagtcagctgcagaaggccgaacagcgcgtgcagatcctgctggcggatagtgaagattccccgaccacgccttttacgccggacgctgaataaatggatttcccgcaacaattgcaggcctgtgtggaacaggcaaacgaagcgctgcgccgtttcatcgccccgcagccctttcagaacactccgctggtggaagcgatgcattatggcgcattgttaggcggtaaacgcctgcgtcccttccttgtctacgccaccggcgagatgttcggcgtgtgccgtaccacgctggatgctcctgccgcggcggtcgaatgcattcatgcctactccctgatgcatgatgatttgccggcgatggatgatgacgatctgcgccgcggcctgccgacctgccatattaaatttggcgaagccaacgcaattcttgcgggagatgccctgcaaacgctggcgttctctatactgagtgatgcgccgatggtcgacgttcctgaccgggaccggctggcgatggtttccgaactggcgcaggccagcggcgtggcgggcatgtgcggcggccaggcgctggatctgcaggccgagggacagcaggttgatttacaggcgctggagcgtatccatcgccataaaacgggcgccctgatccgcgccgccgtccggatgggagccctgagcgccggcgaacgcggccgcgctgccctgcccgcgctggatcgctatgcggaaaatatcggtcttgccttccaggtccaggatgacattctcgacgtggtaggggatactgcgacccttggcaaacgtcagggtgccgaccagcaattgggtaaaagcacctatcccgccctcctgggtcttgagcaagcccggaagaaagcgcacgacctgatcgctgatgcccgccggtcgttagatgagctggccgcacaatctctggatacttcggcactggaagcgctcgcgaattacattattcagcgcgataaataaacaaaaaatgagtctctgatgagttttgatattgccaaatacccgaccctggcgctggtagattccacccaggagttgcgcctgttgccaaaagagagcctgccgaagctatgtgatgagctgcggcgctatctactggacagcgtcagccgttccagcggtcactttgcctctggcctcggcacggtggaactgaccgtggcgctgcactacgtgtataacacgccgttcgatcgcctgatctgggacgtcggccatcaggcctacccgcataaaattctgaccggtcgccgggacaaaatcggcaccattcgtcagaaaggcggcctgcatcccttcccgtggcgcggtgaaagcgagtatgacgtgctgagcgtcggtcactcctccacttccatttccgcgggtatcggggtggctatcgccgccgcgaaagaggataagcagcggcgcgcggtgtgcgtcattggcgacggggcgatcaccgccggcatggcgtttgaggcgatgaaccacgccggggatatcaaacccgacctgctggtggtgctgaatgacaatgaaatgtcgatttccgagaacgtcggcgcgctgaacaatcatctggcgcagctgctctccggtaagctctactccaccctgcgcgaagggggcaaaaaggtcttctccggggtgccgccgattaaagagctgcttaagcgtaccgaagagcatatcaaagggatggtggtgccgggcacgctgtttgaagagctgggctttaactacattggcccggtggatggccatgacgtgctcggtctggtcagcacgctgaagaacatgcgcgacctgaaaggcccgcagttcctgcatattatgaccaaaaaaggccgcggctatgagcccgccgagaaagacccgatcaccttccatgcggtgccaaaattcgaccataccagcggcgtactgcccaaaagcagcggcggcctcccttcctactcgaaaatcttcggcgactggctgtgtgaaacggcggccaaagacaacaagctgatggcgatcacgccggcgatgcgcgaaggttcagggatggtggagttttcgaagaaattccccgatcggtactttgacgtcgccattgccgagcagcatgcggtcaccttcgccgccgggctggcgattggcgactacaagccggtggtggcgatctactccaccttcctgcagcgagcctacgatcaggtgatccacgatgtggctatccagaagctgccggtgctgtttgctatcgaccgcgccgggatcgtcggcgcagacggccagacgcatcagggagcgttcgatctctccttcctgcgctgtattccggatatggtggtaatgaccccgagcgatgaaaatgaatgtcgccagatgctgtacaccggctaccactacagcgacggcccctgcgcggtgcgctatccgcgcggtagcggcaccggcgcgacgctcgagccgctggcatcgctgccgatcggcaaaggggtggtgaaacgtcagggcgagaaaatagcgatcctcaactttggcaccctgctgccggaagccgcggcggtagcggacaaactcaacgccaccctggtggatatgcgctttgtgaagccgctggataccgcgctgatcctccagctggccggcgagcacgacgcgctggtgacgctggaagagaacgccatcatgggcggcgccggcagcggcgtgaacgaagtgctgatggcccaccgccgggcggtaccggtgctcaatattggcctgccggattattttattcctcagggcactcaggaagagatccgcgccgacctcggccttgatgccgccggtattgaagccaaaatccgcgactggctggcataattgccccttccgctcctgctatgcttaagggatacccttgatgaatagcaggagcgcactatgcactatatccccctcggtgatactgccttacgtgtttcccgactctgcctcggctgcatgaccttcggcgagccggaccgcggcagacacgcctggacgcttccggaagagagcagccgcccgcttatccagcacgccattgaaggcggcatcaacttcttcgataccgcaaatagctactccgacggcagcagcgaagagatcgttggccgcgccctgcgcgactttgcccgccgcgacgaggtggttgtcgccaccaaggtgtatcaccaggtcggcgatctggcggaaggactttcccgggcgcagatcctgcgctccatcgacgacagcctgcgccgtctcgggatggactatgtcgacctgctgcagatccaccgctgggactataccaccccgattgaagagacgctcgaagcgctggacgaggtggtgaaagccggcaaagcgcgctatatcggcgcctcgtccatgcatgcccgacagtttgcccaggcgctggcgctccagcagcagaacggctgggcgcgcttcgtcaccatgcaggatcactacaacctgatttaccgggaagaagagaatgagatgctgcccctgtgccaacgtaacggcgtagcggtgatcccatggagtccgctggcgcgcggcaggctaacccgcccctggggtgagaccaccgcccggctggtctcagatgagttcggcaaatcgctgtacagcaccagtgaagaaaacgatgcgcagatcgccgggaagctcgcggacgtggcggaagaactcgacgccagccgcgcccaggtcgccctcgcctggctgttaagcaaacccggcgtcgccgcgccgattatcggcccgtcgcgtcaggaacagctcgatgatctgctgcaggcggtggatttgacgctctccccggaacagatcgacaagctggaggcgccgtatcagccgcatccggtggtgggatttaagtgaaaggcgtggtttccccggcagcgtagcgttgccggggagaggcggttaaagcagaccgatgggccagtgatggccaatgacgtacagcacgccagcggagatcacgccggcgacgatgtcgtcgaccataatccccattccgccgtggatattgcgatcaaaccagcgaattggccacggcttccacatatcgaagatacggaaaatcacgaagccggcggccacccactgccagtccatggtcggcagcgccatcagggtgatccacatcccgacgaactcgtcccagacgatgctgccgtggtcatgggtgcccatatctttggccgtgcgatggcacagatagacgccgatacagatgctcatcatcaccaccagcgagtaaagctgccaggggagaaaggtcatcagataccagaacgggatcgccgccagcgagcccatcgtccccggcaccaccgggcttaagccgctgccaaagccagtcgccagcagatgccacggattacgcatactcaggcggctaagcgcctcgtctcgactacgcaaagtgatcgtatccctttaaatcaagcgcaaccggcttaccgtcgcggataaactgcagcccttcgctctccggcgcaatctgtccgatacaggtaaaacgcgcgccaagatggccaagagccacgtccagcgccccgcggttcagctccggtacggtaaagcacagctcgtaatcttccccgccggcgagcgcccagcgcagcgcctgctcagaatcaacctggcgcagcatcgcatcggagtacggcatggcatcgagatcgatacgtgcgccgcagccgctggctttgagaatatggcccagatcggagatcaggccgtcggagagatcgatagccgatgtcgccaggtcacgcagcgcctggccctgcagcacgcgcggcatcggccgcagatgacgggccagcaggtagtcggcgtcagacggttcatccaccgttagacgattctgcagtaccgccagaccggcggcgctgtctcccggagtgccggtaacatagatccagtcccccggcttcgcgccagcgcgtttcatggcgcgtcccggcggcacaaagccgtggatacccagcgtcatggagagcgggccacgggtagtgtcgccgccaatcagttgcatatcgtaatagtccagctggacaaacaggctgtcgctgaaggcttccagccagacttcatccacctccggcaaggtcagcgccagcgtgagccacgccggttccgcgcccatcgccgcgaggtcgctcaggttcaccgccagcgctttataggcgaggtcggcagggtcgatatcgggtaagaagtgattgcccgccaccagggtgtcggtgctgattgccagcgtttttttctcgggaatatgcaggagcgcgcagtcatcgccgatgccggtttcaacatcaaggcgggcgcttttaacgcgatcaaaataacgggcaatcagggagaattcgccgcatgccatacgttatgcctcagcaaaataataaataaggccgggctgcgaggcgaccctcgcaaaacccggcctgcagtttacttcttgtggggacgaattaccggagccgctttgtccagcacgccgttaacgaacttgtggctatcttcagcgccgaaggttttcgccagttcgatagcttcattgatggcaactttatacggtacgtcatcacgtttggacagctcaaacagcgcgatacgcagcaccgctttttcaacctggcccagctcttccagctggcgggacaggtagggcttcatcaggccgtcgaggtacgcgctgttagtcgccactccggacagcagttcgcggaaatacagaacatcaacatcttttacgtcctgttccgccaggaactggtattcgacatcagcgatgtcgttgtgggataactgccaggagtagagcgcctgaacggcacactcacgggcgcggcgacgagcagcaggtttcacggaattccccttacaaaaatcaggccttgatggctttcaatacgttaatcatttccagcgcggtcagcgcagcttctgcacctttgttaccggctttggtgccagcgcgctcaatggcttgttcaatactttcagtggtcagaacaccaaaggctaccgggatttcgctgtcctgagcgacatgcgccaggccattgctggcaccgcctgccacatattcaaagtgggcggtaccgccgcgaatcaccgtccccagcgcgatcaccgcgtcatatttaccggttttcgccagtgcgccagccgccagcggcagctcatacgcgcctggaacccaaacgacggtgatgttttcatcttttacctgaccaatgcgtttcagggcgtcaatcgcgccttccagcaggctgtcattgataaagttgttgaaacgcgcaatggtgatggcgacgcgagcgtccggggtagcaacgttagcttcaataatgttcatactcttccttcgggttcatgtgccccgcaaggggggcggattttatcatattattctgagcgctgcttcctaataatcaggaaagcctcacgcagtggttaaatgcaggcagacatccgggccaacctgacgtatctcattgaatttaaaatggggggcctggctcagctcttcaagccccggcagcgcgcataatccacgcgccgcattgcctaacagtttaggcgcaatatagacgataagctcgtcgaccaggcccgcctgcagcagcgccccggcaagcgtagcccctgcctcaacccagacgctgttgatctgctgtttgccgagcagcatcatcagcagcaccagatcgagatggccgttatgctccggaaccagcagcgtgcgggcactttccggccactgccgttcatcggcgcgcaggcgggcaaacagcgtttcccccgcctgctgcacaatacgatgctcaggcgtgacgcggttctggctgtcgatgacgacgcgcagcggctggcgcaaattctcttcgggataaagcgcctgggtatcggcgctcagctcctgccagcgcacggtcagcgccggatcgtccgccagcacggtggcgctgctggtcaggatggcatggctctgggcgcgcagacgctgcacgtcgcgtcgcgcctgcggggaggtgatccactggctttcgccgctggccatcgccgtgcggccgtccagcgaggcgcccagcttcagctgcacccagggaaaaccggtgcgcatccgcttcagaaagcccttattcagcgcttccgcttcgttcatcatcagcccatggctgacctcaatgccggcctgctgcaggcgatacaaaccgcgccccgccacctgcgggttcggatcctgcatcgcggcgaccacgcggctgacgccggcggcaatcagcgcatcgcagcatggcggcgtacggccatggtggctgcagggctcaagagtgacgtaggcggtggcgccgcgcgccttttcgccagccatgcgcagggcgtgcacttcagcatgcggctcgccggcgcgatagtgaaacccctcgccgacgatctcaccgtctttcacaatgacgcagccgacgttagggttaggatgggtagtaaagcgaccgcgcgcggcaagcttcagcgcacgcgccatgtacatttcgtcctgcatggcttagtcctgtaagcgggcgatctcttcgccgaattctttaatatcttcgaagctgcgatagaccgacgcgaagcgaatataggcgactttatccagctttttcagctgctccatcaccaggttgccgatcattttgctggccacttcgcgctcgccggtgccgcgcagatgagtcttgatatggttgaccgccatttccacgtcgtcggcgctaaccggacgtttctccagcgctttcagcatcccgctgcgcagcttgtcttcgttgaagggttcgcgcacatcgttactcttcaccacccgcggcatcaccagctccgccacttcgaaggtggtaaagcgttcgttacagaccaggcactgccgacggcgacgcacggaagagccttcccccaccagacgagagtcgatcactttggtatccacggcgaaacagaaagggcaatgcatagcgcgtcctgacaggtagttaaactgaagagtagtttaccgcgaagtgaccggactacaaagaaagagcttttgagacaaaggatctatgggagatgaggccggtttggctaccattaagcatcctctgtaaacggaatcctgaccatgacaagacgttacctgaagctcgccatcgcgggctgcctgttcaccctgaccgcctgcgcccagcaaagcgaaatccgccagatgcaccagagcgtgagtacgctgagccaggagatgacccagctcaaccagcaaacgatcaaaatcacccagcaaaacgcgctgaacgccaaatccacccgcggcgtctatctgctgccggaggccaagaccccggcgcggctggagagccagatcggcaccctgcgcatgtcggtgggcagtattaccccggatggcgatgggtcacgcctgaccttacgcattcagggcgaatccaacgatccgctgccggcctttaccgccaccgtcgcttccggacagatcaccggcaccacccatagctatcaggaagtcaatgttcaggatcagctgattagcgcgccggccagcaccctcgcccccagcgatgtcgatatcccgttgcgcctcaatgtaacgccagataaagtcggttttattcgcgtacacgatatccagcccgccgccgcccagtaagccttcagccgggccagccccgcccggctacgtcctgccccgtcgttcttatccacttacaacttttcgcaagagttcattagaaatcgttctgcagcgcgattttcagtagcattttgtcaagaaatgcatagaatcgtgaacgcaatcgattacgcatgttctggttatgtgaaacaacacgtatttttgtgagcaatgattcctataatagacccccacagaaagacgaaatatttagaaacgcttcggcacttcttttaacgccttcaggctcaatttaaacagtggcattactatgaaaaaaacattactggcagcgggtgcggttgtggcgctctccactacttttgccgcgggcgcggcagaaaacgacaaaccgcagtatctgtctgactggtggcaccagagtgttaacgtggtgggcagctaccacacccgttttggaccgcagatccgtaacgatacctacctggaatacgaagcgttcgccaaaaaagactggtttgatttctacggctatattgatgccccggtattcttcggcggcaacagcacggcaaaaggtatctggaacaaaggttccccgctgtttatggagatcgaaccgcgtttctctatcgataagctgaccaataccgacctgagcttcgggccgttcaaagaatggtatttcgccaacaactatatctacgatatgggccgcaacgactcccaggagcagagcacctggtatatgggtctgggtaccgatatcgataccggcctgccaatgagcctgtcgctgaacgtctacgccaagtaccagtggcagaactacggcgcctccaacgaaaacgaatgggacggctatcgcttcaaagtgaaatactttgtgccgctgaccgacctgtggggcggttcgctgagctacatcggcttcaccaacttcgactggggttctgacctcggcgatgacaacttctacgatctgaacgggaagcacgcgcgcaccagcaactctatcgcctccagccacatcctggcgctgaactacgcgcactggcactactctatcgtcgcccgttacttccataacggcggccagtgggctgatgatgcgaagctgaacttcggcgatggtccgttcagcgttcgctcgaccggctggggtggttacttcgtggttggctacaacttctgattgctgatacagcaagacagcgcccgggccgcagctcctgctgcccgggcttttttatttctcccgcacctcgcaccggaccttgcgcagaaaatcgcttaacgagcggtcggcgcactcgctgaatcgacgttcggtccttctgacctccagacaacggtcgaggcgaaaattgcggtaatcattgcgcagttcgcaccaggccaccagcagccagcgctccccccagaaaaacagccccagcggcagcacttcacgccacgtcacctgaccggattcatcctggtagtgaagctgtaatacctgctgattggatacggcctggtggataacgtcaaaatgggttttagcatagcgatgcgcgccaaggtcaggggcaaacaggcgagtctgctccgcctggcgccgacgcgcctccggcaggatcgccagcattttttcctgggcggactccagcgactgcgacagcgcctcaccgccccaggtttttagcagccgaatcgcagcgatcagcgcctcggattctttggtggtcagcatcagcggcggcagatcgtagcccgccagcagccggtagccgctgcccgcttcgccctccaccggtacgccggagagggagagatcgcgaatatcgcgatagacggtacgctccgacacgcccagccgctccgccagcagcgcggcggtagtgagccgcctgccgcgcaggatctgcacaatctgaaataaacggtcggcgcgtcgggtcatgtctcacttcacaaaagttaaggttaagccggctggtgcaggccgacgcggttgccctcgctgtcggtaaacagggcgatggtgccaatatcattcggcagcgtcagcgggccgaagacacaggccccacccgccgaggcaacgcgctccagcgtggcggcaagatgatcagtatgcagataaataatagcgccctgcgccgagggcgcgataccttcaaatttggccagcgcgccgccgggggccggatcctgatgcgggaacaccgccagctcggcgcagtccatggtttcgcgacgcagcgacacttgcatcaccggctcataaaacgcgacggcgcgatccatatcggcgaccggaatttcaaaccagttaatcacgttgttcatacttcctcctgctcgttagtgagttcagaggcagtgtatgggagggctcctgacagcatactgtcagcaggttttgtcgcgggcaaaaaaatcccggccgcaagggccgggatagctttatctcaactgaaccggattacggcagaatagacggctgatccgccccttctttctcaaccttctgctggatcagatgctcgcgcttcatgcccagcttcaacgccagcgcggaggcgacgtagatagaggaagccgtaccgatggaaacaccgatcagcatggtcagcgagaagccttccagaatcgggccgccgaacaggaacagcatcaggatcaccatcaaagtggtaccagaggtgatcaaggtacggtgcagcgtctgggtcaacgacacgttaaagatctcatacggcgtaccgcggcggatcttacggaagttttcacggatacggtccgataccacgatactgtcgttcagcgagtagccgataaccgacatcaacgaggccacgatggtcaggtcgatctcgatatggaacagcgacagcacgcccatggtgatcaccacgtcgtgcgccagggcgataaccaccccggcggccagacgccattcgaagcggaagccgacgtagatcaggatacagaccagcgccgcaatcagcgccagggcgccggtttgcgcgaggtccgcgccgacgctcgggccgacaaactcaatacgcttcactgccgcattctggctggtcgattcgttaatcaccgtcacgaccttgctgcccagctcctggctgccgttggcgtcatgcaccggcggcatacgtaccatgatgtcgcggctgctgccaaagttctgcacctgcggctcttcaaagcccgctttctgcagggaatcgcgcatctggtccagatcgaccggtttctcaagggtaatttcaatcaccgtaccgccggtgaaatcgagcccccagttaaacccgcgaacgccgatgatggcgatcgacacaatcagcagaaaacctgaaatgccgaaggcccagtagtcccagcgcataaagtcccagactttacggccgtggttcaattgttcaacagtatattcctgtgccacaacgcactcctcagatagacagctttttaacgcgcttgccgccgtacagcaggttcacgatggcacgggtgccgacgatagcggtaaacattgaggtcgcgataccgataccggtggtaatcgcaaaccctttaatggcaccggtaccgaccgcgtacaggatgatcactttgataagcgtcgtcacgttggcgtcgaagatcgagctgaacgcgccgcgataaccttcgtcaatcgcctgctgaacggtacgcccgttgctcagctcttctttgatacgctcgttgatcagaacgttagcatcgaccgccaccgccagggttaacacgatacccgcgatgcccggcatggtcagcgtcgcccccgggatcagggacataatgccgacaatcagtatcaggttggcaatcagcgccgaggtcgcaatcaggccgaacttcttatagaagaggatcatgaacaggatagagaccaccagaccggccagacaggcttccagaccctgcttgatgttctgcattcccagggttgggccgatagtccgctcttcgacgatctgaatcggcgcaatcagcgcgccggcacgcagcagcagcgacagctgacgcgcttcgttcggattgctgataccggtgatacggaagctgttacccagacgcgactggatgttggcgatgttaatcacctcttcctctttcgccaggatagcgcgaccgttagcgtctttcttaccgctgtctttatactccacgaacagggtcgccatcggcttgccgatgttgtccttagtgaagttagacatgatgttaccgcccgcgctgtccagcgagatgttaacctgcggctggttgtactcatccatgctggaggtcgagtcggtgatatggtccccggtcaggatcacccgcttgtacagcactaccggctggccttcacgcgtctgcttcacttccgagtcgcccggcacgcggccagaggcggcggcggactggtccacgttagtattgaccagacggaactcgagggtcgcggtcgcgccaaggatttccttcgcacgcgcggtatcctggatacccggcagctcaaccacgatgcggtcagcgccctgacgctgaaccagcggctcggcgacgcccagctggttcacacggttacgcaggatattaatgttctgctgaaccgcgtactcacgggcttctttcaggcgctcatcggtcatcaccgctttcaggctgttgtcaccctgagaggaaataaccagatcgcgatggcgagggctgagataagagatagcctggtcgcgcgccgcgctgtcgcggaagacgatgctcagaccgtagttgtcttctttacgcacggtcgcgtaaggaatgcctttgtcgcgcagctcgctgcgcaggctatcgatgttctgttcctgcagtttgcctaacgcggtgtccatgtcgacttccatcaggaagtgcacgccgccgcgcagatcaagacccagcttcatcggctcggcatagagcgccgccagccagcgtggggttgccggagcaaggttcagcgccacgacgtatttgtcacccagcacgtgaagcagcgcttcgcgcgcgcgcagctgggtatcagtggtgtcgaagcgcgcaagaatagcgccctcttccagtgccacagacttcgcggttattttttcttcttgtaaagttttctggacctggatcagcgtttgctcactggcggcgacgccgcgcgcgccagtgatttgaacagccggatcctcaccatacaggttgggaagcgcatagatcaggccgacgacaatgacgacgaccagcatgacgtacttccacaaaggataacggtttaacacggcagttccctttgggaaaagttagattacagcgccttcatggtgcctttcggcagaacggcagcaacgaagtcacgtttgataaccacttcagtggtatcgttcagcgcgatagcaatgtagccagtttccgctactttggtcacgcgaccgaccagaccgccgttggtcagcacttcatcacctttggcgatggagttcatcaggttcttatgttccttggtgcgcttctgctgtggacgcaggatcatgaagtaaaaaatcagaccgaacaccaccagcatcagaatcagagacatcgtgctgccctgcgccggtgcacccgttgccgctaccgcatcagaaataaaaaagctcattgaaattccctcattattaaaattaatcaacgttcaaaggaggcacggtgcgcccctgacgttggtaaaaatcggtcacgaagctctctaatttaccctcttcgatagccttgcgtaaaccagccattaaacgctgatagtagcgcaggttatgaatggtattgagacgcgcgcccaatatttcgttgcaacggtcgaggtgatgcaagtaagcgcgtgaataattgcgacatgtatagcaatcacactcggcgtccagcggcgcggtatcgcttttgtgcttcgcgttgcggattttcaccacgccgtcggtgacgaacaggtggccgttacgcgcgttgcgcgtcggcatgacgcagtcgaacatatcgataccgcgacgtaccccttccaccagatcttccggcttcccgacgcccatcaggtatcgtggtttatcggccgggatctgcgggcagacgtgctccagaatacggtgcatgtcttccttcggctcaccaaccgccaaaccgccgacagcgtagccatcaaagccaatctctaccagacctttcaccgagatatcgcgtaaatcttcgtaaacgctaccctgaataatgccgaacagcgcatttttattgccaaggctatcgaaacggtcgcggctgcgcttcgcccagcgcagagacatctccattgagcgcttggcgtaatcccagtccgccgggtacggcgtacattcgtcgaagatcatcacgatgtcagagccgagatcgtactgaatctccatcgatttttccggatcgaggaaaatcggatcgccgttgatcggattgcggaagtggacgccctgctcggtgatcttacggatatcgccaaggctgaacacctggaaaccgccggagtcggtcaggatcggtcctttccactgcataaaatcgtgcagatcgccgtgcagcttcatgatctcctgacccgggcgcagccacaggtggaaggtgttgccgagaataatctgcgcgccggtggcttccacctcttccggcgtcatccctttgacggtgccgtaggtgccaacgggcataaaggccggtgtttccaccacgccgcgctcaaacaccaggcgaccgcggcgggcgcgaccgtcggtggtatccagttcaaatttcatgcttgctcctgcgtcagaaaaacagtccgacgttttcatactcgccacggaatgattccgtagctaaaaaatgcgttatggcgtctacaagccggcgtaccggccttttcagggacgctcagaaatagcctgcggattgtacgtgataaacatcgcatccccgtagctaaaaaagcgatatttctgctcaaccgccaccttataggcgttcatggtgtgctgataacccgcaaacgccgacaccagcataatcagtgtggattcagggagatggaagttagtcaccagcgcatcgatcacctggtactgataacccgggtagatgaaaatctgcgtatcgtcgaagaacggcgcgatcagcgcgtctttcgccgcctgcgccgcgctctccagcgaacgtaccgaggtggtgcccaccgcgatcacgcggttgccgcgcgctttcgccgccagcaccgcatcgaccacctcctgcggcacttcggcatattcggagtgcatggtgtgctcttcaatgctgtcgacgcgcaccggctggaaggtgcccgcgcccacatgcagggtgacaaacgccatctcaacgcctttggcgcgcagtttgtccagcagcggttcgtcgaaatgcaaaccggcggtcggggcggctaccgcgcccggcctggtgccatagacggtttgatagagctcgcggtcggcgtcttcgtccgggcggtcaatatagggcggcagcggcatatggccgatcccgttaaggatctccagcaccgggcgctcgtcgttaaactccacttcaaacagcgcgccatgacgcgccagcatcgtggccttaatgctctcgtcatcgcccagcagcagctcggcgcccggcttcggcgcttttgaggcgcgaatatgggccaggatgcgcttatcatccagcatccgctccaccagcacttcaatcttgccgccgctggccttgcggccgaacagacgcgccgggatcacccgggtgttgttaaacaccagcagatcgcctggattaagcttatcgagaatgtcggtgaaggtgccatgcgtcagcgcgcccgtcggcccgtccagggagagcaagcgacagctactgcgctcaggcatcggatagtgggcgatcagagattcgggtagttcaaaagcaaaatcggtaacgcgcatgacggtaactcagactgaataaagaggcgggtagtctagtgccggggcggtctggctgcaacctttacccctccggatgaatgacataatctatattccaaatcattccgaatgccgccatgcggcaaccgaatgccttaccggtggcaaaggtgccgcgcgcggccagacagcatgccattcggccaccgaggcgccgttcagcgcaacatcggtgtttccacctgcccgctcgtatttaaaggatgtcgttttatgaattttctcgcccacctgcacctggcccatctcgccgacagttcgttgcccggcaacctgatggccgacttcgtgcgcggcaacccgcagggcgactatccggcggagatcatcgacggcatctttatgcatcggcggattgacgtgatgactgacaacctggcggaagtcaaagaggcgcgggagtggtttcgcccgcagacccgccgcgtcgcccccatcaccctcgacgtcatgtgggatcatttcctgtcccagcactgggcgcagctctcccctgacctgccgctggacgagttcgtacgctacgccgagcggcagatcgtccccatcctgcccgactcgccgccccgcttcgtcaatctcaatcaatatctgtggtcggagcgctggctggagcgctatcgggaaatggattttattcagcgcgtgctgaacggcatggccagccgccgtccacgtctcgaggcgctacgcgactcctggcaggatctggatacccattacgaccgtctggagacacagttctggcgcttttatccgcagatgatgcgccaggcagaaaacaaacagctgtaatagccacgtcattgataggtaaaagctggctgaacgattgttagcgcctctttgtgttattgccgggcaggctctatacttgcccgcgttgcgttccaaataaccttagtaattacaggagaatcaaatggttctggtcactcgtcaagcgccggattttactgcagccgctgtgctgggtaatggtgagatcgttgagaaattcaatttcaaacagcacaccaacggtaaacctaccgttctgttcttctggccgatggacttcaccttcgtgtgcccgtctgagctgatcgcgttcgacaaacgttacgaagaattccagaaacgcggcgtggaagtggttggcgtttccttcgactccgagttcgtgcacaacgcatggcgtaacaccccggtagaccagggcggtatcggcccggttaaatacgcgatggttgctgacatcaaacgtgaaatccagaaagcttacggtatcgagcatccggacgaaggcgtagcgctgcgcggctctttcctgatcgacgctaacggcgtggtacgccaccaggtggttaacgacctgccgctgggccgtaacatcgacgaaatgctgcgtatggttgacgccctgcagttccacgaagagcacggcgaagtctgcccggcgcagtgggaaaaaggaaaagaaggtatggccgcctctccggaaggcgttgcaaaatacctgaccgaaaacgtctccagcctgtaatcggcacgcgttttaataaaaggctcgctcaggcgggccttttttgttagcggcgtcaaaatttaagaaaatgacccgccgatatttgtgaccagcgatacacttctgccgaaaaaattcgccctacctctcactttttctctggcaaatttcagcgtcaaaatacaaagccttcataacagcctgaaaaacatataaattatttatatcgttttctgccggtactttgccgtcgatgtgatccccatcaatatttaaaaccgcggatgtgatctcatccatcattttcatcaatgtatttggtcatgatttaactcaggaacaggaatacgttcaggagctgaggatggaaattatttttgacccgtcgttaatcgcccttaagcagaatatttcccgtgcggaagaggccatcgaactggcgggttcattacttgccaggcgccagatttgcagcgccgaatatgtcaacgagatgctgacggtatatgaagattttggcgccgccatcgtgatagatgacgggattgccatgccgcatgcccggccggaaaaaggggcattacagaccgggttctcacttgtcaccaccgccacgccaatctccttcggccacgatgagttcgatccggtttccgtggtcatcgcgatcgccggcgccgatgctgacagtcatatcaaaatgatccaactgatagcctcgctgatcgagtcagatattgtgacctttcttcagcaggaaaatgacgttaattcagtcttacatttcattcaaaaacaaatggagtagtcattatgttagttatcagaacggtttgtggtaacggtattggcagctcattgatggctgcgaataatgtgaaaaagatctgtgacgaattaggcatcaaagcggacgtcgcctcggtcgattttgctaacgccgtcggggaaaaagccgacctttacgtcacgatcaaagaactggcaaatcaatttccggcccactgtcatgtcgccatcattcgcagctacgtccataaagcgaagatcgccgaggatattaccgacgcgctgatgaaaattgctgcgactcactcttaatcagcatagagggaacgaccatgcaggctattcttagtttcttaacggaaatattcagtcaacccgcctttttaatggggcttatcgcctttgttggtttagtggcgctgcgctcccctggcaataaactgcttaccggcacattgaagccgattttaggctatttgatgttgagcgctggggcaggcgttatcgttgccaatctcaatccgctgggcggtattatcgaggccggatttaatatccgcggcgttattccgaacaatgaagccattgtctccgtcgcccagaagatgctgggcgtggaaaccatgagtattttactgttaggctttattttcaacctgattatcgcccgctgtaccaagtataaatatatctttctgaccggccatcattcgttctttctcgcctgcctgttctccgccgttctgcaggcggcggagttccagggctggatgttgatcctgatcggtggattcctgttgggctcatggtcggccatctccccggccatcggtcagcgttacaccaggcaggtaaccgaagacggcgggatcgccatgggccatttcggctctctcggctactacctctcggcatggatcgccagccggaccggcaatccggcaaattccttcgccgataccgaaatttcagaaaagtggggctttctgcgcgataccacggtcaccaccggtatcgtgatgtttgttatctactttgtctgcagcgctgtcgccgggtcggcgtacctgagcaccatcaccgaccaaaacatgctgatcttctcggtgctgaccggtctgcagttcgccgttggcgtagccattgtctataacggcgtgcggctgatcctcggcgatctggtgccggcgttccagggcatcagccagaagctgatcccggactccatcccggccgttgactgcgcggtgttcttcacctttagccccaccgcggtggtggtgggattcatcagctcctttgtgggcgggctggtcgggatgctcttgctcggcgggctgggcatggcgctgattattcccggcatggtgccgcacttcttctgcggcggcacgtccggcgtcttcgccgacaaactgggcggtaagcgcggatgtatcatcgcctcctttatcggcgggatcttcctcgccttcctgccggcgatgctgctgccggcgctcggcaacctcgggtttgaaaacagcaccttcgccgatttcgacttcgcggtatggggcatcattatcgggaatgcgttcacccagtttggtcagatcactatctatctgatttgtctggcgctgctcgtcgcgctgctggcgcctttctgcttccgtcacgtccaggtggtgggcaacacgctcagctatgaggagctgacggcgaagcagaaaaatgaataagcgaggtcatttttcccggcgggagggccacgctttccgccgctgacaaataatcaggagtggttatggctattttgtccattggatttgcttgtttcgatcagtttttctttctcaatgaatggccccaggagaataccaaaaacttttgtcatgattttattgaaagcggcggcggtccggcggccaatgcggcctggctgctgggattatggggcgaggaggtttattacattggtcatctgcagcaggacctttacggtcagcgcattatcgatgagtttgccgaggcgggggtggataccagccaggtggttttctccgatgacatgatcaccccgctggcctcggtgctggtcaatcgcttaacgggttcgcggacgattattacccgcaagatgcaaacgccgccttccctgacctacgagcaaaagctcaaactggacgacctcgccgagcgactgattgccagcgaggagccggtcaccattttaattgacggccatgaggcggaaatcagtgaatatttaattaagaaactgcccaacgccagggtcgtgatggacggcgggtcactgcgcgccagcaatattaaactggcggcctggactgactattttgtagtgagcgaacatttcgcccgcgattatatgagctatcgctcgctgagcaccgaagcagaaattaaagcggccctgattgagttgaataaaatttgccgcggtgaagcatttattacccttggcgaaaaaggctgcgcttttttaaaaagcggtatgctgcagatcgtcccgtcctggctgtgcaatgctgttgataccaccggcgccggggatgtatttcacggcgccttcacctatggcgtccattactcatggcatatcgataacattattttatttgccagcctgaccgccgccatttctattgagaaaaaaggggttcgggaatcgatgccggacctggcggtcgtccaccactcgttaaatagctacgagagaaacttaacgcaatattttgaagaataactgcatttaataaatatcaagaggtgaatatgttagtgtcgatgaaggacatgcttcagcatgccctgcgggacggctacgccgtcggtcagttcaacattaataatctggaatgggtcggcgccgtattaagcaccgcccagcagtgccgctcaccggttattttgggggtgtccggcggcacggttaagcatatgctcgggttaaaatgtattcatgacattgtggttaacgccatggagtatttgcatattgatgttccggtggcgctgcatctggatcatggcacctcccgggaggcctgcgaagcggcgatcgccgccggcttcagttccattatgtttgatggctcgcatctgccgttcagggaaaacctggccattactcgccacctggtgacgctggcccacagcaaaggtatctctgtggaggccgaactggggaccatcgccggcagtgaagacggcattgtcaattccgaagtcatctacgccgatccgcaggagtgctacaccctggtgacagaaacccaggtggattgcctcgccgccgcgctgggctccacccatggtctgtataaaggtaaagcccggctgggatttaccgagatgaaagccattgccgagcaggtgaaggttccgctggtgctgcatggcggcaccggtattgccgatgaggatatgcgccgggcgattgcctgcggcaccgccaagattaacgttaataccgaaaatatgtacgcctggtgccaacaggtgaaagcaattttcgccgccgacaccggacacgatgtgaacgatccgcggaaagtcatcgcccagggactgcagccggtacgcgagatgattgcccgccgcatggcgctctttggctcagagcagcgctattgacgccgggcctgcggctgaaaccaccgccccgacgctgccggggcggtggcgtcaggtatcaaaaggcaaagcaggaacagcccagcacgccccagaaggcctgctcgtcagagaccggaatcgacgacttacgcgcaatatcatgctgatggccgtggacgccacagctaccgcagcactggtgcatctgcaccatggcgccgattttagccgtcgccggcggagcggaacggtaatggcctgggaccttcaccaccggcgaccactccggcagcaccggaataggcggcggcgccagcggcgagaagtgaccggcggcgtacaccactttgccgtcaaccaccgtcagcaccgactcaatgcctttgatctcctcttccgcgacgctgaagtagtctttcgacagcaccaccagatcggcaagctgaccggcggccagacggcctttcttgccctgctcgctggagaaccaggcgctgcccgccgtccacagctccagcgcgacatcgcgcggcaggcggttggcgtcgtcatacatcgccatcccgccaacggtgcgcccggagaccagccagtacagcgcggtccacgggttatagctggcgacgcgggtcgcatcggtgcccagccccaccggcacgtccagcgccagcatctttgctaccggcggggtatgtttcaccgcctctttgccgtagcgatcgacaaaatattcgccctggaaggccatccgatgctgcaccgcaataccgccccccagcgccttcacccgctcaatgttacgctcggtaatggtctcggcatgatcgaagaaccagtgcaggccattaaacgggatatcgcggttcaccttctcaaacacgtccagcatccggctgatggactcatcgtaggtggcatgcaggcggaacggccagcgatgctccaccagatggcgtaccacccgctccagctcatcctccatgccttgcggcagatccggccgcggctgcaggaaatcttcaaaatccgccgccgaaaataccagcatctcgccggcgccgttggcgcgatagaagtcagtcccctgccccggcttcagcatgtcggtccagcgttcaaaatcctccagctcctgcttcggccgctgagtaaacaggttgtaggcgatgcgcacggtcatctgatctttcgcgtgcagctgttcgataatttcgtaatcttccggatagttctggaagccgccgccggcgtcgatggcgctggtcagccccagtcgattcagctcgcgcataaattgacgggtggagttcagctgcagatccagcggcagcttcggccccttggccagcgtagcgtaaaggatcatggcgttcggtttagcgatcagcatcccggtcgggttgccgtggctatcgcggacgatctcgccgcccgccggatccggcgtctctttgctataccccacggctttcagcgccgcacggttcaacagcgcgcgatcgtagagatggagcacaaacaccggcgtatcaggcgccgcctcgttcagctcttccagggtcggcatccgccgctcggcgaactgaaattcgctccagccgccgaccacccgcacccactgcggggacggcgtgcgatccgcctgatccttcagcattcgcagggcatccgccagcgaggggacgccctcccagcggagctcaaggttgtagttcaacccaccgcggatcaggtgcaggtgagaatcgttgaggcccgggatcaccgtatgccctttgagatcgacgatttgcgtcccctcggcggcaaagctcatgatccgatcgtgacttccggtggcaacaatttttccgtcggcgatggccacggcttccgccaggggattcgcacgatcgagggtatgaatctgaccgtgggtcagaatcagtgtggcagtttgcgacataacgcactccttgaggaggctgactcagtttttcttcaaccagccagcaaacaggcgggtcacgatgggcatccagaaccagaccaccagcgcaaccacgcaggcatcattgatgaggtgcagcagcaggctccccttaagcgacggcagcagcatgccggtcaccgcaggcaccaggttggtgctggggaaaatcaccagcagggtgatcagaaactgtttccagcgccgcggctggcgtacgttcaccgtcggcggggtaaaccagaaggccggttcagtccgcacctcagtccgatcgccttccgtcagcagtggggcaatctcagccaccagttgccgacgggtttccgactgcgtccaggcgtagaggtgctccagggtatcgaagcggattatgacgctccacagattctgccctgcggcgggccggatcacattcgccccaagatggccgggaaattctgccgcaatgggcataattttaccgagccactcttcgtagcgctggctgtgttgcggatcgagcagatggctgataaccagggtcaccgatttttgctgcgccatgacgagttccttgcttcagggaaatggccggttttctcctgccactctccataaatgatctgacacaacatccttcatgctgcgttgaagcggcaggcgggcacgtccccgtgaacttgaataaattcagtagctggggacggacaaacgcagccaacaacgcagcagcctgaaggatggagtgatttacgctttacgctccggcgcgccatgcaccatggtataagcgtaatccacgcccatcccgtaggcgccgctgtgttcgcgcaccaggtccattaccgcatcgtaggtcgctttgcgcgaccagtcgcgctggtactccagcagcacctgctgccaggtcaccggcaccgcccccgcctgcaccatccggtcaatagaccgctcatgggcgtcgacagaggtgccggcggaggtatccgtcactacatagacctcgtagcccgcctccagcgccatcaacgccgggaaagtcaggcagacttcggtccacagagcggagatcaccagctttttacggccggtcgctttcaccgctgccacaaacgcatcgtcttcccaggagttcatggaggtacgttcaatcggcttgacgtcaggatgcacggccaataattccggccagatatagccgctaaagcttttggtctctacggaggtataaatcaccggcacattaaaaattttgcccgctttcgccagcgccacggtgttatttttcagggtctggcgatcgatattcgccacgccaaaggacatttgcggctgatggtcaataaagataagcgcggaattagtgggatcgagcagttcacgaatagacattaaataccttcttaatcaattagttaaaaagatgacatgatgattaatgcgtcgtgtggatcctgactgataaagcatggtgagtatagccagttatttctaacaagttattaaggattttttatggtttatattttttgccgcgaccaggatttattcacgcctgttttaatcaaatttttacgccaaactgttctgatttattcactggctttgattattgcgcttaggtacaacagagaaaacaaattaatggatagcttcatatgcgcgtaaactttgatgttttgatgatccttgatgcccttgaccgccacggatccttcgccaccgccgcggagtcgctgtataaaacccccgccgctctgagctatatgatccagaaactggagagcgatctgaacatcgtgctgttggatcgttccggccatcgggcaaaatttaccgataccgggcggctgatgctggagaaggggcgacagcttttaagtgccgccagagatctggaaaagcaggcccagcagctgagcgcgggctgggagcgagagctagccatcgcccttgacgcctcatttcccttttcggccctgctgccgctgatcgccgagttttacgcgcaaaacccacagacgcgactgaacttcagccatcacaccctcgccggttcgtgggaagagctgacccatcatggggcggatattatcctcggcgccatcaatgagccgcccacctccgcggagtggtcatggcaaaccctcggcgcgttggataacatcttcgtcgtcgccccccatcacccgctggctcaggcgaaggagccactggccaataaacagctcagccagcatcgggccatcgtgatccgcgacagcgcccgctattgccatccgctcaacagcaatctcctcgacgagcagccgcaaatcggcgtcgatgatttcgccagtaaagtcgaactattgtgcgccgggctgggctgcggctttctgccgcgccatatcgctcgcccgtggctggtaaaaggcagtctggtggagaaaagcgtcgcctgctggcgggaaaaggatattacctatatggcctggcgcagcgggaatgatgggctggctcagcgctggtggcgggaggcgctcctccgcggcgacctgctgagccagctctaccattaacggccggaccagacgttggcggagatggccgggagggtcagcaccccgtcctggaaggcgccggcgccctcctgcagcgtccacccggccacgttcagcagcggggaatcttcgataaccacctcgcaggcttccccgcggttaatcgccaccagcacccgctgctgtttgtagacgcggacaaacaccaccacgttatcctcggcgtaaatcacctgacagccgccgtagcgcagcgcctggtgggccttacgcagtttcgccatccgctgatacagcgccagcagctgggtatcctgcagcgccggatcccacgggaacggtttgcggcagaacggatcgttattgccatccacgcccacctcgtcgccatagtagatgcacggtacccccggccagctgaacagccacaccaccgccagcggcaggcgcgctacgtctttgccaagaagagatttaaaacgcgccgtatcatggctgtcgagctggttgaacatccgcagctgctgctgatgcgacagcccggcgcgataattatccatccacaccatacaggtctgggcgtctattttctgcggatcgtaagagatatcggtattggcgaggaatccccagatcgggaaggtgaagccgcgatagttcatcgccgcgtcttcggcatccgcctgcagccactggcgcgcgtcgccaaaatgttcgccaaagacaaaagcttccggctgcgcttgcttcgctgcctgggtaatgccggcgatatgctgcaggttattccgcgccccgccgccttcgcccagcatatgcaccacgtcaagacgccagccgtccatgctccatggcgccttcagccagtggcgtacgatactgtcttcaccggcatagatctcgttgaccaggctggtcgaccgatagtcgagcttcggcagactggcatagcccagccagttgtgcgcctgcccctcctctgagaaggtaaaccagtcgcgccacggggagtccggatcgtggccagcgccgccgctgccctgctggtgacggtcgaaccagggatgggaatcgccggtatggttgaacacgccgtcgaggatcatgcgcattcccgcccgctgggtgttgtggcgcagccggagcagcgccgcgtcgccgccaaactgcggatcgacgcgccgataatcctcggtatcgtatttatgcacgcggggggcggcgaaaaccgggttcagatacagagcggttacgccgagctgcttcaggtagggaagtttttcgctgatgccgtcgagatccccgccgtagaacgtcgacccgcccgcctcgccggtaagcgggtcgtcccacgccttgcgcacaatctcccgtcccgccgcgtgatggtaatagaccgcatcctggtcggcgtcacgcgcggcgctgcgggcaaagcgatcggggaaaatttgatagaacacctgatcggccacccactgcgggccggcgtccggcaggtcaatggcgaactgctccagtcgggccggcgggaatcgggtgaagccttgtggcgtaaaccagcgctgatggtcggcccacagcagcttaaagctgtagcggcggcgcggctggccgctggcgagagagatttcgccgcgccatgccaccacgcctggctgcggcgcctggcggagccgctgcatcggcagcgacagctcttcgttatcctcttccgcgcgcagcgtgatccgctgcggcagcgactcaccgcttaaccacagagtaataaacagtcggtcctgttgcaccttgataaagggtgcaaccggaaggtgccatgccttcaacatcgtgaatcctcattgtgcagaatgggcacaccttgccatagccgccgggcgcagaactcatcatctcagaactttttgggggaggataacgggggaggacgcgggaccgcaagccgccccggccgcgcgatgctgaccggggcgatgtcgattactgagcctgcgccaggcggcgctcacggcgggtcttaaagacccagccgagcagcaacagcgcaatccacgccataccgacgtacagcgagatgcgggtgtccggatgatagccgataagggcgataataaaggccaggaacagcaggccgatcaccgtggtcaccaccccgccagggactttgaatttcagcgccttaacctcttcgggcgacagacggcggcggaaggctatctgtgacagcaggatcataatccacacccacaccgtggcgaaggtggccagggaggcgatcaccaggaaaacgttctccggcatgatgtaatttaggtataccgcaaacagcagcgcaatggtcatcaccatcaccgtcacccacggaataccgcgacgcgacgttttagcgaacaccttcggcgcgctgccctgctcagccatgccgtgcagcatacggcccacgccgaacacgtcggagttaatcgccgacagcgaagccgtcaggaccacgaagttaagaatactggccgcgaaggtaatgcccagatgctggaaggtcaggacgaaggggctgccgtcggttcccacctgattccacgggtagatggacataatgacgaacagcgtgccgacgtagaacaccagaatgcgcatcggcaccgagttgatggcgcgcggaatggatttctccgggtccttcgcctcaccggcggtaatgccgatgatttcgatgccgccgtaagcgaacatcaccatctgcagcgacatcaccattcccagccagccgttgctgaagaagccgccgttgctccacaggttatgaatccccgtcggctggccgccgttgccgatcccccagataatgatgccgaacccggcgaggatcatgatgataatggtggccactttgaagaacgagaaccagaactccagctcgccaaacaccttgacgctcatcaggttgacggcgcagatgatcagcaccacgctgagcacccagatccagtgcggcaccgtcgggaaccagacgcccatgtagatgccgaaggcggtaacgtcggcgatggcgacgatcaggatttcaaagcagtaggtccagccggtgatatagcccgccagtccgccgaggttttcctgggcatagcgggagaatgagctggcggcagggttatgcaccgacatctcaccgagcgcccgcataatgatatatgccgcgacgccgccgataatgtaggccaacagtacgctgggtccggccattttaatggcgtcggccgagccgtaaaaaagcccggtgccgatggcggaacccagagccataaagcgaatgtgccgggtgcttagcccgcgcttaagcttgttactactttccatcgtggtttttcaatgccgtttaacacaaaaaataaaaaaccacggaacccgaagtcccgtggttaaacgcttgtcctcaccgccggttaatgcgcgctggaagtcacctgacgtccggctgcgcgatcccagatcaccgcgagaatggtcatcacggcggtgggcatcagccaggccaggccctgctccgccagaggcagacgcgcggtccagtccggcagaatcgcggcaaatgccgatgacttaatcccgtcaatgataccaaacatcaggctgataaacatggccggcgcgataacgcgggacgaattatgccaccaactgcgggtaaagcttaatacaaccagtgcgatacacggcggatagatagcggtcagcaccggaatcgatacctggatcagatggctaaggcccaaattggagaccgccatggagaacaggccgagaacaaagaccagcgtgcgataggagaacggcagatactgggcaaagaactcagcgcaggcgcaggtcaggcccaccgccgtcaccaggcaagcgatgaagatcagcgccgccagcaggaaactgcccgccccgccgaaggtgtgctgcacgtaggcatggaggatcgccgcgccgttggcggactgatccacgagagtagcgctgtcagagcccagacggaacagcgccagatacagcagggtcaggccgacgcccgccatcaggccagcccagacggtatagcgggtcaacagacgcgcttcgctgacgccgcgtgagcgagcggcattaacaatcacgatgccgaacaccatcgcgccgagggtatccatggtcaggtagccgttgacgaagccattggagaatggcgccgtacgatacgcttccagcgcgtcgctgatcgggcccgctggccagatgatggcggcgaccgccagcacaatcagggcgataattttcagcggcgcaaggaaattgcccacggtgtccagcagtttgcccggatagagggagaccagaatcaccagcgcgaagtaaataacgctgtagatcagcagcggcagcgggccgtcgccggtcagcggcgcaataccgacctcaaaggagacggtcgcggtacgcggcgtcgcgaacagcggtcctaccgcgagatagcacaccaccgccagcaggataccggccactttaccaatcggggtgctcaggctttcaacgccgccgccgactttcgccagcgccaccaccgtcagcaccggcagacccaccgcagtgatcaggaagccgatcgccgccgtccagacgtgctcgcccgcctgtaagccaaccatcggagggaaaataatgttgcctgcgccaacgaacaacgcgaaggtcataaagcccaacgctatgatgtcgcgagattttaactgatgggtcataaattcattactgcctgtggatgtggtgttgtaaaaaaaatggaaaaataccgcgctcccctctcagggacgatacagcggccattgccggtaaactcagcgagatatgctcccgaagcggcgtgggaaagaattgtttttggtattaccacgcaaaagcagtctgtcatcgactgcgcaggcgcaatttaaacgcttataacgttttaaagcaaggcacgatcgcaaaagcagatgattatgctggttatgtctttcacaccagaatcatttaccatattgatagaaaacccgtggcttatcatgcgaacaaaaaagcagcgcacgctcattaaataggcgagaaaaaacgactgccaatgaaaatgaccagctgaagctggtcattggcaagataaactgacagcgcgtcgatcaggcgtcatttttggcaattaatcgttccgggagcaggaagctaaagcgggttcccttgcccaccgtgctgtcgatttccagccggctgtcatgatggttaaccgcgtgtttgacgatcgccagtcccaggccactgccccccgtttgccgggaacgggctttatccacccgataaaaacgctcggtcagacggggaatatgctccggcgcaatgcctggcccgttatcctcgacgctgaacagcgctccctgcggggttcgctgccagctgacgcgaatttcggtccccggcggggtgtggttcaccgcgttatagaccaggttggagatggcgctgcgcagctgctcctcattacccagcaccttgagctgctcatcgacggtgaagatcagcgtctgtttctcctggctgagagtttgcgcctcgcgctccaccacccgcagcatcatcggcacgtcgatgcgatcattcatcgccagcgccggcgcggcttcaatacgcgacagcgtcagcagctgcttcaccagaccttccatacgttgagtttgctcccgcatggtgtgcagggctttttctcgggtcgccccctccagcacctgctcctgcatcatctccagatagccctgcagcaccgtcagtggggtgcgcaactcatggctgacgttggcgaaaaagttccgccgcgccccttccagctgatgcatctgcgtcacgtcgcgcgccaccatcagccactgcttgtcgctgtagggcatcacgcgaatttccagatgacgggcgttattcagcaccagattgagcggctttgaaaaatcgcgctgtttcagatagttggcgaactcaggatagcgcagaaggttaagaatgttttggccactgtcgtccggccagcgcaggtttagaatctgctgcgccaggccattacaccagaaaatagccccctcttccgtggtcaggacgaccgcatccggcagcgattccgccccgctgcgaaagcgtttaatcaggcttcccagctcgcgccgacgctttttattacgcatctgcatctggtgcagaccatacagcagcggctcccaactgccgcggccaggcggaggagtcatgctccggtccacccacagccaccacgacaggcgcatcaaattccagaaatgccagatcagcaaaccggtcactgccgccagtaaaaaccacggcagatgacccacaaacgcccccagaatcagggccggaatacacgctaaaaagagctccagcgccagccttttccatgacagccgttccagcacgggtcacactcctgtcaaaattcagaaacgggcggagaaacgataccccgtgccgcgaaccgtttgcaccatacgatcatggccactgtgttccagcgctttgcgcaggcggcgaatatggacgtccaccgtgcggtcttccacataaacgttggtcccccagacgtggttcagcagctgttcacggctgtacacccgctccggatgggtcataaagaagtgcaataatttaaattccgtcggtcccatatccagcggactgtcgccggtcattacccggtgcgatgaagggtcgaggctcagcccctgcatttcgatcacctcttccaccgccatcggtgaaatacggcgcatcaccgctttgattcgcgccaccagctctttcggagagaaaggcttggtgatgtagtcatccgcgccggtctccaggccgcgaacgcgatcctcttcttctccacgcgcggtcagcatcactaccggaatatcccgcgtcatcgcctcgcgcttgagcagtttaataaactgcagccccgaaccgcccggcagcatccagtccaggagaatcaaatcaggccagggttcattgagttgattcaccgcgctgtcataatcttccgcttcgacaggctgaaagccattttgctccagaacaaagcagaccatttcgcggattggagcttcatcttcaacgaccagaattcttctcgccattatttaccctgtgttttttagccatcagtatagaagtgcggcgtcattatgcgtcacttttgtgacagatttatgaaaaaaatgaccgtctgatgatcgggtattttgaagcacgacgcggacttacccctcactaacaagtggtatactgccgcccatgcttttttcgctagggaagatttatgcgcctccttcacacctccgactggcacctgggccagaatttttacagcaaaagccgcgcggccgaacacgacgcttttcttacctggctactggaccgcgcgcaggagcatgaagtcgacgccattatcgtggctggcgatatttttgataccggctcgccgccgagctacgcccgcgaactgtataaccgtttcgtcgtccagttgcagcagaccggctgtcgcctggtggtgctggcgggcaaccacgactcggtggcgatgctcaatgaatcccgcgatatcctcgccttcttacacaccaccgtggtggcgaacgccggctacgcgccgattgagctgccgctgcgcgacggcacgccgggcgccatcttctgtccggtgccgtttttacgcccgcgcgagctggtgaccagccaggccggtcactccggtcgggaaaaacagcagctgctgctgcacgccatcagcgactattatcaggagcagtatcagcaggcctgcgcgctgcgcggcgatcggccgctgcccatcattgccagcggccatctgaccaccgtcggcgccagcaaaagcgatgccgtccgcgacatttacatcggcacactggatgcctttccggcgcaacacttcccccctgccgactacattgcgctgggccatattcaccgggcgcagatggtcggcggctgcgagcatatccgctacagcggctcgccgctgccgctgagcttcgatgaaaccggcaaagcgaaatcggtgcatctggtgagctttagcgaggggcgacttagcgccgtggaaaccctggaggtgcccgtgacccagcctctggcggtaatcaaaggcgatctggccgccatcaccgcccagctggagcagtggcgcggcgtcgagcaggacccgccggtgtggctggatatcgaaatcaccaccgaggactatctgcacgatattcagcggcatattcaggcgctgacggaggatctgccggtggaagtgctgctggtgcgccgcagccgcgagcagcgcgagaaaatactgctcaacgcccagcgggagacgctcagtgaactgaaggtggaggaggtattcgagcgccggctggcgctgaccgaaattgacgatatgaagcgcgcccggctgcatgagctgttcgcccatacggtgcatacgctcaccgcggagaacgaaaacgcatgaaaatcctcagtctgcgtctgaaaaacctcaactccctgaaaggggaatggaagatagactttaccgccgagccgttcgccagcaatggcctgttcgccattaccggcgccaccggggccgggaaaaccacgctgctcgatgccatttgcctggcgctctatcatgagacgccgcgcctgaacaaggtctcccagtcgcaaaacgacctgatgacccgcgataccgccgagtgtctggcggaagtcgaatttgaagtaaaaggcatcgcctaccgcgctttctggagccagaaccgggcccgtaaccagccggatggcaatctgcaggcgccccgcgtcgagctggcgcgctgcgctgacggcaaaatcctcgccgataaagtctcggacaagctggagcaaaccgcgacgcttaccggcctcgactatggccgcttcacccgctcgatgctgctttcccaggggcaatttgccgccttcctgaacgcgaagccgagcgatcgcgcggagctgctggaggagctgaccggcacggaaatctacggccagatttctgccatggtctacgaacagcacaaagccgctcgccatgcgctggagaagttcgaagcccaggcggcgggcatcgtcctgttgacggaggcccagcagcaggcgctgcaggaacgtttgcaggtacttactgacgaagaaaaagccctgctggcccagcagcagagccagcagcagcagctccagtggctgacccgccgcgacgagctggcgcagcagcagcagcaggccgccacccggcagcagcaggcccgccaggcgctggcggacgccgccccggcgctggcgaagcttgagctggcccagcccgccgcccaactgcgtcccctgtgggagcgccagcaggagcagacggcaggcctggcgcaaacccggcagcggatcagtgaagtaaatgctcgcttacttgccagcacggtgctgcgcgcgcgcatccgccagggcgccttgcgtgctcagcagcagcgtcaggctgaactggccgatctggcgcagtggctggccgcccatgagcgtttccgcttatggggtcaggagatcgccggctggcgagcgcaattctcgcaactgacgcgggataaacaacagctaacggctcagagcacccgcctggccgcgctacgccagaagctggccacgctgccagccagccctctcaccctgagcgcggatgacgttgccgcagcgatagaacagcaaacccaatcgcggccgctgcgccagcgcctgatctccctgcatgagcagcaccagctgctgcgcaagcgtctgcgccagaacgccgagagcgtccagcaggcgcaggcggagcaggtaaaacttaacgctaccctgacgctgcgccgggaacaatataaagacaaaaaccagcactatctcgacctgaaggcgctctgccagcgggaagaaacgattaaagacctggaaagctaccgcgaccggctcgaggcgggaaagccctgtccgctgtgcggcgcctgtgaacacccggcgattgaacaatacgcctcgttgacgctcacggataatcagcgccgccgcgatgcgctggaaaaggaggtcgccgcgctgaaagaagaaggcctgctgatcctcgggcaggtcaaggccctgacgcaacagctccagcgtgacaccgaagcggccgggcggctcgcagaggaagagcaagcgcttactaaagcgtggcaggagacctgcgcctctctgcacatcacgcgggatattgcgcaagagataaacgactggatgcaggagcaggagcgctacgagcagcagctctatcagctcagccagcgcctgatgttgcagaatcagcttaacgatcagcaggcgctggagcgccatgccgagcagcagctggcggccacgcgccagggactggagagcgccctgcaggccctggccctgagcctgccggcagaagggacagaagccgcctggctgcacgctcgcgaaagcgaatttgcccagtggcaggcgcaacagacccaacatgatgccattcagcagcaaatcgctgctctgcggccactgctggagacgctgccgaccagcgacgagacagaggttgaagctgagtcggccatcccggacaactggcgcgaaatccacgaggaatgcctgtcgctgcacagccagcttgtcgcccagcagcagcaggaaacccaggaaaaggcgcgtctggaccagtcgcaggcgcaattcacctccgccctggccgccagccgctttagcgatcgggaggcgttcctcgccgccctgctggatgacgagaccgcccagcggctgacgcagctaaaacagacgctggagcagcagcttcagcaggcggccgcgctctgcgagcaggcgacccggcaacatgaggcgcacctggcgctgcgtccgcaaggggtggacgctgacgtccccacactgcaaacccagctgcacgccctggcccagcggctgcgggataacactacccgccagggtgagatccgccagcagctcaggcaggacgcagagagccgtcaacagcagcaggcgctggggcagcagattgcagaggcggcgcagctggcggacgactggggctatctcaattcgctgatcggctccagcaccggcgaccggttccgcaaattcgcccaggggctgacgctggataatctggtctggctggcaaaccagcagctcaaccgcctgcatggccgctatctgctacagcgcaaggccagcgaggcgctggagctggaggttgtcgatacctggcaggccgacgccgtgcgcgacacccgcaccctctccggcggcgaaagtttcctcgtcagcctggcgctggccctggcgctgtcagacctggtgagccataagacgcggattgactccctgtttcttgatgaaggcttcggcaccctcgacagcgaaacgctggacacggcgctggacgccctggatgcccttaacgctagcggtaagattatcggggtgatcagccacgtggaggcgatgaaagaccgcattccggtgcagatcaaagtgaagaagattaacggcctgggctatagccggctggacaaagcgtttgcggtggagtgaggtctgaattatggcgatgtcccctcaccctaaccctctcccgagggagagggttagggggcggggaagcggttcaggtcccctggagcggccacagccaggccgcgccgcgtaccccgctggagtcgccgtgcatcgctttgcggatcggcgtttcacactcgccgccgaagacccactgcttcaccaggtccggcaccgtctgatacagtcgttcgacgttgctcatcccgccgcccagcacgataacgtccgggtcgaggatattcaccacgtgggccagcgatttcgccagccgctgttcatagcggctcagcgccagttcagccttttcgtcaccttctcccaccaggcgcataatctcgctgccggttaacccttggccgctcagccgctgatagtcggtggcgaaaccggtgccggagataaaggtttcgatacacccctgtttgccgcagtagcaagggacttccgcacggtagcgcagctcatcgtcgttcatccacggcaatgggttatgtccccattcgccagcgttaccattgccgccgatatgcgcccgcccgttgagcgccaccccggcgccgcagccggtgccgataatcaccgcgaataccgtttgcgcccccgccgccgcgccgtccaccgcttccgacaccgccagacagttggcatcgttagccagccggacttcccgctcaaggcgcaggctgaggtccttatcaaagggctggccgttgagccaggtcgagttggcgtttttcaccaccccggtataaggcgaaattgagccaggaatgcccatccccacggtaccctgctgtccggtcgcctgctcggccatcgccaccagagtggcgatggtctcgatggtttgccggtagtcctcccgcggcgtgggtaaccggtggcgaaacagctgctctccctgatcgctcagggctatcacttcggtttttgttccacctaaatcaataccaatacgcacgctcagctcctcaccccgattaacaatgcaagcatagcgacaattcgctatcatgcccgcctgatttaacgacaaagccgtggaaattatcatgctgtggttcaaaaatttaatggtttaccgtctcagccgcgatatcgaattgcgcgccgaggagatggaaaaacagctggccgagctgacatttaccccttgtggcagccaggatatggcgaaaaccggttgggtgtcgccgatgggatcgcacagcgacgcgctgacgcatacggcaaacggccagatcattatctgcgcgcgtaaagaagagaagatcctgccgtcgccggtgattaagcaggcgctggaggcaaagatccagaagctggaagccgatcaggggcgcaagctgaagaagaccgagaaagattccctgaaagatgaagtgctgcactcgctactgccgcgcgccttcagccgcttcagccagacaatgatgtggatcgacaccgtcaacggcctgatcatggtcgactgcgccagcgcgaagaaagcggaagatactctggccctgttgcgtaaaaccctcggctcgctgccggtggtgccgctgaccctggagaatccgattgagctaacgctgaccgagtgggtccgctccggcaccgtggcgcagggcttccagctgctggacgaagccgagctgaaagcgatgctggaagatggcggcgtgatccgcgccaagaagcaggatctggttagcgacgaaatcgctgtacacattgaggccgggaaggtcgtcaccaagctggcgctggactggcagcagcgtattcagtttgtgatctgcgacgacgcgtcaattaagcgcctcaagttctgcgatgaactgcgcgaccaaaacgaagatatcgatcgggaagatttcgcccagcgctttgacgccgactttatcttaatgaccggcgagctggctgccctgatccaaagcctggtggaagggctcggcggcgaagcgcagcgctaagcgccgctttccttcctgccgggcaggaaggaaaaaacaacccggcggcaggcgccgggcgtcacgctggcttacagatagcggcacagataagaggttggctcagccacctgcagatgaaattcgctgttgcctggcacattgaaaacttcgccggcagcgtaaactttccactcagtctcacccggcagcaggacattcagcgccccgctgactaccgtcatctcttccggctgcgccgtaccaaaggtgtattccccttccgccatcacgccaacgctggcgcgaccggtactgctgctggtgaagccaatggatttcacttttccgtcaaagtattcattgctttgaagcataaacaagcccttctgatcgtcggttaaaggctcaatatagggggcgctccttgcccctgtcacgtgaaattaacacattagaccaatagttctgccgccagtcgggaaaccagcacattcgacagcaaaaccggaacatcgagggctttttgtaacacatcgcgatgatgctgatagtaaccgagacagtcgaggaccagcacgtcggcgccctgctccagcagcgttttgccggcggttaatagctcgctgtcgctgccggtaaacggattggccagcgcgtagtatggcgacttttccagcgagagccacttttgccgctgcatgggcatgatctcttccaccggcacgatcacccctacctggtgcccatcgacgatcgatgccaccagcggcgggatgatccgctgcggctcgaggaggatcgcgtggtgggtggtaaaaccggtcagctgttcggaactgagcagcaggatcacatcataatgttgtcgatccagcatcgcgatcgcgctgcggacatcgcgttcaattttctgtcgcgacaccatcaccaactggttattactgagcaaggtcaggagtcctttctcgccgtcacctacggcgtactcggccattacctcgtcaggcgtcatctcgcccagcaggctgatgtgggcgatctgttcttccctgatatgttcggtcaggagcggcaatactcccgccagcggcacaacgccgatggtcaaaattgccatcgttgcactactcatatcatgtaccttttcacaaccactgcttcaacacaggctttccacacacagcatccgcccccctggtgagtaaaaatcaaccgtcgagaagcgtagcagctccacgccgcggttgaatgtaaagattgccgggcggcggcgccgtgcctgaaaaatccgtgtgttagatattcattagtacgactgataaataaaaaatgtgagatacgcccgatattgccagcatggcgggcaattcgggctcagggggttacgacttgtcaggatcttcataacgccgtttggcatccacggcttcctgctcggtaggatgttcgctgataagcgaatcaggctcaggataatccgcacggagctgataccaggtcaccgtctgaccctgaggacctttctctaccgcaaccacgcgcgcttctctcggatatgggggcctgtttggcatagttcttccttcttctggtagcagaactattaagtataggcgcccctcgccgccttaatgtaagtaaattcttaacttaccggggttgccgtcgcgctgcacagcatggacataatctgctccaccacccgatccggcgaggccgtggcatccacaatatggtgggcagcgtcccggtataacgcttcgcgctgcgccagcacctcgcccacttcctcgcgcaccggttttccggtcagcgtcggccgctgttcggctttcgggtaggcttccagacggtcaatcagcgccgacaccgaggcctgcagataaatcaccacgccattctcccgcataaactgacggttaccttccgccagcacaataccgccgccggtggcgattaccgtattcggcagggtcacggccttcagcgacagggtctccagttcgcgaaaacgcgcccacccttccgcctgcacgatctcagccaccgtccgctgctcatgggcctgtagccgatgatcggtatcggagaactgaaaatgccgcgctcgcgccagcgcatggccgacggtggttttaccgcagccgcgtggcccaataagaaagataggctgtgtcataaccgaagaccccctggttccgtctgtcgcaaaaaaatgaaaacgaaagcacgtattatcgctgtctgtcccgcaatgcatacgtaaagaaaaaattacacaacttctttacaccccattaccacggtgagaagaggggctattaatgtaaacttatcattgcatttagtgtttaaccagctttactttccgcttggcgttattttttatccaccgctggcgtaaacggtaacacatttatgcatagctttacgaagcaacatatttacaacatcatgtttcagaagcaccctgatgcctattcgacagtgtgacagaggaatgtaacatgcaatctgaagaacaacgccttattgatggactgttttcccggctgaaagaggctgaggcgcacagcgcatcgcgcgatgccagcgccgaggagcggattgcccaacacgtgagcgcgcagccggcggccccctactatatggcgcaaaccattcttatccaggaagccgcgattaaacagcttaacgatcgcatccaggcgctggagagtcaggtcagccaactgcaggcggcaaagcccagcagcggcggcttcctctccggcctgtttggcggtggcggctcgtcacgcggttctgaccctatcccgggcgcggagcaatatggtcgcccgcaggccagcgctcagccgcagtatacgccaccaccgcagcagaactatgccccgcaggctgccgcacgcggcggcggctttatggcgggcgcgctgcaaacggccgctggcgtggcaggcggcgtggtgctgggcaatatgctgaccaatatgttcagcggctcgcacccgcaggagatcgtcaatatcatcgaagagaagccgcagcctgatgccgcctccgcgcaggacagcatcgcgcaggacaccaccgcaggtgacgatccgttccgccagggagacgatcagttccttgccgacaatacctggaacgacgacttcgacgccggctttggcgacgatgattttggcagcgatgacgatagctgggtttaaccctggcgacgcttaaccgccagcaaccacttctccagctcggcggcaaactgttgccgatcgcgctgcgataaactatccgggccgccggtctgaacgccgctggcccgtaatgtctccataaaatcccgcattgtcagccgctcgcggatcgtcgcctcgctgtaacgttccccgcgcggattcagcgccgctccgcccttcgccagcacctccgccgccagcgggatgtcggcggtgatcactaaatctcccgccgcgcactggcgaacgatttcattatccgccacgtcaaaaccctgctcaacccgcagggtgcggatgaaacgcgacggcggcacgcgcagcggctggttcgccaccagcgtcagcggagtctgggtccgctctgccgcgcggaacaaaatctctttaatcacgttcggacacgcgtccgcatccacccaaatggccatgccagctcctgttacctgcaataagtgacgccaatgttacctgcttttctcccccaggaaagcgccaggatggtaagctaatcagatcgtaacgaaaaaagcagaggggaatggtgatggataagaaaattggctttatcggctgcggcaatatgggtaaggccattctgggcgggctgatcgccagcggtcaggtacagccgggacaaatctgggtctacaccccgtcgccggacaaggttgcagctctgcgcgaccagtatggcatcaacgccgccgacagcgcccaggaagtggcgcagattgccgatatcgtcttcggcgcggttaaaccggggatcatgaccaaagtgctgggcgatatcgcctccagcctgaataaagagtcgctggtggtctctatcgccgccggcgttacgcttgagcagctggcgcgcgcccttggccacgatcgcaaaatcattcgcgcgatgccgaatacgccgtcgctggttaacgccggtatgacctccgtcacgcctaacgccctggtgagcagcgaagatgttgccgaagtgctgactattttccgttgctttggccaggcggagcaaattgccgagccgatgatccatccggtggtgggggtaagcggttcggcgccggcctatgtctttatgtttatcgaagcgatggccgatgccgccgtcctcggcggaatgccgcgcgctcaggcctataaattcgccgcccaggcggtgatgggctccgccaaaatggtgctggagagcggagaacacccaggggcgctgaaagatatggtctgttcccctggcgggaccaccatcgaagccgtgcgcgtgctggaagagaaagggttccgctcggcggtaatcgaagccatcacccagtgtatggaaaaatcagagaaactgagccgctcctgaagctgagccggcgggcttcaagccctgagaggttaaagaacaagggagcgcgagcgctccctttttttcaggctttcttcaggcagctactcatgaaggtactgcgttcatcgcccttcagtgatttcgccgtggccgctttgctgcagtcgctcattttctgctgctgaggggtgagcgcctttccctgcgaggtcgtggtctcttttttcagacactggctcataaaggttttgcgctcctcacctttcagcattttggctgacgcttgctgattgcagtccgtcatcctttgctgctgaggagtgggcgttttttctgccgcgccaaccgcgctgataaagatcaagccaaacagtagggtcatcaataaagttattttcatcgcaccatccttctgtgagtggaacgttgtaagtctggacgcagatagaaaaaaaaccagccggtgacgcaatttcgccaccggcagcgacttatttgagactcagggcagctttcatggtcgtgaacaggtcggtctgatcggtcaggccgacgacgttagccgcatgcggaccgtaggccgcaatgcgcagttgggtgccggtgtgctccatcgactcttcctcagagttgccgtaactcatcaccatcaccgcgccatcgtgcgtgttcagagcctgggtcagccccggggctttgctatccgccgggatgatctggctggcatgcgcatggtcggcggtgacgatcaccagggtattaccgtcttttcgcgcgaattccagcgccttctgcaccgcttcgtcaagatcaaccgtttcgccgatctggccgcacggattggccgcatggtcctgcttatcgatggacgcgccttcgacttgcaggaagaaacctttctcgttgcgactcagcaggtcaatcgctttctcggtcatctgcgccagcgtcggcaccgaggcgtcacgcttcgggtttggcgtacaggtcaccggcggcttatcgatattaccgtgataagacgccttcggcccttcccagcgtaccggcatattgccatcggcaaagagtcccagcagcggtttatcctgactggcttccgtcgcggcggcaagagaagccgcgtcggtcacaatctggtagccgcgcgcttgcgcctgctcgcgcagggttttgccctgccactcgcccgccgtcgccgtttcggcaaaggtcttcgcgccgccgcccagggtgacatccggtcgggcgttcagcagctgttcggtaatggagcctttgccccctttttccagcgcattgctggggcatttttcgctggtgaccgtcgggccatagcatttacgcgatgtcacatgcgccaccaacgccgcgggggtggcgtcctgcagctcggcggtggaaacgttgccggtggccagccccgccgctttcgccagctcaaggatggtctgatgcgcattctcatgaatatcgacgcccagcgcgccgttataagtcttcacgccggtggtccaggcggtggcggaggccgccgagtcggtcacgtagtccggtttcccggtttttttatccagcgaataatgcgtgtactgcccggttaacggcagagcatcaattcctttaaagaaaccgcccgccccctcggcatagtttcgcgcagcggtaatttccgaatcacccatgccatcgccaatcagcagaataacgtttttagctggcttattgattagcgaggcgcgcagcgcttcggtttgatcgcctgttaaacgacgcgcgccgccaggagtggtgatatctacctgcgcagcgcgattttccagaaccggcgcagcagtagtttctgcatgaataaccggcgagcccagtagaggaatcagggcaataaacagggcgcttaatttcacttttgtcatctccatgtaaaaaatacttaaaaaaacaaaacgagggagactttataaaagggagatgacagaaaaatgacggcatccttgtcgtgtcacaaagactagctacgaggatgccgcaacagcttctttagatattgctgcagcagcatcgcatcatggtcgttgaccggcggacagggcgtcacctggtcaatcgcctgttcaatatcctgaatcaatgcctgctgggcatcatgctccatatggcgcaataatgcggtgaccacgatctccagcgcttcaacctgcaccgtcagttcctttgcttcttcttccttttgcgccagtttaaccagtaactcagcaatgagattcttcatagcaccagttccttatgcgaggcctgttttgattgggatgtcatacgcgatgacggacctcagaattacttaaattaagaatcatcgcaacacccaatatacagcgaaacgttttaccacaataaaataccactataaatagtattgtttaatcatgaccggagttgcttataaccagattgcctggaaaataataaaatggaatagcgttcacgccataacgataacaaaaagtaatagtaaatccgctgacggcgaataatgctgacggtatcgcaataaataccgtcagcagaggttcaggcgttagcccgacgggtttggcgcagcatccacgccagctgccagaggttaatgaaaacgataatggcggtggcaataaacacccagcggaagccggccatggctgacacagaggcgccaattagcggcccggcgacgttgcccaaatacataaacgactggttatagccaaagatacgcccggtgacgctgtcgctgctgtacttcagcaataaggtctgcaccgccgggagcatcgcgccatcggcaaagccgagcagaaaacgcagcgtacccaattgcagcggggtggtgacaaaggacatggcgaagaacatcaccaccgcgcagcagagcgtcgccagcaggatccgcgaggtgccgatacggtcgccaagcttacccaaccgtggcgcagaaatcagtgccgacacgccgggcaccgcggcgatcatcccggccagaaaagcgatattgttgctgtccggcgccatcgacttaataaacagcgccagaatcgggccgattgagccgttgcacaattggatcaccagggtggtgaagaacaggctgatcaccagccccggatagggcaaagaggcaaagacttgtttcccggtgagacgctcgcttttgctgacctgcgggcgaacgccctctttaatcagaaacagggtcaccagaaaactgatggtcagcaggatcgccgtaataaaaaagaccatccgcagcccgacgtggtccgccaggaaaccgcccagcagcggaccgccgatcaccccgctaatttgcgccgtcgacagcgtgcttagcgcccagccgctgcgctcgcgcggcacctgggaggccaccagcgccatggcgttgggaatataaccggaggttaagcccatgatcgcccgcaggataaacagctgccagacgttggtggcgaaggcctgcagtaaaatggcaatcgccatccccaacgaggcgcgcagcagcatgagcttgcggcctttacggtccgccaggcttccccacattggcgagacgatcgccgagacaagaaaagtgacgctgaaggtcagccccgaccacatcgatagcgcttcatgcgaggtgacgccgagctgggagacgtagaggggtaaaaaggggagaatttgactgatcgccaggccggtaaaaaagcaaccaaaccagacggagatgagattaaccttccaggattccataactacgcgtattcattaatgatttgccaattattatctagcttagcaatttcatcccactggtgtactaccatagatgcgctggcggtgagtttggtgttttatggctgcggatgagagcctgacgaagcattttctggtcatttaggctgctcatagcgctttatgctcaaaagcagaagccctgcccgcgcatgccgaaatgaaaatggttggcgtgagccgcgttgtactctggccccagcgcgttaccgaagtaatggcaactgctgctcaacagcgccgccagccaggggcgcgaagtctcgctccgccagccctgcaggacgctaacgcgtctaccgtccgccagacggaaaccgctgacgtccagcgcgtccgccgtggcgtgttcactgcgccgcgcctgttgacgatggtaaatattgcggcaggcaaagctgccgagatgatcgatctgacgcagatcgctcgccatcagctgccgggtcagcggcttcgcctgctgctcgatgtacagcgcactgctcagcgccagcgggcaactggcgagaaaactactgctcagctgcaccgagccaaaattcgccacccgcaccacgttacgcagagggcagcttccctcgctgtcggccaccggccggctggcgataagccgccggcgattggcttccgccagcagggaggcgcactggtctgccgtcagcctgcgcagcttaaacgacgtcagccagcccgggggatcgtccagcgccagcggcgccagcggattcaggtgcggcggcagattgcggtatcccaacaggcccgcgccgagcagcccggccagcaccagcagcgtctttcctctcacgcccactcccgtcaattgatcaggtaaatattatggcagccaggcagcggtttcacatggtatgttatgccctttgatgttatctggatggaagttgaaatggcaaagatgagggttgggatcgtttttggcggcaagtcggcggagcatgaagtgtcgctgcagtcagcgaagaatatcgtggaagcgattgataaatcgcgcttcgatgtggttctgttgggtattgataaacaggggctgtggcatatcaacgacgccggcaactacctgctcaacgcacaggatcctgcccgcattgccctgcgcccttccacggtgactctggcgcagatcccgggccgcgaagcgcagcagctgattaacgccgaaagcggccaaccgctggcggccatcgatgtgattttcccgatcgtccacggcacgctgggtgaagatggctccctgcaggggatgctgcgcatggcgaatctgccgttcgtcggctccgatgtgctgggctctgcggcctgtatggacaaagacgtgaccaaacgtctgctgcgcgacgccgggctcgccgtcgccccgtttatcacactcacccgcgccaaccgcgcgcagttcagctttgccgatgtcgaagcgaagctgggcctgccgctgttcgttaagccggctaatcagggatcgtcggttggcgtcagcaaagttaaaaacgaagagcagtaccatcaggcggtggccctggccttcgaatttgaccataaagtggtggtggagcaaggcattaaagggcgggaaattgagtgtgcggtgctgggtaacgaccacccgcaggccagcacctgcggtgaaatcgtcctcaacagcgagttttacgcctacgacaccaagtatatcgacgatcagggcgcgcaggtggtagtcccggccgctatcgcccctgagatcaacgacaaaattcgtgctatcgcggtgcaggcctaccagaccctgggctgcagcggcatggctcgtgtcgacgtgttcctcaccgccgacaacgaggtggtgatcaacgagatcaacaccctgccgggctttaccaacatcagcatgtatccgaagctgtggcaggccagcggtctcgactacaccagcctgatcacccgcctgattgagctggcgctggagcgccatgccgcggaccgggcgctgaaaacctccatgaactaaaacgcgttttaccccgcctggcagcggcggcctcaggcctcttctgccgggcggcggcggatcacaaagcccgcaatccagaagctaatgacccaggtgatcagaccgacggcgtaggattgccacccctgagtttcaaaccccatcagccccaccactccattaagaataaaaatcaaccccagcgccacggcgtagtagtgccaatcgcggcgaattttatcagtgagcttcatgcggcctccaacagcaaaaaacgcatcttcgcatagcagcccgcggcggtctgtagcgatatggagaatgttgctggattgcgacgccgctctcccttttgtgctcctgtggcgcggttaacacaacggcgaaaacaggattattcctggacggcaattaccagcaatctgatactgatgatggcccctgactgccagaatacctgacatagagctggagaaaaaaccagcagcgcagatgtgggagggcctatggctgaattcagtttttcaaaatcgcttttgggaaataaaaaaaggggcgcgctgaccggcagccatgtcgcctacgggctgttcgtgttgatttgctgctgggccggcgcgcagatgctcagcatgctgatccacgccccgggggtatttgaacgcctgatgcaagcccaggacgccagccgtccgcaagtcgacatcagcctcgccgtgggtaccctctttggtctgatccctttcctgatcggctgcacgttcatcggggtactggcgcttatcgtgcgctggcgtcagcgccgttaacgccgcgccatacagtttgcccgccgctcatcaacccgtttcgcaaaccacgccgtcgtcagatttcgggtgatttttggactctccagctggatccctggtaacatctcccgcggcagggttttgcccgcctttttctcggcgagacggaaaacctgctgataaagatcggtcttctcaaacgccaggctgtcgccctttttcaactgacgatggatctcgctgtcgctcatccccagctggctcgccaggcgacgcaccgccagctcggtgctgcccggctcctcgctgtcgtagcggataaggtcgccgtcgagcgccagttttaccccgctggctttcaccaccgcgttctggaaggcggcgttacggctggcgtaccagccggcgttgaagtcggcaaagcggtacaatggcgcactataactggccggatagttcagcagatgataggtgccaaaccacaggccaccgcgcagactgaagatctcctggcgcaccgtgccgttcattttccacgggtagccgaaggtgtgctgctcggcaaaagcaatgctgacctgcatcggccccccggtgtgcaccgggttaagggaaccgaacagcttctgccccatcggcaccatcccgataaagtcatcaaaaatggcgctcaactgcttttccgtcttcacattgtccagacggtcgctatagcttttaccgtttggcgaggtgatcttcagcgcggtatggaccagaaacggcggaatgtgcattttttccgcccggcggtcaatttcctgccaggcgattttattcagccccggcaccaccggatcggactgatagttagactcttgctgcgcgaccgccagcaccgagcagacgttttcttccgtcggcgccagcttctggctgtcaaacgcggtggcgatggcttgcgcccaggcctcccgatccttgacgctggccggcattttctgccgcaccaccgacgccacgtcaacaggcttctcgccctctttcagcgccggagcctgctggctggtacaggcgctcagcgccatggccgccagcagcgtcaatgaaacgggaataatgcgcgataaacgtgcggccattatgcttccttgtcttgattaacgtaatgtcgggatcgcttcctgcagcggtttgccgtccagctcgcgttcaaaactgcgcagacgtttgtagatggacatcagttccaccagcgttgtccacgagctgatcaggtactggaacgagccgcgcacctggccgaagacgttggtaatttgcgtcatcagcccgagggtaatcgtaccggcaacgatcgacggaaacagcaggaaaaggccgaaaacgttatccacctgcagatagaggatgcgggcgatattgaaatacatatagtggaaatagagacggaaatagttgcgacgcaccgcgcggaatagctcgcgcaccgtcggcggcgtggcgcgagtttcatcgtcctcgccgtaaaccagctctttacgataggccgcttccacgcgctggtttttaaactccaggcccggcagcttaatccccaccaccgccagcaggccggtacccatcagcgaccagacgatagcggcaatcaccaggccatacggcagatggccgacgataggcaggtcgggaacatgttcggagagcgtcaccagcaccggcaggaaggcgatcagggtcatcaccgcgttgataaagctcacgcccatatcttcgagggtggaagcaaaacgcatggtatcttcctgcacacgctgcgcggcgccttcgatatggcgcagatgctgccagtgggccatatagtgctcgttcatcgccgtgcgccagcggaagacgtagtggctgacgaagaagttgttcatcacgccaataatcaccgcgatgatcgcgatgccgagaaagacgccgatttcctgataaaactggttgatgctgaccttatgcggggtggccagcgcgctctggatcaggtcgtagaacggcgcataccaggcgttgatcgccaccccgacttccaccagaaaccaggtgacgaagatgatgagcgaggtgccgagaatcgaccagtactgccagcggtgcgggcagtagacaaaccagaacagcgcgaacacgccgacgcaaaacagatagtaagcgtagaacaccagatagttgagcgaccagaagcgcgccgcgctgatcgccacattttgcgatgccccggtgacccgcagcagccagtcgccgccgcccgcctgccaaaagatcacggccagcagcgaccagataaaggcagaaataaaaaacggccccggtttggggaaaaaagatttaaacatcattgtctcctgctaacttcttatcgttctgctattgctgtgtacgacgcatacgtcggccgccgcgtggatgagccctcgcgggacagacgaatgataagaccggatatcaacagcttagttctgctgccatgcgtgcagaattgtttctgtgggtttcacctgtaaaggattgccaggaatggtcagcgtacgccacacctcattgtagtgggcgataagcgtcgcggcctgcgcggcggggcggtcggcggtggtgtgggcatcttccgcgataacaataccgtacccgcggctggcgccatttttaatggtggtatcgaggcagtagtcggtggcgcagccgcagatgacgaactgctgaatgtcgtgttcgtccagcacctgcgccagcgaggtgtgatagaaggcatcgcaggcggttttggtgacatacagcgcgccagccggctgctccagctcaggaagcagggcgaagccttcgctgccggcttcgaggccgccggcttcatcatgctgaatgaaaataaccttgtccgccgcgcgcaccagacgattaatttgcgcgacgcagcgctcgcgcgccagacgcggcgtggcgaacacgccgttttgcatatccacgaccatcactacccgttgagccgtcattgttctctcccacgaaccttcagccaaacggtcatcatacgcgccggcgaaaaaagccggtatccgaaagcgtaaaaaagtcttttttacgcaccgttacctttttcctgcaggaatgtcgtgaatcccgctttgttctgcgccacttcgtagtataaataccctcttctttttatttatttaatggatgatctccgttgaaacgtagtttgctcatttttgctgcgctgtgcgcggcgtcgtggacctcggtgcaggccgcacagcctaccgttgacccggttttcgcctcggatgtggtcgatcgttacgccaatcatatctactacggcagcggcgccaccggcatggcgctggtggttatcgatggcaatcagcgtgtttttcgcagctttggcgaaacccgcccggggaataatcagcacccgcagctcgactcggtgatccgtatcgcctccctcagcaaactgatgaccagcgagatgctggtgaagctgctcgaccagggggtggtgaaactcaacgatccgctgagcaaatacgccccgccgggcgcccgggtgcctgactggcagggaaaaccaatcaccctggttaacctcgcgacccataccagcgccctgccgcgcgagcagcctggcggcgccgctcatcgtccggtgtttgtctggccgacccgccagcagcgctggaactggctctctaccgcgaccctgaaagccgcgccgggctcgcaggcggcctactccaatctggccttcgatttactggcggacgcgctcgccaccgctgccggcaaaccgtatccgcagctgtttgaagagcagatcacccggccgctggggatgaaggacaccacctttaccccgtcaccggatcagtgccagcggctgatgatcccggaaaaaggcgccagcccatgcaacaacaccctggcggcgatcggcagcggcggagtctactcgacgccgggggatatgatgcgctggatgcagcagttcctgtcatccgatttctatacccgcagccagcaggccgaccggatgcagacgctgatttatcagcgtaaccagctgacccgggtgattggtatggacgtgccgggccgcgcagacgcgctgggcctcggctgggtgtatatgaagccgaagaacggccatccggggattattcagaaaaccggcggcggcggtgggtttatcacctatatggcgatgaatccgcaggctaacgttggcgcctttgtggtggtaacccgctcgccgttaacccgcttcaacaatatgagcgatggcatcaacgacctggtcagcgagctgagcggcgcacagcccaacatgcagacggccagccagtaagcccggggaaggtttcgccgatgcgccataacgatcgttttggcgaaacatcccgctgccatttcagttacactatcgtctttcatttcacaaaatcaggcaaaccatgacagatttaatcactcgcccccgccgcctgcgtcaatccgctgcgctgcgcgccctgtttgaagagacaacactgagtttgaacgacctggtgttgccgatctttgttgaagaagaaattgatgattacaaagcgatcgaggccatgcccggcgtgatgcgcattccggaaaaatatctggcgcgcgagatcgaacgcatcgccaacgccgggatccgctcggtgatgacctttggtatttctcatcacaccgatgccaccggcagcgatacctggaatgaaaatggtctggtggcgcgtatgtcgcggatttgtaagtccacggtgccggagatgatcgtcatgtccgatacctgcttctgcgaatatacctcccacggccactgcggcgtgctgtgcgaccacggggtggataacgacgcgaccctggaaaacctcggcaaacaggccgttgtcgcagccgccgcgggggcggatttcatcgctccttccgccgcgatggacggtcaggtgcaggcgattcgccgctcgctggacgccgccggcttcaccaatacggcgatcatgtcctactcgacgaagttcgcttcttccttctacggtccgttccgcgaagcggccggtaccgcgctgaagggcgatcggaaaacctatcagatgagcccgatgaaccgccgggaggccattcgcgagtcgctgctcgatgaagcccagggcgccgactgcctgatggtgaaaccggctggcgcctacctggatattctgcgcgatatccgcgaacgcagcgatctgccgctcggcgcctatcaggtcagcggggagtacgcgatgatcaaattcgctgcccaggcgggcgctatcgatgaagagaaagtggttctggaaagcctcggcgctatcaaacgcgcaggcgccgacctgatcttcagctatttcgccctcgatctggccgagaaaaagatcctccgttaaacccgcccctccccggtggcgctgcgcttaccggggcccgcaggcctatcccgcatgtaggccgggtcaggcgcagccgccacccggcgcaaaaacgtctccctacccgttgccattgcccggcagcgctgacgcttgcgcgggcctacgagattgccgggcccgcagtcccatcccgcatgtaggccgggtcaggcgcagccgccacccggcacaaaaacgtctccctacccgttgtcattgcccggcggcgctgacgcttgcgcgggcctacgaacttgccgggcccgcagccccatccgcatgtaggccgggtcaggcgcagccgccacccggcgcaaaaacggctccctatgcgtcgtctcccccgctgcgaccgaaacttcacccaactgtaatctgaacgacatctccaccttctactgtctgggcaggacggaggaggagccactatgtttagtctcgacaacgtactcgatgacctgtggcctcaggcgaggcccgccccctggcaaaagaaactgttaaaaaagctattttatgaggaagagtttcaacaatttgccgaccgtcaccgccacctgaaggggcttgatacggtcgaacaggtgctggaatacctcaatatccgctgcgccatcccggcgcacgatctcgaacaaatccccgaatatggcccgctggtcattatcgccaaccaccccaccggcaccctcgacggcctggcgctcctgtatgcggtatcccgcgtgcgccgcgatgtcaaagtggtcaccaaccgcatgctcacccaccttgagcccctgagctcgctgtttatcccggtagataatattcatggccgcaccgctaaagcggcgctgcagcagatggaccagcagctgcaggccggcggggtgctgatcttcttcccggcgggggaagtctcccgcctcacccctcgcggcatccgcgataaaaaatggcactccggctttattaagctggcggcaaaatatcgcgccccgctgctgccggcgtggattaacgcccgcaacagcgccctgttttacgccagcacgctgatatcagacaacctgccgctgctcctgctgatgcagcagatgtttcgccggcgcaacagcagcctgccggtgcgtatcggccagcagatcccctggtcgaactggttcgatgtgcagtccagcgctcgcgagcttaccggcagctgctatcagcaccttgaacagctgcgcaaagggctgccggggcggtttaaaaccgaaagcgctatcgcccgtccggaagaccgggcgctgctcaaacgcgaactgcacaaggccgaatgcctgggccgcaccgccgatggcaaagtgatttacctctggcagcgcaacggccaggaggacgcgccgctgctgcgcgagctgggacgcctgcgggaaatcgccttccgcgcggtcggggaaggcagcggcaaacggcgggatatcgacgggtatgacgacgactatctgcatctgatcctgtgggatgaagaagacctcgagatcgtcggcgcttaccgctttatgccgacggctatccagttggcaaagcgcggcctggaggggatctacagttacagtctgttccattacgacgggcggatggacgatgtcctgcagcacggcattgagctggggcgcagctttatccagccgcgctactgggggcgtcgcgggctggactacctgtggtccggcatcggcgcttatctggcgcgctatccgcactatcgctatctgtttggtccggtgtcgatttctggcggattgccgcccgccgcccgcgatctgctggtggcattctaccggatgtggttcccggcgacgcatccgctggcggagtcgcgtcgaccttatccggcgtcgctgcccgacgtgctggcgcagtttggcggggaggattacaacgacgacctggcccggctgaagtccctgctcggcaacctcggctgcgcgatccccccgctgtataagcagtactcggaagtgtgcgagccgggcggcgtgcagtttatcgatttcggcagcgacccggatttcaacaactgcgtggatggtctggtgctggtggatctcacctacctgaaggccaatcgctaccagcgctatattggcgcgcatctgggtgcgcaaaaatcggcataaacgctttttcccggcttgcggcgcgttgcgccttagccgggctaccgtttccgacggatcggtagcccggaaaaggcgcgtcaggcgacgcctccgggaagcagcgggcaatgcagcatccgcttttctccgcggctcgcggctgatgccttaaccggctacaagccttaccccgcccggtaatacggcttatcgccgaggatcgtcgcccggtgcatgatccgccgctgcggcagatagtcggcgttggcgtaatgctgggtcacccggttatcccagatagcgacatcgttcggctgccagcgccagcgcacctgaaactccggtttagtgacatgagcaaacaggaagttcagcagcgctgcgctctctttctcactcacctcgacaattcgcgtggtaaacccttcattaacgaacagcgcctgcttgccggtcaccgggtgggtacgtaccaccggatgcagcagcggcggatgcttcgccaccgcttcctgccagcgccgatgctcggcttcggtcttgttgtacttatactcctggaacgatttgcggaaatcgtgttcggcatgcaggccgctcagcagctgccggaagggttctgacagcgcttcccaggcggcgatgccgctggtccacagggtgtccccgccggtcgtcggcagctctttcgccgccagaatggcgccggcgggcggcgtgtcgataaaggtgacatcggtatgccagttgtcattatccggcggattatcgttgtgggtatcgaggacgataatctcctccacccctggggcgtgagggtagaccggatgaatatgcaggtcgccaaaacgcagcgccagatcgcgctgttgcgccggggtgatattctgctcgcgcaggaataccacctgatgacgcagcaccgcgtgatacagctgttcaaactggttgtcgctcagcggacgggttaaatctgccccgctcacctgcgcgccaatatagggccccagcggggtaatgctcagacgttcactcattgtacttctccatgccagggcgtcaggcgccgctgcagcgcgcgcagacccagttccagtaaaaaggcgataatggcaatcaccgcgatccccgccagcaccacatcggtggcgagaaactcgccggcagactgcaccataaatcctaatccgcgggtggcggcgatcagctcagcggccaccagcgttgaccagcccaccccgagaccaatgcgcagcccggtgaggatctccggcagcgcgccgggcaggatcaccagccacagcacctgcgcccggctggcgccaagcgaacgggcagcgcgaatccgcacctgctgcgcgctttttacccctgccagcgccgacatggctaccggcgcgaaaatcgccaggtagatcagcaggatcttcgaggtttcaccgatgccaaaccagatcaccatcagcggtaggtaggccagcggcggcaccggacgatagagttcgatcagcgggtcgaggatcccgcgcaccgtcgagttgagccccatggcgatccccaccggtacgccaataagcactgccgccagcagggcgataacgatccgcgtcaggctcgccgccaggtgctgccagagcgtcgcatccataaagccctgcggcccggcgatggtgataagcttctgcagcacctggcccggcggcggcagaaacagcgggctaatcagctgcagcgccgcgaccgcccaccagacggccagcaataccgccagggtcgccacgctgagggtgagctggcgggagagcggccagcgccacttcagcgtcgactgacgcggtttgtcgttcagtaccacgctcatgagaaagcctcccgttggtcaaacacccggctcagaatgtattcccgctgttcaataaagcgcgggtcggatttaatgctgcggcaggattcgcccgcgacaaagcgacggctgaaatcaagcggcagcctctccaccacccgtcccggccccggcgacagcagcaccagctcggtcgccatgaagatggcctcttcaatatcatgggtgatcagcagcacctgtttgccggtctcatgccacagtttcagcagcagcgtctgcatctgctcgcgggtaaaggcgtcaagcgcgccgaagggctcgtccagcagcaacagctgcggattcgccgccagcgcccgggcgatgcccacccgctggcgttgaccgccggacagttgccagataaagcgcttttccgccccttcgagccccaccttcttcagcatctgcgccgccgcttgccggcgctgcgctttatccacgcccgccagctggaggcccagcgccacgttatcctgcacattgcgccacggcagcaagccttcgttctggaagaccaccccgcgctctgcgcccggcccggtcacccgctgaccttcgagggtgatgctgccgtgctgatagggcacgaatccggcaatcaggttcagcagggtagttttaccgcagcccgaaggccccagcaccaccaacagctccccactctccagcgtcaggttgatatccgccagcgccggtttaccgccgtagtcagcggaaagatgcgagatttgcagcatcgccgcctcctttacttcacaaagcggtcagtaacgtactgacgataatcggttcccgccgcaggcactttgccctgctctttcaggaagcgcgcggtatcgacgatggcctgattgaccggcccgttcagcgcctgcgcctgctcagcggcggtgagataggtattgcccttcaccagcccggggacatcggcttccggcacgccgctcaggcgcgccagcttgctgatgttgtccggctgtttcagccatgcctccgggttggcgatgtagggctgctgggcgtcgatggcgcttttagcaaacgctttgacgatctccggatgctgctcggcgaagtccttacggaccacccagacgtcaagggtcggcgcgccccactccccaacctgagaagaatcggtcagcaccttgccctccttttccagttcgttaaccgctggcgcccagacgtaagcgccatcgatatccccgcgctgccaggcggcgataatcgccggcggctgcaggttaataatctgtacctggcccggcttgatgccccagtgtttgagcgccgacagcaggctgtagtgggtggtggagataaacggcacggcaatgcgcttgccgatcagatcttccggtttggtaatgcttttcttcaccaccagcgcttcggagttgccgagctttgaggcaagcaggaacacttcaatcggcacctgctggctggcggccaccgccagcgggctggagccgatattaccgatctgcacatcgccggaggccagggcgcgtaccacgctggcgccgctgtcaaatttccgccagtcgacggtcgccccgctggttttggcgaaggtgttgtccgcctgggcgactttcgccggctcagcggaggtttgatacgccacggtaacgttgaccgcctgcgcctggaaggcggcgacagccagcgccgccagaagagtaattcgcgatgtgaatgccataatgtctgcttcccctgagttgttataggtgcagtatttccggcatcaggatggagatgaagtaattaaaaattctggctaatagcgaatcgtttttagaacaaaagcgggaaaggatagttggttttgtgcggtgagttagtggcagatggttggcgccgggcggcggctacgccttacccagcatccggttcgcgcaatatgtaggccgggtaagcgcagcgccacccggcaaaaatttagcgcttcgcgttaagcgcggcgatgtccttcggcgtggtgcggcagcagccgccgatcagcttcgccccggcggccagccactgcggcagataatccgccaggctggcgcaggcttcgccatgacggtgccaggtcttgctcaccgcatcataatgttcgccggagttaggatagaccaccagcggcagggccgtcaggctgtgcaaatgcgccagcgccgcgggcgtattttccagggcgatacagttgatccccaccgcccccacctgcgggttatccgccagggcggccatcacctcgcgcagcggcgtgccgtcgctgagatgttcggcgtcgcgcagcgtgaaggagtaccaggcgcgggcgcggggatactcctgcagcagggccgccagggcctggatctcagcgaatgacggcagggtttcacaggccagcaggtcggcgccggcatccagcagcgcttcgacgcgcgggcggtggaaggcctggaactctgccgcgctgcgctgataatcgccgcgatactccgagccgtcggcgagaaacgcgccatacggccccaccgaaccggccaccagcagcgtaccggcctgcgggttctcggcgaggtacgcctcgcgcgctttgcgcgccagctcgacgcttttgccgattagcgcccgggactgcgcctcatccagcccgcgcgcggcaaagcccgccggagtggcctgatagctggcggtgatcgccacctgcgccccggcgcgaaagtagtcgagatgcacatcgcggatcagctgcgggttctccagcagcactttcgccgaccacaggctgtcggccagatcgcagccgcgggcctccagctcggtggccatggcgccgtccagcagcacgaaaggctgggcggcaagcagggcggtaaacggattagtctgcgacatgttggggctcctgagtcatattccgtgaacgagtaagataccaggcaccatagcacagggccacaaaggggatcccgcaccacagcgcaattctctggctcgggtcaaaagcgaggcccacgcaggccaccaggcacagcacaaagcccagaacgggcactaccggataccagggagcgcgatactgcagatcgctcagcgccttaccctgctgcagatggcggcggcggaacataaagtgcgaggcgcagatgctcaaccacaccgccaccaccgcaaaaccggagatcgccgacagcgcgacaaacaccgtatcgggcgccaccacgctggagaacagcgccagcacgccgcccagcatactcaccgacagggcggtcaccggcacgccccgtttattgactttggcaaagcaggccggcagcgtcttctcgttcgacagcgaccacagcatccgcccggaagcgtacaggccggagttagccgccgacaggatcgccgtcaggatcacgaagttgaacatgtccgccgcataagggatgcccaccttctcaaacaccagcacgaaggggcttttctccacccccgcctgctgcattgggatcagcgccgccagcacaaacacggtgccgataaagaaaataatcagccgggcgatggtggtgcggatggcaaccggaataaccttatgcgggttttccgtctctccggcggcaatgccgataagctccgtcccggagaaggcgaagttcaccgccaccatggtcatcaggatcggcaggccgccgtgcgggaaccagccttcggcggtgatattgcgcaggcccggcgccggggagccatcctgcatcggaatgatgccgaaaatggccgcgccgccgagaataataaacgcgacgatggtgatcactttcaccagcgagaaccagaactcgccttcggcgaagaagcgcgtcgaaatgatgttaaggccgaagatcactgcgcagaacaccacgcaccagatccagaccggcacctgcgggaaccagtactgcatgcagaatcccgccgcggtgaagctcgaccccagcgccaccgtccacgttagccagtagagccacgccacggtatagcccgtcgccgggccaagatagcgcgccgcgtaaacgtggaaggcgccggtctctggcatcgccaccgacagttcgccaaggcactgcatcaccagccagaccaccagggcgccaatcagatacgccagcagcgtcccggccgcgccggtggtggagatgatatagccggtattgaagaataagccggtgccaatcacgccgccgagcgacagcatgatcagatggcgcgttttcatggtgcgcttcagctgcccaccttgttgttgtgttgtgctttgcattttattttctcacgccagcccgcttgcccgggtcatgatgcgtataaacgtatagacatctaaacatccaaaagaagaagtgttataccgtgccgccgttgaaaaagcaaagccgctgcaccagggcgcgcgccgacagcgtgcagcctgccccatttttgcgcagcgccagcgggcgcgccacggactgacgccttatcgcggcaggcaacgttctggcactctctttgcagcctgtcgttcagcacctttctatctggcgaggcaatacgtatgacagagcaaaccaccaccttaaaaagaacgctcggcagttttcgtttatgggggatcgccatcggactggtgatatccggggagtacttcggctggagctacggctggtcgcaggcgggcacgatggggtttatggtcgtcgccctggcggtcgccgccatgtactgcgcctttattttcagctttaccgagctgaccaccgccatcccgcacgctggcggccctttcgcctacgcctaccgcgccttcgggcccaccggcggctttatcgctggttttgccaccctgattgaattcgtcttcgccccgccggccatcgccatggccatcggggcctacctcaacgtgcagtttccggcgctggatccgaaatgggtcgcctgcggcgcctacgtgatctttatgacgctcaatattctcggcgtcggcatcgccgccaccttcgagctgatcgtcaccctgctggccatcttcgagctgctggtgtttatgggcgtggtcgcccccggcttctcctggagccacttcaccactaacggctgggcgggcgcggacagcttcagcggcctggcgctgccggggatgttcgccgccattccgttcgccatctggttcttcctcgccattgagggggcctccatggcggccgaagaggccaaagatccgcagcgcaccattccccgcgccctgggcggcggcattctgacgctgacggtgctggcgatcggcgtgatggtcttcgccggcggcgtcggcgactggcgcgcgctgtccaatattaacgatccgctgccccaggcgatgaagacggtggtgggcaacggcagcggctggctgcatatgctggtgtggctggggctgtttggcctcgtcgcctccttccacggcatcattatgggctactcgcggcagatctactccctcgcccgcgccggctatctgcccgccgggctggcctccctcaaccgccgcacccgcaccccgcatctggcgatcctcgccgggggcgtggtggggatcgccgcgatcttctccgactcgctgatcaccatcagcggcatgccgctgaccgcctgcatcgtcaccatgtcggtatttggggctattgttatgtatatcacttccatggcggcgctgttcaaactgcgccgtagcgagccgaagctgatccgtccgttccgcgccccgctctacccgctggcgccggcctttgccctcggcatggcggtgctctgcctggtggcgatggtctggtataacctgctgttggcgctgattttcgcggcgatgatgctcggcggctacctgtggttccgcaaaaccgcagcggcccgtgaacgggcgccagtggatcctcaactgcgcacggtctcctgaggaggcggcatgtataaaaccacgctatcgggccaggtatggcgctttgatagtctgaaaacgctgatggcgaaagcgtcgccggcccgctccggcgacgccctcgcagggattatcgccacctcagccgaagagcggatggcggcgaaaatggccctcgccgaggtgccgctgaccgacattctcgacaacccgcttatcccttacgagcaggacgaagtgactcgcctgatcctcgacacccatgatgcgcagggctttgccgccctgcgtcacctgacggtcggcgattttcgcgactggctgctggatgatgctaccgataccgccacgctgcagcgggtcgcccgcgccatcaccccggagatggcggcggcggtcagtaagctgatgcgcaatcaggatctgatccttgccgccagcaaatgccaggtggtgacgcgctttcgcaacaccatcggcctgcccggccacctcagcgtacgcctgcagcccaaccatcctaccgacgacctgaaaggcatcgccgccagtatgctcgacgggctgctgtacggcgccggggacgcggtgatcggcatcaacccggccagcgacagcttaccggtgctggcgcagctgaacgtgatgctggacgatattatccagcgcttcgccattcccacccagtcctgcattctgacccatgtcaccaatacgctgcagctgattgagcgcggcgcgccggtggatctggtgtttcagtcggtggcgggaaccgaagcggccaacagcggcttcggcatcaatcttgccatgctgcaggaggcccgcgaggcggccctgagcctcaggcgcggtaccctcggcaacaatgtgatgtattttgagaccggccagggaagctgcctgtcggccaacgcccaccacggcgtcgatcagcaaacctgtgaggcgcgggcctacgccgtcgcccgccactttgaaccgctgctggtcaataccgtggtcggttttatcggtccggagtatctctacgacggcaagcagattattcgcgccgggctggaggatcatttctgcggcaagctgatgggcctgccgatcggctgcgacgtctgctataccaaccacgcggaagcggatcaggatgatatggacaccctgctgaccttgctgtgcgccgccgggctcaccttcctgatcggtgtgcccggagcggacgatatcatgctcaattaccagagcacctcgttccatgacgcgctgtacgcccgtcgcctgctgggcttaaagcatgccccggagttcgccgactggctggcgaaaatgcaaattatcgatccgcatggcgcgctgcggctcaccgacgcccgtcatccactgctgtccgtcctgccgcaaggagcctccgtatgaaccgtcccgatgcctggaacccgctgcgtgaatttaccgatgcgcggatcgccctggggcgcagcggcgccagtctgccgacccgcgaagtcctcaactttggtctggcccatgccagagcgcgggatgccattcatcagccgttcgccagccaacaattggtggcgccgctggcggcgctcggcctcgaggccctgacggtgcacagcgccgcgccggaccgtcatacctatctgcggcgcccggatctcgggcggcagctcgccgatgagagtcgcgccgacctcgccgccagcggcgtccgccccgccgacctgctgctggtgatcggcgacggcctctcttcctgggcggtagagcgccaggcggtgccgttgatccgcgccctgctgccctatctgcggacgctgggtatcggcctggcgccggtggtgctggcgcatcagtcgcgggtggcgctgggagatgatattggcgaaaccctgaaagcccgcgcggtggcgatcctgattggcgaacgaccgggtctctcctcgccggacagcctcggcgtctacctcacctggcagcctcatcgtcagcgtctggagtctgagcgcaactgtatctccaatattcggccggagggattaagccatgacgccgccgcctttaaactggcctggctgctggagcaggcttttttgcgtcggcttaccggggtgggtctgaaagatgaaagcgataatccggcgctgcatggtaaaataaaaccgttgccccctttaaaataataagtcacgcgagcagcagaatagatttttaatattatcttgtgcacctgactttatattccgccgcgtgctgaaattgcccggcggcgcttcgctggtacgggtctacggaagccgtgccagcggtttatatggcgtatttttcaggccgggtaaggcgccagtcgccccccggcaaaatgctttcaccgtaccaaaaaccgtgttgtcgccagccttatgcccttccctgcaggtaataagaatattgcatgagtaaaaacgaaacggacgttgtaaggtaaatcagcgcattaaaaatacccgtcatacttcaagttgcatgtgcgttggctgcattctctcccccagtcacttacttctgtaagcgtctggggactcgcttacttgccgccttcatgcgactcgaattatttagggtatatatctcgttatctattcaacataacagccaataattcgccggatacgctggcgcattattcctcaatgttatgcagtcattgatggttaaagataaataatcgaccgacggagaaatacccatgaaatcgttttccgggaaagcgtctttaatggccacgctggttgccgcgctggtcggcgccagcagcgcgcaggcagcggaaattaaaatcggggtggtattacccctgagcggcgccctcagcggctatggccagccgtcgcagaaagggctggacattattcaggccatcaccccaacgttaaaaaatggcgataccatcaagcttatcgttatcgatgataaaagcgacaaagtcgaagcggccaacgccatgcagcgcctggtctccagcgataaagtggatgccgtgatcggggaagtcacctcctccaacaccctggcgatgaccaaaatcgccgacgacagcaaaacgccgctggtctcctccaccgccaccaacgaccgcgtcacccgcaaccatccctacgtcagccgggtctgcttctcggacagcttccagggggtggtcggggccaatctggcctcccgcgatctgaaagccaaaaccgccgccatcgtgtttgacagcagcaacgactactccgtcggcctggcgaaagcgttccgcacccagttcctgaaaaacggcggcaccattcccatcgaggtccaggctccgggcggcagcaaggactttaaagcccagttggcgagcgtcaaggcgaagaatgtcgacatgatttacatgccgatctactacaccgaaggggcgctgattgccgtgcagtctaaacaactggggctcaacaaaccggtggtgggcggcgacggtctggccgcggatcaggtcttcttcgatgtcggtaaagacgcggtcaacggctatatgaccaccgattactactcgccgaacgccaaagagcagaccccggcgggggaaaccttcatcaaagcctgggaagccaaataccagcagccgacccatacctggggcgcaatggcggcggacgcctataacgtcatcgtcaacgccatgaaccagtgcagcgatccccacgatcgggtctgcgtgaatgaaaaaatccgcgccaccaaagatttccagggggtgaccggcacgctgacgttacagaacggcgacgccattcgcagcgcggtcatcaacgaagtgaaagatggcaagctggcgtttcgtaccgtggttaacccttaagttgtgacgaggctacaaaatggacggcgccatttttctccagcaagtggtcaatggaatgagtcttgggggcatgtacgccctgattgccatcggttatacgatggtttatggcgtgctgcggctgatcaacttcgcccatgcggacgtgatgatggtcggcgcgtttagtacgctgtttttattttcttcggttgggctacccttcggggtagccgttttcctgaccctcgggctgtgcggcctgtttggtatgctgattgaccgggtcgcctatcgtccgctgcgtcaggcctcgaaaatctccatgctgatcactgccatcggcgtcagcttttttctcgaaaacctgtttaacgtactgtttggcggcagctcgcgcttcttctccgcccctgactttttcaaccagacccgggccttcggcagcgtcatcattaccaacgtggcgtggattgtgccgctgatcaccgtcctgctgctgctggcgatcctctggctgctgtaccgcacccgctatgggatggcgatccgcgcggtggcctttgacgtcaacaccgtgcgcctgatgggcattgacgccaaccggatcatctccctggtcttcgccctcggcagtagtctcgcggcgctcggcggcgtgttctactccatcagctacccgacgatcgatcccctgatgggcgtgcttatcggcctgaaggccttcgccgccgccgtgctgggcgggatcggcagcgtcaccggcgcggtgctgggcggctttatcctcggttttaccgaggtggtcgccgtggcgatcttccccgaactgggcggctataaagacgctttcgccttcctgttcttgattctggtcctcttgttccgcccggtcggcattatgggcgacgaacgtctggaaaggagccgtttctgatgctcaacgcgacgacgaccgccggggcgcagctgcgcaacctggccattattgtcatctgtatcgcgctgctggccggaatcaacgtggttttcaatgactacattgttcgtgtcatcagcaccatttttatctttatgatcctcgcggtcagctacaacctgatcaacggcgtgaccggccagctgtcgctggagccgaacggcttcgtggcggtgggcgcctacgtgaccgccctgctgatcctctccagcgacagcaaggtagacatgtttgaaatggccgcccccagcccgtggatcctcagcctgcacgcgggcttcctccccgccctgctgataagcggcctgtgcgcggcggcgctggcggtgtgcctcgccgtgccggtcttccgggtacgtggcgactacctggccattgtcaccctcggctttgggtttatcatcaagatcctcgccattaacaacccgcaaatcaccaacggcgccatcgggctgaacgatattccgcagcagccgcatctcctgttctggtgcgggctgttcgccctgctggccaccggcatgatcctccagctggtgtggtcgaagtatggccggatgatgaaagctattcgcgacgatgaagatgcggcgatcgccatgggggtcaacaccttccgcattaaaacctgcgccttcgccaccagcgccttcttcgaagggatcggcggcggtctgctggcttccctgctgaccaccatttccccggggctgttcgactttatgctcaccttccagctgctgattattatcgtcctcggcgggctcggcagcaccaccggcgccctgctcggcaccgtgctggtggtcggcagcggcgagtggctgcgcttcctcgatcagccgctgcagttcttcggtcacgatctcggcgcgtacccgggcctgcgaatggtggtcttctccctgctgttgctgatcatcatgctcttcgcccgcgaggggctgttggggaaaaaagagatttggcagaccggaagaaggagcggcggctatggcggaaaataacgttatcctgcaggtgcaggacgtcaccatgcaattcggcggcctgcgggccatcgacaacgtcagcttccatgttgacgaggcggagatctttggccttatcggccctaacggcgcgggcaaaacaaccctgtttaacgtcattaccgccaactataaacccaccagcggcagcgtcaccctggcgggcacgtcgctgaaggggctgaagcccaaccaggtggtgaacgccgggatcgcccgcaccttccagaatatccgcctgtttaactccatgacggtgctggagaacgtgatggtcggactcgaccgcgccagccgctattcgctgctggaggcggccctgcatattggtcgctactttccggccgagcgggcggcgaaagccaaagcgatggccatcctggaggatatcggcatcgcccacttcgcccatatgcaggccacaaacctaagctatggcaaccagcgcaaagtggagatcgcccgcgcgctggccaccgcgccgaagctgctcctgctcgatgagccggccgccgggatgaacccgaaggagaccgaggatctggcggagctgatcttccgcatgcgccatgactatcagctcagcgtcctgttaatcgagcacgatatgcccttcgtcaaccgcctgtgcgagcgggtgatggttctggagtacggtaagccgttgttcagcggcctgatggccgaggcgatccagcatccggacgtcatttccgcttatctgggagaagccaattatgcttaacgcccgggaactgaaggtcttttacggcgtgatccagggtctgaagggcgtcgatatcgacgtctatgaccgggaaatcgtcaccctgatcggcagcaatggcgccggtaaaacctccaccctgaacgggatcgtcaacctggtgcgctccagtgggcgcgtcagcttcctcaacgacgatatctcacgcagccagacccaccagatcgtgcgtcgcgggctggcgctggtgccggagggacggcgcgtctttaccaacctgaccatcgaagagaacctgcgcatgggcgcttacaataatctcgccggctacgcccgcctgcgcgatcgcatgtacgccctctttccgcggctcaaggagcggcgccatcagatggcgggcaccatgagcggcggcgagcagcagatgctggccatcgcccgggcgctgatgagcgagccggtgttattgatgctggatgaaccgagcctcgggctggcgccgaaaattgtcggcgagctgttcggcatcattaagcaactgcgcgaagagaatatgacggtgctgctggtggagcagaatgcgacggccgcgctggcgatcgccgatcgggcgtatgtcctggagaatggccggatcaccttgtcaggcgcggcgcgggagatgctgactaatccggaaattaagcggatgtatctggggggataggcatggtcaaaactgcctgggctgcggcggcgcctcctgcaaggccgcaacctcaggcagtctcttgctacacaaagcacacctcgttccagtaggcttctcgcgtcctgcgtcgctcagtatgtcttatcatgacggaaccaccgggtttccacgttgccaatgtccacgccgtagaggctggctaccggcaggatcgcctccatgacgcgctgggtatcctgctgtccggcttcaccgttggacaaaaaagccagccagcccgttaaccgttgccacaatgccactttcgttttctcctctgtcgggaagcgaatcgcctgggtctatttcaaccacagttggccgggcgcgggaaatattaattccgaatttgcaatcctggctggcgcatattacccccggtcctatcaccctctccctggccctctccctgagggagaggggaccgcccggcagtcgttgccgtcctggtaaaacgccagcggcgcataaagaatacccataggtttgttaagttctttttggttatagataagaattttttcttctttgccgccgacgggcaatttgtgggagcgtgatgtccacaaaacaaaacagggattcaggggaaaaactatgcgcaataaaaccacaaaaatcgcactggcgctgggtatgctgctgctcgcctcgcaggcacaggcggaccagctggctgacatcaaagccgccggcgtcgtaaaagtcgccaccttcgacgccaacccgccgttcggctccgtggacgccaaaacccaccatatcgtcggctacgacgtcgactttgcccaggcgctggcgaaagcgctcggcgtcaaactcgagctggtggccaccaacccggccaaccgtattccgctgctgcagtccggtaaagccgacctgatcgtcgccgacattaccatcaccccggagcgggcccaggttattgatttctcaacgccgtatttcgtcaccggccagcagttcctcgtgccggccggctctccggataagctcgatgagtacagcaaagcgcgcatcggcgcggtgaaaggcaccaccggcgaacaggccctgcaccagcgtttcccgcaggctcgcgtcctctcctatgacgatattccgctggccctgaccgccctgcgcaacggcaacgtccaggccatcacccaggacagcaccatcctcgccggtctgctggcggaagcgccggataaagccaagtttaaaattctgcccgacctgctcagcaaagaagagattggcgtgggcgtgaagaaaggcgaaccggccctgctgaaggccgtcaacgatgagctggtgaagctggagaaaaccggcgaagccgcgaaaatttacgatgtctggtttggccctgccactaaaacgccgcagccgcgcgcctttaccatagaagcgaaataatatgttctcgggtttactctcccactccgcggctccggccgcggatttttcacgtctgcagcgcgccagcattacgttccgtgatgtggccaagcgctacggcgatcatcaggtacttaacgccatcaacctacaggtccagcccggcgaagtagtggcgatcctcggcccttccggatcgggaaaatcgacgctgatccgcttgatcaaccagctcgaatccttaagcggcggcgagatcctgatcgacggcaaacccaccagccggctgagcggcagcgccttgcgccagctgcgcagccgcgtcggctttgtcttccagcagttcaacctttacgcccacctgacggcgcaggagaacatcactctggcgctggagcgcgttcatggctgggaaaaaagcgcggctcaggcgcgggcgctggcgctgctgcgtcaggtcggactggaagaaaaagcgcagcagatgccggcgcagctctccggcggccagcagcagcgggtggccatcgcccgcgccctggcctcctcgccgcagattatcctgttcgatgagcccacctcggcgctcgacccggagatgatcggcgaagtgctgcaggtgatgaaaaccctcgcccacagcgggatcaccatgctggtggtgacccacgagatgcagtttgcccgcgaaattgccgaccgggtggtgtttatcgacggcggcgacatcctcgaagtcgccccgccggctgagtttttcgcccatccgcagcatgcccgcgcgcggcgttttctgcagaaggtgctggatccgctgcaccaggagagcctcgagtgacgccgatgcttgactggcacggcgtcctgagcgggcagccgttgcaatggattatctctggttttctcaccaccgtctgggtcagcgtcgccgggatcctgctcgccaccctgctggcggtcctgctgctggccctgcgcctcggcggcggacgcgcggggcgcggactggtggccgcgtgggtctcgttgtttcgcaacactccgctgctggtccagctgctgttctggtactttgccgcctggaacctgctgccgctggcggtgaaggaggtggtgaacgacgaacacgcctggtccattttgccgggtaacgtctggtggctgacgccggagttcctctgctcgatgtgggggctgggggtctttacctccgcctttctggtggaagagatcgcctccggactgcgcgccgtcagccacgggcagcgggaagccgcgctgtcgcagggctttacgccgtggcaggagctgcgctttatcctcctgccgcaggggctggccaacgcctggcagccgattgtcggccagtatcttaacctgatgaaactctcatcgctggccagcggcatcggctttgcggaactgacctatcaggtgcggcagattgagagctataacgcgcacgccctggaggcgtttgccgtcggcaccgcgctgtacctggcgctgggggtggcgatgggcgtggcgctcacgcgtctcggcccgggaagaaaactgcaacggagcgcccgacatgaacgctaatctggcggtgatcgccgataacctcgattacctgctgtggggccgactggcggagggccagcccggcggcgtggcgctgaccctgctgatggccatcggcgccaccctgctggcgctgccgggaggcattgcgctggcgggcctggcctggcgctacggcgggctggtgcggcgtctgctgtttctgtgggcggaaattatccgcggcatcccgctgatatttgtcatcttctggctgtggtatctgctgccgatgctgaccggcggcgatctgcccggcgcggtgaccgtgaccctggcgctggcgtggtttaccgccgcctcggtgatgcactcggtgctggccgggctgcagtcgctgccgaaaggacagtatgaggcggcgctgacccaggggttcgctcccgggcaaacgctgcgcctggtgctgctcccgcaggcgctgcgcaacgttcagccgtcgctggtggggatctttatcggcctgctgaaggacacttcgctggcgtttatcgtcaacgtcccggagctgaccaccgtggccggccaggtcaacaaccgggtgcagatctatcccctggcgatcttcgtcttcaccggcgcggtgtactacctgctgtgctgcggtctgagcctgctggccagccggcgctttacccgccgcgcgaccaccagataaggctcactccgcgggacggggcttcagcggacaggtatcgctgatcttaataaatttgtcgttatagaccagatagtggttccccggctggcgcagcgccggctggcgaaccacgtccccgggacgcagataccacgcgtcgccctcctcttcggtcgaatcgcacccgggtttaatcagcagcttaaaccaggtattgccggtgttgctcaccgtcccggccgccttatcgaaagaccatttaaactgtacctgccgcgggcgcaccaccaggatggtatccatcaccaccactggctccatgctgacttcgccgccggtcgggctgcgcctcgtcaggttacgggtgggaatttcacgaaacgagacccgatagtagcgctcgcggttatcccgcggcccatgataataaaatttgaaatattcgctctccccggcctgcagcgccagctggcggggggcgaacagcagttcgccatccaccggccgggagcgcacttcgctgccgccagggcggtcgatggcgctgacagtgatccggtacagccgcgcgcttttattgttattgaccacccgtttgctggcgaaatccgcttcagccggcagggaaaaggtcagattgccgaccgagatcgcctgcgccagcggcgccgccagcaggcagctcagcgtcagcagggccttagttaatgttgcgccacgtcgcctggacatgaatctctcctgaagcgctgacttcgccaaaccagccgttatcgtctaccgtccgcagcgaaatggcgttatccatcggaatcgaaaatttcaccgtggtcttatccatctgccccacttcgccggagatatcggtccacggcgtggtcagccacagcgcatcggtcatatcccgccagctgtcatcgcacccggcgtcgtaggtctgcgtcgcgccgctgcgggtgataaaagagagcgtcgccgggaacggcactttcgccgtaccgtcatcggagctgaagagacagtaggagcgcccaccaatcacctgcgccggtccggtcactttgatcagcacttcgtcggcggccgttttaccgctggtggtgacgatgtagccgaaatcgagcgccggttcaccactgccgacatacccctcccgcgacggcgccgaggtatattcgtcagagataatgctgatgctgaaatcacggggcttgataatcagcgtattggaggtggaaaactcataccagcctgactccggcgaggtggtgttctggaagcgaaagttgaacaaatccttggtattgatatcgctgatcccgagattcaccatctgcttaaagaagttactggagaagaacacatagatcgcatctgagctcttcatctcattgaaggtgtagtaataggcggtattgctcaccggcttccatgagctgccgttgaggctgaactgcatatcatacgccccgacggccgaggccagcgacgagttggcgatcgccgggaaaatatggatcgacgtattgcttaacccattggtctgcaaggtataatttaccatcttacagcttaatcctgaacggctgccaatggtctgtgtccggcagtcggcgttcccttccccaagggttggcacgccatcgctgttgataaacacctccgccagcgagtgggtgtttatcaaccgcaggttcgcggctttggtgtgggtgacgttgcgcacataccagttgccggaggcctgatccttacagcgcgcgccgctgctggcgtcgtagttcaccgaggtctggcaggcattgatggtcatcgtgaagctgccgccgaccggcatctgttgcagatactgataaaacgcgtccgacatcataccgtgcatccacttcgcgccgccgctggtcaccgtcgcgccatagaacccgctggcgtcggtggtctgcggcaggatcaggctggtggccatatcgcacccggcgtaccagttgatgcagcgcaggccggttaaggggtgcgaaaccggcgagttttccagccacatatcaaacttccagttggcattaagcccggtgttgtagccgttatcgatatagccgagactctgctgatagatggtcccggagccggtgtattttaagccggtccagcggttggcgccggtcatgcgcggatccagcgccccgccgggagtgacgaaaaagttgtcgtcggagttgttttccacaaacacaaactcgcgcgccggcgcatccgaccaggtggtcttggtcaccgccgccctgagcgcggctgccggccagagcagcgcgaggatcgccagcgccatcagtgcattaactttcattctcttctcctgactgctgcaccgccgcccacgacgagaggccgctgcagaccacatccccgacccagacggcgccgcgcgcctggctgagctcgagcgccacttcgcaggttttattgccgccgtagctgaaatcgatagtggggtatttcttatccacgtccatgacaaactcgccgttttcatcggtgcgggtacggccgatatggttgttaatccgcgcattcgccagcagcgtgccgtcttctgcacgaatacggccggagacggtgaccatctgcttcacctctggctcaatcaccgcgacgttgcccggataaagggtcagatgactcttgcgcccgctgacgatgtcgtagctgtcgagcgagtttttgctgttctgcagctccacctcatagcgaccatagggagagagcggcaggtagttacgcttgccgctgagcgggaagatccgcccgttaaccctggcgctaatctgaccatcgtcctccagcccggtgttgaagatcaccccggcgttgccgtcggttcgtccgctggcggcgatatttttaccctgccagccgacgctgccgctggcggtgaggttggtgttgacgtagccgtccgccgcgctgttgacgttcagcgtgccgctggcgtagcgggcgtcgaactgggcatacgcgccgccgctgagggttttgtcatccccggtatcgccggagatggcccgcgacagattggcgccgatggtgcgaatagtgccttcatcaaactgcttgcgcgctgagaggttagccatggtgtagccgttctgatgggtcatcccggcgctgaaccagttgcccagcggcagcgacagatcgagggcgatatatttcccggtgttggcgctgctgtcgccattgttatagcgctggatccccgcccgcaggccgagcgagccaaaggcgccgctgtagaccgtctgatagtaatccgcggtgtagtaatggctgttgtagcgacggtcatcgttgtagctgacgctgaacgtccccagcttcgaccacagcgcgttcaggttgagggtgccgccgatcgcccggttgtcggcatcgctgcgccgcaattgatcgccaatgcgggttctctcctggttaacccacactgaactgaatcccccgggcaacgtggcgctgatgctgccgacgctgctccacgagctgtcgctggccagcatgttttgcaggttaacgttgatcgactcgcccagcggtagcgtcaggcgggtttcccccaccgcctggttgtcgtagccatagcccgtagccgcccagctcagggtgctgagcgacccggaggccgaaaggcctgccagccagctctctttcgccggccgggtctttttcccgctctctgaccagcgatccatatgaaaactgccgccccatacctgccacgccagcggcgcgccggcgccgcgtccccggctgaacagcttattgacccgctgggtgcgtttgctgaccacccgaccattgacgatcacctccacttccacgtcgtaaataccgtacggcaggccgcgggtatccacttcatggttgcccatggcgaagttctggacgctcagcaaccgaccgtcacgggtgagatgcacctcgcccgccgccggcagaaaggcgatcaccggcgtggcggactggctgttgtcgaagacggtggagctggcctggttcccccaggaaaggccgtaaatcttaccggccgaaatagcggtcatcggtcccagggactgcaggttccaggtgtcaagcatcccgccggcaaagcggtggccggcgaaatcgcgctcatacatggccttatataattcactgtcctgctgaccgctgccgatgccgtatagcgagccgtcgagcaccacgtgatgctcacgcagcgccgtgacgttgttcagcgacaggtagctggaggtgttgctcccgccgttacgcatctggttgttatagacgccgaggttatagctcaggttgctgctgagagcgttgacgctggactgaccgatatcttcgctgcgcgagcgcaggacggtgcccagcgcctcgcgcttgaccaccagctgcagcagcagctggcgcaggctgagatccagctgtgcgctgtcggtcaggggaatggtgagcgcctcgctgaacggggcgttggccaggccaatcagctgctggcgggtctgttcgctaacgctggcgttaccttcactctcctccagctggatctgccggacgcgcagctggccgccgtccagccagataaaggcgctgccgatccgctgatcgtcccggctgctctggctgccggcgagatgaatatagagcgggacgctcatgccgtcctgcagcgcctgactgaaggcctgcggaataatcaccccgccaatctgctgcgcgcctgcggcagcagcgctgacgtcgggctgaacgaacaaaaagatcatgccgaaggcaagccgcgttttcagtcctggggtaatccatcgttgaggcatcgtcgttatccatctgcacagctgtctatttcacgggaacaaactgctcaccctgccaaagcgccacccgtccttttttatccgccgtgtccacgcgcgtaaaacggcgcgatttacccggcatcaggtagtaattctctttacattccttaccatcggcggccttcaggcaggggccgtaggcgaggatccgcagcgtcgcattcccggtgttggtcagagagccgttggcgtactgaaagcgatagttcacctgccggggcgccaccaccaggatggtgccgatgcgagcggaagcagtggccaccgcgctgcggttggcattatcgcgttgggcatcgctgagcgcctgatcgaaccagacaatgcggtagtagcgctctttgtcatccgccgggcctttgtagaagaagcggatcacatcgctggcctgggcgggaagcagcaggctggcgggagtgagcaatacctcatccggtttgtccattgggataacctgcccgccgtccagcggggaagagagccgttcgagatggatattgatcagtcgaccgctgtctgtactgttcttgatcgttttgctcagcgtgctgctgccgctgttcataaaggatgaaatatcgccgacatccagcgcctgcgccggcgacaccccggcaagcagcagcccgagggccagaaggtgctttttcataacaattccgtccgtgaaaaaagcagggggagatccccctgctggtgcatcagaaggatcagctggtccaggtggcgtcgaactgtacgctgacgtcgccgctccagatcccttccggcagggtgctgtaatcggtcacggcggtggtgccgttggtggtgccgctgatgatggagaaagtgaaaccatcctgcgcggtggtacggccgctggcgttgtagccattagccaacgcgctgaggttgccgcccataatattgttggcggtatcgatcatcacggtatcgccagttttttccaccgcggcgccgttataatccacgcccacgctcagcgtggagccggaggtatccagctgggttaaggtgttggtgataagacgcgaggtcagcttaaaggcggtcgccgttgtgtccccctcaatcgccacgtcaaacagacctttctgcgagttaaagcctttaatgccttcggcgtactggaacgccaggctgccgagcggggtcacaaccagcttgctggtggtgtcttttttagcggtcgcagaccaggtcgctacagcctgagccgttacgtcagcagcctgcgccacgcccataccggtaaacgccgttaccagagctattgccagaaccttttttttcatcgctttttcatcctgagttgaattaaggacatgatgtcccggtgaaccatttaaaaaacagaattgcctgggtgttactgaactaacttatatattttggaatacagtttggcctcagcattacgccgatgggtatacactgtcttcacgctacaattttcaattctggcgatcgatttcggctgcatgccctgggcggtcatgcggataattttcatttcccgatctgtaattttatctttcttaatatctttgcggagaaacctgccattaattacataggccagttcttttcgaatatcgcgactcagaccaacatataccacgccgcgaatatcgctattgtaataccagtagttcgctaaggcctctgatttcctggccgcaatcaatacgacctgtttcccctttaccgcggatagccattcgctgtcgcgcctgataaattcgtttaatgaagccgtattgagattgataaacacaaaatcttttctgattttctccagtgagagataaattaattcgtcgatgtctacaatcagttcggacagtcctttatagaaataggagtcatcggcagaccaaatatacttatcggaacagcttttatattccatatagtttttaacctcatagtccttgaagtaatcatttttacaacgtcactgcttgccaggcctataaagtttactggcgtattcgtttcctttaataaatcgccattaaataagacacgcattacttatcaatattggataagcgggggattaaactataattattttctgcttggcgttgaatttaagttttttcctatggagtgtcaacatgcggaaaggcaatgaatttcgcgcccaggtcaatatttacaaaaactgaaaatatcaaatttttgagcgccagaaaaagacatttattttcataaggttattggtaatataaccgtcaattcttatctgcgctttatattatccaggatcttcgccctattatgttaggaatattcttaatggaactcttgaatggcttatcaaataaaccggatttagcacaaaagaaaggatataaatctacaaataaacaaaaaccaggatgattcaccaacacataagactcatgaatagattaacctgccgcacaaaatagttatgtatatgttaatacatgcgggatgttgaatgctaaacaaaggcagacgcattatctattcgattaaacggtcttcttcatcaagattaagcgaagattgccgaaggctgcctacgcctacgaaccggtctgtctccgcgccctccaaagcatagcggcttttcggcgcttcgccagccgccagcatgccgcacgcgttgagccgctggccgtcgctctttcacgccagttcacgctttgttcgcaataccgtcatcgaaatttcatataaagacctattaatagtggccagttaatgacgaacctggacactcttatgaacagctctcttgccgcggtggccgaaactgatttccagccgttcaccgatcccgctgccggccggcagcggaaggtcttaagcgtgcgtaatctgagtaaagcttatcaagcccagcacaaggtgctggacggcatcagctttgatctgcacgccggggaaatggtcggggtcattggccgctccggcgccggtaaatcgacgctcctgcatgtcctcaacggcacccacagcgccagcggcggagaaattcttagctacccggaagtcggtaccccgcacgatgtctcacagctgaaaggccgtgcgctcaatgtctggcgtagccactgcggaatgatttttcaggacttctgcctggtgccgcgcctcgacgtgctcaccaacgtcctgctgggccgcctcagccagacttcaaccctgaaatcgctgtttaaaatctttcccgcagccgaccgggcgcgcgccattgcgctgcttgagtggatgaacatgctgccgcacgcgctgcagcgggcggagaacctctccggcgggcagatgcagcgggtggcgatctgccgggcgctaatgcaaaaccccgggatcctgctggccgacgagcctgtcgcctcgctggatccgaaaaacactcagcgcatcatggatgtgctgcgcgaaattagcgagcagggcatcagcgtgatggtaaacctgcattcggtagagctggtcagggcctactgcacccgggttatcggcgtcgccagcggccagcttatttttgacgatcacccctcccggctgacgcaggatgtgctgcagcggctgtacggcgatgaagttagccaattgcattaatttcactcacacgggcaacataatgaaaaaatatatgactggcgcagttcgtttatccgcaatggtcgcgggcatgatgatggcatggcaggcagcggcggcgcagccgaaagagctcaatctgggcattctcggcggccagaacgccacccagcaaatcggcgataaccagtgcgtgaaggccttcctcgataaagagctgaacgtggataccaaactgcgcaactcttccgactattccggggtgatccagggcctgttggggggcaaagtcgacgtggtgctgagcatgtccccctcctcctacgcctcggtttatctcaataatccgaaagcggtggatatcgtcggcatcgccgtggacgacaaagatcagtctcgcggctatcactcggtggtgattgtcaaagccgactccccgtacaaaacgctggacgatttaaaaggcaaagccttcggcttcgccgatccggattccacttccgggtatctgatccctaaccatgcgtttaaagaaaaatttggcggtaacgccgacaacaaatacaacaacaccttctccagcgtcaccttctccggcggccatgagcaggacatcctcggcgtgctgaatggccagttcgcgggcgcggtcacgtgggcctcgatggttggcgattacaacaccggctacactaccggcgcgttcaaccgcctgattcgcatggatcatccggatctgatgaagcagatccgcattatctggcaatcgccgctgatcccgaacggcccgatcctggtgagcaatgcgctgccggcggactttaaggcgaaggtcgtggcggcagtgaaaaagctggacaccgaggatcacgcctgctttatcaaagcgatgggcggtactcagcacatcggcccgggcagcgtggctgacttccagcagattattgatatgaaacgcgagctggtgagcgcgcgttaatcctgcctcaacgccgcctgcttgccccagggtaagcggcggcgctacgttgaagatccccgacgcatgaagacaacccacaccgaatttgaacgctattaccagcaggtacgctcgcggcaaaagcgcgatgccgtctgctggtcgctgctgctgctggcgctctattttgccgccggcagcgccgcggaatttaatctgctgactatctggcactcgctgccccatttctttgactatatggcagagaccatcccgcccctgagcgccggcaacctgttcgccgatgtgcagaccaaagggtcgctggcctggtggggctatcgcctgccgatccagctgccgctgatctgggaaaccctgcagctggcgctggcctcgaccctggtggcagtcgccatcgccacggttttcgcgtttcttgccgccaataacgcctggtccccggcgccggtgcgctttgccattcgcgtgctggtggcgtttttacgcaccatgcccgagctggcgtgggcggtgatctttgtgatggcgttcggcatcggcgcgatcccgggctttctggcgctgatgctgcataccgtcggcagcctgaccaaactgttctacgaggcggtggaaagcgcgcaaaacaaaccggtacgcggcctggcggcctgcggcgcgtccccgctgcagaaaattcgcttcgccctgtggccgcaggtgaaaccgctgtttctctcctatggctttatgcggcttgaaatcaacttccgctcgtcgaccattctcgggctggtgggcgcgggcggcatcggccaggagctgatgaccaacatcaagcttgaccgctacgatcaggtgagcatcaccctgctgctgatcattctggtggtgtcggcgctggacatgctgtccggtcgtctgcgcctgtgggtactggagggtaagaaatgagcgtctggcacatgcaaccggatctcgccgccagccggcggcagcataagcagctctatcaggtccaggggcgctacctgctctacgtcgggctggtggcgctagcctgcgtgctctattacgtctggttttttctgcagttcggcatcagtggcgagcagctgaccatcggcctgcagcagattggccgctacctggcgcggatgttcgtctggcacgacttctggaactggccgttcggctattactttacgcaaatcggcgtcaccctggccatcgtcttcgccgggacgctgaccgccacggtgctggcgctgctgctctccttcttcgccgcccgcaacatcatgcgcggcgtggtgctggggaccctcgccctgctgatgcgccgcctgtttgatgtgctgcgcgggatcgacatggctatctgggggctgattttcgtgcgtgcggtcggcctcgggccgctggcaggggtgctggcgatcatcatgcaggacaccggcctgctgggaaggctgtacgcggaaggacacgaagccgtggaccgatctcccgggcgcgggctgaccgccgtgggcgcgaatggcctgcaaaagcatcgctttggcatttttacccagtcgttcccgaccttcctcgcgctgagcctgtatcagattgaatccaacacccgctccgcggcggtgctgggcttcgtcggcgccggcggtatcgggcttatctatgccgagaatatgcgtctgtggaactgggatgtggtgatgtttatcaccctgctgctggtggcggtggtgatgatcatggacaccctttccgcctggctgcgccgtcgttatatcggcggcgccgcggtgccgctgtatcagggcggacgctagcgcgcctttgcgccggatggcggcttcgccttatccggcctccccgtccggctccgactgtctccaggcccggcaagcaacggcgccgccaggcgatggcatcaggcacggagctgcttttatgccgggtggcggctgcgccttacccggcctactcgtccggctccgactgtctgtaggcccggcaagcaactgcgccgccaggcgatggcatcaggcacggagctgcgtttatgccgggtggcggctgcgccttacccggcctacaaccccaaatcaccgctggcgcaggggctgctgaaactgccggtgctggcggcctcaacatcgctgagacgttcccggaaggccggggcagcccgcatggatgcgggctgagggccgtgttttgcacggacgctgcctcggcccgacccgaagcctgcagggataagtcgaaggcaccgcgcagcggcgatgttgctggccggagcccgggggtacagggggcggcggcgactggccgccccctgtgcgctccctgcgccatgaatgacataacgcagacaattaaccgggagcgcaaactacgctgaagccaccgataacataaacaacaacactgcagtgcttcccctcaccctggccctctcccgaagggagagggaactgtccggctggcgtttaggcccgtgcaagcgcagcgccgccgggcaataatcaggcacggtacccgtgatgttgccgggtggcggctgcgccttacccggcctacaggatccattcacaggctcacaccccgtaggcccggcaagcgcagcgccgccgggcaagatatcaggcacggtatccttgatttcgccgggtggcggctgcgccttacccggcctacaggatccactcgcaggctcacaccccgtaggcccgtgcaagcgcgccgccgggcaacagtatccggcccccgcccctacttcgccaggctggcaaagcgagcaaagaccgcatcaaaaatcgccagcccttgcgccacctgctcagcagtaatggtgcacggcgggaccacatgaatgcggttctccaccacaaaggccagcagcccggcttcggtcagggcccctttgatcgcagccatgtcggcggcggtcagcggcgttttttgttcacggctgctcaccagctccagcgcctggaacaggccgcgaccgcgcacctcgccgataatggcgtgcttctccgccagcgcctcgagaccggggcgcagcacctcgttgccgatagaggccgcgttctcaaccaccttctcctctttcatcgcgtcgatggtggcgacaatcgccgccatcgccagcggatggccggagtaggtcagccccccggcaaagaagtggtcgtcaaagtagcgggcaatcggctcgctaatcagcaccccgcccgccggcacgtagccggcgttaacccccttggcaaaggtcaccagatccggcaccacgccatcctgctcgaaggcgaaccagctgccggtacggccaaagccggccatcacctcatcgaggatcagcacgatgccaaactcgtcggccagggcgcgcacgccctgcatatagcctgccggcggcacgaggatcccggcggtgccggggatggactccagcaggatcgccgcgatggccgtcggcccctcgcattcaatgatccgccgcagatgcgccagcgcgcgctggcactcctcttcctcagtcgcggcgttgaactcgctgcggtaaaggtaggggttgaagaagtgaacgtggccgcgggagaactcattcggcacccggcgccagtcgccggtagcggcgatcgcgctgccggtgttgccatgataggaacgataggccgacagcaccttgtcgcgcccggtatagagacgcgccatgcgaatcgcgttctcattggcatccgccccggcgttagtgaagaacaccttactgaagcccgccggcgccaggtcgacgatgcgcttcgctgcttcgccgcgggcaaggttggcggtggcgggcgcgatggtgaccaaggtttccagctgcgccttcatggccgccagtacccgggggtgctgatagccaatgttgacgttcaccagctggctgctgaaatcgagccaggtgttcccctcataatcccatagctcgcagccttgcgccccggcgatgaccagcgggttgagattgccctgcatcgaccatgaatgaaacacataggcgcgatctaattgccgaacttcgtcattgcttaccgcgacctcgttgtgaattgccagcttcataccctgccctctctcatgtcgtagtggttggcttcatcattggccttggccgcgcaaatcggatagagccagtgcgcgcataacgatgtgacacggtgtcacatccccgcccgtcgtctggctctgtgccttgtcgtccggcgtttttatagtgaagggacaaccgcacaggagaatgagatggcaacgagcaacgtagtgtttatcaccggggcgacctcgggttttggcgaagcggcagcgcaggtgtttgccgacgcgggctggtcgctggtgctgagcgggcgccgctatccgcgactgaaggccttgcaggacagactcgccgccagggtgccggtgcatattattgagcttgacgttcgtgacagcgaggcggtggctgccgccgtggcgtcgctgcccgccgatttcgccgatatcaccaccctgatcaacaacgccgggctggcgctgtcgccactgccggcgcaggaggtggcgctggaggactggaaaacgatgatcgacaccaacgtcactggtctggtgacgatgacccacgccctgctgccgacgctgatccgccatggcgccggggcgagcattatcaatatcggctcgatcgccgggcagtggccctatcccggcagccatgtgtatggcgccagcaaggcgtttgtgaagcagttcagctataacctgcgctgcgatctgcttggcaccggcgtgcgggtcaccgatctggcgccggggattgccgagaccgaatttaccctggtgcgaaccaaaggcgaccaggcggcatcggataagctctatcgcggcaccacgccgctgagcgcgcgcgatatcgccgagcagatgttttatatcgccacgctgccggcgcatatgaacattaaccgggtggaggtgatgccggtgcgtcaggcgtggcagccgttcgctatcgaccgggattaagcgaaacccgacgcatcccctgtcggcgataccggcaggggatgcaggccggactaacggctgctttgcagaaactgcctgacgcgttcggagtcaggctgagtgaagaacttctccggcggcgccttctcaatcagcagtcccttctccagaaacaccacctcattggacacctggcgggcaaaatccatctcgtgggtcaccaccaccatggtgtagccctcggcggcaagggctttcattacccccaacacctcattaaccagctccgggtccagcgccgacgtcggttcatcgaagagaataacttccggcgacatcgccagcgaacgggcgatcgctacccgctgcttctgtccgccggagagagtgatcgggtagacatcggctttgtgcgccatgccgactttctccagctgctgcatggccatggcgttcgcctcgtctcgtttcatgcccttaacgcgcagcagcgcctcgctgacgttctgctgcacggtcaggtgcggccacaggttaaaactctgaaagaccatccccacccgctcgcggattttggccagctggcggtgcgacatcgcccggccgcgctgttcatcaatccccagccgctgaccgccgatatgaatttcaccgcggtccggctgttccagccagttcatacagcgcagcagggtggattttcccgacccggacgagccgagaatactcaccacggtccccttctccaccgtcaggttaatatcccgcaggacttccacattatcgaactgtttggagacgtttttgacgcttacggcaatagactcaggcatggctcattcctcttttggctccccaggcggtcaggcgcttaatcagcagctccagcagaatgctgatcgcccagtaaagcccaatggcgacgataaaggcgttaaacggaataaaataggtcgcctggacgctgttggcggcggcggtgatctcctgaacggtaataatgctcaggaaagcggtgtccttcaggcaaataatcagctgattgccgatcagcggtaaggcggaagagacgatattgggtaaaataatccgccgaaaaatggcatagcgagaaaagccctgagcaatcgccgcttcaatatatccgccggaaaatacccgccgctggctgcgtaatatttcaaagaaataggcgccatgataaataatcagggccagtaaaccggcggtccacggctccatgctaataccgagctgcggcagtccgtaatacagaagataagcgaggatcaaaaaagggatcgcgcgcatcaggctgacgaaaccaataataatccggttaatcactttcttttgatattcgctaaaataacacagcgcaataccgataatcagcgccgccagggcggcggtaataaacagttcgagggtcgcgaataacccggcaataaagctatcgcgaaccgaccagataacgccccactgattcataatgcctcccgttcctagcgcgccagacgcctggctttacgttccgcgataccctgcagcttcaacaaacagccgatgatcgccacatacagcaggccggcggcgaggatcggcgacagcggctcgtaggtgaccgaggagatacggttggtgacccgggtgagatccaccacgccaatcacggcgatcgccgggcttcctttgatcaaaaaggacatctcattgaccagcgccggcaggctctcgatccacatctgcggcagcatgatgtagcggaagtaggtccagcggcgcatccctaccgactccgccgcctcccgctgttcgcgcggaaaggtgcggaaggcattgcgccagatctcagcgttaaacgccgacgtgttaagcgtcagcgccacgatggcggccacgttcttgtcgaggttaatgcccatcgtgggcagggaaaggaacagaaatagcaccagcgtcaccagcggcgtcgcgcgggccagactgatatagaccaccagcagctggtcgatcaccggcaggcgcagcatccgtaccagggcgatcagcaggccagccaccaccccgaaggcgatagcgatggccgaaatccagagggtcgtccatgcgccttcgattaataactgccaggaaattgcatccatgaggccctccttctcaacaacaggcggcggtcgcccgccgcggaatattacagtccggcgagtttgtgaaactgttccgggctggtgatcgcctcggtcggcaggttgtcataggtttcgccgaaccattttttctgcagctcggcgagcttgccggtctccttcatgtggttcataaacctggtcatataggccagcagctgcggcgagtttttcgggatcggccacgccatataccccggtccggagacggccagccctttggcgaagaccttcggtttggctttcgccaggtcgtttaccgagatcaccacgttaatcacgtaatccagtcgcttgttcgccaggtcggcgtaggcttccggataggagggatactccaccaccggccccagcttgccgccggtcttctccagcatcgccttcagctccggcaaacgcgccagcagcgcgctcccggcctgtaaccccacttttttgccgctgagatcggcaatggtatttagcgaggtatcgccagcgcgtttgacgaaatagtgctgcgcggaggcccacggtggggtgaaatcaaagaccttcagccgctcatcggtaataaccgccccggttaaggccatatcgtattgcccggtggagacagccgctaataatccggtccacggtaatatgctctggtcgacatggaatttggcgtacttacgtaattcctcaagcatatctttgttaaagccatcggcctggccattattcataaagttaaatggcgcataatcatcttccgtcgccactttcaaggtgccggatttttctatttccggaagatcggccgcgacggcgtgataagaaaaagcgaccgttaatacagcgctcagacacattgatgccaatgattttttcattatttcacccctgatggattggccagacgggttcattccagaacgcgaaaaggtttctgcaaaatagtggccggggacgttccggtccacggcggctgaatacgtttttaatgtgggagcgtttttcaattccgtatagagccagatgggccgcatcgctgtgtcagatggcggcagggtggtatggaatttgctgagcgtaacgggtggtcgcaatgcgttattgccagaggagccccgtatgatccgtcacctgttacacgttgattttcagcctggccgcggtttgcaggaacaggtgcgagagacgctggtgaatgccattctcagcgggatcttcgccgccgacaccccgctgccctcctgtcgccagttggccagccagcttcgcgtctcgcgcaacaccaccgcgctggtgtttgaaagtctggtcaacgagggctacctgattagccgcccacgcagcggttactacctgcatcccgactatcatgaagcttcgcctgccgccgtcgagagtgcaccgcagcgcgaagcggctgcaccacgctggggcgaccggctgcagatgacccccagccagcaggagtcgatcctcaaaccggcgggctggatgcactaccgctacccgtttatctacggccagcccgatacccggcaattcccgctggccacctggcgctcggcggcgaactggctgcacggcggggtgcgcgacccggcgtgggtcatcgaccatattgaccaggatgtgccgatgctgatcgagcagatccgcacccgggtgctgcccaagcgcggcattgtcgccgcgccggatgaaattctcatcacccttggctcgcaaaatgccctctacctgctgacccgactgctgctctcttccaccacccgcattggcgtcgaaaacccctgcttccgcgaagccatcaacacctttctgctcgccgacgccgaggtggtgccgcacccggtggatgaagaggggatcgtgcttaatgagcgtccctgcgattactactatgtcactccaggtcatcaggtgcccaccggggtgaccatgagcagtgcgcggcgtcgccagttgctggagcatgccgcccgccatgacgcggtcattattgaagatgattatgactcggagagtaactttaccctcaacccgctgccggcgctgaaggccagcgatcgcagcggccgggtggtgtatgtcagcagcctgtcaaaagcgctgtcaccggggctgcggttggggtttatggtcgccgacccggacctgatcgacgaggcgcgcgccctgcgccggctggtctatcgccatccgccgaccaacattcagtaccagatggcccacttccttgcccagggccattatgaaacccatctgcggcgctaccactttgactccgcccagcgctgggagcgtctgcacgccgccctgcagcgctatctgccgtcgtgtcgcgcgctggcgggaagcgaacatgctaacgccttctggctgcagaccccggcgcagatcaacacccagcagctcacctggcgcgccgcccacgccggcgtgctgattgagcccggggcgcgccattttcttaacgccgcgccgccggataactattttcgcatgggattccacgccattaaccccgacgccatcgcccagggggtggaggtcctgcgcggccagctggagcagatgggttagcggtattgttcatactcaacggcgtcgcgcacgctgagcagcgccgggcgcaggctgtcgaaaggcaccgatccgagcgcaatgcgcagcgcctgcgggatcgtggcggagacgcagaacggctcggcggtcgataccgaaatgcggcgttccatcagcgcattcgccagccgatcggcccggctctcttcacccagcggcagccagacgaagtacgaatcgggatgactgacgacgggaagcccgcaaagtacctcgcgggccacctgctgtcgctgtcgcgcatcctggcgtttctgcgtttcaaagcgcgccaccgtgccatcttcaatccaggcgcagatcagcgaacttatcagcgtcggcgtattccacgtcgtggcccggatggcgcgctcaatctccgggcgatagcgcggcggagaaatcaccacccccacgcgcagtccggtggcgatattttttgaaaatccggtgacatacaccgttctttccggcgcatagctgaccaccggcggcggcggatggctcaccagccgggcataggcggcatcttcaataatcagcagatcgtgctggcgcgcgagatcggccagcgcctgtcgctgcccggtgttgagcacccagcccagcggattgtgcagcgtcggcatggtatacaccgcccgcacccgccgctgctggcacagcgtctgaagcgcctgcaggtccggtccctccggtcgacaggggatcgccgccagctccagatgatacagcgccgccagaaccttgaagcccgaataggtcagcgcatccaccgccaccacatcccccggtcgtaacagccccatgacggtcaccgccagcccgtgctgtgcgccgttgacgatcaggacattttccgcgtccggcgcaaagtgctggcaggtcaaatggcgggcgataatgtcccgctcggcgagccgccctgcatgaggctgatagcgcagatgcgagtcaatatcgcccgccatcgccagctgcctgagcgcctcgcgcagcgcatcgccctgctccggcagcgaagggtagttgaaattaagatccacgacatcggcggcgaccacctgctgatcgaccccgtgccccggaggcagcgagaggtcgcgcacgaaggtgccgcggccggtttcgccgctgaccaaccccatctcttccagttcccggtagacgcgcgtggcggtggccagcgagaggcgttctccggcggcaagggtacggtgcgtcggcagacggctgccggcgggcagctgcccgctgcggatcgcctgcgcatatcggtcgacaacggctttatatcgggctttcatcgtgaaatgtatctatgacaataatttgattgtattagattggccacattaccatcgccgctgacgatgctcaagcgggcgcagcccaatcagataacgcgaggttaacgtggtagattcagcaatggataaatcggcgcccggtccctggtccggatgggttcatggtttactgggggtgatcattttcagcggttcgctgcccgcgacgcggctggcggtgcaggatatggatccgttgttattgacctttctgcgcgcctctatcgccgggctgcttgccatcgcgctgctggtgggctttcgccagaaacgcccgcgcctggcgcagcttgtgtccctgatcatcgtctcatccggggtggtgctcggctttccgctactcacggcgctggccctgcagcgcatcacctcggcgcattcgattgtgtttattggcctgctgccgctgatgaccgccctctttggcgtactgcgcggcggcgaacgcccgcggcgggctttctggatcttttcgctgctgggcagcctgctggtggtgggattcgccctgacgcaaaatgcggcggcctcactcagcggcgatctgctgatgctggcggcggttatcgtctgcggcctcggctatgcggaaggggcgaagctgacgcgggagctcggcggctggcaggtgatctgctgggcgctggtgattgccctgccgttgatgctccccgcctcgctgctggttcagcccgcctcctggcatgccatctcggcctcctcctgggtcgcgctcggctatgtgtcgctgttcagcatgctgatcggcttcatcttctggtacaaagggctggccgcgggcgggatcgccgccgtcggccagctccagctattgcagccgttcttcggactaggcctgtcggcggcgctgttgcacgaaaccgtcagccccttgatgctggcggtcacgctgggcgtggtgctgtgcgtggtgggctcgcgcaaatttggccgccagcgggttggcgcagggagcccgagccgtgattgaccgccccgtcatccgccgtcccgggtcgcggcggcgtaaccgccttacccgggctatagcatgataaacggctggaggtcgcgtcgccggggaggacgaccgtctacaccggccgcgcgtactgaagcatcacctgcagcagcacgttggcgccggcggcgacgtgctccggcgaggcatactcaatttcgttatggctgatcccgtccttgcaggggataaaaatcatcccggtgggcgccaggtagctcatatacactgcgtcatgcccggcgccggagacgatcggccgcgccggatagcccagccgctgcgcggcatcggcaatggcctgctggcattcggcatcgaacggcgccgccggatagtggcttacctgcttcagggccacctgcagaccgctctcccgctcaacctccgcgataaacgcccgcagctggcgatccatctcgtccaccagcgcatcgctgagattgcgcatatcaatggagaaggtgacctccccgggcaccacgttgcggctgttgggccacacctgcacgctaccgaccgtgccgcgtccctcttcgctgcgcccggcaatggccaccacttcctgcataatgcgggtcgccacctgcagggcatcctgacgcaggcgcatcggcgtgggtccggcgtgcgaggcctggccggtgaccacgcagtcgtaccagcggatccccagcacgccctgcacgataccgatggttttcgcttcatcttcgagaatcggcccctgctcaatgtgcgcctcaaaataggcgccgatgggatggtcccccggggtctgctcgccaatatagccgatctgcgccagcgcctcgccgacgctgatgccctctttatccgtgacggcccaggtctcctccagcgggaagacgccggcaaagaccccggagcccatcatcaccggcacaaagcgcgacccctcttcgttggtccagaacaccacctcaatcggcgcctcggtggcaatctgcagatcgttgagcgtgcgcaccacctccagcgccgccagcacgccgtagttgccgtcaaatttgccgccggtgggctgagtgtcgatatggctgccggagacgatgggcggcaggccggggttgcggccttcccggcgcataaatacattgcctattttatcgatggtgacgctcatcccggcctcccgtgcccagcctattaccttgtcccgcccctggcggtcgaggtcggtgagggtcagacggcggcagccgcccttcggcgtggcgccgatctgcgcgagatccattaacgacgcccacaggcggtcgccattgatgcgccagccggtggtgtcggtcgcgggggtaaaaagtacatcactgctcatggtagtctcctgacatcaaggtcgccgccagcgtaaccggcggtgggaatgcgctatcaacgcctggtcttcatcctgtatggttttttgccgccgatcagacggccagggcctgggcgttagcgtcaatcgccagctcgcgccagcggtggcaactcaccgcgtggcgctccgcgacggattccgtcggcggcagactctgctcacagaccgggcgacggtgcgggcagcgctcggcaaaggcgcagccgggcggcaagcgagccagatccggcggcgcgccgggaatgcagtgcagggcatcacctttcttaagcccctctttcggccgactgcccagcagcacctgggtataaggatggcgcgggtggcgcaggatctcgctcatcgacgcttcctcgacgatccgcccggcgtacatcaccgccacccggtcggcgatctccaccgcggcgccgatatcgtgggtcacaaacacgatcgacagcccgcgctgcttttgctgctcgcgcagcaggatcaggatctggatttgcaccgtggcgtcgagggcggtggtcggctcatccgccagcagcagcttcgggttacaggagagcgcaagggcgatcatcgcccgctggcgcattccgccggacatctcgtgcgggtaagcatccagccgccgctcggggctgggaatgcgcacctggctcagggcctccagcgccctgtcccgggccgcctggcgcgacagcccttcgtggcggcgcaacccttcaataatctgctgcccgacggtgtagaccggatcgaaggccagcagcggctcctgaaaaatcatcgcgcagcgtccgccgcgatagcgccgcagctggctggcgctcatcgtcagcacctcgtcatcccccacctgcagggtgccggagagctcactgctccctggcgggtgcaggcgcatcagcgcccgcagggtcacgctcttgccggaacccgactcgccaatcagcgccatcacctcccccttttgtacctcaaaggagactccattgaccgcgttgatggtctgcccgtcgcggcgaaagacgacccgcaggtcgcgcacatggacaaaggcgttatccgacatggctgacctccttaagggggatgctttgatgccagggcgaggccggctgcgccatcaggcaggcgctctggtgcccctccccgaccgcctccagccgcggtttcacctcggcgcagaccgccttcgcatgcgggcagcgggtgtgaaagcggcagccgctcggcggcgcgatggggctggggggatcgccgcttagcggcgaggtcagggtgcggttttccgggtccatggagggcatcgagcttaacagcgcccgggtataggggtgggcggaggcggtaaacagctgctccgccgggccaatctccaccacttcgccaaggtacatgacgaggatccgatccgacagccagcgaaccacgtgtagatcgtggctgatgaacacgtaggtcagctcgagagtccgtttcagctcctgcagcagctgcagcacctgggcttccaccgatttatccagcgccgacacagcctcatcgaggatcaccagccgcggcttcatcgccagcgcgcgggcgatattcacccgctgccgctggccgccggagagcgcatgcgggtagcggtcggcaaagcgcgccggctcaaggccaacgtgcgccagcagatagctggcatattcgctggcctctctggcgctgacgccgtggacgcgctggccgaaggcgatgctctcctccatggtcaggcgcggattgagcgaagcatagctatcctggaaaaccatctgcacctggcgacggtaggctttcagcggcagacgtgacgagccgaccccctgtccgtcgaagatcagttcgccgctgtcctgggtgagcaactgcatcagcagccgggcggtggtcgatttgccgcagcccgactcgccgaccacccccagggtttcgcctttcatcaccgtgaagctgatatcgtccaccgcctgcaccacctcccggcctttgccgccgcgaaagtacttcagcaggtgattgaccttcagcagcggctgcgccggcccgccaaggtcgatattgataaagggttgcatcgcttactccttaatcgccattgccgcacgcaggcggtccgcgaggatattgaacgaaatggaggtgataaaaatcatcaggcccggcagggcggccacccacggctgggtatagattgccgtgcgcagcgtattgagcatcagcccccactcgggctccggcggccgcacgccgaggccgagaaacgacaggccggaggcgaggatcatgcacaccgaaatcagcccggtggagaagacgaagatcggcccgagcacgttgcccaacacctggacgcggataatggtcaacgcgctggcgccagtggcccgggcggcgtcgatatagtccatatgccgcacctgggcggtcacgctctcggcaatccgcgccacctgcgggacaaacacgagggtcagcgacaacagcgcattgccgatgcccgcccccaacgctcccgacagcgcaatcgccagcaggacggagggaaaggcatagaacacatccacggtgcgcataatcacggtattggttttgccgcccgtatagccggcgataatcccgatggccccgccgataaaaaaggcgaacaccaccgggacaattcccataaacagcgacagtcgggtgccaaggatcagccgcgacagcatgtcgcgtcccagctcatccgagcccagcgggaagccgtcgctgccgatgggtttcaggcgcaggaacatcgacgtttgatagggatctttgacgataagccacggaccgaacagcgccagggccagcagcaggaggatcaccacgcccaccaccaccccgccggggtcgcgcagtaggcggcgcagcacgccgcgccagtaaccttgccgggtagcgtgggccgctgcggccgggaccgctttcgtcgttgccgtatccaccatggtcagctcctcttaatacgcggatcgagggtggtctgcagaatatccaccagcaggttgagcagcacgaaaaacagcgccagcacccagatggtgccctgcagcaggggcaggtcgcgctgaaaaatggcggtattgagcagcaatccggttcccggccaggagaaaacggtctccacaaggatcgagccgcccatcagatagcccacctgcagccccatcaccgccagcgcggtgggcgcggcatttttcatgacatggacaaagatgcgcgactcgttgagcccgcgggcgcgcaggccaacgataaactcctggctgaggatatcggccacctgcgagcgcacggtgcgggcgataatcccggtcgggatcaccgacagggtgagggccggcagcagcatgaactgcaggtgcgcccagtcccattgccagcccacctcgcctatcggcccgccgccggtggccggcagcagcgcgaacttgacgctgcagaggatcaccagcagcatccccagccagtagtgcggcacgctgacgccaaacaccgacaataccgaggccagacggtcaatgacgctgttgcgaaaatagccagcgacaaagccgaacaggctgccgaggacaaaaccgatcgccgtcgccagcagcgccaggcgcagagagtaagccaccgcggtcatcacttcgtctatcaccgggcggccggtggcgaccgacataccaaggtcgccgtgcagcgcccgccacagccagtggataaactgcaggggcagcggcttatcaaagccgtaagcctgcattaatgtctgacgcagcgcctccgaggcgtccggcggcatcaccgacaccagcgggtcgcccggggcgatctgcaccagcatgaaacagatcaccgccacccccagcatggtggggatagccagcagaatgcggtatagcagcgtattgatcatcggtcgcccctttcgcgattactcttttttgctcaccaggctgaggtcgataaaccagctctgcggttgcaccaccccggtcaccgcaggggaaatcgcacgcggcccgacgtcgtgggcgacaaacaggaatggcacctgatccaccagcgcggcgtgcaactcaccggccgctttgttcatctccgccggggtaaaggcgtgcttgacggcggcggccagcttctccgtctccggcgtggaaaagtaaccccagttggtcgccaccggcggaaacgctttggccgtcgagaagcggatcaggccaaagtaaggatcgttaaccgcggcgctgacgttgatcgcatcgatccctttcgccgaggggtcccgggcgcccaggcgccagttggtaaacagggtgttccattccaccactttgatatccacattgaagaagcagctcttcaggctctgctggatatactcgttcatcggcaagggctgcatctgcccggagccggaggccgaggtagccaccgtgacgcgcagcggtttgctggcattgtatccggcctcggtcattagctggcgggcggcgtccgggtcatattttatctggaaggtgggtttgccatgccacgggctgtcagcctcgtagaccccagtggcctcggtcatgtagccgccgaggtagctcttcagctcggcacggttcagacacaagttggccgctttgcgcacgcggatgtcctgccacggcgatcctttttcaaaggagaactgccagggccacagatgcggctgggtgttggcgtagaggtgaaaaccctgagacttgatctgatcgatggcgtccggcgccggggcttcaatccagtccacctgcttcgacaacagcgccgcggtacgggcgttggcctccggcaaggggatcagcaccactttatccacccggggaatgcgatctttgttccagtagtcggggtttttatcgaggatcagctgctgacgcggcaccagcttctccagtttgaacgggccgctacccaccgcgtgggcggcgaaggcggtccacgcctgtttgctgcgcgcggcgctatctctcacgctggccggcaccgcgtcatactgcttctgccacgccgtcggcgagacgataaacaggttggtgatgttgtacggcagcagcgcatccggttccgaggtggtcagcgccacggtgtggtcgtcaattttctctgcgccggtgagggtcggcatgcgcgacagggtgttgccgatctgacccggggcgtactgcggcgccgctttattcagcaccttatccacgttccagacgatggcgtcggcgttcacctccgtcccatcatgaaacttcacccccggacgcagggtgaaaatccagcggctggtgttctgcggatcgatgtgccactcggtcgccagccccggcaccagaccgctgggcttttcaccttgcgacagatcccactccaccagcgcgtcgtacagcgggatgccggtaaagcggttgccctcatagccttgatccggctggccaagggttaacggaatatccgcggcggtcatggcgatccgcagcgtggaggcgttggcaggtaaggcggcgcccgccagggccagtgcgccgctcaccgccacggcgagacgaccggcacgcgaaaataacgtctttttgtgcatcacatgatccctgttaaataaagtgtcacggattaacaggcaaaatgcgtaccagctcttacgcggacgaaaataggccaaaaccgaccggtaaaataagaatgacttatattatcaccatgataattatgggaaaataattgcatcttattccgccgcaccgccagcgggaaatatgttgcagaattgcaccagccgctatatggcaaatttcaaataatcactctgcgtcactttttattcatcccccgtccaccgccgccgcgtattctccgtcgggatcaatcccttctatacttcagggaacacatcgaccgggagagactatgcctttagccgattttcaccgctccgatccttttaccctcggtatcgaactggagctgcaggtggtgaacccgccgggttacgatctcagccaggatgcctcgacgctgattgccgacgtccagcatcagttgaccgtgggagaagccaaacatgacatcaccgagagcatgctggagatcgccaccggggtgtgccgcgacatcagccatgcgcaaatccagctcagcgccatccagcaggcggtccagcgcgcggcgctgcgccatcatctgcagatctgcggcgggggttcccacccctttcatgcctggcagcgccagcaaatcagcgataacccgcgctatgtcaaaaccgtcgagcattttggctatctggcacagcaggcgacggtctttggccagcatgtgcacgtcggctgccagagcggtgacgacgccatctatctgctgcatggcctatcgcgctttgtaccgcacttcatcgcccttaacgccgcctcaccgtggtttgacagtaccgacagccgcttcgcctgttcacgcctaaaccgcttctcctcctatcccgacaacggtccgatgccgtgggtggccgactggcaggggtttcgtcgcctgttccgccagctgagctacaccagcatgatcgacagcatgaaggatctgcactgggatattcgccccagcccgcagtttggtaccgtcgaggtgcgggtgatggacacccccctgacccttgcccaggcgatccacatcgccggctttattcagaccctggcctgctggctgttgacggagcgcccttttaagcaccagcctgatgattatctgctgtacccctttaaccgctatcaggcctgccgctacgggctggacgggaccctcaccgacgtgcgcagcggagagcagcgcagcatccgccaggagatcctgcagctcgccgaccggctggcccctttcgcccatcagctgaaggcgacggcagcgctggaggcggtggttcgccaggcgaaatcgccgcacagcgaggcgcagcagatgcgcgactttatcgccaacggcggttcgctttccgggctggtgcaaaaacactgtgagatttgggcggcataaggcagcgaggcgggtatactcggcgcagactatagaaaggactgcccatgttattacgttgcctgctccctctggcgctgctgcccctggccgccgtcgccagcgccgcctgtaccctcaccgacccgacgctgaccctgcagagctatcgggtggatgcgcagaaagagcgcattgcgatgtactggcaggatcggcacggcaaagcctggggttccctgcgttcgctgctggcgggtatcgatggcgacggccgggtgcagatggcgatgaacggcggcatttacgataaggcctacgcgccgctggggctgtatatcgaagacggcaaacggctgacgccggtcaaccgctccgccggcggcgggaacttctttatccgccccggcggcgtattcctggtggaaaacggccgggcgaaaatcgtgccgctgccggcgtacaaaccctctcccgccatccgctatgcggtgcagtccggcccgatgctgattgaaaatggcgtcatcaactggcgactgaagccctccgccagttcgcgcaagctgcgcaacggggttggtatcgataagcagggccgggtggtgtttatgctcagcgatcgcgagaccaacttttacgattttgcctgctatgcgcagtcaaagcttggcgtgcggcagatgctttatctcgacggcaccctgtcgaagatgtaccgcaaaggcggcagcgtgccgtggcagtatcatccgttcgtgaccatgataacggtggagagaaaatagcgggcgcgtttgggggcagccattccagccaggagagtgaataaattaacgacaggccgggcaaggtattgccgccgtgcccgatgtccttgcccggtgacgctgcgcttaccgggcctacagagtctgttcgctatggtgtggctcctgaaatctacgggcgtgcagcagggctgattcccgctgaaatcggcgaaccgaaggtcggcagataaggcggggctcacgcccaaacgcaacgtgaacgcaaaacccaccctcaccctacccctctcccaaagggagaggggaccgcccggtagtcgttgcagcctggagtatccccgttaccgaccggtagcgccgcgcttacccccgccgatgcgcccactcgcgcatacgttgaaacagtacatacagcgacgggataaacaggatgccaaccatcgtcgccaccagcatcccgctgaataccgtggtgccgatgatccgccggctctgcgccccggcgccggtggcgagcatcatcggcatgatgccgataataaacgacaccgcggtcatcattaccgcgcggaagcggcgggtagccccctcgcgcgcagcgtcgactatcgacagcccctcctcgcgccggctgcgggcgaactcaacgatcagaatcgcattcttcgccgccagggcgatcagcagcaccagccctatctgaacatacacatcgttggcatagcccgcggtccacagccagagcagcgctccgccgatggcgaacagcaccgagagcatgacgctcgccggcagcgtccagctctcatactgcgccaccaggaacagccacgccatcgccaccgccgccagcacgatccacaccgcctgattgccggtctgctgctcctgccaggagatcccgctccaggcatagtcatatcccggcggtagatgggcctgcaaaatctgctccatggccgccatcgccgtgcggctgctgaccccctcggccgctgaaccgctcaccgacacggacgggaactgattgtactgctgaataaacggcgcccccaccgtcggcgtaatggtgaccagattgctcagccgcacccgctcgccgtcgcggctgcggacgtacagctcgctaatctgctcagcccgctcgcgccactgcatctcattttgcatcaccacatgatagacacgattgttacggctgaaatcgccggcgcgcgtgccgccgaacgccgtctgcaggctgctgaagatctgcgccaccggcacatccagcagcgccgcccggtcgcggtcaaccgtcagggtcagctgcggcacgttgctgctccaggtggtaaacacccggctcagctgcgaatgctggttcgccagctggaggatctcccgcgtcacctgctccagctccgccgacgactgaccggcctgcgccaggatgcgcagatcaaaccccgaggcattgcccaggcccggcagggtcggcggtgcgaaggtcatgatcgtcgcctccggtagcgacagcagctggcgctgaatatccgccatcaccgcatccagcggcggccgctgatgccagtccttgagcattaccgagataaccccgccgttagaggcgctggtgccgttgagaatgttgaacccggacacctgaatcacatcctccaccgccgggttagccatcagcagcttgcgcgcctgggtcatcaccgcttcggtacgctccagcgacgccgcctccggcagctgcacgctggcaaacaggtaaccctgatcttcctgcggcaggaagcctttcggcatcgaggtgaagctgaacgccaccagcgcgcctgccgccaccgtcgccgccagcgccagccagggacggcggttcatccagcctaccagccggccatagccgtcgcgggtgccgtcgagaagacggttaaacgcccgccacaccgccgctggccgggcaggacgcgggcgcagcagcagcgcgcagagggccggcgtcagggttagcgccaccaggctcgacagggccaccgcggtggagagcgttacggcaaactgccggtacagctcgccgacgatccccgggagcagcgccaccggcacaaacaccgccagcagcaccagggtcgtggcgatcaccggcccggcgatctgccgcagcgcctgggcggtggcctgcaggcgatccagcccttccgccattttggtttccacattctccaccaccacaatggcgtcatccaccaccatcgtcagggcgagaatgatcgcgaacaggctgagggtgttggcgctgtagcccagcagatagagcaccgcaaaggtgccgatcagtgacaccgggatcgccagcactacgatcagcgtcgcccgccagctctgcaaaaatagcgacaccaccacgaccaccgccagcagggtcagcgccagcgagacgccgatctctttgatcgtcgccgccacaaagcgggtggtatcgaacttcacctcccaggtgagatccgccggaaagcgagtgtgcaggcggttaagctccgcacgcactgcgctggcgacctgcagggcgttggcggtgggcgtcggatagatccccagataggccgacgctttaccgttcagctgggcgccggagctgtagctgcgggcgcccagctcaatggtcgccacgtcggcgaggcgcaccagctgcccctgcgcgccgcggcggaggataatctcgccaaagctggccgcctcgttcagacgccccagcccgttgatggtcagcgtctgctgctggccgttaaataccggcggggtgcccacctgccccgccgcgccctgtacattttgctcgcgcagcgcctgggcgacatcatccgtggtgatgttgagcgcgttcatgcggtccgggcgcagccagatacgcatgctgtaatcccgggcgccaaacatctggacctcgccgacgccgggcaggcgggccagcgcctcgcgcacctgggtgctggcgtagttgctgacaaacagcggcgacagcgtgcccagcggcgagtagaggcttacccccataagcagattgctggcgcgcttgcgcacctggacgccattctgctgcacctccgccgggagctgcgccagcgcctgcgccacccggttttgcacgtcgatcgccgccaggtcggcatcggtgcccgccgcgaaggttatgctcaggcggtacgtcccctcatccgagctggtggactccatatacagcatatgatcgacgccgttgagctgggtctccagcggggcggcgatggcttccgccacgtctgacgcgctggcgcccggccagctggcgctgacgttcaccaccgggggggtgatcgccgggtactgctccaccgggatcagcttcagcgacaccgcgccgacaaaggtcagcagcagcgcgatcaccatggcaaatcgcggacgacggataaaaaaggtcagcatcccttctccttagctagttcagcacctgcaccgcggcgccttcgcgcaaccgctgcgcgccgtcggtgatcacctgctcgcccgcctgcagccctttctcgaccgcaaactgctgcccctgctgccccgcgagggtcagacgacgctgcccggcggtgtggtccggcttcagcacccagctgaaaaagccctgcggatcctgctgcacggcggcggccgggaccatcactcgcgacggcagttcctgcggacggaacaggatcgtcacgctgccgcccggcagcagacggtgctgcggattggcaaactcggcccgcaccgctacgctgccggtgcgggcgtcgatccggttatcgatagaggtcaacaccccgtcgcgccgtttaccatcaacctcaatctgcgccagccacgcctgcttcagagcgtggatatcggcgtgctggccggttttgctgaaaaacgcggcttcgtcgagggcgaacgagacccgcaccggatccaactgcacaatgtccaccagcacgccgctggacgaattgaccagcgtcccgacgtgaaaggcgctatggcccacgcgaccggtcaccggcgccgcaatctgagtgtagctgagcacaatctgctgggcctcgacgcgggctttggcctgctgtacggcagcggcggcgacgtcgcgctgcatccgggccgtatcgacgtcgttgcggctgatggagtgattgttgataagccgctcgtagcgagtgagcaactgctgcgactgacgtaatgaggcttcggcgcttttcagctcggcctgcgccagagccagcgccgcgcggggctgcgcgtcgtcgagggtaaacagcaggtcgccttcggtaacatactgcccgtcctggaagtggcgctgaacaatcaccccttcggcgcgcgcgcgaatgtcgacggcgcggatcgcctcgacccgcccggggatagcgcgttcttcagcatgaggagccagttcaaccgtggcgacgcggaccggcaccgccggcgcggcggtcgccgtcagggcgccgccgaccagaccgcaggccagcagagcaaagcggaaggttttaatcatagaggatccttgcgacagtaacgcgcgcctgcagcgaggcgcgcgagattgttcaggccgttttgcggaaccggcgcgtcagacgcttctcgacttccaccaccaggaacatggcgacgccgatgaccagagtgacaaaccagtagcgcagcggcagcgcttccgtaccaaacatgctctgcatcagcgggacatagataatgaccagctgcatcagcagcaggacgccggtcaccagccagatgcctttgttgcgcagcagacccatgctcagggagaagctgtcgctgctgcggcagttgatcatgtagacccactgcgccgtcaccagcatctgcagcagcacggtgcggataaactccggactgtggccgcgcggcgccagccaggcctcaaggataaaggcggcaatcgcgatcatcgacccgacgaaagccactcgccacacggcgaaaccatccatcacatgctggccggttttacgcggcggacggttcatcacgttgcgctctgcggcctcaaaggccaggccgaaggagagcgtcgccgacgtcgccatgttcatccacaggatcagcaccggggtcagcggaataatgttccccgccagcagggcgatgatgatcagcagcccctgcgccaggttggtcggcatgatgaagaggatggtcttcttcaggttgtcatagacccgacggccctcttttaccgagctggcgatggtggcgaagttatcatcggtcaacaccatgtcggccgcctctttggtgacttcggtgcctttgatacccatggcgatacccacgtcggcctggcgcagcgccggcgcgtcgttaacgccgtcgccggtcatgccgaccacttcgccgttatcctgcagggctttaaccaggcgcagcttatgctccgggctggtacgggcaaagatgtcgtactccaccgccgccttcgccagcgccgcatcgtccatgtgctccagctggtagccggtcatggcctggctgctgttggtgatccccagcatctggccgatgctcatcgccgtctgcgggtggtcgccggtgatcattttcacgcggatgccggcggtctggcaggcgtggatggcgtcaatggcttccggacgcgggggatccatcatcccggcgatgccgaggaaaatcagtccctcctgcaggtcctcatggttgagggtggtggcatcaaggctggccggcttacaggccgccgccaccatccgcagtccctgacgggcgaagcgcgccatctcctcttcccagtactgcgcctcgaacggcaccgcgccgtggcggctcatctgctcgcggcacatggcgaagataacgtccggcgcaccggtgatcagcacccgggcatcgccatcgatgtgctgcagggtcgacatatatttgtactgcgagtcaaaggggatcttggccaccagacgggcctccaccgccgggagctgcgctttcgccgccagcactttaagcgccccttcggtcggcccgccggtgatcccccacagaccgcgctcatcctgggtaagctggctgtcgttacacaggtcgatggtgcgcagccaggtctccagcacggtgccgggctgaacctgcacgggctcatcgctcccctcgaggaagatccgcccctgcggctcgtagctgtcgccttccacccgatagcagcagtcggcggtgatgatcgctttgacggtcatttcgttcatcgtcagggtgccggttttatccgagcagaccacggtcatggcgccgagggtttccacggtcggcagcttacgaataatcgcccgcttgcgcgccatcgtctgcacgccgagcgacagaataatcgagatgatcgccggcagtccttccggtaccgcggctaccgccaggctaatcagcgacagcagcagctcgcccatcgggatatcccgcagcgcgaggctgaagataaacagcgccaccatcatggcgagaataatggcgaaaatcgctttgccgagcttatccatctgcaccagcagcggggtacggtgcttctcaatacccgccatcatctggttgatatggccgagttcggtctgcgcgccggtggcggtcaccacgccgacgccgccgccggcgctgacggtggtcccggaaaagaccatgttcacccggtcgcccagcggcagatcgccctccagcgcgtcggtgattttatccaccaccgtcgactcgccggtgaggatcgcctcttccacccgcaggttgtgggtttcaatcaggcgcatatccgccggcacgcggtcgccggcgcgcaggataacgatatcccccggaaccaggtcgcgcgtcgggatagtctcatgcttgccgttacgctggacgcgggcatcgctggagagcatgttgcggatcccctgcagcgatttttcggcgttgctctcctggatatgaccgatcagggcgttaatcaccgtcacgccgaggatcaccaaggtatcgacccagtgccccatgatggcggtcagcgccgcggcggccagcagcacgtaaatcagtacgtcgttaaagtgggcgagaaagcgcagccagcccggtttgcctttcttttccggcagcgcgttcggcccacaggtattcaggcgctcggcggcgtctgcggaacttaacccagcggcctggcttttggtctgcgccagcactgcgtcaacggtctgctgccagacctgccgtggcgcggtgtcgcccgagggcgtcgtaaactttgggttattcatcttggtcaatttacattttccttataaattccgtgagtcggaaagcctgaaatcattcctggccaatgaagtaaaagagggcaaaaatgccgataaaaatgtgaaccaatacaagtctaaatttttcgcaaaataaaaattttgtgataagttaattccacaaaccaactattacagaatattaataaaccaaaactaaacgaggtaaaatatgtttggaatctaccgcgggcgccgactggcgctgtacatcgcgctagccattatcattgctacgctggtgggatatagcacttacagttttgtaaaagcgctggcataataatgacgttaatttacacccggctgcaattaacttaattacaaattatttcagattaattaacatgagagcgaaaggcaggcgataatatttaaaatagtcgtgttatagcgagtaaaaaaacaaagcatattgcgttaagcattattttaccggacaatatgtttttttaactgatgattaacatgacatgaaacatccactggaaacgctgctctccgccgccgggatcttactgctggccctgctctcctgtctgctgttgcccgcgccttcgctgggcctgacgctggcgcaaaagctggttgagacattccatatgatggatctcaaccagctctatacggtgctgttttgtctgtggttcttagcgctgggcgccattgagtatctggtgctgcgctgggtgtggcgtcgctggttttccctcgagcggtaaaccaggagaggcgcgcctcagtgggcgcgactgtggttctctttgcggtaggcgcccggcggctgattgaaggtccgggtgaagacgcgggtaaaggtctgttgcgaatcgaagccatacttcaggcagatatcgtagacccgctgatcggtgtcgcgcaaatcgcgggcggccagcagcagcttcctttcgcgaatatagcgccccaggctctcccctttgtactgtaaaaacagccgttgcagatgccatttcgaatacccggcatggcgagcgatatcatcaatacgcagcggttgatgcaggttatcatcaatccactcgacgatagtatcaatcacctgagcggaaatcgtcatatgctctctcctctgatactgcactggcgcttagcgccaccaggcgttaaatgattgcgtcttatcggcgacccacaccggctcgccctgcacaggcgtcagcagacgccaggcccttccttcgctggcagccgccagccgttgatacggttcatcccagctgtgtttcgccaaaacgaatcgtcctgcatgcccaggcagcaccgcgcgagcgcgcagatcgtcggcagcctgagccgtttcatccggcatcatgtggatatatttccagtcctggtcatactgcccgttctccatgatcgccagatcgaccggaccgaactcatcgcctatcgctttaaagtgcggcccatacccgctgtcgccgctgtaataaatcttttgctgccgggtaacgaacagaaaactggcccacagcgtctggttacgcttcagcccgcggccggaaaagtgccgcgccggcagcacgtggacggtgagctcgtcgctggccggtaccgcctgctgccagtccgcttcggtaatcagcgccccgtccattccccagtagcgcagatgcgatccgacccccagcggcgtaatgacccgcttaattttcggcagtaaggcgcgaatggtggcgtaatccagatggtcgtagtgatcgtgggagatgatcagcagatcgatctccggcatcccttccgcccgccacggatagtcgccggggaaggctttattgataaaggagaacggcgccgcgtaatcgctgaacaccgggtcgatcaggatgcgttttcccgccagctgcaggtaccaggaggagtggccgagccagaccatcacgtcctgcccgaggggcagcgtcgccagatcggtcttcaccagcggcagcggttgcgcgggacgggcgttttcccgtttggtcatcaggaaatcccaccacgccgccagcatatttttctgcccggtgaaccctggcgtgggcaattggttatggaactggccgtcccggtagtggggagacgcttccacctggctaagctgtgctccctgcggcgccttaccaaaaccggcattaagaacaaacggcaatgtcgttgctgctgcgagtaacatgatggcgaccacgctgaaagtgacacggttcatatcctgaccagacaaaagcccccatcccggaggctttatgatataacttgattatgagtgagtacgcactcattattaggaaagcgatgaaagtcgtcaagacgattttcaatttttgcgttccgccgttgcagcgacctggtcagacgtgccaagatcggcggtttgtttaaacctgcgtgaggaaaaaagtagtggctcgtccaaagagtgaagataaaaagcaagcgttactggaagctgccaccgcggctttcgcccagtccggcatagccgcctcgacgtcggccatcgcccgcagcgccggtgtggccgagggaacgctgtttcgctatttcgccaccaaggatgagttgctcaacgagctgtacctcgcgattaagctgcgcctggtgcgcacaatgatcgccgggctggatccggacgagaagcgcccgaaagagaacgcgcgcaatatctggaacagctatatcgactggggcgtgcgcaacccgatggagcacaaagcgatccgccggatggcgctcagcgagcgcatcaccgacgaaacccgccgccaggtaaaagagagctttccggagctcaacgaaatgtgccagctgtcggtgaaagagatattcctcagcgaggcgtaccgcgcctttggcgacgccctgtttctgtcgctggcggaaaccaccatcgaattcgccagccacgatccgcagcgcgcccgggagattatcgccctcggctttgaagccatgtggcacgccctgcatgaggcggacgcctaatgacgccggaaacactgcatccctgcgctcaccgtatcgccctgagctacccgtttaccgaacactgctggccctttgggccagagtacgacgtgtttaaggtcgacggccgcatctttatgatcaccatgactattcgcgggcgggcgctggttaatctcaaggccgagccgcagaagtcgctgctgaatcagcaaatttatcgcagtatcgaacccggctaccatatgaacaagaaacactggatcacggtggtgccaggagaggatatcagcgaggatctgctggccgagctgattgacgattcgtggcatcaggtggtgaacaagctgagtaaaaaggcgcagcagcgcctgcgtccgcgctgattttcagccaaatgcgataagtgttatcgcatttttcacccttatcattttgcgatcttcgctgtactcttcctctcctgaacgcaccggtaaggtgctgtaaactgtgaggaagagttatggatatcgtatcggtcgctttgaagcgctattccaccaaggcctttgacgccacgaaaaagctgactgccggggaagcggaacagctgaaaacgctgctgcagtacagcccgtctagcaccaactcccagccgtggcactttattgtcgccagcaccgatgaagggaaagctcgcgtggcgaaagccgccagcggcacctacgtgttcaacgaacgtaaaattctcgacgcctcgcacgtggtggtgttctgcgcgaaaaccgcgatggacgacgcctggctgcagcgcgtggtggatcaggaagaggccgatggccgtttcgccaccccggacgcaaaagccgctaaccacaagggtcgcaccttctttgccgatatgcaccgcaaagagctgaaagatgacgatcagtggatggcgaaacaggtgtatctcaacgtcggcaatttcctgctgggcgtagcggcgatgggtctcgacgccgtgccgattgaaggggtcgattttgcgatcctcgatgaggaatttgacctgaaagcccagggctacaccagcctggtggtagtcccggtcggccaccatagcgtagaagatttcaacgctaccctgccgaagtcgcgtctgccgcagtcgacgaccattaccgagatttaattcccttctgccgggaacgcccgggccatggcgcagcagcgtctcgcccgggacttttttcatccactctttcccccctctttttctgccgtttgtgccaagtttctggcgctcataagcccgcttgtgccaggaataacgactttagtgtgaaccagacgatttaattaattgataaataatattttttatttctggcacgccctttgctcttaacagataccgctatctggatgaaggagaaaccgggtgaaacatatctatgtggccagccacggccattttgctcgcggactggtgaacagtttgtcgctgctgattggcgacgaacacggcgttatcccggtctgcgcctatgacgaagatatcgtgaccaccgaacagctggagcaaaccctggagcatctcatcgtccaggcgaatggtgatgaagtggtgatcttcaccgacctgcttggcggcagtatcaacaatagcgccgtgagcgtcttgatgcgacatcgcaacgttttcgtggtcgccggcatcaatctgactctgctgctggagtttctgctgtgcgaagaagccactaccgaggccgcgattatctacgccaccagcgcggcgcgtgaatccattgttttcatcaatcctctaataacacaaccatcctctgacccacagggagaatctcatgattaaactcgtgcgcattgattatcggctgctgcacggccaggtggtttttgcctggacccgagcgctggatatcgaccatatcatcgtcgccaacgccaaagccgcggcggatgccttcattacgatgtcgcttaacctggcaaagccagcgggcgtcacgctggacatcgccaccgttgaacaggcggcggaaaagcttaacagcggcaagttggatcataaaaaagtcatggtggtcctgggcaatactgcggaaaccctcgcgctagtggaaaaagtcccaggaattagcgcaattaattacggcggtctgccacagaaggaaggggcaagacaattcggcaaggccatctatctgaccgaagaggaaatcgcccatagcagagtgctaaaagaaaaaggtattcggctggagatgcgtcaggtacccgcccactcggctgaactccttaacgaccaactttaacttcggaggtcactatgttgctcaccgcaacgttactcggactgatcgctgccctggggatacttgatggtcgcctgcttggggtatcaatgatcgatcgaccgctggtgatgtgcgccctcaccggtctggtctgcggtaatttacatgaggggattctgattggcgctacgctggagcttattttcctcggcaacgtcgccatcggcgccgcgcacccgccagatatcgtgaccggttccgtattggccaccgcgttttcgatcatgtccggtcgtggtccagaggctgcgctcaccatcgccatccctgtctcaatgctggcgcagacgctgggaatcctggtgcgcgtggtgaacgcccgctttggtcatctggcggaccgctatgcggcacagggtaatacccgaatgatcggcctgatgcacctcgccggtccgacgctactctattttttaaacggatttctaccggtattttttgccattctgcttggttcttcggcggtaagctggttcctggaggccattccgccggtgataaccaatggattgatcgtcgccagtaagatcctgccagcgctcggcttcgccctgctgatcagcatgatgctcagcagcaaactgatgccgtacctcggtctgggatttctgatagcggcatataccaaactggatatcatcgccatcgcgctgttcgctgtggtgttggcatttatcatcagccagttccttaatcttaagcagcaggagagctaatcatgagcgaaatgacgcaaactgtgactggcgctacccagccgcaaagcgatgatgcaagccgcatcaccgcccgcgatttacgcagcgtgttctggcgctcctttacgctacagggctcctggaactacgagcgccagcagcatatgggctatgccttcgcaatgtcgccagccctgaagcgcatctatcaggacccaacggagctggggcgcgccctgcagcgtcatctggtgctgtttaacaccacgccccatctctcgacctttatcttcggcctgtcgattgccatggaagaagagaaccagcgtaaccccgaatttaatgaggagtcgataaacgcgattaaaaccagcctgatggggccgctggcgggcatcggcgactccatattctggggatcattaaaggttatcgccgccgggatgggtatctatttcgcccagcagggcagcctgctgggaccgatactggcgctgttagtttataacctgccgcatcttttgtgccgctggtatggcctgaagctcggctaccgggcgggtacgacctggctgatgagaatttaccaaagcggccttatggaccgggtgacctatatcgcatcaattgttggcctcatggtcgtcggcgcgatgaccgccagcatgatagatatcaccaccccgctcagctttaccgccgggcagaccaccatgaaggcgcaggagtttattgacaaaatacttccttcgctgctgccgctgcttttcacccttgggatgtacaagttgatccgcaagggagtcaatattaactggatcctgctaggaaccgtcgcgtttggcatggcggccagcgcgctaggcctgctttaagaagaggaatatcacccatgcacgtagaagactatatgaatgaaacacccgcctgtctgctcgctatgctgacgcagacgcgggaagatctatggcaggcggcaaaagcgctaacggagcgcggcgtcacgcgtattatcctgaccggctccggtacctcttatcacggcgcgctgaccgcccgctcgtttatgcagcagtggtgcgggctacccgttgatgtctactggccttttctgctggatgattcggcgctgaccctcagcgacaaagcgctggtcatcggcatttctcagggaggcggcagcctctctaccctcgccgcaatggaacgcgcccgggcagccgggcatcttaccgcttccatggccggggaagcgccagccgttatcgaccgggcggcagatttggtcttaacagtaccctgtggagaagagcgggctggcgccaaaaccaaagggtatcactgcaccatacttaatctgatgctgctggggcttgctgtcgccagtcgccagcggcgcctgagcgatgaggagcgcaaggcgctactcgtccgcatggataccacgtttaatcatttgcctacgctcattgaggcctcgcaggcgtgggttctcaatcatgcccgaccgcttatcgacagcgcggacattcgcctgaccggtccggcaaggctgtttggcaccgttcaggaaggtgcgctaaagatgcttgaaacgctacgctgtccggttgccggttacgaatttgaggagttcatccacgggatctataacgccttcgacgagcgctctaccctgatcatgctcgatccgtttcccgatgagcgtcaggatcgcctggcggaaatacttggcggctggactcagcatatttatcgcattggtccacaagtcgaaaataacggcaaaaatatgcccttcgcatttattaacgatcccgactttgcggtctttgaatatattattccgttacaaatggtttgtgcccgactgccgccagtgaagggcatcgatcccgcaataccgaaggatccgcatttccaccagaaaatgaaaagtaaacaactcaattaattgacgcatagtaaaagttatccgcgtttcagcggaggacccgttacatcccaaggagaccaatatgtctatagctcatcaaaacgcacatactattattcgcgatattttatctaagcagcacattgagcgcgtatggtttgttggctgcggtggttcattaaccggtttctggccggggaaatattttctcgattgtgaagctaaaaagctggccgtcggctatgttaccagtaatgaatttgtccatgcgacgccgaacgcgttaggtaaaaacagcgtagtgatcctcgcctcgcagcagggcaacaccgctgaaacggtggaagccgcccgcatcgcgcgtcagaaaggcgccgccactattggactggtatatacccccggcacgccgctgtgcgaacacagcgattacactattgaatactgctgggcgcgctatcccgaaaccgtcgatccgacgcagcaaaaagcggcatacagcctgtggctggcgctggaagtgcttgcgcaaactgagggatacgcccattacgatgagatggtcagcgcctttgccagttttgaatccgtggtacgcggcgctcagcagcaggttcaggcggatgcgcgccattttgccgaagcctggaagaccgaaaaggtcatctacatgatgggcagcggcccctcattcggcgccgcgcatcaggaatccatctgtattctgttggagatgcagtggattaactccgccagcatccacagcggcgagtatttccacggcccctttgagattaccgaaacgggaacgccgtttattttattaaaaagcagcggccgcacccgcccgctggatgatcgcgcgatccgctttatcgaacgttaccagggaaaactgcagattattgacgtggaaaaggtgggaatcgacgcactgcacgccagcgtgcgcgaatatttctgcggcctgctgcacaactgcgtactggatgtttacaacctggcgctggccaccgctcgcaaccacccgctgaccacccgccgctatatgtggaaagtcgaatattgattcgctaaccgcctgccagccccggcgtaattctccggggctgcgttgaggattaccagctaaaatcttcaatacgtaattcaaaaatatcgtgaatatagccaatttccgctaccggtagcgccacgttatagagtattttcaggcgctggaacgagtgattcaccatggcaataaattcaccatgctggcgggtaaattgctcaagatctttataatggctaatttcattacgcattaccagacgctcaatcatacagctgagatgcacatataaactgataattaagttattattaaaatgaaaaccaagcgtattttgccactcagcgataatggtttcgatatggcccatggtttttccagcattcagtatcgtcagagagttgacaacgttatgcagtgaaaactcacgaaccatatttttattaatcagcgcaatttgcttttcattaagatagccgcttaagagctgactcagatgtcgatgcccctgctcgccaagtagttcctcaatgccaacccaaggcactccggccagctgcgggtcgtgggtacccacgaccgcaataacttcatactggtggagcaacgataccgccgtacgactgttttttaagcgcgtatactcgcaggcgatgatgttaatatcaaaatcgttgagcaggctcttctccatcagatttttaaatttaaatgcggtaccgatacctgtaatacaggtcaccagcagcacacgctcttttttttctgcgggccagaacacatcccaacgcgactgattaagcggcacgatctcttcggcgatttgttcgatgttttttcccaacgcgatctcgctggcaacgttcagcgccatgcgggtcgtgacgttatccaccactaccagcgggccgttaatcaccgacaaaagcgcatcggcaatctccttggtgtagcccatatcaataagcaccatcacacccgcacgcgtgtccgtatgctggagataatcaaccacggcgcgactgacatcgttaaacgccacctccatcggcatatccatggcctggtagatcttctcgccaatcaggcggttggcaacgccggcaatgctgctggcggtcgaataaccgtgggcgattatcagcgctttcacttttccgccgctggtcgcatcgatagcattactgacaatggcggtaatcgccagacggtcaagcgtatcgatgagcagatcgtatttattattgacgacatccagtagtttctccgcgatgcgttgcgccagccccgccgaggagtccagccagcgctgcatcaccagacgcacgggctcagcaacgctgcgcggcgccagagggaggctggtgaggtagcggccggtaagataagcgaattcgacatttagctgaaggtcataattgacagcgattgctttgcccacatcttcaataaagcgcagccgtttgtcctgcagagagaccgtactctcctgattcatcagcgcatcaagatagagcgtcacgttctgataaataagcttttcaaaggtccgcacgctaatattatcctgagccaactcctcgcacaggctacaaatattttccgttagccgttggtattcatggtgacgaccagaaaaaagaggctgcgcgtcgccatcgcggtaaatcataacccgctcgctattttgctgaagggtaaaaggcgcatccgccagtaatcggtcgggcagcaaacccgcttttatatgtaaaagaccgctatcacgttcgccaaatgtccaggcgctggcgcaaatattgcgaatcaaattttccagcccaccgacatttccttcaagcgtttcacgcattagctggctgacgatttcgccatccagctccagatcgtggttcaaacgctgggcttcacggcggaaaaagtggtggataaacgccagccgctcgaattggccgcgttcagcgatcggcagaatttttacaatcaccggaatacggcgaataaaggtcgccaggaagtgtttttccagatcctcggttgaagcaaaaattagccgcaccgtggcgctgcgctcgtcggcgctctcccccagccggcgccagctaccgttatccataaaatgaaacaacttttcctggccttcgggcggcagccgatgaacctcatcgataaacaacaccccgccgttgctggtctcgataagaccaggaacggccttatcggcgccggtaaaggcccccttcgcatgaccaaataacttcgaggtcagtagttctggattattcgcgtactcggcgcagttaaatacggtaaaaggcgcatcggcaggtaaaataccttcatctattgcgtagtgccagagctggcgagctagaaaacttttcccggtgccagtagggccccgcagcagcagcggcagacctgcgccagggtagctgatggcagccttgcactggcgcaatgcttcctgcaggctgccctgcgcgccaatcagctgcgccagactatcctgacgatccgcgcacagcgcctgaatggaggcgtattcgccgtgccgaaccgccaggcggtgatgatcgcgcagaacggtaacgggtaaaaacagcaccgggcgaccgttcactttgaccacccgctgctcgcgatggagattattcagatgatggctgatgatgctgcgtttttgcttcaagctatcggcgatggccatagcgttaaactcgcccagcgcttccgccgtcagcgctcgcccggcgatccgttgttctagttggcgaaaaatcgactccttattcatctcgctcccctgtcaaaagcgtaaaattcgcttatacgacaattcgcgcaggacgtcgctgccgccagccacacttctttaaaaacgcttaatttttcatggcttaacgttccccgcatgccagatgcgctcggcatagcggccaatcaccgccagcgagacggcaaggatcaggaaaaacagcactttgtgcatcccgttccagaaaaactcaaagaaacgggtatagagattgatcgccaggaaggttagtccgaagccgcgcagcattccgtcatcggttttcaggctgataaaaatgcagacgccggccgctacggcaaacagcagcccccacggcaggagtcgcgcctggctcacctggtaccagttgtctgcgtcgtaattgccgaaaatcgacatgatccacagcgcaataaacaggtacgtgaggcccatcgccttgctgacggtaaacagctgccgctggcgaagcagggattgcgcgccgtagcagagcgccagcagcgcgccgccgaacaggacgaagcgaatcgggtagttcatgcccagccagtaggcgccccaccccgagacgtagccggtttccgcgccgaaccagttgcccagcgccagcagaaaaaagagccacaccagcccggagcgggcaatatagccgatggcgccgtaaatcacgcatccggccagaaacagcggtgcgatatggccgctgccgttatccagccgttcgccaagctgccatagcgccacggcggtaaagacgacgcccagaaacaaaatcgcctcggtgctgtagtgccactgcgtctcccgccgctggcgacgaaaaccccagccgtagcaggcgactgccagcagcgcaggcagcaggatccgcatcagcgccgagtggctgaacaggctcagcagccacgccaccagctcgctgtcggcgaacagactgcccagggaaatcagcacgcaggccagcgcggtccagaaggcatagcggctcaggcgccgccagtcgaagggggagacgcgcatcgtttgcgccagccgctggctgtccgaggggattaactccccgctggcctgccaggcattcagcgcgcgctgaataatgcgctgctcttttcgggttacgttcataggcattccttgggactgatgacaaacctgttttcgctaatatgctcgcctttctgccgggcagcggctgtcgccctccccggcctacttaaccatttatatatcagattgttactccttaccgtaagcccgcgtaagcgcagcgccgccgagcatgatatcaggcacggagccgctttattgccgggtggcggctggcgccttacccggcctacggtccgcagcagccagccgttaacttacccactagtgcgactgaaactgccgctgttgcggcctcaacatcgctgagacgttcccggaaggccggggcagcccgcatggatgcgggctgagggccgtgttttgcacggacgctgcctcggcccgacccgaagcctgcagggataagtcga

SEQ ID NO: 59 - DNA, 295055 bp, Unknown
  source: /note="Description of Unknown: KP2-Mcoc1 Bacteria Sequence"
tttgcctggcggcactagcgcggtggtcccacctgaccccatgccgaactcagaagtgaaacgccgtagcgccgatggtagtgtggggtctccccatgtgagagtagggaactgccaggcatcaaatttagcgtgctgatatggctcagttggtagagcgcacccttggtaagggtgaggtccccagttcgactctgggtatcagcaccactttttaggttaaagttcggcacgttgtaaagaatttgcctggcgacaatagcgcggcggtcccacctgaccccatgccgaactcagaagtgaaacgtcgtagcgccgatggtagtgtggggtctccccatgtgagagtagggaatcgccaggcatcaaataaagcaaaaggcccagtcgaaagactgggccttttgcttttgtgttatctgttgtttgccgatgagcttctttgctgcccagggaaaatctaactggcatcgatatgaacattgcgcagcaacggcccggagagagggaaaggacgttcgccatcattgctcaccatcagagtaaaggcccgctcttcgaccgggcctttggtgtttgttggttctgaaccctgaatctgaaaagtttgccgatagcgatggacgactcattgccagcggtctctggcaacaacaacggctaagaaagctggcgaactatcgtcaggaagagcctgaatgatcgcttactttggggaatggagtggagcagatacaggggatacacctgtatctgcggttggggaagcgatctagcgggtcagagcaacgatccctaacgtgaggccggctaccgcggccgcacccccggcgattgcgcctgcggtttcccagttgtcttctgttgtgcctttcatacaggtattggtatggactaagcggccttgcgagtcataaaccggtacgcagggagagtcatgggcacagcctgccagcagagaggccagcagcgccacgattaaatactttttcatgatattacctctggataatccgctgggttgtactgaaagccagtgcagaacggaatggcttattttatcaccgcggattgtccgggccggaggccgaaatcatctcaatatatgagccgcgtaaatatcgtgaagataagcccgggaatatgcagaaaagatggagagaaagattgtgattcagcgatgctgcgtgcgatggcggttgccagactgtggcgcgtttagctggctgccaatattgcatgcgaaaaaaagcgcccgcaaggggcgccttcaagacatagccgagttattcagcgtgccgggtaaagcgtcgtctaacgaccacgaagaacaccggaacaaagaagattgccagcagcgtcgcggtcagcatcccgcccatcacgccggtgccaaccgcattctgcgccccgctgccggcaccatggctaatcaccagcggcatgaccccgagaataaaggccagagaggtcatcagaataggccgcaggcgcatccgcgatgcctccagcgtggcctcaatgatccctttcccttctttctccatcagatccttggcgaactcgacgatcaggatcgcattcttggccgacaaaccgatcgtggtcaagagtccgacctggaagtaaacgtcattatttagcccacgcagcgtggcggctaacagcgcgccaatgacccccagcggaaccactaacatgactgagaaggggatcgaccagctctcatacagcgccgccagacacaggaagacgacgatcagcgagatggcatagagcgcaggcgcctggttgccggagagccgttcctggtaagacatcccggtccagtcataaccgatgccgctcggcagtttactggccagcgtttccatcagcgccatggcttccccggtacttttgcctggcgaagcttcaccgaggatctccatagatggcaacccgttgtagcgctccaggcgcggcgagccatatatccagcgtgaagtgacaaaggtggagaacggcaccatttcgccgttggcgctacgaacatacatgttgttaatgtcgctcggcagcatacggaagtgggcatcagcctgaacgtacacttttttcacgcggccgcggtcaataaagtcattgacgtagtatccgcccagcgcggctgatatcgtttcattgatatcggagagcgatacgcccagcgcctgcgctttttcctgatcgacatccagtttgaactgaggggtatcttcaagcccattagggcgtacccgaaccagctgatccggatgctgtttcaccatgcccagcagttgattgcgcgcctgggtcagagcggtatgaccgagtccgccctggtcgatcagttcaaagtcgaagccggtggcggtacccagctcaataatggctggcatgttgaacgggaaaaccatggcgtctttgatctggctaaaggctacggtggcccgcttgatgatggactccacgctgttttcatcgccgctgcgcgcttcccagggcttcaggctgacaaacgccataccggagttttgtccctggccgctgaagctgaagccgttaacggtaaagacgctttcgacgttggccttctcgttatgcaggtagtagtctgtcaccgtatccaggaccttctgcgtgcgctcctgggtagcaccggacggcagctggatcatggtcaggaagacgccctggtcttcgtcgggcagaaaggacgtgggcaagcgcatgaacagcacggccatccccacgacgatcagcaggtagatcaccagataacggccagttccacgtaaaataccgctgacgctgttggtatagtggttaacgctctggtcgaagcgggcgttaaaccagccgaaaaatccttttttctcatggtgttcagctgaggctggcttcaacaacgtggcgcagagcgccggagtcagtaccagcgcaaccagcacggagagcgccatggcggagacgatggtgattgaaaactgacgataaatcgcgccggttgagccgccgaaaaaggccatcgggacaaatactgcggagagcaccatggcgatacccaccagcgctccctggatctgcgacatagatttttccgtcgcttcttttggcgagagcttctcctcaaccatcacacgttcgacgttttccactactacgatagcgtcatcgaccagcagacctatcgccaacaccatgccaaacattgtcagcgtgttgatggagtagccaaacatcgacaataccgcgaaggttcccaacagcaccacgggtacggcaatggttggaatgagcgttgcgcgcatgttctgcaggaacagatacatgacaagaaagacgagaataattgcttcaaaaagcgttttgaccacttcgtgaatggagattttgacgaaaggggtcgtatcatacggataaaccaccttcatcccctgagggaagtagggctgcagctcggccagcttcgctttaatcgcggtggcggtatccagggcgttggcgccggtcgcaagcttaatacccagaccagaggcaggtttaccgttaattctggcgacaacgttatagttctctccccccagctcaatgcgggcgacgtctttcagatggacgacagagccatcggcgttgacccgcagcgtgaccttgccaaactcctgcggatctttgagccgcgtctgagcgatgattgacgcgttcaactgctggcctttcagcgctggcgtaccgccgagctgacccgcggcgatctgatcgttctggacctgcagcgcattgatgacgtccaccggcgtcaggttgtatttattcagcaggttgccatccagccagacgcgcatagcgtactgcgcgccgaacagctgcacatcgcccacgccgttgaggcggctaataggatctttgacattggaggcaacatagtcagaaatatcgtcctgggtggtggtcgggttatcagagataaagccggcgaccaacaggaagctgctactggatttctcgacgctaatcccttgctgctgtacttcctggggcagcagcggcgtggccagctgcagtttgttttgcacctgtacctgggcaatatcgggatcggtacccgatttaaaggtgagcgtaatggttaccgaaccggcagagtcgctggtcgacgacatatacatcaggttgtcgatgccgttcatattctgctcgataacctgggtgacggtatcctgtacggtctgggcatctgcaccggggtaggtggcggagatcgcgaccgcaggaggggcgattgtcgggtactgagctatcggcagctgcaggatggccaggccgccggcaatcatcataatgatggccagcacccaggcgaagaccggtcgatgaataaaaaacttagacatggctgggtatccttattgcacggccggcgccgcacgctccgcttccgctttgacagtgacgcctggacggactttctgtaagccgctgacaatcactttatcgcccggcttcagcccactggtgataagccacttatcgccaacggcctgagtcgcgaccacttcccgggtttcaacctggtttttgtcattcaccagcatcacggaggcatcaccacgcggcgtgcgggtcaccccttgctgcggtaccaggatagcctgcggatcgacgccttcgtctatgcgggcgcggacgaacatccctggcagcaggacatgctgcgggttagggaagatagcgcgcagagtaattgagcccgtactttcatcaacagtgacgtcagaaaactgcagtgaacctttgagcggataggcctggccgttctccatgaccagctcaacgcttttagtatcaccgccgcgctgcaggctttcctgcttaaggcgcatgaagtcattactggactccgtcacgtcaacatagatgggatcgagctgctggacggtagccagggcatccgattggccgttggtgaccagcgccccttcggtgacgctcgatttaccgatgcgcccgctaatgggggaggttactttggtgtaggccaggttgatacgggccgtttctacggcagctttggtggcgatgacatcggcatcggcctggcgggcggtggccactgcctgatcgtattcctgctggctgatatatttagtacccagcagtggaacgtagcgtttcaccgtcaaatgggcgatagcggccgcggcttcggctttggcctcatcgcctttggcgctgttccacgccgcctggtaggtcgccggatcgatctgatagagcgactggcctgcttcgacatcacttccttcaacaaagttacgcttcagaatgataccgctcacctgggggcggacttccgctacgcgaaaagcagaggttcggcccggcagttcggtggtgactgatagcggcgcgctgttcacgacatggaccgtcacctgcggcgcctgcgcatggggttgctggttgtcagaattatcgcaaccggttagcaataaggccgagataattaaaccggataaaagtgtcactctggcgtgagtcgtcatggcggttccttatagattacgtacccaatcaggcggcgaatctgtgaaagaaagagggaatcaaaaagcagtttgccatcctacaaataaacgccgttggatgtaagagatacttatttttaagcaatcagcaaggcacgcaaaaacaaaaaaatggtcactgtagtattgcgatttatcgcaattgtaaaagttgataaatagacattatttcagtgaatgtattttccggtgatattcacttgaataattaattctcttttcgcatcaggattaacttgtctgcatttttgctaaataatacttcatggcaaatgctagattaattctaattaagaatatcctatatgatctgcttatcgggaagtggggccttgtatggcaagaaaaacaaaagaagaggcgcagcgcacgcggcagctcctgattgagtccgcaatccagcagttcgccctgcgcggagtaaccaacaccaccctgacggatatcgccgatgcggcgggagtgactcgcggcgcggtgtactggcattttgccagtaagacggagctgtttaatgaaatgtggcagcagcagccgccgcttagagatttgattcagcccagtcaggccatagagtacgaacatgagccgctaaatgctttacgcgagcggtttattgcaggcctgcgctatattgctgcgaatcctcgacagcgcgctctgatgcaaattctttatcagcgctgtgagttttccagtgatatgctttcggaatacgaaattcgccaacgtattggttttaattattcactcattggcggcatcctgcagtgctgcgtgcgtaacaatatattgccagccgaaacaaacattgagatgatattaattgttttacacagtgctttttccgggctgattaaaaactggctgctcgatccgcaacgcttcgatctttatcagcaggcgcctgcgctggtggataatataatggcggtggtctgtgctgcgcgtttatcgggagggcctgcgctacggctggtgaatcagtaatgaggtctgttggcgcagataataaaaaaggcgcttccccatgccgaagagcgccttttatatcaagcaagcaactgactagtatcagttcatgccgtattttttcagttttttacgcagcgtaccgcggttgatgcccatcatcagagcagcgcgggtctggttaccacgggtgtattgcatcaccatgtccaacaggggctgttcaacttcagccagtaccagctcatacaggtcattcacatcctgaccgttcagttgagcaaaatagttcttcagtgcctgtttaaccgagtcacgcaggggcttttgagttacctgatcctgagagttaacggtagaaacggtcagtacgtcagaatttacgcgttgttcgaacatagttctgtcagctctttatttctattacgcaaaattttcgaagtatgcctccaacgcctccagctgttcgctggcatcctcaatggcgttgaatgtgcgccgaaactggtcatctggagcatgttcctgaagataccaggagacgtgtttacgcgcgattcggtacccttttgcctgaccataaaagtcatgcaactcccgaacgtgcgcacaaagcaagcgcttcacctctgccagcggcagcgggggcagcagctctccagtgtccagataatgctggatttcccgaaagatccagggtcttccctgagctgcacggcctatcatcagggcatcagcccctgtatagtcgagcacagctctggctttaagcgggtcagtaatgtcgccattcgcgataatcggaatggaaactttctgcttaactgcccgaatactgtcgtactcagcgtctccgttaaacaaacaggcgcgggtgcgtccgtgaatagtcagagcctgaatgccacactcttcggccagttgggcaatctctacgcagttacggtgttccggttcccaaccggtgcgaatcttgagagtcacaggaacgtccaccgcgttaacgaccgccgtcaggatcgacttcacctggtcggggtactgcaagagggctgaacctgcaagcttgcgattcacctttttcgccgggcatcccatattgatatcaataatctgggcgccgctttccacgttaatccgcgcggcggcagccatctcttccggcacgctaccggcgatttgcacggtacgaataccgggctcatcgatatgcaccatccgtaaacgggacttgtcgctctcccacacctgtgggttagaagacatcatctcggaaacggttaaacccgctcccatctcgtagcacagcgtccggaatggtctgtcagtaatgccagccatgggcgctgcgatcaggcgatttctgagctggtggtgtccgatgcgcatgagttaagaaatgaccatactgtgactgcaaggcggcgtatattacgcattttttgcacgagatgaaaggccaaactttgagcaatcctctgttgcagatcaatgaatccgggactagcgtaaaagggatgaataaatacttatattaatcattgatttaatggatgatggataatttgtgtccatttataaaatcataaaacttctcgatttttcttggataaactggccgcatggcgatataaaacgctgtttttgtagccaaaaaagtgctctgtagtgcgatctgcctctcatttcctggcattatttggtggctactggaaacaaaaatgcggcccgtaggccgcatcgcgcttagtttttccggccggtaatccggcaccactcttccttctcgaccaccgggtcaagggcgaagagatcggcataggcttcacagacgctctccgcctggctggcaaggatgccggaaagccccagcaaaccgcctgaaacgggcaggacgctgattaacggcgccagctcacgtaacgggcctgccaggatattcgcgaccaccacgtcggctttcatcgactccggttggtcctgaggaagatagagctccaggcgttcagaaacgccgttacgctgcgcgttatcacgactggcctgaatagcctgcgggtcgatatcaatcccgattgcttttgccgcccccagcttcagtgcggcaatcgccaggatgccggagccgcagccgaaatcaatcaccgtttttccgttgaggtcgagtccatccagccactgcagacacaaggatgtcgtcggatgcgtaccggtgccaaaggccagacccggatcgagcatcacgttgacggcattttcatccggaacatcgcgccagcttgggcagatccatagccgctccccgaagcgcatggggtggaagttatccatccattcccgttcccagtctttatcttccagttgctcgatcttatgcgcgaacccggcgcccagcagcggatgctgctccagttgggcaacgaccgctttcatatcggtttcagcatcgaacaggccgattacgtcggtatccccccacaggcgggtttccccgggcaatggctcaaataccggcgtatcgtgcgtatcctggaaggtgatcgagaccgatccggcctccatcagcgcatcgctaagatcttcagcgttcgcgccggtggtatttagtttcagttggatccatggcatagcaaaactctttatttatcagtagtcaaaatgggggactgtggggcgggacgaccgaaacggttccccgccacaaacgccagcaaactcagcagcagcgcgggaacgatcgggtgaaagcccagaaactgcactttcagcgtggccagtacggcatacaggacgccgcctacgatcatggcgctcagcgcgccagccgcgttggcgcgttcccagtaaaggcccagcaccagcggccacaggaagacggcttccaggccgccgaaggccagcaggttcagccagattatcatctccggcggccgccaggccgcgagcagcaacaagacccccagcaggagcgtgatgccggcggacatgcgtttaagccgcttttcgttagtcgcctgatccggccgccagttcaggtacagatctttgatgatcgtagcggaactttgcagaagttgggcattgatcgtcgacataatcgccgccatcggcgcggcaaggaagatcccggcggcaaagggcggaagcactttaaccatcagcgtcgggatcaccagatccggcacggttaaatcggggatcaccgcccggcctaatgccccagccagatgcatgccaaacatcaggatcgccaccacgatggtgccgataatgatgccgcgatgcacggctttgctgtctttgtaggagatacagcgcactgcggtatgtggcagaccaataacgccgaagcagaccagtacccaaaacgaggccataaaggttggcgagaggatatcctccgcgccctgcggggacaccagcttgacgtcgatcgactgcagcgtctctaccgcatggccaacccccccggcggcgtggatcacgcccaccagcagcacgatcgtgccgatcagcattaccatgccctgcatcgtgtcgttgagcacgctggcgcgaaagccgccataggcggtatacagcgcgatgctgaccccgaagatcagcaggccggtatcgtaaggaataccggcagccgtctccagcaggcgggcgccgccgataaactggacggtcatggcgccgacaaaggccaccagcagactcaggctggccagccagaccagcaggcgactctgatagcgcgcaaacagcatgtcattgagggtgacagcattatagcgacgcgcaaggatggcgaattttttccccagcacgcccagcgacagccagatggcggggagctggatcatcgccagcagcacccagcccaggccgtatttataggcggcgccgggtccgccgataaatgagctggcgctgatataggtggcggttagcgtcatggccagcacgaagccgcccatcgagcggctgccgagaaagtactcattaagaaagctacctgaggcgcgttttctcatggcgtagagggataaaccgaacaccaccaccaggtaggcgatcaggggaataatgacctcaaactgcatcatcgtcctccagagaaatatcgcggaaaatcagtttgaccatcgcccagcacagcagaatgaacagcagcggtaccagcaggcaggccatttcaaaccagtgtggcaggccggtaaagccaatagccacccccggcaaataggcggcggccagccaggcggcaaggtagagaagggtcagccacagcgcccagcgcgcttctttgtgggcctgaacaaagcgtttgtccattttttgtcccttgaggatgaagaaagcggggattgtaccgcatggtatagatgaggagagagaaaaagaaaaaaggccggtttacccggccttttgctgagagagcagaattatttttcctgcaagccgagttttttctccagatagtggatattggtgccaccatgctggaaattctcgtcgctcataatgcgcatctgcagatcgacgttggttttgatgccatcgatgatcagctcctgcagcgcattcttcatgcgggcaatcgccacgtcacggctttcgccgtagcagatcagtttaccgatcatggagtcatagtacggcggtacggtgtaaccggcgtaaatatgtgactcccagcgcacgccaaagccacccggcgcgtggaaacgggtgattttgcccgggctcggcaggaaggtgttcgggtcttcggcgttgatacggcattccaccgcatggccgcgaaccaccacttcatcctgcttgatagacagcggctggccggctgcgatacgcagctgctctttgatcaggtcaacgccggtgatcatttcagttaccggatgctctacctggatacgggtgttcatttcaatgaagtagaactcgccgttttcgaacaggaactcaaaggtacccgccccgcggtagccgatatccacacaggctttcgcgcaacgctcgccgatgtagcgacgcagttccggggtgatgcccggcgccggcgcttcttcgaccactttctgatgacggcgctgcatggagcagtcgcgttcagccagatagatcgcgttaccctgaccatccgccagcacctgaatttcaatgtggcgtgggttttccaggtatttctccatgtagaccatgtcgttgttgaaagccgctttggcttccgctttggtcatggagatggattgcgccagttcagcgtcgctacgtacaacgcgcataccgcgaccgccgccgccgccggaggctttgatgatcaccggatagccgatgcgtttggcatgggcgcggttagcgtccatgtcgtcgcccagcgggccatcagaacctggaacggtcggaacgccagctttcttcatggcggtgatggcggacactttgtcgcccatcaggcggatagtgtcggctttcgggccgatgaagatgaaaccggaacgctcaacctgctcagcaaaattagcgttctcagagaggaagccataacccgggtgaatcgctaccgcgccagtgatctcagcggcgctgataatggccggaatgttcagatagctttttacggacggagccggaccgatgcagaccgtctcatccgctaacaatacgtgttttagatcgcgatccgcagtggagtgcacagcgacagtcttgatgcccagttctttacaggcacgcaggatgcgcagtgcgatctcgccacggttagcgatgacaattttatccagcatgttcgcctcgttactcgataactaccagcggctcgtcgaattctactggttggccgctttcgatcagaatggctttcaccacgccggctttgtcggcttcgatctggttcatcattttcatcgcttcgacgatgcacagggtgtcgcccacgttaactttctggccaacttccacaaacgctttcgcgtccgggctcggcgtacgatagaaagtaccaaccatcggggaacgtacgatgtgaccactgatttccgctttcgccggcgcttcagccgcagcagctggtgcggcagtcgcggcggcaggcgcctgaggctgcatcatcggcgcagcataagcctgctgcataaccggatagcttgcggccggtgcagagcggctgatgcgaacagactcttcgccttcagaaatttccagttcggagatacctgattcttcaaccagctcgatcagttttttaatcttacgaatatccatgagtgggttccgtactctttgtttagtgtgattgtgacaggcgttttaccgccgtctgtaaagcgtatgaataaccatccgcccccagcccgcaaatgacgccagcggcgacatctgacagatacgagtgctggcggaagggttcgcgtgcatgcacattgctcaggtgaatctcgataaacgggatgttcacggcgagcaaagcgtcacggattgctacgctggtatgcgtgaacgcggccggattaatcaggatatagtccacgttgtctttagcctgatgaattcggtcgattaacgcatgctccgcgttggactgcaggtgatccagactcacattcagcgccgccgcttcagatgttaaacggttaacaatttcagccagcgtgagagggccatacttctcaggctcgcgggtaccgagcatgttaatgtttggaccattcaaaagcaaaatgtgaaacttcactgccattgtgtggcgatctcctgccattttcgggtaaaaaacaacatataccttcaatgcgcccttgtcaccttttcagggtcagaaaaccccgtcaggaaaaccaaagtcgcacattataacgatttcgtagcaattggcagctaaatactggtcttatcagggaagattatcaaccgctatctgaaaaagagtcgcggttgataaaggatctgcgggaaactgcacattaccggattgcgcgccaccactggcggaacttcttgtaacgccatgtcaatagccccgctgccagcagggcatatataacgggctgcggcgagacgatcttcactgaccacaggtagtgtatcggcgcgaggatcgccaccagatagacgaagttgtgtaaaagttgccagcgacgccccagttttcgctgcatcgcttgcgtggaggtcaccgccagcgccagcagaatcgcccagctgatcatgcccaatgtcagataggggcgggtgataatctccgagcccagcagcgccagattgttaatgcccagctccagtagggtatagctggtcaggtgcagcgtcgcccaggcaaaacaccataaacctaacaggcgacgaacgcgaatcaataatggctgcttcgcatagcgcgccagcggagagaccagcagcgtcgccagcagaaacttaagcgccattctgccggtaaagtgctggatatccttggctggatcggcgctaaagtagccctggtgcccggcccagaataaccagaccagcggcaaaaaccccgcaaggtgaagtaaaatcttcagccagacgatctgtttgacggtgaaacgcactagaagttctcccgcagattcatgccgcgatacagcgacgccacttcgtcggcatagccattaaacagcaacgtcggttgacgcttcacatcgagcacgccgccggcgccgataaaccgctcgctagcctgcgaccagcgggggtgatcgacgtgcggattgacgttagcgaagaagccgtattcgtccggcgccgccaggttccaggtggttggcggccgctcgcgggtcagctcgatactaacaatggattttatgcctttaaaaccgtacttccacggcacggtcaggcggaccggcgcgccgttttgcggcggcagcgctttgccatacaccccgacggtgagtagcgtcagcgggtgcatcgcttcatccagccgtagcccctccacgtaagggtaagcgagccccccgccgataaaccggtctttctggccgggcatttgatccggagcatagagggttttgaaggccacatagcgcgcgctgctggtgggctccaccagcgccagcagtttatgcagcgggaagccgacccaggggaccaccatcgaccaggcttccacacagcgcatacgataaatgcgctcttccagcgggaagcgtttggtcagatcgtcatggtcaagggtcagaggtttcgccacttcgccaccgatggtgagcgtccagggatcggtgcgcaggctacccgcgttcgccgccggatcggctttatcgaggccgaattcataaaaattattgtaaccggcgaccttatcttccggggtaagcgtcagattagcctgccactcggcgggtttagcaaactccagggccttgcccgccggggccggcgggcggtcatttcctttaaaccagtccagcagatcggcctgcgcggcggcgggaagcgaaagcgccgtcgcgctgatacccagcattttcagcacctggcgccgcttgagcataaaaacggattcggccgtgacgtcggcttccgtcagtttttttcttttcatggtgtcctccgtcatgcgttttcctaagcatgacggagacggcgatgaatggcgaatatgtcacgaaaaattgcacattaggatgaggagccgccgccgaagcagaggcgcggtcgtccaggaatcatcggaaagtggcgcaagacgtttcctttaccgcgcatgacccggcatctttagcagggaaaaagagggcggcaagcaggccaaacggtaaaccggtaataatttgcgccgccggcgcggggttgccatcctgcgtctaaaattaaagcgcttctggcgcaggccgcaggcgggcgacgattggcaaattttttctgcaaactatactcgctatcggcatacttttaccgataatacgcattccattgccagactcgccatctttgatagtatgcgtcgcgctttaaaaggttaatgcttgcggcaaggtgcgcgccggcacgggagcctgatggttcatcgggtagtcattcactcgcggagttaacacagggatgcgattaacgacgaagttctcagcctttattacgctgctaactagcctgaccatctttgtcacgctgattggcgcttcgctgagtttttataacggcattgagaacaaggtcgaaaaccgcgttcaggcggtggcgaccatgctggataaccggctcatcaccacctctttcgataagcttgaaccgcagttggatgagctgatgacgccgatcgagatcgtgcatatcgatttcatgctcaacggcaaaccgctctacagccattcccgacccgatagctatcgcccgctcggcagccatgagcaattccgtgagatcacggttcagtcgcttaaacatcctggtattacgctgcatctggtctacgttgacccgatggtgaactatttccgttcgctgtcgatcactgccccgctgtcgatctccattggcttcatggtggtaattattttcttcgccgtccgctggatccgccgccagctggccggccaggagctgctggagctgcgttccacgcgtatcctgagcggcgagcgcgggccgcaggtgcgcgggtcggtctatgaatggccggccagcaccagtagcgcgctggatatgctgctgtcggagctgcagttcgccagcgatcagcgcagccggatggatacgcttattcgctcctacgcggcgcaggattcgaaaaccggactgaataaccgcctgttttttgacaatcagctggccacgctgctggaagaccaggagaaggtgggaacctacggcatcgtgatgatgatccgtctgccggagtttgatctgctacgggacaactggggacgggcggcggccgaagaacattactttacgcttatcaacctgctctctacctttattatgcgttaccccggcgcgctgttggcgcgctatcaccgtagcgacttcgccgtgctgctgccgcaccgtacgttgaaagaggcggatagtatcgccggcctgttgctgaaggcgatggatgcgctgcctccaacgcgtatcctcgatcgcgacgatatgatgcatatcggcatctgttcgttccgcagcgggcaatcggcggcgcaggtgatggaacatgcggaagcggcgacgcgcaacgcggtgctgcagggcagcaacagctggtcggtctatgatgacacccttccggagaaaggtcgcggcaacgttcgctggcgaacgctgatcgaacagatgctgagccgcggcgggccgcggttgtaccaaaaaccagctgtcacccgcgacgggcgggtacatcatcgtgaactgatgtcgcggatgtacgacggtaaagaagaggtgattgcagcggaatacatgccgatggtgctgcagtttggcctggcggaggagtatgaccgcctgcaggtaacgcgcctgctgccgtttttaggcttctggcccgaggagaatctggcgctccaactgtcggtggagtcgctgatccgtccgcgtttccagcgctggctgcgcgatgccttgatgcagtgtgaaaaatcgcagcgtcagcggattatttttgaacttgcagaggcagatgtttgtcaatatatcggccgtctgcagccggttatgcgattggttaacgctctgggcgttcgggtggcagtggttcaggcggggttaaccctggttggaaccagctggatcaagcagctggatgcggagctgatcaaactgcatccgggtctggcgcgcaacatcgaaaagcgcagcgagaaccaactgctggtgcaaagcctggtggaagcctgtaaaggcatgcctatgcaagtttttgcgacgggcgtacgcagccgcagcgagtggttggtactgtcccaatgcggtgtcacgggcgggcagggggaattttttgccgcctcacagccacttgacacaaatgtgaaaaaatattcgcaaagatactcggtttgatctgccgtttagcgtgatttcacgtagaataacgcgcgccatcgtgaagggggtgtgcttgtctacctgccggatcatcgcaatgtaaatgccagtgaccctcctttgacaggttacaaattcaggcgtggagcgctgctgaagatttcagcaatgaacggagtcgggaaaatttgtaacaaaggaaatgaactgcactaattttcaccgcagcaggtgatttttgcgccttgtcgctgctgcgtgtggttggtaaagtaagcggattttgttttccgccccagctttcaggattatcccttagtatgttaaaaaaatttcgtggcatgttttccaatgacctgtccattgacctgggtaccgcgaatacccttatttacgtaaaaggacaaggcatcgtattgaatgagccttccgtggtggccattcgtcaggatcgtgccggatcgccgaaaagcgtcgccgccgtgggtcatgaagcgaagcagatgctcggccgtaccccgggtaatatcgcggcgattcgcccgatgaaggacggcgttatcgctgacttcttcgtgacggaaaagatgctgcagcactttatcaaacaagtgcacagcaacagctttatgcgcccgagcccgcgcgtgctggtgtgtgtaccggttggcgcaacccaggtcgaacgtcgcgctattcgtgaatccgcgcagggcgcaggcgcccgtgaagtcttcctgatcgaagagccgatggcggcagcgattggcgcaggcttaccggtttctgaagcgaccggctccatggtggtggatatcggtggcggtaccactgaggtggcggttatctccctgaacggcgtggtctattcctcttctgtacgtatcggcggtgaccgcttcgacgaagccgttatcaattacgtgcgtcgtaactacggctccctgatcggtgaagcgaccgctgaacgtatcaagcatgaaatcggttcggcttacccgggcgatgaagtgcgcgaaattgaagtgcgcggtcgtaacctggcggaaggcgtgccacgcggcttcaccctgaactcaaacgaaattcttgaagcgctgcaggagcctctgaccggcatcgtgagtgcggtcatggttgcccttgagcagtgcccgccggaactggcgtctgatatctctgaacgcgggatggttctcaccggcggtggtgcgctgctgcgcaacctggaccgtctgttaatggaagaaaccggtattccagtcgtggttgctgaagatccgctgacctgcgtagcgcgtggcggcggcaaggcgctggagatgatcgacatgcacggcggcgacctgtttagcgaagagtagtcagcctgaaggtccggggcggcatacgagctgcccctggtctttactgacacgagaatacgcatagcctatgaagccaatttttagccgtggcccctcgctacagattcgccttattctggcggtgctggtggcgcttggcgtgattatcgccgacagccgcctgggtacgttcagtcaaatcagaacgtacatggatacagccgtcagccctttctactttgtctctaatggtccccgggaactgctcgacagcgtatcgcagacgctagctacccgcgaccagctcgaactggaaaaccgcgcgctgcgccaggagctgttgctgaaaaacagcgatctgctgatgctgggccagtacaagcaggagaacgcgcgcctgcgtgaactgcttggctcgccgctgcgccaggacgagcaaaaaatggtgacgcaggtcatctcaacggtcaacgacccttacagcgatcaggtggttattgacaaaggcagcgtgaacggcgtctatgaaggccagccggttatcagcgataaaggcgtggtggggcaggtcgtggccgtggcgaaaatgaccagccgagtgctgctgatctgcgatgccactcatgcgctgccgatccaggttctgcgtaacgacattcgcgtcattgccgccggtaacggctgcacggacgatctccagcttgagcatctgccggcgaataccgatattcgcgtcggcgacgtgctggtgacctccggtctcggcggtcgtttccctgaagggtatccggtcggggtagtctcctcggtgaaactggacacccagcgcgcctataccgtgattcaggcgcgtccgacggccgggctgcagcgcttgcgctatctgttgctgctgtggggcgccgatcgtaatggcgctaacccgatgaccccggaagaggttcatcgggtggctaacgaacgtctgatgcagatgatgccgcaggtactgcctgcgccggatgcgatggggccgcagatgccggcgcccgccaccgggttgacgccgcctcagccgtcgcagcctgcaggggggcaatagtggcaagttaccgtagccagggacgctgggttatctggctctcgtttcttatcgcgctattgctgcaaattatgccctggccggcggacatcagcgttttccggcccaactgggtattattgatcctgctgtactggatcctcgcgttgccgcaccgggtaaacgtggggacgggtttcgtgatgggggctattcttgatctcatcagcggttcaacgctcggcgttcgcgcgctgtctttaagcatcgtcgcctatctggtcgcgctgaagtatcagctgttccgtaacctggcgctgtggcaacaggcgctggtggtaatgttgttatccctggccgtggatatcattgttttctgggcagagtttttagtgatcaacgtctctttccgtccggaagtattctggagtagtgtagtaaacggcatcctctggccatggctcttcctgctgatgcgtaaagtgcgtcagcaatttgcagtgcaataaggttgatatgacaactctgtatctcgcttctggttccccgcgtcggcaggaactgctgactcagcttggtctcgctttcgagcgtctggttcctggtatcgaggagcagcgccagccgcaggagagcgcccagcactatgtcgtccgcctggcgcgcgaaaaagcgcaggccggggtggcgatggccacccgcgatttgccggtgctgggagcggatacgattgtcattttgaacggcgaagtgctggaaaaaccgcgcgacgccgaacacgctgcagcgatgctgcgtttgctttccggccacacccatcaggtcatgaccgcggtggcgctggcggataagcagcaaacgctggactgtctggtggtcacggaagtgaccttccggcggctcagcgagcaggatatcgccgattatgtggccagcggcgagcctttagataaagcaggtgcatacggtattcaagggttgggtggttgcttcgtcaggaagattaatggcagctatcacgccgtagtcggcttaccgctggtggaaacgtatgagttgctcagtaactttaactcactgcgtaaaggaaagggataaagatgacggctgaattattagttaacgtaacgccatccgaaacgcgcgttgcgtatattgatggcggtattctgcaggaaatccatattgagcgtgaagcgcgacgcggaatagtaggcaatatctacaaaggtcgtgttagccgagtgctgccgggaatgcaggcggcttttgtagatattggtctggataaggcggcgttccttcacgcctccgatatcatgccgcataccgagtgcgtcgccggtgaggagcaaaagcagtttaccgtgcgcgatatttcggagctggtgcgccagggccaggatctgatggtccaggtggttaaagatccgctgggtaccaaaggcgcgcgtctgaccaccgatattaccctgccttcccgctatctggtctttatgccaggcgcctcccacgtgggggtctctcagcggattgaaagcgaagccgagcgcgagcgcctaaaaaaggtcgtcgcagaatattgcgatgagcagggcgggtttatcattcgcaccgctgcggaaggcgttcacgagcaggagatggccgccgatgccgcttatcttaagcgcgtatggaccaaggtgatggagcgcaaaaagcgcaaccagacccgctatcagctgtatggcgagctggctctggcccagcgcgtgctgcgtgattttgccgatgcgcaactggatcgcattcgcgtcgactcgcgcctgacctatgaggcgttgctcgaattcaccgccgaatatatcccggaaatgaccagcaagctggaacactacagcggccgtcagccgatattcgatctctttgacgttgagaacgaaattcagcgcgcgctggagcgtaaagtcgagctcaaatccgggggctatctgatcatcgaccagaccgaggcgatgaccaccatcgatatcaacaccggggcctttgtcgggcaccgcaatcttgacgatacgatcttcaataccaacatcgaagccacccaggcgatagcccgccagctacgtttgcgtaatctcggcggcattatcatcattgatttcatagacatgaacaatgaagatcaccgtcgacgggtgttgcactctttagagcaggcgctgagtaaagatcgggtgaagacgagcattaacggcttctcccagctgggcctggtggagatgacccgtaaacgcacccgtgaaagcgtggagcatgtgctgtgcaacgagtgcccaacctgccacggacgtggaacggtaaagtcggtggaaacggtgtgctatgagattatgcgtgagatcgtccgcgtacatcatgcttatgattccgatcgcttcctggtctatgcttcccctgcggtggcggaaaccctgaaaggggaagagtcgcatgcgctggcggaagtggaaatctttgtcggcaagcaggtgaaggtacaaattgagccgctctataatcaagagcagttcgatgtggttatgatgtaagacaccgcgtcattgtgcggctgacaaggagagaggcgtgaggcgactgcccgggattttattgctcaccgtggcaacattgattgttatcgtcgcgctgctggtgagtggcttgcgtctcgtgttgccacagctcgacgcctggcgtccgcagctgctggagaagctctccaccctcaccggtacgccggtggacgcctcgcagatcaccgccagctggcagacttttggtccgacgttagacgcccgcgatatccatgtcgggctgaaagatggcggcacaatggcggtcaagcgcgtaaccctggcgctggatgtctggcagagcctgctgcatatgcgctggcagttccgcgacctcaccttctggcagctgcaggtccataccaatacccctattcagaccaatgacggtggcgaaagcctgaaaaccgaccgcatcagcgatctctttttacgtcagttcgatcactttactctgcgcgacagccatctgagcttcctgactctttccggtcagcgggcggagctggcggttccgcagctgacatggcttaacggcaggaaccgtcatcgcgccgaggggcagctcagcctctccagcctcaccggccagcatggcgtcatgcaggtgcggatggatcttcgcgatgaggatggcctgctgaataaaggccgggtctggctgcaggcggatgatatcgacgtcaaaccgtggctgggacgctggatgcaggacaatatcgccctgaaaagcgcccgcttcagcctcgaaggctggatgaccattgaaaaaggtgatgtggccagcggcgacgtatggctgaaaaaagggggcgccagctggcagggcgataacgaagtccatcatttgtcggtggataacctgacggcgcatctctcccatgataagcaaagctgggccttttatattcccgatacgcggatcgctatcgatgataaaccctggccaagcggagccctggcgatggcgtggatcccggcgcaggacgttggtggcgacgatcgtcagcgtagcgatgagttacgtattcgcgccagcaatttggccctcagcggcctgagcgggttacagccgtttgctgataagctggcgccttctctgggcgaactctggcgtaccacgcagcctggcggcaaaatcaatttgctggctctcgatatccccctgcaggcgacggagaaaacgcgttttcaggcgcagtggagcgatctggcgtggaagcagtggaaactcctgcctggggcagaacacttctccggcagtctgaatggcagcgttgagcacggggaattacgcgcccatatggcgaaggcgctgatgccgtatgccggcgtcttccgcgcgccgctggagatagccgctggcgaagccacgctcagttgggtgaaaaacgacaaagggtttatgcttgatggccgcgatatagacgtgcaggcgacaggcgtacgcgcccgcggcggcttccgctatctgcaaccgcagggggacgatccctggctgggcattctggcgggcatcagcaccaatgacggtggccaggcatggcgttatttcccggaaaatctgatgggcaaagcgctggtggactatctgagcggcgcgattaaagcggggcaagccagcgatgcgacgctggtgtatggcggcaatccgcatttattcccttatccgcataatgaaggccaattccaggtttatgttccgctgaagaacgccacttttgccttccaaccggactggccggcgctaaccgggctgaacatcgatctcaattttatcaacaacggcctgtggatgcaggcggataaagcgatgcttggcaacgtgaccgccagcaatctcgatgccgcgatcccggactatgcgcaggaaaaactgctgattgatgccgatatcaaaggcccgggaaaagaggttggaccttactttaatactacgccgctgaaagagtcgctcggggcggcgctggattccctgcagctggatggggatgtgagcgctcgcttacatcttaatatccccctcgacggcgagatgaccaccgcgaaaggcgatgtgcgcctgcagaataatagcctgtttatcaaaccgttagatactacactgcagaacctgagcggtaatttcagctttgtgaatggcgatctcaatagtcaaacgttgagcgcgacctggtttaatcagccgctgaacctcaatttttccacccgcgaaggtgaaaaagcgtttctggtggatgtcgggatgaatgccaactggcagccgtcgcgcaccgggctgctgccgaaagccgtgagtgaggcgttgagcggtagcgtcccgtgggatggcaaggtcgccatcgaactgccgtaccatggcaatgccagctataaggtcgatatcaacggcgatctgaagaatgtgagcagtcgcttaccttcgccagtcagtaagcccgccggcgaaccccttccggtcaaaattaacgtcgccggcggcctgagcagcttcgacctgaccggctccatcggggcgaagaatcatattaacagccgctggttgctcaatcataagctgacgctggatagagcgatccttaccactgacagcaaagggtactctccgctgcccgatcagtccggtatcgagctcaacctgccgccgatggatggcgcgcagtggctggcgctcttcgagaacggcgcggcaaatgaagtgagcagcagcgtgctctttccaccgcgcattgtgctgcgtacgccgtcgctggccctcgcgggtcaacagtggaacaacgtcagtctgatgtcacagccggtcgccggcggctcgcaggttgaggcgcaggggcgtgagatcaatgccacattgacgatgcgcgacaatgctccgtggctggcaaatgtgcgttatctctatttcaatccggccagcgccagcggccagaacgcaacagagaatgtggccccccagacggcgacgcggctggatttccatggctggcccgatctgcagctacgctgcgcggaatgctggctgtggggacaaaaatatggccgcatcgatggggatgtggcgatcaaaggggataccttaacgctctccaacggcctggtggataccgggtttggccggctgacgaccaacggcgtgtgggtgaacgccccttcaggggttcgaacctcgctgaaaggcagactgcacggcaataagacggatgcatttgcggatttctttggcgtctccacgccggtgaaggattcgccgtttgatatcgactacgatctgcactggcgcgcgccgccctggtcacccgatgtcgcgtcgctcaatggcatcattaaaagccacctgggcaaggggcagtttaccgacctgagtaccgggcacgctggccagctgctgcgtctgctgagtgtggatgccctgctgcgtaaactgcgtttcgatttcagcgataccttcagcgaaggcttttacttcgattcgattaacagtacggcatggattaaggatggcgtactgcataccgatgatacgctggtggatggccttgaagcggatattgctatgaaagggtcggtcgatctggtgcgtcgccagctggatctgcaggcggtggtggcgccggagatctccgcgaccgtcggcgtggcggcggcctttgccgtcaaccccatcgtcggcgcggcggtatttgccgccagcaaagtgctgggtccgctgtggaataaagtttcgattctgcgctaccgcatcaccggcccgattgaccagccgcagatcaatgaagtgctgcgcctggcgcgcagcaataaaaagcaatgatttgacgattgccgggaattgccgcaatctcaatagatagccttctgtatttccgcctgtcaggcggcaacaaacgagtagcataacgatgagtctgaacctggtaagtgaacaattactgtcggcaaatggcctgaatcatcaggacctgtttgccattcttggtcaactgaccgagcgccgcctcgattacggcgatctctattttcagtcgagctatcacgaatcctgggttctggaagacagcatcattaaagatgggtcgtacaatatcgaccagggcgtaggcgtgcgcgccgtcagcggcgaaaaaacgggctttgcctacgccgatcagatcagcaaactggcgctggagcagagcgcccaggcggcgcggaccattgtgcgcgacaccggcaatggcaaagtgcagaccctcggcgccgtagagcatcgtgccctgtacaccagcatcgacccgctgcagagtatgacccgggaagagaagctggatattctgcgccgggtagacaaagtcgcccgggcggcggaccagcgggtgcaggaggtttcagccagcctgagcggggtgtatgagctgatcctggtcgccgccaccgatggcactctggccgccgacgttcgtccgctggttcgtctttccgtcagcgtgctggtggaagaggatggcaagcgtgagcgcggcagtagcggcggtggcgggcgttttggttatgactatttcctcgcctcccaggagggcgacgtgcgggccgatgcctgggcgaaagaagcggtgcgcatggcgctggtcaacctctcggcggtcgccgcccctgcggggatgctgccggtggtgctcggcgccggctggcctggcgtcctgctgcatgaagcggtcggccatgggctggaaggcgatttcaaccggcgtggcacctcggtctttagcggccatatgggggaattagtcgcctctgagctgtgcaccgtagtggatgatggcaccatcgccgatcgccgtggctcggtggccattgatgacgaagggacgccggggcaatacaacgtgctaatcgaaaacggcattctgaaaggctatatgcaggataaactcaacgcgcgcctgatgggcgtcgcaccgaccggcaatggccgacgtgagtcgtatgcccatctgccgatgccgcgtatgaccaacacctatatgctggcgggccagtcgacgccacaggagattatcgaatcggtcgactacggtatctttgcgcctaacttcggcggcgggcaggtggatatcacctccggtaaattcgtcttctccacttccgaggcctatctgatcgaaaaagggaaggtcacgaaggcggtgaaaggggccacgctgattggctccggcattgagaccatgcagcagatttcgatggtgggcaacgacctgcgcctggataacggcgtcggcgtctgtggcaaagagggccagagcgtgccggtgggcgtcggccagccgaccctgaaggtcgataaccttaccgtcggcggcaccgcctgatcctgacctggttcccggcgctgccgggaaccgcttcaccgggcgatcccgcgcccgtgcatgccctgatagatcttcgccacgtcgacaaaatactccgtcagatagttgatacagacctgcactttcagcggcagtttatccttttccgtatacagggcgtagaccggtcgcggatcggactgatagctgggcagcaggatctcaagctcaccgcggttgatctcttcgatcgcccacattaacggtacataggcgatacccaccccggcggtcagccagcgcaccagcgtcatagggtcgttggtcacgaagcgcccctgcggggtgaggcgggtcgagatcccttccggcgcgataatgacaaactcattgtccggccgcacgctatattccagccaggcatgtccggcaaggtcggccggtttctctggattgccagcctgcgccagatagcttttagcggcgcataataccatcggcattgagcccaggcggcgggaaaaaaggctggaatcctgcagggcgcccacgcggatcaccacgtcaaggccgtcggcgatcaggtctggcgcaggtatgccggtgaccagattaacagagagcccggggtattctttgagcattttcgccgttatgcgcgccagaacattctgtgccatagttgaagagcagccgatgcgcagcgtcccgatgggggtattgttaaatgcgtataattgctcatggacatcctgcgcttcaaacagcatcctacggcagccctggtaatagattttacctgcttcagttaagccaaggctgcgggtgctgcggttgagcagctttacctgcagctcatcttccagtttggcgacggtctgactgatcgaggaaacgctcatctgaagctggcgggccgctgcggtgaatgaacctaattcgaccactttggcgaaaacggacatgcgttttaatcgttccattattcactctggcttaaaagtgatttagatcacacattgtagataatgcggcaatcgttacgttaatatattgttagctacataataaacgcatctgctcactacctgtacgcttcttattcaaggtcatcatgagtctgtttcctgtcatcgtgattttcggcttatcgtttccgccgatcttcttcgagttgcttttgtcgctggctatcttttggctggtgcaccgactgctggttccgaccggcatttacgattttgtctggcacccagcactgtttaatacggcgctctattgctgccttttttatttgatatcgcgcttgttcgtttgaggttgatgtgaaaacactaacaagaaatatcctccgtactgccattaccgtgatactggtcattctggccttcgtggcgattttccgcgcctgggtttattacaccgcctcgccgtggacgcgtgatgcgcgctttagcgccgacattgtggcgattgcccccgacgtctccgggctgatttctcaggtaaacgtcaaggataaccaactggttaagaaagaccaggtattgttcgttattgaccaacctcgttaccaaaaagcgctggcgcaggcggaagctgatgtcgcctattatcagacgttagctcaggaaaaacgcgtcgaagccggtcggcgtaataagcttggcgtacaggcgatgtcgcgggaagagattgatcaggcgaacaacgtactgcaaaccgttgaacatcagctggcgaaagcggtggctagtcgcgacctggccaggctagatctggagcggacggtcattcgcgcccctgcggatggctgggtgactaaccttaacgtctacactggggaatttatcacccgtggctccacggcggtggcgctggtgaaagagaatacgttttacgtcatggcctatctggaagagaccaaactggagggcgtccgtccaggctatcgtgcggagattaccccgctgggcagcagcaaaaccattaaagggacggtggacagtatcgctgcgggggtgaccaacgccagcagcagcagcgactcgaaagggatggcctcggtcgactccaaccttgagtgggtgcgtctggcgcagcgtgtgccggtgcgtattcgcctcgatcaccagcaggggaatctgtggccatcgggcaccacggcgacggtagtgatcaccggtcaagaagatcgtgataccagccaggccaacttcttccagaaactggctatgcgcctgcgcgaatttggttaatcgctatggggacatataccattgctccccggcatctccgctttgccattaagcttgcatgcgcggtggtgctggcgctgtttgtcggtttccattttcagctcgaaacgccgcgctgggcggtactgacggcagcgatcgtcgccgccgggccggcctttgctgctggcggcgaaccgtactccggcgcgatccgctatcgcggtatgttgcgtattgccgggacctttattggctgtattgcggcgctggttatcatcatcctgatgatccgcgcgcctctgctgatgatgctggtctgctgtctgtgggccgggttttgtacctgggtttcgtcgctggtcaaggtcgaaaactcctatgcctgggggctggccgggtacaccgcgctgattatcattattaccatccataccaatccgatgctggcgccgcagtttgctgtcgaacgctgcagcgaaattgtcatcggtattgtcagcgccatcgtcgccgatctcctgttttcgccgcgttcgattaaaaaagagatcgacctcgagctcgataatctgctaattgcacagtataagctgatgcagttatgcgtcgcgcacggtgaaaaagaggaagtggatcaagcctggggagcgctggtacgccgcactacggcgctggaaggtatgcgtagtaacctgattatggaatcctcacgctgggcaaaggccaatcagcgcctgaaggcgatcaacaccctttcgctaacccttatcacccaggcttgcgaaacctatctgattcagaactcacgcccggaaatggtcacggacgactatcgcgagctgttcgccgagccggttgagacggtgcaggatgttcaccagcagctgaagcgcatgcgccgcttcctgacctggaaaggcgagcataataccccggtcacgatttatagctgggtgggcgccgccacgcgttacctgctgcttaagcgcggcgtggtggggaatactaaaatcagccgtatcgaggatggcgtgttgcgcggcgaaacggtggttaaagtggagtccgccgaacgtcatcacgcgatggtgaacttctggcgcacctctgtctcctgtattctcggaacgctattctggctgtggacgggctggacctcaggcagcggcgcgatggtaatgatcgccgtggttaccgcgctggcgatgcgcctgccaaacccgcgtatggtggcgatagacttcctctatggcaccctggcggcgttaccgttgggcaccttgtacttcctggtgatcatgccggcgacgcagcagagcatgctgttgctttgcatcagcctggcggcgatggcgttctttatcgggatcgaagtacaaaaaaggcgtctcggatcgctgggggcgctggcgagcaccatcaacattctggtgctggataacccgatgcagttccagttcagccagttcctcgatagcgcgctggggcagatcgtcggctgtttcctcgctctgatggttattctcattgtcagggataactcccgggccagaaccggtcgggtgctgctgaaccagtttgtctccgcggcggtctcttcgctgaccaccaactcggcgcgtcgcaaagagaatcatctgcccgcgctctatcagcagctgtttttattactcaataaattcccgggtgacgtcgcccgtttccgtctggcgttgacgttaatcatcgcccatcagcgcttgcgcgatgcgcccgtgccggtgaacgacgatctctccgccttccatcgtcagctgcgacgtaccgcggaccatgtgatctccgccggcagcgatgataagcgtcggcgctattttacccagttgctggcggagcttgatgtctatcaggagaagctgcgggtctgggaggcctcgccgcaggtcaccgagccggtacggcgactggttgagatgttgcataagtaccagcatgtgctgaccagcagctaacccataaaccgacgcccaggcgtcggtttttttatcgctatacttaacggcgacagaaagagaagcgggaggggctgtcatgaccacctatacgtttgattttgacgaaatcgccgaacaacaggatttctaccgggagttttcccgaaccttcgagctggctcaggataaggtcaacaacctggattcgctatgggacgcagtgaccggtggcctgctaccgctgccgctggatattgaattcatccatttaaatgacaagcagcgccggcgctttggcgcattgattttattgtttgatgaagcagaggaagagctggagggggagttgcgttttaatgcccgacaagcataaaaaagcccccggcaggcgggggcaagtcgtcgaaataagacgacgagggtttatttgtacagctcagcggtggcgtgccagctatcgccggtacgtgcttcaataatacggtagctgctggcgccttctttctcggctttagccgccagttcctgacgcatgtccattggcgcactacctacctgggatacggagatggtgcccatggattgcagattttgggcttgctctgcgttcacttgctggacagccgcgctggcaccgaaagagagaagggaagccaggccaagggatgcgatgatcattgcgcgtttcataatctttactccagtctttgttttgccgcggcggggcgatgtatgtcgccgggccgcggtagagaatttttgtcaggttaatcgttgacgtctaaaacttatttatacagctcagcagtggcatgccagtggtcgccagtgcgggcttcgataatgcggtaagaagaagccccttcttcctgcgcttttttgttcagcatttcatgcatatccatcggggaagatgctaccgcgccgacggaaaccgtgccgatggcctcgcggccctgggcctgctcgctgttgataatatcagcggcgaaagcgccaaacgacacgacggacaggatgctgatagcagctacagtggttttgattttcatgatgttcacctcgtcgaatctttttgttgggggtctttgtttcgtgaccctcatcacaaaaccaagtatacactaatcactaaaaatattaataccatgctaattgttttgtgcgttaatagttacaatagattgcgctttttataacggataagaattaaaaatgacacgttagcgacagcgataagatttatttctaataaattcataaaggtatacgaatttgatcttttgtgcgttttacgattttcgcgttagtaaaagaacgtatagacggcgtaaatgacactaagtgttaaatagttgttgtgccagaaggggggagaggcaaaagaaagaggagtcgccctctgacggtagccagaggggaattactcagagttcctgctcaaacagaaccagaatggcgtcgtgcagatctttcaccgtaaaaccgcgtgcaggcgtggtaaagatggtgtcatccccggcgatactgccaagaatgccttccgctttgcccagcgagtcgagaagacgggcgatcagctgcgcggcgccggggctggtatgaatcaccactacggcatcgttatagtcgatatccagcaccaaattcttcagcgggctggaggtggtcggtaccccaagctcggcaggcaagcaatagaccatttccattttggcgttacgggtacgcaccgcgccaaatttggtgagcatgcgggaaaccttcgattggttgatattctcgaagccctcttcctgcagcgcctggacgatctctccctgcgagctgaatttctcttctttaagcagcgccttaaacgctttaaccagttcttcttgttttgccgaacttcgcataagtcacccagattatggtggtaaaatcaacatcattatgcataaccatgaatttttatgcaaataatccgcgaaaggataggtcaataatgttatgaagggggcatattttagcaaaaaaaccgtataaggaacatgttctcatcacaacgcttaaagccatgtaaaagtaaatgaaatgttattgagttggtgttgttttgcgcaactggctgggtgtattgtaaccaatagtcgatccggttcttcgctttgctggatggtcagtcaggaagcataaagtgcgccgctgttctattgctacgcacaataatgcattcttcagccataatcattgtaattgttcatcttgtgaattaaggtccaggcgacggaataacgaaagactaaattaaccataataaggagtttaggatgaaagttgcagtccttggcgctgccggtggtatcggccaggcgcttgccctactacttaagacccaactgccttcaggttcagagctctcgttgtacgacatcgctccggttacgccgggcgtggcggtagatctaagtcatatccccacagatgtaaaaattaaaggattttccggtgaagacgctactccggcgctggaaggcgcggatgtagtgctgatctccgcgggcgtggcgcgtaagcccggcatggatcgttccgacctgtttaatgtgaatgcgggtatcgtgaagaacctcgtgcagcagattgccaaaacctgcccgcaggcctgcatcggcattatcaccaacccggtgaataccaccgtggctatcgccgccgaagtactgaaaaaagccggcgtgtacgataaaaacaaactgttcggcgttaccacgctggacatcatccgttccaatacctttgtggcggagctgaaaggtaaatcggcaaccgaggtggaagtcccggtcattggtggtcactccggggtcaccattctgcctttactgtcgcagatccccggcgtcagctttagcgatcaggaaattgccgacctgactaaacgtattcagaacgccggtaccgaagtcgtggaagcgaaagcgggcggcgggtcggcgaccttgtcgatgggccaggcggctgcccgttttggtctctctctggttcgcgccatgcagggggaaaaaggcgtggtggagtgcgcctacgtggaaggcgacggccactatgcgcgtttcttctcccagccgctgctgctggggaaaaacggcgtggaagagcgacagtctatcggcaaactcagcgcctttgaacagcaggcgctggagggcatgctggacaccctgaagaaagatatcgcgctcggcgaagacttcgtcaacaagtaatctcgccctaacagaagagccggaaccgctgttccggctttttattgtccagcattcatggaaaccgggtttctggtcagattcccggccggtccggtatttagcgattaacgtggctccccaaacggggagccgtttagttggtggccgggtattcctggacggcgatatggagcgtgattttcttatcatcacgcatgatgaccaccggaatttccgatcccgggcggatctcggccacctgatccatcgtctccagcgccgagacggcgggtttgtcattcacggagatgattacgtcgttggcgcggatcccggcttgcgccgctggaccgtccggagccacatcgttaacgacgatcccctgaatctgatcgatccctccgccctgcgcgtgcagcggggcgatctcccggccgctaatgccgatatagccgcggatcacccggccatcgcggatcagtttatccataattttggtcgctaactggaacgggatcgcaaagccaatgccttccggcgtttcgccgtcattgctcttgtcaaaggagagggtgttaatccccatcagctcgccgagggagttcaccagcgccccgccggagttaccgtggttgatcgaggcgtcagtctgcaggaagttctggcggccggtcggattgaggccaatgcgccctgtggcgctgataatcccctgggtgatggtctgccccaggttataagggttgccaatcgccagcaccacgtcgccgatgtgcggcgtgcgtttcggattgatcgggatcaccggcagcccgccggtagcattgattttgagcacggcgagatcggtgagggaatcggatcctaccagcagcgcttcgaagacgcggccgtcctgcagggcgacgataatctgatcggcatcgttgataacatgcttgttggtcaggatatagccgcgctgatccataatcacccctgagccaagcgtcagctgattatggctggtgctgttaagggcgcggttatagacgttcaccacggcgggcgccgcgcggcgcaccgcggcgttatagctcgccggggagtcgtctgccgtatcgttctgggtagtcggcgccaactgccactggcgcagcgagggcatcagggccagcagcagacccccgacaagcaaaccgatgagtactgaacgtaataactttccaggcatgatgcagatatcgttaatgaatggtcaggcgcagcatagcatgagttgtccggacatcgcacatggcggcgatgcccggagagacaatcagcgcagcagcagatagatgctttcgttgccgcggatcacgttcagggcgatgaccggcggtttgccttcgagcgctttgcgcagttcggcaattgagtgaatacgctgccggttaaggccaatgataatgtcatccttatgcagaccgacctgggcggcggcgctgcctttatccacattatcgatcaccactcctttggtgccatctttcatctggccgtcgctgaacgaggccccctgcagcgccgggataatcagttccgcgctggcggttgaggaggtgctcttatccagggtcacttcgacatcgaccggctttccatcgcgcagcaggcccagtttgaccttggtacccggctcggtggtggcgatccgcgaacgcagttcggcgaaactgttcagcggtttgccgttcagactcacgatgacgtccccggatttaatccccgctttggcggagccggagtttggcaggacttcactgacgaaggcgccgcgctgaacgttgagattcatcgctttggcgatgtcggcgctcatttccatgcctttaatgcccaacaggccgcgcttgatttcgccaaactgaataagctggtcggcgagggttttcgccatattgcttggaatggcaaagccgatgccgatgctgccgccgcccggcgcgaggatcgcggtgttgatcccgataagctcgccgttgaggttcagcagcgcgccgccggagttgccgcggttaatcgaggcgtcggtctgaatgaaattctccagcccttcaaggttcaagccgctgcggccaagggcagagataatgccggatgtggcggtctggccaaggccgaacgggttgccgacggcgacggcgaagtcgccgacgcgaagtttatcagagtcagcaatggcgatttgcgtcaggtggtctggcttaatcagctgcagcagagcgatatcgctctgttcatcgctcccgaccagtttggcatcgaactcacggccatcgttcagctggacgctgatcttctgcgcctgattgatgacgtggttattggtcagcacatagcctttcgccgcgtcgatgataacgccggagccgagcccttcaaacggctgcgcctgctcctgcggggcgttatcgccaaaatattttttcagctcttccggcatattgagcgtcggcgaggcagtgccttccacctgtacgctaaccaccgccggcagaaccttttccagcatcggcgccaggcttggtaacgcgccctggccgggcacctgagtcggtaaggatgccgctgccggaggcaggaccgacaacgataacccaatgcttaacgctaacgcactcaacagcaaagtctgtttcttcattagatgctggctctcgtaacctgaggtgtatggaaaaatgtcctgaataacctgatgttattgaatttttgcacaggtaacaacgtggggactggtttaaattgtagccgggaagtgggggaaggagcgggcgcgacgggcgcgcccggagaatattttaatcgcagcgaggcttaatcgcgttttgcgcctccgcgcagtaaaccggatgcgccctcggagtagtcgcgcggcatctggaccggcgcctgatcgttactggcttcagactcttccagacggttgcggaacgggttggcgtctgccatcgagtccggcagcaggttgttagagcttttcgccatatgctgatatagctgacgatagtcgtgcgccatgttatccagcagttcggcgctacgcgcaaagtggctcaccagctcttcacggtactcttcaagctcggctttattcttttccagttcgtactgcagcgcctgctgttggcgcagtttgcggttgccgaaacgcatggcgacggcaccaatgatgataccgacgactaacccaattagcgcgtattcccaggtcatgaacatctcccgttgtattgtggttccgtagggtggctcttaggctctccgcctgcgcccgatagtgccactataaccgctaattccacagaagtggaatcctggcgtatcatcgcgtagtgtagaacggcctttttttcgtcaatcgtgagcttcggcattacggttttcaaggaataacaattagatcatgcaaagcctgtctccaacatcgcgttaccttttagccctgaaagagggcagccatcaacccgacgacgtccagcaagaagcggtgagccgccttgataccatttaccaggaactgcagacgcagcccgcgccggtcgcgtcaggcggcggtttgcgcgcgaaattcggcaaactgctgggtaagcgcgagccggctgccgggacggcacctgtccgcggcctgtatatgtggggcggcgtggggcgaggcaaaacctggctgatggacctgttttaccagagcctgccgggcgagcgtaaacagcgcctgcatttccatcgtttcatgctgcgcgtacacgaagagctgaccaccctgcagggacatagcgacccgctggagatcgtcgccgaccgctttaaagcggaaaccgacgtgctctgtttcgacgagttttttgtctccgatattaccgacgccatgctgttgggcgggctgatgaaagccctgttcgcccgcggcatcaccctggtggcgacctccaatattccgccggatgaactctatcgtaatggcctgcagcgggcccgttttctgccggcgatcgatgccatcaagcagcattgcgatattatgaacgtcgatgccggcatcgattatcgactgcgtaccctgacgcaggcgcacctgtggctgtcgccgctgaataacgacacccgcgaacagatggataaattgtggctcgcgctggcgggcgcgccgcgcgctgccgggccgacgctggagattaaccatcgcgagctgcctaccctcggcgtagaaaaccagacgctggcggcgtcattcgccacgctatgcgtggatgcgcgcagccagcatgactatatcgcgctctcccgactgttccatacggtgatgctgttcgacgtgccggtgatgaccgcgcagctggagagcgaggcccgccgctttatcgctctggtggatgagttctacgagcgccatgtaaagctggtggtcagcgcggcagtaccgctgtacgacatttaccagggcgagcggctgaagtttgagttccagcgctgtctctcgcgtctgcaggagatgcagagcgaagagtacctcaaacgtccgcatatgccctgacaggtgactttttcaggcggattcagggccgtaaggccgccccgggcgcggcctgaaaaatctcataaaggggtcgatctttgaccccgacttctctataatcttgcgaccccacgttacgagaaggtttttttcccgaaactttctatgcgccggcataggctattcgaaggggtaggtttgctggacaatgtcgtgtgaacctcaactgactaaacgtttgggtgttcaccaacgtgtaacttattatttgggtaagcttttaatgaaaacttttacagctaaaccagaaaccgtaaaacgcgactggtatgttgttgacgcgaccggtaaaactctgggccgtctggctactgaactggctcgtcgcctgcgcggtaagcacaaagcggaatacactccgcacgttgataccggtgattacatcatcgttctgaacgcagaaaaagttgctgttaccggcaacaagcgcgaagacaaaatgtactaccaccacaccggccacatcggtggtatcaaagaagcgacctttgaagagatgattgcccgccgtcctgagcgtgtgattgaaatcgcggttaaaggcatgctgccaaaaggcccgctgggtcgtgctatgtaccgtaaactgaaagtttacgcgggtaacgagcacaaccacgcggcacagcaaccgcaagttcttgacatctaatcgggattataggcaatggctgaaaatcaatactacggcactggtcgccgcaaaagttccgcagctcgcgttttcatcaaaccgggcaacggtaaaatcgttatcaaccagcgttctctggaacagtacttcggtcgtgaaactgcccgcatggtagttcgtcagccgctggaactggtcgacatggttgagaaactggatctgtacatcactgttaaaggtggtggtatctctggtcaggctggtgcgatccgtcacggtatcacccgcgctctgatggagtacgacgagtccctgcgttccgaactgcgtaaagctggcttcgttactcgtgacgctcgtcaggttgaacgtaagaaagtcggtctgcgtaaagcacgtcgtcgtccgcagttctccaaacgttaattgttttctgctcacgcagaacaatttgcgaaaaaacccgcttcggcgggtttttttatggataaaacggctgttatccacaagcatagcgccggttctcgccactttttcagcatttccagaatcccctcaccacaacgtcttcaaaatctggtaaactatcatccaattttctgcccaaatgctggtgattgttcattttttgttttattcgtgaacgaaggtgacatcgcgctaatggggtttttacatctggctggtcatgagtggccggcagcagtacaaaattctgaatatacctggaggttttcatggctgtcgctgccaacaaacgttcggtaatgacgctgttttctggtcctactgacatctatagccatcaggtccgcattgtgctggccgagaagggtgtcagttttgagatagagcacgtggagaaggataacccgcctcaggatctgattgacctcaacccgaatcaaagcgtaccgacgctggtggatcgtgagctcactctgtgggaatcccgcatcattatggagtatctggatgagcgtttcccgcacccgccgttaatgccggtttatccggtggcgcgtggtgaaagccgcctgtatatgcaacgtatcgagaaggactggtattcgctgatgaacaccatccagagcggtaccgcagcgcaagctgatgctgcgcgtaagcagctgcgtgaagaattgctggccatcgcgccggtcttcacccagaaaccttacttcctgagcgatgagttcagcctggtggactgctacctggcgccgctgctgtggcgtctgccggttcttggtgtggagctggttggcgctggtgcgaaagagctcaaaggctatatgactcgcgtatttgagcgtgattccttcctcgcttctttaactgaagccgagcgtgaaatgcgcctcggtcggggctaaataatggatgtatcacagctgacgccgcgtcgcccgtatctgttacgggcgttttatgactggctgctggataaccagctgacgccgcacctggtggtggatgtgacgctgccgggcgtgctcgtgccgatggagtacgcgcgcgatgggcaaatcgttctcaatattgccccgcgtgcggtaggcaatctcgagctggcgaacgacgaagtgcgcttcaacgcgcgctttggcggggtaccacgcaacgtgtctgtcccgctggctgcggtactcgccatctacgcccgtgagaacggcgctggtacgatgttcgaaccggaagcggcctatgacgaagacgtcagcagcctcaacgatgatgacgtcgcgccggagagtgaaagcgaaacggtgatgtcggtgatcgatggcgataagccggataatcacgacgacgatcctgacgacacgccgccgccgcgcggtggtcgcccggcgctgcgcgtggtgaagtgaatcccttctctgacaggccctgcggggcctgtttttttgtctgtccgctttgttaactctgccacaaacgaggcgtcccatggctggtatcgtcatcgccacaggtagtttttagggagcagacatgtctttactcgcacaactggaccagcgtatccgtcatcatggcggattaattgtctcctgccagccggtgccgggcagtccgctggataatcccgctatcgtcgcggcaatggcgctggcggctgagcaggcgggagcggtagcgctgcgcatcgaaggccaggccaacctgcaggccgttcgtccgttagtgacggtgcccgttattgggttgatcaaacgcgatttgcctgatagcccggtgcgtattacgccgtggctggaagatatcgacgcgctggcgcagggcggagcggatattattgctattgacggcacccagcgtcagcgtccggcgtcagtgtcggcgctattagcagaaattcatcggctgggaaaagtggcgatggccgattgctcatctctcgacgatgctctcgagtgctggcagttgggggctgagattgtcgggacgactctctccggctataccgcagaagagacgccggatgagccggatctggcgctggtgcaatgcctgagcgtggcgggctgcagagtgattgccgaagggcgctataacacgcctgcccaggcggcggaggcgatgcgctgcggcgcgtgggcggtgaccgtcggctcggcgattacccgcctggagcatatctgcggctggtataatacggcgctgaaagcggcggtttacccggcgaatgagcaataaaaaagcccgatgacgttaaccatcgggcttttatgcgtgaggctccggacctaatcagacttcaaggtagttgaggatcccgtccgccgctttacggccttcggcaatcgcggtgaccaccagatcggaaccgcgaacgatatcgccaccggcgaagattttcgggttgctggtctggaaggcgttttcgctgccttccggggcgataatacggccctgggagtccagctcgacgctgtgcttcgccagccactccatgctgtgcggacggaagccaaacgccatgactacggcgtcagccggcaccacgtgctcagagccggggacgagctccgcgcggcggcggcccttcgcatccggctggcccatttcggtgcgcgccatcttcacgccgcaaaccttaccgttggcatttacttccacgcccagcggctggacgttaaactggaactcaacgccttcttcgcgcgcgtttttcacttcgcgttttgagccgggcatgttctcttcgtcacggcgataggcgcagatcacgtgcgccgcattctgacggacggaggtgcgtacgcagtccatcgcggtgtcgccaccgccgagcaccaccacgcgtttgccttccatgctgacatagggctcatcggcggtttcaccaaagcccatgatctgcttagtgttagcgataaggaacggcagcgcgtcgtaaacacccggggcgtcttcgttgtccagtccaccgcgcatcgactgataggtcccgacgccgaggaacaccgcatcgtactccttcagcaggtcgtcgagctgcacgtcgcggcccacttcggtattgagtttgaactcaatgcccatgccggtgaagatctcccggcggcgggtcatcacctctttttccagcttgaacgctgggataccgaaggtcagcaggccgccgatttccggatggcggtcaaataccaccgccttgacgccgttacgggtcagcacgtcggcgcaggcgaggcccgccgggccagcgccgatgatcgcgacggttttaccggtcggcttcacgtcggagagatccggacgccagcccatctcgaatgccttatcgttgatatagcgttcgatgttgccgatggtcaccgcgccgaactcatcgttcagcgtacaggagccttcacacaggcggtcctgcgggcagacgcgcccgcagacttccggcagagtgttggtttgatgcgacagctcggccgcttcaaaaatacgcccctcgttggccagcttcagccagttcgggatgtagttatgcaccgggcacttccattcgcagtacgggttgccacaggagaggcagcgatccgcctgcgccttggcctggccttctgaaaacggctcgtaaatttccacaaactcaattttacggatcttcagcggtttctttggcggatcaacgcgctgcaggtcgataaattgataaacgttctgactcatcttaaccccttactgcgcctgcacccgcagctcagctgcggaacgactacggtgacccaacagtgctttaacatcgctggactttggtttaaccagcgcaaacttcgcggagaaggccggccagttggcgaggatctcttcgccgcgttgcgaaccggtaagctgtacgtgctcggtgattaaaccgcgcaggtgctcttcatggatggccagagaatcaacgtccagcacttccaccagctccgggttcacgcgtttgcggaagtcgccatcttcatccaggacataggcaaagccgccggtcatccctgcgccaaagttgacgccggtttttccgagcacgcagacgatgccgccggtcatatattcgcagccgttgtcgccgatgccttccaccacggtgatggcgccggagttacgcacggcgaaacgctcgcccgcgcggcctgcggcgtacagacgaccaccggtcgcgccgtacaggcaggtgttgccgataatactggcttcatggctgcggaacgcagagcccaccggcggacgaatggccagcagaccgcccgccatgcctttcccgacgtagtcgttggcgtcgccagtcagatgcagttccacgccgccggcgttccacacgccgaagctctggcccgcggtgccgctaaagtgagcgacgatcgggtcgcccgccagtccctggtcgccatgggtctgggcgatatacccggacagcgaggcccccacggagcggtcggtgttacggatatcaaaccagaacgtcttgctctgcttttcatccacgtacggtttcgcctgctgcagcagctgggcgttgagcacgccgttatcgaacggtgggttgttctcggtgcagtacagcgctttgcccggatgcggctctgcggtctccagcagtttacccagatccagtttctgctgcttggcggtgaacccatccagctctttgagcagatcggtgcggccaatcagatccaccagacgcttgacgcccagctgggccatcagctcgcgggtctcacgggcgataaattcaaagtagttggtcactttgaacggcagaccgtgatagtgattcttacgcagtttgtcatcctgggtcgccacgccggtagcgcagttgttcaggtggcaaatacgcaggtatttacagcccagcgcgaccatcgggccggtaccgaaaccgaagctctccgcgccgaggatcgccgctttgatgatatcgagaccggttttcaggccgccatccacctgcagacggatcttatgacgtagaccgttagcgaccagcgcctgctgggtttccaccaggccgagctcccacggacagccggcatatttcaccgaagagagcgggctcgccccggtgccgccgtcgtagccggcgatggtgatcaggtcggcataggctttggccacgccggtggcgatggtgccaacgcccggctcagaaaccagtttgaccgaaatcatcgctttcggattgacctgcttgaggtcgaaaatcagctgcgccagatcctcgatagaatagatatcgtggtgcggcggcggggaaatcagcgtgacgcccggtaccgaatagcgcagtttggcgatgtacggggtgactttatcacccggcagctggccaccttcacccggtttcgccccctgggcgactttgatctggatgacgtcggcattgaccaggtaggctggcgtgacgccgaagcggccggacgcgacctgcttgatgcgcgacactttattagtgccgtagcgcgccgggtcttcaccgccttcaccggagttggagaagccgccgatgctgttcatcgcttccgccagcgactcgtgcgcttccgggctcagggcgccgatcgacatcgccgcggtatcgaagcgtttaaacagctccttcgccggctctacttcgtcgatgctgatggcgtcttcgcctgggttgagcgccagcaggtcgcgcagcgtggccgctggacgttcgttaaccagtttcgcgtattgttgataatcgctgtattcgccgctctgcacggcctgctgcagggtgcgcaccacgtccgggttgtaggcatgatattcgccgccgtgcacatatttcagcaaaccgccctgggccagtggcttacgcgccagccaggcgcgtttcgacagattcagcagatcctgctggaagtcgtcgaagctggcgccgccgatgcggctgaccacgccctggaagcagagctcggagacatcgcgatgcagaccgaccgcttcgaacagcttcgagcagcggtaggaggcgatggtcgagatccccatcttggacatgatcttatacagacctttattgataccgttgcgatagttcagcatcaccgcacggtacggtttatcgatggctttgctgtcgaccagcttcgccagcgtttcgtaggcgaggtatggatagatagccgtcgccccaaagccgagcagcacggcgaagtggtgcggatcgcgggcgctggcggtttcaacgatgatgttggcatcgcagcgcaggcttttatcgaccagacgggtctggatcgcgccaacggccatcggcgccggtaccggcagacggtctttggcgatgttgcggtcagagagcaccagcagcacggtgccgtcgcgcaccatttgctccgctttatcgcacagcgctttcaccgtctcgctgagggaggcctctgccgggttgaacgtgatatcgaggacgtcggcgcgatagtgctcttcttccatcgtcgtcagctgtttaaaatcggagtacagcaggatcggcgatttgaagctcagacgatgcgcctggccttccgcttcgcagaagacgttcatttcgcgaccgatgctggtagccagcgacatgacgtgcgcttcgcgcagcgggtcgatcggcgggttagtcacctgggcgaactgctgacggaagtaatcgtagataatgcgcggctggctggagagcacggcgaaaggcgtgtcatcgcccatcgaaccgactgcttcctggccattttcgccgagcacgcgcaggacggagtccagctcttccgcgctgtagttaaactgtttctggtagctggcgagcgtgtcgtcatccagctggcggctgccaacctcttcgtccggcagatcttcgaacggcaccaggcgacgaacgtttttctccatccactctttatacggatggcggctcttcagatcgtcatcggtttccgctgagtgcagaatgcgtccggcacgggtatcgataaccatcagctcgcccgggcccacgcggcctttctcgaccacttcgtcaggctggtaatcccagatgccgacttcggaggcgcaggtgatgagcttatctttggtaatgacgtagcgcgccgggcgcagaccgttacggtcgaggttacaggccgcgtagcggccatctgacatgacgatgcccgccgggccgtcccacggctccatatgcatggagttaaagtcgaagaacgaacgcagctccggatccatatccgggttgttctgccaggctggcggcaccagcagacgcatggcgcgcacgatgtccatcccgccggccagcagcagctccagcatgttgtccatagaactggagtcggagccggtttcgttaacgaacggcgcggcgtcgtgcaggtcagggatcagcggggtctggaacttataggtacgggcgcgggcccactggcggttgccggtaatggtgttaatttcaccgttgtgcgccaggtagcggaacggctgcgccaacggccagcgtggtacggtgttggtggagaagcgctggtggaacaggcagatagccgactccaggcgcaggtccgcgaggtccaggtagaagcgcggcaaatccgccggcatacacagacctttatagatgttgaccagattggacaagctacaaacgtagaaatccttgtcttcctgcaggcgtttttcaatgcgacgacgcgcaataaacagacggcgctccatatcgcgcgggcgccagccagccggggcgttgacaaagatttgctcaatacggggcagcgaggagagggcgatttcaccgagcacgccttcgttggtcggcacatcgcgccagccgacaatcgacagggtctcaagctgaagttcttcttcaacgatgcggcgcgccgctttagccagctcaggatctttattcaggaacagcatcccaacggcgtagtttttggctaaacgccagccgcgctcttcggcaacgatgcggaagaaacgatcgggtttttgcagcagcagaccgcaaccgtcgccggttttaccatcggcaaggattgcgccacggtgctgcatgcgggccagtgcgtgtattgcggttcgcactaccttgtggctaggttcgccttctatgtgggcgatcaggccgaaaccacagttatccctctcaagggatttgtcgtacaacatatcagtgaacctccccaggctctacggacaccctccgataccgattgcgcacaggcacagaaagagcatggcgacggggtttacacctcgcattcgccctctttaaatccttttcgcatcggtacacaagtttgaggacttgctgttaagagggaatctcaattactgcataaatatgatgagcagagtgctcatccagaaagcttccagcggattcccaacttatcgggaatccacacttacgtcaaatggcaatcttattaatacaaaaatgtgctatacacaagttaactaattgttattaaagaaaataatggcaatttttatgctttgaatacgcctgctggtggtgcggctagtgtgatctgtctcactgtgcacgcggctttgcattaccaatatgcgctgaaatacatttcattattagcatatttgactgcaatatttttaactactggacattaataccgttttttaccagaaagcagattagggcaatgcgaagataaaatataaggaaaactcatcacctggtggttgaatgaaattgcagtaatcttgattgtttatgcaatagggttgatcgccgcgctgacgattgatccaggtcatcgccgtcggtgacgaaaagtggcaggcttggccccctttgttgagggcggtctatcagattatgcagttacagaaattagtcaatatgtttggtggggatcttatgcgtcgctatggcgaaaaggtccataagctaacgctgcacggcggttttagctgcccaaaccgcgacggcacgctgggccgcggcggttgcactttctgtaacgtggcatcgtttgccgatgaggcgcagcagcatcgctctatcgccgaacagctcgctcatcaggcgcagctcgtcaaccgggcgaagcgctatctggcctattttcaggcctacaccagcaccttcgctgaagtgcaggtgctccgttcaatgtatcgtcaggccgtcagtgccgcaaatatcgttggcctgtgcgtcggcacccgcccggactgcgttccgcaggcggtccttgacctgctgagtgaataccatcagcaagggtatgaggtatggctggagctggggctgcaaactgctcatgataagaccctgcatcgcattaaccgtggacacgatttcgcctgttatcagcgtaccgcgcgcctggcgcgagagcgggggctgaaagtctgtgcgcatctgatcgtcggtctgcccggagagagccaggggcattgtctgcagacgctggagcaggtagtggcgaccggcgtggatgggatcaaattgcatccactgcatattgtgaaaggcagcattatggccaaagcgtggcaggccgggcgtctcgatggcattgagctggaggcgtataccgtcaccgctggagagatgatccgccatacgccgccggaggtgatctaccaccgtatttccgccagcgcccgtcggcccacgctgttggcgccgctgtggtgtgaaaatcgctggaccggcatggttgaactggatcgttatctgaatcagcagggcgctcagggctcggcgctgggccgtagctgggttgttccccaggctgagtgagaagtacgagcgtgatgtccggaacaatgccggacatcgcgctcctgccatttatgcctggctggctttcatcgtcacacgcggagttttgatcacgaacagcaccagcagggcgccaagcgcggcgatagtgccggcgagtacgaaagcgctgtcaaatttaccagtagactgcacgatatagccggtaacaatcggccccacgatgccggagacgctgccgataagatggataaagccgctggcgccgccaacgcgggatttatgcaccacgtcctggataatcgcccagtagatcgccccggttacatagaggaaaaagatggagaccgacatcagcagaacggcaggcacgacgctgctgacggtacccgccagtcccacgcagatagcggccatcagcaggcataccaccagcacaattttgcgcgacagcagcaggcgcccggtgagtttaaaaattttatcggaaatatagcccccaagcgccagaccgacaaagccgactatccatgggatcatagtggtaaggctcatctgtttaatatccagatggtgctgttgtaccagataggacgggaaccagctgagaaagaaaaacagaatatagttgtagcagaagaaggcaaaggccgttaccagaataattggctgtttcaaataataacccagcgagtgagctgtttgattttctattgtttccagcgcgacttcttcttctttcattttattaatcagcttaagttcttcctggctgacttttttatgcttttcgggcgaattagcggcaatgaaaaaccacgctatcatccatacaataccgatagcgaaaataatcataaaagccgggcgccagccgaatgccagggccaggtaaccgacgatggggccggcgaccgcgccgcccagcggagagcctgcgctgagaaagccgacggcggtagccgcttgctttttaggaaaccagccgttgatcatcttgttcgccgatgcgcagatcgggccttccgccatcccgaaaagcacccgcagcaccagcatggaataaaagccggtggctaccgcggttaagccgcaaaacagcgaccacagaccgaccgccaggcccattaccagcgttgcgccaaacttatccacggccaaaccgccaataaaattaaataccgcgtagccgaagaaaaagctgccgaaaataatgccgaattgttcagcgttaagtgcaaggtccttttcaatcatcgggaccgtaatggataatgccacccggtcaagataatttatcatatatactaaaaataataacaggacgataatccagcggatattttttcccatgataacaccatgctcattatattatttatatcaggcgcggcggatacgcagatatccgtcggccgttattctatacgatgccggtttaacccaactgcagcagcactttgcagcaggtcttacggtcgttagcaaaaatctccatggcctctttcacctgctccagcggcatacaatgggtgattaacgcctccggacgaataaggcctttctccatccagtcgatgaccagcggaaaacgcccgctgttcagccgggaggagaaaatagaaatttctttactggtgatgctttgctgagtgagggttgaggcctcgccggagaaaccgagtataccgatgcgggcggcgggggaggcgaggagaatggcttcctgcaggatcgccgggtggcaggcggcatcaatgaccagcgtgggggcaagctgccgctgcgccagctgttccgtgagcggctggtcagtgttatcgagcgtcagatcggcgccgttttcccgggccatctgcagacgttcggcaatgcgatccacgacgatcacctgcttaacgccatataccccctttagcgcctgaatgattgtcagccccatcgggccagcgccgtaaaccagggcaatatcttgcgccgtgggctgcagctgggcggtaatatttgccgcgatggtaaaaggctcaaccatcgttgcctgacggtcgctgatagcctcggggatgcgccaggcatttttcgccggcacgcaggcatagtcgctaaatcccccgtcgcggtgaactcctatgacctggagctgcgtacagacattcggccttcctaccgagcaaggataacaatggccgcagctgacaacggggtccaccgcgacacgctcgccgatgcgtgccggagatacctgctcgccgacggcgtcgatgatgccatagaattcatggccgatgacgcggggatatttcgcgaaagggttgtggccgtgatagatgtgtacatcggaaccacagatcccagcaaaagcaattttcacccgtacttcatgggcgcccggaactggaaccgaacgtgattcaatgttcagttggcctggctctttgacgacgacgcttctcattttgattccttccattgtcttttttctgaacaaattacgctacttttattaccatacaagtatgcaaaagatcataatcaggcctggatcacatttgagaaagctcggcagaaaaagccatagcatgattaatctattgaaataaattgaaaaaaattatgaatgcgccgacgcattcgccgctggcgagccggtcggcaggaatgtgatcgctatcacgacagccaacgctcaatcatctatgattactggtatggtagtagggtaaattaaactaagttgagcaggtgaagacaatgcagatgacaatgcgctggtttggaccagaggaagacaaggtttcattagaacatattcgccaggtgcctggcgttgagggggtggtcggcgcgctctacgacgtcgcggtgggcgaagtatggccggtggataaaattgagcgtctggtcggtcaggcccatgccgcaggcctgaaaatggaggtgatagagagcgtcaacatccatgacgacatcaaaatcggcctacctacccgtgaccgctatattgccaactaccagcagaccatccgcaaccttgcccgctttggcgttaaagtcatctgctataacttcatgccggttttcgactggatgaagacggatatgaactacgtcctgccggatggctcgctgacgatggcgtttgagaagaaagatatcgataagcggctggaggacgtggtgaaggaggtgcttgagaattcaaacggcttcgccttgccgggctgggagccggaacggctggcggaggtgcagaccctgtttgccaaatatagcgcggtggatgatcagaagctgcgggagaacctggtttattttctgcaggcggtgatcccggtttgcgaagaggttggggtgaaaatggcgatccacccggacgacccgccgtactccatttttggcctgccgcgggtggtcaaaaaccgcgacgatctggactggatctgccgggctgtcgattcacccgccaacggcattacgctctgcaccggctcgattgccgaagatcctgataatgacgtgtacgccatcctggccgaatttacgcggcgtaagcgaattcattttgcccacgtccgcaatataaagctgatgcaggataaagacttttacgagtgcgcccatccgtcagagtacggctccctggatatgtacaaagtgatgcaagcgctgtatgacaacggattcgacggctatattcgcccggatcatggtcgctttatctggggagagaccggacggccgggctatggcttgttcgaccgcgccctcggcgtgacctacctgaaaggactctgggaggcgttaagcaagcgttaatccctctcctgatccccctcttttgcggctggttcgcctcagcggccggccgccgtatcgactcctgcccgcattttttgcacaacttacagcgcattgctcagaattgagtattattgtgcggagttgtcgtgaaggaatcccctatgaagcaaattcgtatgctggcgcagtattatgtcgacctgatgatgaagctgggtctggtccgcttttcgatgctgttggctcttgcgctggtggtgctggccatcgtggtacagatggcggttaccatggtgctgcatggccaggttgaaagtatcgacgttatccgctctatcttctttggcctgctgatcacgccttgggcggtctactttctctcggtggtggtggagcagctcgaagagtcccgtcagcgtctttcgcggctggtggacaagctggaggagatgcgtgagcgcgatctaaagctgaacgtccaactgaaagataacatcgcgcagttgaatcaggagattggcgaacgtgaaaaagcggaagccgagcgcgagaccaccctcgagcagttgaagattgagatgaaagagcgcgaagagacgcagatccagctcgaacagcaatcctcctttctgcgctctttccttgatgcttccccggacctggtcttctatcgcaatgaggataaggagttttcaggctgtaaccgggcgatggagctgctgaccggcaaaagcgaaaaacagctgatccacctcaaaccgcaggacgtctatagcgaagaggcggcggaaaaggtactggagaccgacgagaaggtgttccgccataatgtatcgctgacctatgagcagtggctggactatcccgatggccgcaaagcgtgctttgaaatccgcaaggtcccctactacgatcgcgtcggtaagcgtcgcggcctgatgggtttcggccgcgatatcaccgaacgtaaacgctatcaggacgctcttgagcgcgccagccgggataaaaccacctttatttccaccatcagtcatgagctgcgtaccccgctaaacgggatcgtcgggctgagccgaattttgctggataccgaactgaccagcgagcaggaaaaatacctgaaaactatccatgtctcggcggtgacgctggggaatatcttcaatgatattatcgacatggacaaaatggagcgccgcaaggtgcagctcgataaccagccggtggacttcaccagcttccttgccgaccttgaaaacctatccggcctgcaggcacagcagaaggggctgcgctttgtgctggagccgagcctgccgctgccgcataaggtaatcacggatgggacccgcctgcggcagatcctgtggaatcttatcagcaacgccgtgaagtttaccccgcagggcggaggggtgaacgtccgcgtgcgctatgacgaaggcgatatcctgcacttcgaagtggaagactccggaattggtattcctgaagcggaacaggacaaaattttcgccatgtattaccaggtcaaagacagccacggcggcaaaccggccaccggaaccgggattggtctcgccgtctcgcgtcgcctggcgcgtaatatgggcggtgatatcagcgttaccagccagccgggtaaaggggcgacctttacgcttaccgtccatgcgccagccattgcggaagaagtggaagatacgctggcggaagacgacatgccattaccggcgctcaacgtgctgctggttgaggacattgagctcaacgttattgtggcccgttcagtgctggaaaaactgggtaacagcgttgatgtggcgatgaccgggaaagccgcgctggagatgtttgagccaggcgaatatgaccttgtgctgttggatattcagttaccggacatgaccggactggatatttcccgggaactgaaacagcgctttgccgctgacgagctaccgccgctggtcgccctgaccgccaacgtgctgaagaataagaaagagtatctcgacgccggaatggacgatgtgttgagtaagccgctatcggtgccagcgctgacggccatgatcaagaaattctgggatgcaccggatgaggaagcgcaggaagcgccggcggccgatctgcataaagccgacgcggtgctggataccgatatgctggagcaatatatcgagctggtgggaccgaagcttatcaacgatggtctcgcggtgtttgagaagatgatgccgggctacatgtccgttctggagtctaatctgaccgcccgcgaccaaaaagggattgtcgaagaggggcataagatcaaaggggcggccggttctatcggactgcgccacatccagcagctgggccagcagatccagactccggatctgcctgcctggtctgataatgtcgctgaatgggttgaagagatgaaatccgagtggcaaaacgatgtagcggtactgaaggcgtgggtggcgaaagccagcaaaaaatgaccccggacagaccggggtgcgcgaatactgcgccaacaccagggaactggtggttgagccagtgttgtttgagtgatgttgttacgtggcgcaaccgaagaagtggattgctcgctcattaagatagcaaagcttaactaatttgttacatgaatcagtaaaatatgtgaagcatagcgagttaatcgacatttttgactggtttcagcgagttgcatggaggagcgaaagcgatgaaaaaaattggtgtggtactgggcggctgcggcgtgtacgacggcagtgaaatccatgaggcggtgattaccctgctggcgatcgcgcgcaacggcgcgcaggcagtgtgctttgcgcccgataaaccgcagcgcgatgtcatcaaccatctaaccggggaggcgatgccagagcagcgcaatgtgctggtggaagcagcgcgtatcgcccgcggcgacatcctgccgctggcgcaggcgcgtgcggagacgctggacgcgctgatcgtccctggcggcttcggcgcggcgaaaaatctaagcagcttcgccgccgagggcagcgaatgccaggtggatcccgatctgcgggccctggcgctggcgatgcatcagaccggcaagccgctgggctttatgtgcattgccccggcgatgctgccgaagatctttgcgtttccgctgcggatgaccattgggaccgatcttgataccgccgatgtggtggaagagatgggggcagagcacgtgccttgcccggtcgacgacatcgtggtggatgaagacaacaaagtggtcaccactccggcgtatatgctggcggaggacattgcgcaagccgccaccggaattgagaagctggtggcccgcgtgctggcgctgagcgcatgaggctccgcgttgcgccccttgcgctattaaaacgtctggcattgcgtctgctgctgatcgccgccgttttctggggcggggggatcgcgctgtttagcgtgctgccggtgccgttttcggcggtgatgcttgagcggcaggtgagcgcctggctgtccggcgatttccattatctggcgcattccgactgggttgccatggataagatctctccatggatggggctggcggtgattgccgccgaagatcagaagttcccgaaacactgggggttcgacgtgtcggcgattgagaaagcgctggcgcacaatgaacgtcacgagacccgcatccgcggcgcgtcaacgctgtcgcagcagacggcgaaaaacctgtttttatgggatggccgcagctggctgcgtaaggggctggaagccgggctgacagtcgggatcgaaaccgtgtggagtaaaaagcggatcctgaccgtctacctgaatattgccgagttcggcgatgggatatttggtgtggaagcggccgcccagcgctattttcataaacccgccagtcagctgacgccgggggaagcggctctgctggccgcggtgctgccgaacccgatccgctatcgcgccgatgcgccgtcaggctatgtgcgcagtcgtcaggcctggatcttacgccagatgcgacagctgggcggggaagggttcatgcgcgagcataagctctattagcgggttactccggcgccggggctggtacagtcgccagtcgtccctcgccgggaagcgtcacgtttagtcttcgtcaaagccagcgttaaacagggcaatcaccgcggcgagggcttcaacttcctgcggaccgctggcctccacctctatctgtcgccctttcgccgagtccagcatcagcagggcaatcacgctgttggcttccgcctccgtgccttcatcgttgcgcagcagtacttcggcatcgaaattctgcatcagttcgaacagcttcatcgccgggcgggcgtgcatgcccagcttattggtgatttcaacggtctgctttacggtcatgatttacgtttttccagcgtccgatgacgagactgcacgttcttgccgcgcgagcggaagtagtcagccagttgttcagcaatataaaccgaacgatgtttaccgccggtacagccaatggccaccgtcagatagctgcgattgttggtctccagcatcggtaaccatagctcaagatagcttcgggtctgataaataaagttgtgcacttcagtgtgccgatcgaggaaggcggccactggtttatccagaccggtcattggacgcagtttcggatcccagtgcgggttgggcagaaagcgcacgtcaaagacgtaatcggcatcgatcggaataccgtgcttgaagccgaaggattcgaagaccatcgtcagttcacgctcgcgtttacccagcagtcgggtacgcagcatttccgccagctcatgcaccgacatttccgacgtatcgacgatcagatcggcgcgggagcgcaggggctccagcagatcgctctcttcgtcgatggcgctttccagcgacagattcttgctggagagcgggtgcaggcgacgggtatcgctgtaccggcggatcagggtattgcggtcggcatcaaggaacagcagctgcggagaaaaacattccggcagattctgcatcgcctgctcgaagatctccggggattccggcatgttacgcacgtcgatgctgacggccgcggagatattgcggtcagccagcgaccgcgccaggtcgggcagcagcacgaccggcaggttatccacgcagtaaaagcccatatcttccagcgctcgcagagcgacggatttccccgagcccgagcggccgctgacgatcatcagtaccatgtaccgtttctcctcagtacgataaaggataaggtgcgactgccgttatgcgtcatcgctgcttcctgcttcggtgatgatctcatacaactcttcatcgctctgcgccgctcgcaggcgacgacaaatcgctttgtccgccagccgtttggccaccagggagagcgtatgcaggtgagtttttgtctggtcggccggcaccagcagcgcgaacagcaggtcgacaggttgattgtcgatcgcgtcgaaggcgatgggggtttccagctggacaaaaacgccgacagcacgcagcgtatcctcttccagttttccgtggggaatggcgataccattgccgatcccggtactgcccattttttcgcgggtgaggatcgcttcgaacaccacctgcggcggcaaacttaactgtttggcggccagttcgctgatgatttccagagcacgcttcttgctctggcagtgcacctggctacgggtacattcctggttcaggacgttgctcagttgtagagccgaatcgttgttcatcataatttcacctgagcgcccccgcgcccgtcgccgatgatatccagcggcgggcgcaagggggcccggacaattagtgttgttttagtttatctttgtgcttcgttaactgtcttgccagcttgtcgataagaccatcgacagccgcatacatatcctgcccttccgcactggcatggatttcgccaccgttgacatgcagattcgcgtccgcaatttgcgtcactttctctacttttaacacaatatagacctgattgatccggtcgaaaaattgctccagcttgctgaacttcgccgtaacgaattcgcgcatcgcaggcgtaatttcgacgttgtgtcctgtaatgttgagctgcatagtgtcttccttatcggttatgtcagaccagttgtttacgctggtttgacggcgggatggataaagactctctgtacttcgcgacagtgcggcgcgccaccataataccctgctcggacagcatggaggtgagcttactgtcgctcaacggcttcgcggggttttccgcggcgatgagcttcttcaccagcgcgcgaatcgccgtcgacgaggcttcgcctccgccttcggtattcacatggctggagaagaaatacttcagttcaaaaataccgcgcggactgtgcagatatttttgcgtggtgacacgggaaatcgtcgattcatgcatctcgacggcctgggcgatatcggccagcaccatcggcttcatatactcttcaccctgttcgaaaaaagcctgctgctgctctacgatgcagcggctgacgcgcagcagggtatcgttgcggctttccagacttttaatcagccagcgggcttcctgcagattgctgcgaatgaactggccgtcggcgtcattgcgggcgctgttgcccattgccgcatactgctgatttattttcaaccgtggaatgctgtcggcgttgagctcgacggtccagcggccgctcaccttgcgcaccagcacatccgggatgacatattccggttcgctggtctgaatggactggccagggcgaggatccagggactggatcaggttgaccgcctctttaagcacctcttctttcaggcgggtgactcgcattagagtgcggaaatcatggttggccagcagatcaagatggtcgctgataatcagccgcgcctcttccagccacggcgtctctttagcaaattgcgacagctggatcagcaggcagtcgcgcagatctttcgctgcgacgccaaccggatcaaaacgctggattcgcttgaggaccgcttccacctcctccaggccgatctcgtcatcgccgatgctgtcgacaatatcttcaatctgaatcgtgaggtagcccgtatcgtcgacggcgtcgacgatagaggtggcaatagcgcggtcggtgtcggtgaaaggcgtcagctcaacctgccacatcagatagtcctgcagagtctgggtggtctcgccttgatagacgggaagctcgtcgtcctgatagtcgacgccgttacccgacggcgtgccagcggtatagatttcatcccagctggcatcgagaggcagttcgtcgggcatctctttttgctcaagcgcatcgacggtatcgagggactcgcggtcctccacctcttttgcctctacctcgtcgtgaagatcggtttgctcaagcaacgggttactttccagcgcttgctggagctcttgctggagttctaacgtggacaactgcagcaaacgaatcgcctgctgcagctgcggcgtcatggcaagctgttggctaagccttaattgcaaaccttgcttcatgttcagggtaaatatctccggctaaaacgtctgtaacctctaccctatcagagtctgaagtcttccccaagatacacgcgcttaacctgctcatcttcgaggatctgctgcggtgtaccatgagcgataaggtgtccctgactgacaatatacgcgcgttcgcagaccgcgagggtctcacggacgttatggtcggtaatcagaacgccgagaccgctgtcgcgcaggtgctcaatgatgcgtttaatatcgataacggagatcggatccacgccggcaaagggttcatccagaagaataaatttcggattcgccgccagcgcgcgggcgatttcgacgcggcggcgttcaccaccggagagcgcctgaccgaggctgtcgcgcaggtgctcaatatgaaactcttccatcagctctttagcgcgatcttcccgttgttcgctggttagatcgtcacggatctgcaggaccgccatcaggttgtcatagacgctgaggcgacggaaaatcgacgcttcctgcggcaggtagccgatgccccgtcgcgcgcgcgcgtgcagcggcagcaggctgatgtcttcgtcatcgatgatgatattgcctgcgtcgcggggcacaatcccgaccaccatgtagaaggtggtcgttttaccggcgccgttcgggccgagcaagccgacaatctcgcccgagttaacggtgagactgacatcttccaccacgcggcggcctttatacgctttagcgagattcttcgcagttaaggttgccataacggattagttactcttcttttgctggttgccgcttttatcctgcagctcggacggcaccagaacggtggtgacgcgtcgacctttatcgctgaaggcctgcattttttgctctttcaccagataggtgatcttgtcgcccttgatgttgctgtcgagctgttccagataagcgttgcccgtcagcacgacgtaatcgttctgcagctcgtagcgcattttcgacgcccggccttttaccggcttgccgttatcctgcatctgatagaaagtagccgggttaccgaaaccttcgatcacctctttgcctttctcgttgcctggacgggtgaccaccactttatcagcgttaatcttgatcgtcccctgggtcacgaccacgttaccggtgaaggtgacgacattgccctgcatgtccagcgactgctgatcggattcgatatggatcggctgatcggtatcgcccgtcttggcgagggccggcaggctggcggccagtaacgcgccggcgagcgcaatcttaaggctgagtttgtttgttctgaatttcataagaggttctcaccttttcaatcagctcggcatttttgctgcgaaggtttccacgcattttcaggccgctggaattaaatgtggtgccgtataacgtcaccatgtcatcggaggtaacgtcctgcgttaccagatttatctgggcgttatccgtcgtaattttgcgcagttgagaatctggcgcgagcgcattcacctcaacgtgcccgtaaagatagagcatccggtcattcgtcagcttcgctttgtctgctctgaccgaccaggtaggcaccttgttagtatcaaaggtggtcatcaccggtttggtaaaccaggagacctcctgatcggaaaaatattccacgtgctcggcaatcagccgatagctcagggcgccttccggactgtataccacggtgtcggtatgttcgcttttatacgtagggtcgttaggattgacctccggctgggccgtgtcgtccgtattcgccagattcaggccgataaggatcagcgcgagcagcgacagtaaaatgataacccaacgtctggttttactcatattgattgccctttggcctcatccaacttgccctgcgccaatagtaacaaatcgcagacttcgcgtaccgcgccgcgtccgccgttaatccgcgtgacataattcgcccgcggtagcagcagcggatgcgcatcggcgacggcgacgctaaggcccacttcggccatcaccggccagtcaataagatcgtcgccgatgtaggcgacttcttccggccgcacgtgcagtttgtccgtcagatcgcggaacgccagcagcttgtccgactgcccctggtacaaatgcgtgatgcccagcgtctgacagcgatcttctaccagtttagcttttcgcccggtaataatcgccacttcaatacccgaggtcagcgcgcagcggataccatagccatcacggacgttaaacgctttcagctcctcgccgtgattacccatatagataagcccgtcggataatacaccgtcgacatcaaggatcagtagacggatcttcgccgcgcgatcgacaaacgcctggcttaccggcccgtagcaggtcgctaactgagcatcagcattattcattattttttccttacttacactacgcccgcgcgcagcagatcgtgcatatgtaccacacccagcagatggtcgccatcggcaaccagcacgcaggtgatatgacgggattgcatcaggtttagcgcatccaccgccagagtgccggggcggatgcggatacctccccgggtcatgacgtcggcaatgctggcatcgcgcatatcaacgccggtatcgaagacccggcgcaggtcaccgtcggtaaaaataccgatgatgttcatatcgtcatcgcagatagcggtcatgcctaaatttttacgcgtgatttccagcagcgcatcgcgcagggtcgcctgcaggccgacgtgcgggatttcatcaccggtatgcataatatcattgacccgcagcaacagcttacggccgagtgcgccgcccggatgcgacagggcgaaatcctcagcggtaaagccgcgggcttccagcagggcgacggcgagggcatcacccatcaccagcgcggcggtggtgctcgacgtgggcgccagtcctaacgggcaggcctccttcggcactttcacgcacagatggatatccgccgcgcgcgccatgctgctctccggccggctggtgatacagataagcttcacctgctggcgcttgaggaccgggatcagcgcgaggatttcattcgattcgccggagttcgacaacgcaattaccacatcctgaggggtgaccatacctaaatcaccgtgcgccgcttcgccggggtggacaaaaaatgccgaggtgccggtactggcgaaggttgccgccattttgcggccgatgtggccggatttgcccatccccatcaccacgactttcccgccgcagcggaaaatcgtttcgcaggcatgggtaaagtcttcatttatgtattgatcgagctgggccagaccttcacgttcaatttccagcacctgacggcctgcctgttgaaagtcaaaatccgtgggcaaatctatttgcgacatgatgttatcccgaatcattcaacgaagagcggtgctgtccaaaacagcatcgccaaccaaaccacaaagccgccgaccagcagcgcgccaaccagtcgtcccggctgctgctgacggcgccagcacagcactgcgaagatcaggctgaccagcagcatcacgccataatcgcgagtgaaggcttcggtcgcaaagctccccggcgcgatcagcgccggtaaacccagcaccagtgcgatattaaggatattggcgccgatgatattgccgatggcaatatcatcttcccctttccgcgccccggcgatggcggtggccagctccggcaggctggtgcctatcgccaccaccgttaggccgacggtcagttcgctgatggcgaaatagtttgccagcactgtactgttatccaccaccatgcgggtcgccatcggcatgacgatcatcgctacccctaaccagagcagggcgaccggcagcgacccttcgcgtggcagctccgccagctgttcgcgggtcaggctatcgcttccctggcgctccgccaggcgagcgattttgatggtgaacagcagccacagaagcgctaacgccagtaaaaatagcccgtcgagacgggtcagttgtccatcgtagagcaccagtcccgccagcacgctgaccagcaacattagcggtaattcgcggcgcagaatatcagaatgcacggtaaatggcctgagtaaggcggcgagaccgaggatcaataagatattggtgatattagatccgagcgcggtgccgaccgccagatcggtctgcccgtgcagcgaggccgcggtggcgaccatgatctcaggcaggctggtgccgatactgaccactgtcatgccgatgatcagcggcgggatccccaacatacgacacaggatggaggcggcatagaccagacgatcggcgctgtagacaaccagcaataaaccaataattaacagagccgtcgctaagagcatctaaagtcctttcttcaggtataatcgtcgcctcgctgggttatccctacgcagcgtaacgaattcttaattttgactttatgtgtgccaaaagtaaaacaaatgccagctttcgctaacctgtgcaggtaagattctgtaaaaatgttgtgattgtggcgcaagaaagggccatgcttgcccgtcaggtgtttagtaaggatgattttatgagccaaactcaggcgaatttagttgaagtgcgcggtatccgcttttcacgcggcgatcgtgtgatcttcgacgacatctcgctgtcggtgccgcgcggtaaaattactgcgatcatgggaccttcggggatcggcaagactaccctgttacgcctgatcggcggccagatcccgccggacaggggagagatcctgtttgatggcgagaacgtgccgcagatgacgcgttcgcgtctttatacggtgcgtaagcggatgagcatgctgttccagtccggcgcgctgttcaccgatctcaatgtctttgacaacgttgcctatccgctgcgcgaacatacgcatttgccgcctgcgctgctgcatacgacggtgatgatgaagctggaagcggtggggctacgcggtgcggcgaagttaatgccttctgagctttccggtgggatggcgcgccgcgccgccctggcgagagccattgccctggagccggatctgattatgttcgacgaaccgttcgtcgggcaggatcccatcactatgggcgtgctggtgaagctgatttctgaactcaacagcacgctgggtgtcacttgcatcgtggtttcgcacgatgtgcccgaggtgcttagtattgcggactacgcgtatatcgtggcggataaaaagattgtcgcccacggtagcgcccagtcgctacgggagaataccgatcctcgggttcgtcagttcattgatggtattgccgacggtccggtgccgttccgttatcctgctggcgactatcaccatgatttattaggcatagggagttgagcgactcatgctgtttaatgcgctggccgcgctaggtcatcgcggtattaaaaccaccgcgacgtttggacgcgccggattaatgcttttcaacgccgttgtcggcaaaccagagtttcgcaagcacgcgccgctgctggttcgtcaactctataacgtcggcgtcctgtcgatgctgattatcattgtatcgggcttgtttatcggtatggtgctcgggctgcaggggtatctggtgttaaccacctacagcgcagagaccagtcttggcatgctggtggcgctgtcgctgctgcgtgagctggggccggtggtcgccgcgctgctgtttgccggccgcgccgggtcggcgctgaccgccgagattggcctgatgcgggccacggaacagctctccagtatggagatgatggcggtggatccgctgcgtcgcgtcatttccccacgcttctgggccggtgtcatttcgctgccgctgctgacgattatcttcgtcgcggtagggatctggggcggtgcgctggtgggtgtgagctggaaaggcattgacggtggttttttctggaccgcgatgcaaaatgccgtcgactggcgaatggatctggtgaactgcctgattaagagtctggtgttcgctattacggtaacctggattgcgttatttaatggttatgacgctatccccacttccgccgggattagccgggcgacaacgcgtaccgtggtgcatgcgtcgctggcggttctggggctggattttgtgctgactgcgctgatgtttgggaattgagttcatgcaaacgaaaaaaactgaaatctgggtaggggtgttcttactggtggcgctgctggcggcgctgtttgtctgcctgaaggcggcgaacgtcacctcgctacgcaccgagccgacttatcgcctttatgcgactttcgataacatcggcggcctgaaggcgcgctcgccggtgcgcatcggcggcgtggtagtggggcgggtagcggacattacgctcgatccgaaaacctatctgccacgcgtggagctcgatatcgatgagcgctacaaccatatcccggataccagttcgttggcgatccgcacctctggcctgctgggcgagcagtacctggcgctgaacgtcggttttgaagacccggacctcgggacgactatccttaaagacggcggcactatccaggacaccaagtccgccatggtgctggaagatctgattggtcagttcctttataacagtaagggcggcgacaatcagaattctggcaatgataaggccgaggcagaaggtcatactgacgcgacgccggcagccggcacgacgcattaatttcaggagaaatacgatatgtttaaacgcttactcatggtcgccatgctggtgattgccccgctgaccgccgtccaggccgcagatcagtccaatccgtataagctgatgaatgaagcggcgcagaaaaccttcgatcgcctgaagaatgaacagccgaagattaaagctaatcctaactatctgcgcgacatcgtcgaccaggagttattgccgtatgtacaggtgaaatatgccggcgcgctggtgctgggccgctattacaaagaagcgacccctgcgcagcgtgaggcctattttgccgccttccgtgaatacctgaagcaggcctacggtcaggcgctggcgatgtaccatgggcagacttaccagattgctccggagcagccgctgggcagcgcaaccatcgttccgatccgcgtcactatcatcgacccgaacggtcgtccgccggtacgtcttgacttccagtggcgtaaaaatacccagaccggcaactggcaggcctacgatatgatcgcggaaggggtgagcatgatcaccaccaaacagaatgagtggagcgatctgctgcgcaccaagggcgttgatggcctgaccgcgcagctgaaagcgatctctgcgcagccgatcaccctggaacagaaaaaataatgagcgggcagctgagctggactcgcgagggcgagacgctggcgctgcacggggagctggatcaggatctgctggtcccgctctgggaggcgcgcgcccaggcgacggcgggaacggcgatcatcgatctcagtcagaccacgcgcgtggacaccgcgggcctggcgctgttagtgcattttatggcgctgattcgccgtcagggccgggaagcgcagctggtcggcaagagcgaaaacctgcaaacgctgatcggtctttacaacctgcctgccgatctgatctgataatcttttcagtgccttagcactgaagctattccgaaagccctggcaatcttttcgccggggctttttgcttgtttaagaccgcgccactttcctctaagatgttgggctgttttcactatcagataaatttgagcccatggaaaatcatgaaattcagaccgtgctgatgaacgcactccccctccaggaagtccacgtctctggcgatggcagccactttcaggttattgctgtgggtgagatgttcgatggcatgagtcgggtgaaaaagcagcagagcgtttacgcgccgctgatggaatatattgccgacaaccgcatccatgcgctgtcgatcaaggcctttactccgcaggagtgggcgcgagaccgcaaactcaatggcttctaagctgtgggggatcccctgcagcgtatgtgaatttttaatagagaacagaatcaatggataaattccgtgttcaggggccgactcgccttcagggtgaagtcaccatctccggggcaaaaaacgccgccctgccaatcctcttttccgcgctgcttgccgaagagccggtagagatccaaaacgtacctaagctgaaagacatcgataccaccatgaagctgctgagccagctgggcgcgaaggtcgagcgcaatggttcggtatggattgacgccggcccggtcgatgtattctgtgctccgtacgatctggtgaaaaccatgcgcgcctctatctgggcgctgggcccgttggtggcgcgtttcggtcaggggcaagtttctctgcctggcggctgcgctatcggcgcgcgtccggtcgatctgcatattagcggtctggagcagctaggcgccgagatcaaactggaagaaggttatgtcaaagcctcggtcagcggtcgcctgaaaggcgcgcatattgtgatggataaggtgagcgtcggcgccaccgtaaccatcatgagcgcagcgacgcttgcggagggaacgacgattattgaaaacgccgctcgcgagccggagattgtcgataccgccaacttcctgaacgcgctgggcgcaaaaatcacaggccagggtagcgatcgcattaccatcgaaggcgtgcagcgcctgggcggcggcgtctaccgtgtgctgcctgaccgtattgaaaccgggactttcctggtggccgcggcgatttccggcggcaagatcctctgccgtaacgcgcagccggataccctggatgccgtactggcgaagctgcgcgacgccggggctgacatcgaaacgggcgaagactggatcagcctcgatatgcacggcaaccgtccgaaagcggtcaacgtgcgtaccgcgccgcacccgggcttcccgaccgatatgcaggcccagttcacgctgcttaacctggtagcggaagggaccggcgtgatcaccgaaacgatctttgaaaaccgcttcatgcacattccggagctgatccgtatgggcgcgcacgcggagatcgagagcaataccgctatctgtcacggcgtgaagcagctttctggcgcgcaggtgatggcgaccgatttgcgcgcgtcggcgagcctggtgctggccggctgtatcgctgaagggaccaccatcgtcgatcgcatctatcatatcgatcgcggctatgagcgtatcgaagataaactgcaggccctgggcgccaatattcaacgcgtgaagggcgagtaaccgcgtcctgacagcgccccgggacgttgttccggggcgctgtcgagcaatcacatcacttgtcgatcttcttctgacgcatcatctgcgttctgtcgataaactcatgagtcaccgggtcgtggtagcgtgacggccagatgacccacggctgcgtttccagcgctgtggcgataatcaattcgcctttcggccaggggcgggtcagggcgttcgccagcgttgaagaacttagtccgtgccgtcgcgactctgccgccagcgatgttccccgtttacgtaatcccgcaacaatatctgcgggatgccagtcgatgaacttatccataaattctcctggtgttaaaggtccagatcgtcccacatgggcgatagagacactatacccgcgtactatgtagggttctaacaagttctgttaaagcgccggaatattcagaatctatcaagatattcggaattttagggagagaaatggcattttactggaactttcccgcgcgtcgcgcgggaaaggaggggggattaatgatcgcgctggactgcaatatgcgccagcccaatcaaggcttcgcgccagggcgtgtccgggaggatctgcagcgcggcaatggctttgtcagcttcttcttcggcacgcttctgcgtccattccagcgaaccgcaggtcgccatcgtttccagcacagcatccagtagatggcggccgttgccttgctcgatcgcaccgcggatcatcgctgattgatcgggtgtgccatggtgcatggcgtgcagcagcggtagcgtgggtttaccttcgttcaggtcgtcaccgacgtttttaccgagccgctcgccgtcagagctataatcgagtaaatcgtcgattagctggaaagcggtgccgagatagcggccataatcctgcaacgcgcgctcttcttccgcagtgcagtcggccagcagtcccgcacactgcgaggcagcttcaaacagacgcgccgtcttgctgtagataacgcgcatgtagttctcttcggtgatatccgggtcattgacgttcatcagctgcagcacttcgccttcggcaatgacgttcaccgcttccgacatgacctcaaggatcttcagcgagcccagctgggtcatcatctgaaaggcgcgggtatagataaaatcgccgaccagcacgctggcggcattgccaaacgccgcattggccgtggctttgccgcgacgcatatcagactcatcgacgacgtcgtcatgcagcagggtggcggtatgaataaattcaatcagcgcggcaatggtgacatgcgcgctcccctgatagcccaccgcgcgtgcggcgagcacagcaatcatcgggcgaatgcgtttgccgccgccgctgacgatgtaatagcctaactgattgataagctgaacatcggagttgagttgctcaagaatcgtcgcattgacacccgccatatcttgcgcggttaactcattgattttttctaaattcatcgcaaaagccgggccaaatgtcctgttaccatgaatccaggtgggatcacagaaggattaagacagaattaaaagaagatatgattgtactgaaaaattgccgtagataaacgttgtcgtgaaagttgtgttttttttctgcattgatcgctaatcgctcttgtcaaaggctcgcgttttgcgtaatattcgcgccctattgtgaatatttatagcgcactctgaatcacataaagaggtgcgcggaagcggagttttatatgtacgcggttttccaaagtggtggtaaacaacaccgagtaagcgaaggtcagaccgttcgcctggaaaagctggacatcgcaactggcgaagctgttgaattcgctgaagtgctgatgatcgcaaacggtgaagaaatcaagatcggcgttcctttcgttgagggcggcgtaatcaaagctgaagttgttgctcacggtcgtggcgagaaagttaaaatcgttaagtttcgtcgtcgtaaacactatcgtaagcagcagggccatcgtcagtggttcactgatgtgaaaatcactggcatcagcgcctaagacctgaggagtagatttaaatggcacataaaaaggctggcggctcgactcgtaacggtcgcgattcagaagctaaacgtctgggcgtaaaacgtttcggcggtgaagcagttctggcaggtagcatcatcgttcgtcaacgtggtactaaattccacgctggtaccaacgttggttgcggccgtgaccacactctgttcgctttgactgacggtaaagtcaagttcgaagttaaaggcccgaaaaaccgtaaattcatcagcatcgttgctgaataagtttttcgcgtcccggtaacggatgaaagccccgcaacacgttgcggggctttttacattcgtctaccggaaaatttttgcagggaaacaggcatgaagcagcaggctgggattggcattattctggcgcttaccaccgcgatgtgttggggagcgttgccgattgcaatgaaacaggttctcgaggtgatggcgccgcctacggtggtcttttatcgcttcctgatggccagcattgggcttggcgcgatcctcgcgatcaaaggcaaactgccgccgatgcgaatttttcgcaagccgcgctggctggtgttattagcgattgccaccggcggtctgttcggtaacttcatcctgtttagttcttccctgcaatacctcagccccacggcttctcaggtcatcggccagctgtcgccggtggggatgatggtggctagcgtcgtaattctgaaagagcgcatgcgcggcacccaggtggtgggcgcgttgatgctgctcagcgggctggtgatgttcttcaataccagtctgattgaaatctttacccgcctgacggactacacgtggggggtaattttcggcgttgctgccgctacggtgtgggtaagctacggcgtcgcgcaaaaggtgttattgcgccgtctggcatcacagcagatactatttttgctgtacactttgtgtacgattgcattattgccgcttgctgagcccggagtgatttcccggttaagcagctggcaactggcatgcctgattttttgcgggctgaataccctggtcggctacggggcgctggcggaagccatggcgcgctggcaggcggcgcaggtcagcgcgttaatcaccttgacgccactgtttacgctactgttttctgatttattatcaatggcctggcccgatgttttcgccagaccgatgttaaacctgattggttatctcggtgcgtttgtcgtggttgcgggcgcgatgtattccgccatcggtcatcgtctttggggacgttggcgtaagcgagaggcggtagtaccgctgccccgctcaggcgaatgatttacggagagtaaaatgaagtttgtagatgaagcaacgatcctggtcgtagcaggtgacggcggcaatggttgcgtaagcttccgccgcgaaaagtatattccgaaaggcggtccggatggcggcgatggcggcgatggcggcgatgtctggctggaagcggacgagaacctgaacaccctgatcgactaccgttttgaaaaatcgttccgcgccgaacgtgggcagaatggtcaaagccgcgactgtaccggtaagcgcggtaaagacgtgacggtaaaagtgccggtcggcacccgggttatcgatcagggcaccggcgagaccatgggcgatatgaccaaacacggtcagcgtctgatggtggcgaaaggcggctggcacggtttgggcaacacccgtttcaaatcgtccgttaaccgtacgccgcgtcagaaaaccatgggtaccccgggtgataaacgcgacctgcagctggagctgatgctgttggccgatgtcgggatgctgggcatgccgaacgccggcaaatccaccttcatccgtgcggtctccgccgccaagccgaaagtggctgactatccgtttaccaccctggtgccaagcctgggcgtggtgcgtatggacaatgaaaagagcttcgtagttgccgatatcccggggctgattgaaggcgcagcggaaggggcaggcctcggtatccgcttcctcaagcacctcgagcgctgccgcgtactgctgcacctcatcgatatcgatccgatcgacggctccgatccggttgagaatgcgcgcattatcatcggcgagctggagaaatacagcgagaagctagcctccaaaccacgctggttagttttcaacaagattgacctgatggacaaggccgaagccgaagccaaagccaaagcgattgccgaagcgctgggttgggaagagaaattctacctgatctccgcggccagccagcagggcgtgaaagagctgtgctgggacgtgatgaccttcatcatcgaaaacccgatcgtccaggcggaagaagagcagaagccggagaaagtcgagtttatgtgggacgactatcaccgtcagcagcttgaagaggccgaagccgaagcagaagatgacgaagactgggatgacgactgggatgaggacgacgaagaaggcgtcgaattcatctacaaacgctaatcctgacttctctggatcaaaaagggccgcatctgatgcggcccttttgttttaattgttctggtacaaatctttatacaagcggctttcaaagcggaccagtgggatgcggcgattgcgctgatcagctggctccacggcgtatccggagagatattgcacgaaggccatcttttgtccgctggcggtagtgatgaagcctgcgaggttataaaccccctggagcgacccggttttcgccgaaactttaccatcgacgcccgcctgatgaagaccggcgcgatactgcagcgatccgtcatggcccgccagcggcagcatggagatgaagttgagctcggtatcgtgctgggcgatatactgcagcacctgcatcatggtcgccggggcgatcaggttgtggcgcgacaggccagagccgtcggcgatgatagtgttgccgagatcgaccccagcctgttgacgcaggatctgccgtacggcatcggagcccgcccgccaggtgccaggtacgccgaaccgggcgtggccgatggtgcgaaagacggtgtcggcaatcatgttgtctgacttcttcagcatgatccgcagcagatcgtgcagcggagccgactggctggttgccagcacggtgccgggctcattggccagcgtctggcgcagcagcgtgccgctgtaggtgatccccgcctgggccagctcggctttgaggatcgctccggcatagctggcgccatcctgaatggcgaaggccagaggcagcggctcgctacgctgcggcaggcagccggtgagagtatagcgattgagatcgcccggcaccacgtcgagctcgcaatactgggcttccgatgagccacgcgccagcgttcgtacctggctgaacatggtgaccggataataggatgcaacgcgaatgaaggcgacatcgcccggtttctgcgcgctatacagcgagacagagaagcagttacggtcgacaatcgccgccgccggcggggcgctgaagcactgcgtcaggtcgttccacggccagccgggcgctttgtcatggctggcgaagaccgaggtatcgatgagcacattgccttcgatacgctgcacgccggcttttttcagcgtcgccaccatattgcgaatatcctgccgtttaagcgtcggatcgccgccgaagcgtgcaatcaggtcgcctttcagcacgccgccgtcaagggaacctttggtttccagcgtggtggtaaagcgaaaatcgggccccagttgcagcagcgccgccagcgcggtgatgaccttttgcgtactggccgggagcgccatttgctggctgtgatagtcgatttccggcgtcgatgcgccgaccttttgcgccataaaggcaaggttcgcaccggcgggaagctggttgatgtactcgtcaatattcgccgcctgagcgctaagcgctataccggcggtcaatccgatgataaatctgggaaatcgcataatctcgcgctaacaacctgaagccaggccgtcatactacggtgcaacgcccagtaaagtaaacgatgacccataatgaacttcggggtaaaatacccatcaaatgaaaaattgctgctgacctggggagtgtttcccgggtcggtttctttttgctcgtgtcctgcccgtgggcaggacaggtggcggagcggagctatccgttccctgaaggaatgataaagaggtataactaatgcaagcgattccgatgaccttacgtggcgctgaaaaactgcgcgaagaactggattatctgaagtctgtgcgtcgtcctgaaatcattgccgctattgctgaggcccgtgaacacggcgatctgaaagagaatgccgagtatcacgccgcgcgtgagcagcagggtttctgcgaagggcgaatcaaggatatcgaagcgaagctgtctaatgcgcaggttatcgatatcaccaaaatgccgaacaacggccgggtgatttttggttctaccgtcagcgtgctgaacctcgataccgacgaggaacagacctaccgcatcgtgggcgatgacgaagctgattttaagcagaatctgatctccgtgaactcgccgatcgcccgcggtctgatcggcaaagagcaggatgacgtcgtgactatccgtaccccgggtggggaagtggaatacgaaattaccaaggttgaatacctgtaaggcgtatttcccgctacgatgtttatagattgtaaagaaaggaaaaaggccgcatagcggccttttatcaacgtcaggagcatggcattttgctcgcctggccgcagaaatccctcgttttacacaaagttgtgtcgagattcaggatattcttagcgtggcagcgagattttacgctctggtgttgggcggtacagaaccagcgttttaccgatgacctgtacgttacaggcgccggtttcgcgtacgatggcttccacgatcaaggcttttgtttcgcgatcttctgaggcgatcttcaccttgatgagttcatggtgccctaacgcttgttcgatctcggccagtaccccttcggtcaaaccattgttgccaagcataactaccggcttgagcggatgtgccagacctttcaggtgctgtttttgtttagtactcagattcatcgtatttttttgcttacgttgggattgaaaacgggtcattctaccgccatctcccatatatcgccaaactaccgcgtcgatttttacgcagtaaagtacgatgaacccgaacgggaatgttaaatgacaggtaaaaagcgttctgccagctcaagccgctggcttcaggaacactttagcgataaatatgttcaacaggcacagaaaaaggggttacgttcccgtgcctggtttaaacttgatgaaatacagcaaagtgacaaaatttttaagccggggatgacggtagtcgacctcggtgctgctcccggtggctggtcgcagtatgcggtcacgcagatcggcaacagcggccgcatcatcgcttgcgatcttttaccaatggatccaatcgttggtgtggacttccttcagggcgattttcgtgatgaattagtcctgaaagcgttacttgagcgagtgggcgacagtaaagtccaagttgtcatgtccgatatggcgccgaatatgtgcggaacaccggcggtggatattccccgggctatgtatctggtagaactggcgcttgaaatgtctcgtgatgtattagcgccaggtggtagttttgtagtgaaggtgttccagggcgaaggcttcgatgagtatcttcgagaaattcgctccctgtttacgaaggtcaaagttcgtaagccggactcttcccgcgctcgttcgcgtgaagtgtatattgtagcgaccgggcgtaaaccataaccggcagatttcaaacgaaagtttgaaagaaactggatatagagtatcctgacgctgtttttaacacagttgtaataagaggttaatcccttgagtgacatggcgaaaaacctaatactctggctggtcattgccgttgtgctgatgtcagtattccagagctttgggcccagcgagtcgaatggccgcaaggtggattattctaccttcctgcaagaggtcaatcaggaccaggttcgcgaagcgcgtatcaacggacgtgagatcaacgttaccaagaaagatagtaaccgttacacgacttacattccggttaacgatccgaagctgctcgataacctgttgactaaaaacgtcaaagttgttggcgaaccaccagaagagccgagcctgctggcttccatcttcatctcctggttcccaatgctgctgctgatcggcgtctggatcttctttatgcggcaaatgcagggcggcggcgggaagggcgcgatgtccttcggcaaaagcaaagcccgtatgttgacggaagaccagatcaaaaccacttttgcagacgttgccgggtgtgacgaagcgaaagaggaagtcggcgagctggtagaatacctgcgtgagccgagccgcttccagaaactgggcggtaaaatcccgaaaggcgtcctgatggtcggccctccgggtaccggtaaaacgctgctggcgaaagcgatcgctggtgaagcgaaggtaccgttctttaccatttccggttctgacttcgtcgaaatgttcgtcggtgtgggcgcttctcgtgtgcgtgacatgttcgaacaggctaagaaagccgcgccttgcatcatcttcatcgatgaaatcgacgccgtcggccgccagcgtggcgcaggcctgggcggtggtcacgatgaacgtgagcagaccctgaaccagatgctggttgagatggacggctgcgaaggtaacgaaggtatcatcgttatcgcggcgactaaccgtccggacgttcttgaccccgcgctgttgcgtccgggccgttttgaccgccaggtggtggttggcctgccggatgttcgcggtcgtgagcagatcctgaaagtgcatatgcgtcgcgttccgctggcgccggatatcgatgcggcaatcattgcgcgcggtaccccgggcttctccggtgcggatctggccaacctggtcaacgaagcggcgctgtttgctgcccgcggtaacaaacgcgttgtgtcgatggttgagttcgagaaagcgaaagacaaaatcatgatgggtgcggaacgtcgctccatggtgatgacggaagcgcagaaagagtctactgcttatcatgaagcgggccacgcgattattggtcgcctggtgccggagcacgatccggtgcacaaagtgacgattatcccgcgcggtcgtgcgctgggtgtgaccttcttcctgccggaaggcgatgcaatcagcgccagccgtcagaaactggaaagccagatctccaccctgtacggcggtcgtctggcggaagagattatctacggtccggaacatgtttctaccggtgcgtccaacgatattaaagtggcgacgaacctggcgcgtaacatggtgacccagtggggcttctccgacaaactcggtccgctgctgtatgcggaagaagagggtgaagtcttcctcggccgtagcgtcgcgaaagcgaagcatatgtccgatgaaaccgcgcgtatcatcgaccaggaagtgaaatcgctgattgagcgtaactacggtcgtgctcgccagctgctgaacgacaacatggacattctgcacgcgatgaaagatgcgctcatgaagtatgagaccatcgatgcgccgcagattgacgacctgatggctcgtcgcgaagttcgtccgccagcgggttgggaagaacctggttcttctaacaactctgacaacaatggcacgcctcgtgcgccgcgtccggttgatgaaccgcgtacgccgaacccgggcaacaccatgtcagagcagctgggcgacaagtaagctaccgctgttgatgcttgtttaaccttaaaaccccgggcgtccgctccggggtttttcttttttaacctcttcagtctcagggattttgtgatgaaacttgtagcccagggctcaaccctcgatctctctcacccccacgtgatgggtattctaaatgtgacgcctgactccttctccgatggcggcgcccataattcgctgattgaggcggtgaagcatgccaatctgatgatcaacgccggcgcgaccatcattgatatcggcggtgaatcgacgcggccaggggcggctgaggttagtgtggaagaggagcttgcgcgggtgataccggtggttgaagccattgcccagcgctttgaggtatggatctcagtggatacctccaaggcggaggttattcgccaatcggccagggccggggcgcatatcatcaacgatattcgttcgctgaccgagcccggcgcgctgcaggccgccgcggaaaccggactgccagtgtgtctgatgcatatgcagggacaaccaaaaaccatgcaggaggcgccgaagtatgaggacgtcttcgccgatgttgagcttttttttaatgagcacattgtgcgctgcgaacaggcggggatcgcaaaagaaaaattgctgctcgacccgggattcggtttcggtaaaaatctctcccacaattaccaactgttggccaggcttggggagtttcatcactttggtctgccgctgctggtcggtatgtcacgtaagtcgatggtaggtcagttgctgaacgtcgggccgtcggagcggctgaacggcagcctggcgtgtgccgtcattgcagcaatgcagggcgcgcagattatccgcgtccatgatgtcaaagaaacggtagaagcgctgcgcgtggtggaagccaccctcgccgctaagggaaaaaaacgttatgagtaaccgcaagtattttggcaccgatggtattcgtggccgcgtcggcgatgcgccgatcactccggagtttgtgctcaagctgggctgggcggcgggcaaagtgttagcgcgtcacggttcgcgtaaaattatcatcggcaaggatacccgtatttcgggctatatgctggaatcggcgctggaagctggactggcggcagcggggctctctgcgtcgttcaccgggcctatgccgacaccggccatcgcctacctgacgcgcgccttccgcgccgaggcggggattgttatctctgcttcacataaccctttctacgacaacggcattaaattcttctccattgagggcaccaaactgccggatgatgtcgaagaggcgattgaagccgaaatggagaaagagctcacctgcgtggattcggctgagctgggcaaagccagccgtatcgtcgatgcggcggggcgctacattgaattttgtaagggtacctttcccaacgaactgagcctgggaacgctgaaagtggtggtggattgcgcgcacggcgcgacctatcacatcgcccctaatgtcttccgcgagctgggagcccaggttatcgcgatgggctgcgagccagatggtctcaacatcaacgaagaggtcggcgccactgacgtgcgggcgctgcaggcgcgcgtgctggcggaaaaagccgatctgggtattgcctacgacggcgatggcgatcgggtgattatggttgaccacgaaggcaataaagtcgatggcgaccagatcctctatatcatagcccgggaaggattgcgtcaggggcagctgcgcggcggcgccgtcggcacgctgatgagtaatatggggctggagctggcgctcaagcagttaggcatcccgtttgcccgcgcgaaggtcggtgaccgctatgtactggagatgctccaggaaaaaggctggcgcatcggtgcggaaaactccggccatgtgatcctgctggataaaaccaccaccggcgatggcattgtcgccagcctgcaggtggtcgcggcgatggtccgcaaccacatgagcctgcatgacctgtgcagcgggatgaaaatgttccctcagctgctggtgaatgtccgctttaccgagggcagcggtaatccgctggagaatgagcatgtcaaagcggtgaccgcggaagtggaggcggcgttaggaaaacgcggccgtgtcctgctgcgtaaatcgggtacggagccgctaatccgcgtgatggtggaaggcgagcatgaagatcaggtgcacgagtttgcgcaccgcatcgctgaggcggtaaaaagcgtttagctttgccggctaagtggttaaaaaggcggcgcttgccgccttttttatgatcgaaaattggctttttgctgtttttttctgcagttgatacaatgtgtcgaaattgcccttgcgaaggtcattcgctttggttagtattcacacccgcttcagtgggaaacgttaaaacgtcccgctttattggtcgaagcacttggtatgcggcgaatccgcaaggaacaggttgattatgtacgaagctcttttggttgttttccttattgtagcgattggccttgtaggtctggttatgctgcagcaaggtaaaggcgctgatatgggagcctccttcggtgcaggcgcttccggcacactgtttgggtccagcggttctggcaactttatgacccgtatgaccggcatcctggctgcgctgttcttcatcatcagtctggcgctgggtaatatcaacagcaacaagaccagtaaaggaagtgagtgggataatctgagcgcgccgaaaacggagcaaactcagccaactgcgccggctcagccgaccagcgatatcccgcactaagtattctgtaccgaggtggtggaattggtagacacgctaccttgaggtggtagtgccctaacgggcttgtgggttcgagtcccatcctcggtaccaatattccagaaaaaagacgctgaaaagcgtctttttttgtttttgtccccgctggccatttatttataaacatctcttcgctggttgcctccttttactgtcgttaaagtcgcctcgtcaaattaacagaggtgaagtgacacaatgaacaagatcgggttgcttatcgtcgccggcgtgctcggtttagctgggtgcagttcaacatcgccctcccaaacggtggagacgattaatgcgctaaccgtaccggtatcgcccagtgagtctgggactacagcgaatcatgcccaggcggtgaggcgctatttccaggacaatacggcactgattagtcgccttaaccattcgttgaaaagtcattatctgcaggacgtggagcgccgcgatgtgttcgacagacacagcgaggcgtataaggtgtatggcgccctgacccgcctggagcagatggcgtccatgaatgaggtttaccgcaaagagaataatgttgcgggcctacaagagatcaaccgcgtactgaaaagcgtgccgctgaccagctgagaatgaaacagggactgccgaccggcaatccctgtgaagagttaaaagcggaagttaaccccggcgtaagcgccgtcggccagcgtgttatcgcgattgccatctttccctgccatatcaatatagcgatagccagcttcgatattcagagatgggagcacgttaaggcgtaccccggcattggcctccacataatcctcaacgccgctggacattgagtccggtgagtaatagccctcgccgaaaagcgtgaaatactgaccaagggggagttcagcgccaccaccggcggcgatggcgtaaccttcatcaccatcttttggattcagatagaccgccttaccgcccagggtcatcagaaaagggccaaggttaaagttataacccattcccagtcctacactatctccgtcgttgtcgctatgggcccactgagaactgaacgtcatacccggttccccggcgccaaagctggcggacagattggtaaactcggcgccagcttctccatgcaggttaacggctgcgcaggcagcgctgctggctcccaaagcgatcgttacggcaaccatttttgcagcaatagacttcattattaaattccttcagataaaaaaaagcccgatatgggcgttcgggcataattaacgggttcgtgcatctcattgttatggtcgcggcaggcgagggggcaactctcgctaccgccgcacacgtctggccgatttccgctggcatatcctgagccggtgcagacccggcggttaacgccgtttgtggtcgtctgctggcgaactcagtaatagattgtcttccgggaaacccaggcgcttagcataaaatttttgttcttttagcggtaacggttattggtttaaatttaaacatcttccccgctgcagcaaataacaataaatgataggaggagtgcgggtcagaatttttcaggaagtgagacgatattttgtaaataaccgccgcgggcaaaggtaatataaccgcctttctttaatgctgacaatacattgagaatactgctacgcgacagaagggtcctgtcctgaatatactcaagaatagatactcgctgtcgggtctcttcgcttaatagcatcatctccagcaaatggttacggatgaccgaataggtacgctgctgcaggaccagatcgtcacgatacaccatatacgaggtatgataagccaacaggctggtcacctcttcccacaggttatgctgacgaaaaagcgccgaagccaggtcatagtcgatccgtagcagttcgcatgatacctcggctcgcaggctgtggctgcggctgggctgcagcatttccgtcacgccgaaaagatgcggctcatagacggtcaccatcagtagcctgtcggaattacgaataatcgacagctcgccttttttaaaaataaagagctgggttttgcctttatattcccatgtcagtctttttctggcgatcgcgttaacgggtgtcgcgtgtggctcaagtacatcgatcagtcggtcaatggtcttttgcggcctgatcggcggtttaatattcatgatgtgtatcaccagatatgaattaatcaattgaggctattatagtcaacagttttgctggtctggcgataaggaaaaaatgcgtcatggcattttttttacgttggtgggtcattcaaaataaaaagccggcggtgatccgccggcggaaagcaacattgtcaggcgattatttgcctttgttttccagattttcaacctgcggtaaaccggttgccgaggaggcgctcagcaggccagactgtgcatagccgaacagcttctcgcgggtatcggtgatgtccagattacgcatggtcagctggccgatacggtcttcggcagtaaacatggaatcgcctttttccatggtcagacgctccgctttataggtcaggttgtctgataccgtattaaggatcgagtagtcgttaccgcgacgcagttcgagggtgacttcgccggtgatctggctggcgacccagcgctgcagcgaatcacgcagcatcagcgcctgggaatcaaaccagcggccctgatacagcaggcggcccaactggcgaccgtgggcgtgatattgctcaatcgtatcttcgttatggataccggtcagcaaacgctcgtaggcaatatgcagcagcgccatccccggagcttcataaatgccgcggcttttcgcttcgataatccggttttcaatctggtcgctcatgcccaggccgtgacgaccgccgatgcggttggcttccagcatcatctcgacgtcatcggcaaaggttttaccattcagcgccaccggatggccctgctcaaagcgtacggtgacctcttccgcagggatcttcacgttttcgtcccagaacttcacgcccataatcgggttgacgatcttgacgctggagttcaggaattcgagatctttcgcttcatgggtcgcgccgagcatattggagtcggtggagtaggctttctcgaccgacatcttgtaatcaaagccgcaggcgatcataaattcggacatttcgtgacgaccgccgagctcattgataaagtcgctgtccagccacggtttgtaaatctgcagttcagcgttggtcagcaggccgtaacgatagaaacgttcgatatcgttgcctttataggtgctgccatcgccccaaatgttaacgccgtcttctttcatcgccgccaccagcatggtgccggtgaccgcgcggcctagcggcgtggtgttgaagtaggtcaacccaccggtggtgttatggaaagcgccacactgaatcgcggcgatcccttctgcgaccagctgtttgcggcagtcgatcagacgggcgccttcagcgccgtactctttcgcgcggcgcgggatagcatcgtagtcgtcttcgtccggttgacccaggttagcggtatatgcataaggcacggcgccttttttgcgcatccataacagcgcggcgctggtatccagtccaccagagaaagcgataccaatacgttgaccaaccgggagatgcttgagaatcgtcgtcataaaataaaaccctgctcgatagactgtggtgagttcgacccaacaaccttaactgcatttttatgcattaattgtgagtattcatttaaccatcttttactggcgacaggaagtgcttcatcatctttttgctaaaaaagcctgaaataccagcacaaacggcaatcgggggcgctaaaaagcatgttgacaaaatatactaatcgccgttacaattcatctcgattttatgtcccgtcttcggtaccaaatcccagcagtatttgcgtcttttgctcaaaaagagtaaaatatgccacgtttcaggcgcggggtggagcagcctggtagctcgtcgggctcataacccgaaggtcgtcggttcaaatccggcccccgcaaccactttcccattaagtactttttcaaatatactgtgaggactaggtgtccttcgtagccgaatttgaaagaattcttgcggaaggtgttccagatcgccatggcgatctcagggttcagttatctaaagccccgatttatcggggttttttgttatctgacttcagaataactgggctatacgccctttttttatgtcttgggggtgggtttgtccacattagagcaaaaattgacagagatgctcactgcgccggttgaagcgcttggctttgagctggtcggcatcgaatttattcgcggtcgcacatccacactgcgcatctatattgatagtgaagatggcatcaacgttgatgattgtgctgatgtgagccaccaggtaagcgccgtcatggatgtcgaagacccgatcactgtcgcttacaacctggaagtctcttcgcctggtcttgaccgtccgatgttcaccgccgaacactatcaacgtttcaccggcgaagaagttgcgctggtgctgcgcatggcggttcagaaccgccgcaaatggcagggcattatcaaagcggtagacggtgagatgatcacggtaaccgtcgaaggcaaagatgaagtgttcgcgctgagtaacatccagaaggcgaacctggttccccacttttaacagtctggattgaggtgaaaggccccgatgaacaaagaaattttggctgttgttgaagccgtttccaacgaaaaagcgctgccgcgtgagaaaattttcgaagcgctggaaagcgcgctggcaacggccaccaagaaaaaatacgaacaagagatcgacgttcgcgttgaaatcgaccgcaagagcggcgatttcgataccttccgtcgttggctggttgtagaagaagtcacccagccgacgcgcgagatcacgctggaagcagcgcgtttcgaagatgaaagcatgaacgtcggcgactatgtcgaagatcagatcgaatctgttaccttcgaccgtatcaccacccagaccgctaagcaggttatcgtgcagaaagtccgcgaagccgagcgcgcgatggtggtcgatcagttccgcgagcacgaaggtgagatcatcaccggcgtggtgaaaaaagtgaaccgcgacaatatcacactggatctgggtaacaacgctgaagccgtgatcctgcgtgaagatatgctgccgcgtgaaaacttccgtccgggcgaccgcattcgcggcgtactgtacgctgtccgtccggaagcgcgtggcgcccagctgttcgtcacccgttccaaacctgagatgctgatcgaactgttccgcatcgaagtgccggaaatcggtgaagaagtgctggagatcaaagcggcggctcgcgatccgggctctcgtgccaaaatcgcggtgaaaaccaacgacaagcgcatcgacccggttggcgcttgcgtcggtatgcgcggtgcgcgtgtgcaggccgtgtcgactgagctgggtggtgaacgcatcgatatcgtcctgtgggatgataacccggcgcagttcgtgattaacgctatggcgccggcagacgtcgcgtccatcgtggtggatgaagataaacacaccatggatatcgcggtagaagcgggcaacctggcgcaggcgatcggccgtaacggtcagaacgtccgcctggcttcacagctcagcggctgggaactcaacgtcatgaccgttgacgatctgcaggctaagcaccaggcggaagcgcatgccgctatcgataccttcaccaaatatcttgatattgatgaagatttcgcgacagtgctggttgaagaaggcttctcctcgctggaagagctggcctatgtgccgatgaaagaactgctggaaatcgacggtctggatgaagccaccgttgaagcacttcgtgagcgtgcgaaaaacgcactgactacgctggcgctggctcaggaagaaagcctgggagataacaaacctgccgatgatctgttgaatctcgaaggtctggatcgtgccctggcattcaaactggctgcccgtggtgtttgtacgctggaagatctcgccgagcagggcgttgatgacctggctgatatcgaagggatgaccgacgagaaagctggcgagctcatcatggccgctcgcaacatttgttggttcggcgacgaagcgtaataaactgtagcaggaaggaacagcatgacagatgtgactattaaagcgctggcctcagagattcagacctctgtggatcgcctgatacagcaatttgctgacgcaggcatccgcaaatcggctgatgattctgtgacctcgcaagagaaacaaactttgttgacgcacctgaaccgtgaacacggctcggcgccagacaagctgacgttacagcgtaagacgcgcagtacgttaaatattccaggtaccggtggaaagagtaaatcggtacaaatcgaagtccgcaagaaacgcacctttgtgaaacgcgatccgcaagaggctgaacgcctggccgcggaagagcaggcgcagcgtgaagcggaagagcaggcccgtcgtgaagctgaagaagcagcgaaacgcgaggcgcaattaaaagctgaacgtgaggccgcagaacaagctaaacgtgaagtcgctgataaagcgaaacgtgaagctgcggaaaaagacaaagtgagcaatcaacataccgacgaaatgaccaaaaccgcccaggctgaaaagatccgtcgcgagaacgaagccgcggaattgaagcgcaaatcggaagaagaagcacgccgcaaacttgaagaagaagcgcgccgtgtagcggaagaagcacgccgtatggctgaagaaaacgaaaaaaattggtctgaaacctcagacagcccggaagatagcagcgactatcacgtcaccacatcacagcatgctcgtcaggctgaagatgataacgatcgtgaagtcgaaggcggtcgcggccgtagccgtagcagcaaagcggctcgtccggcgaagaaaggcaacaaacacgctgaatcgaaagctgatcgtgaagaagcccgcgcggccgtgcgcggcggtaaaggcggtaagcaccgtaaaggttccgctctgcagcagggcttccagaagccagcgcaggccgttaaccgtgacgtcgtaatcggcgaaaccatcaccgttggcgaactggctaacaagatggcggtgaaaggttctcaggtcatcaaagcgatgatgaagctgggcgccatggcgaccatcaaccaggtcatcgaccaggaaaccgcacagctggttgccgaagagatgggccacaaagttatcctgcgtcgtgaaaacgaactggaagaagccgtaatgagcgaccgtgacaccggcgcggcggctgaaccgcgcgcaccggtcgtgaccattatgggtcacgttgaccacggtaaaacctcgctgctggactacattcgttctaccaaggttgcctccggcgaagcgggtggtattacccagcacatcggtgcttaccacgtcgaaaccgacaacggcatgatcaccttcctggataccccgggccacgccgcgtttacctccatgcgtgctcgtggcgcgcaggcgacggatatcgtggttctggtggtggcggcagacgacggcgtgatgccgcagactatcgaagctatccagcacgctaaagcggcgcaggtaccggtggtagtggcggtgaacaagatcgataagccagaagccgatccggatcgcgtgaagaacgaactgtcccagtacggcatcctgccggaagagtggggcggcgagagccagttcgtccacgtttccgcgaaagcgggtaccggcatcgacgacctgctggacgcgatcctgctgcaggctgaagttcttgagctgaaagcggtccgcaacggtatggcgagcggcgcggtcatcgaatccttccttgataaaggtcgtggtccggtagctaccgttctggttcgcgaaggtactctgcacaagggcgacattgttctgtgcggcttcgaatatggccgtgtgcgcgcgatgcgtgacgaactgggtcgcgaagtgctggaagcgggtccgtccattccggtggaaatcctcggcctgtccggtgtgccggctgccggtgatgaagtgaccgtagtgcgtgacgagaaaaaagcgcgtgaagtggcgctgtatcgtcagggcaaattccgtgaagttaagctggcgcgtcagcagaaatctaaactggaaaacatgttcgctaacatgaccgaaggcgaagttcacgaagtgaacatcgtactgaaagcggacgtacagggttctgtcgaagcgatttccgattccttactgaaactgtctaccgacgaagtgaaagtgaagatcatcggttccggcgtaggtggtatcaccgaaaccgacgctaccctggcagcagcatccaacgcgattctggttggcttcaacgttcgtgccgatgcctctgcgcgtaaagttatcgaagcggaaagcctggatctgcgttactactccgtcatctataacctgatcgacgaagtgaaagcggcgatgagcggcatgctgtctccggaactgaaacagcagatcatcggtctggctgaagtgcgtgatgtcttcaaatcgccgaaattcggcgccatcgcgggctgtatggttactgaagggacgatcaaacgtcacaacccaatccgcgttctgcgtgacaacgtggttatctatgaaggcgagctggaatccctgcgccgcttcaaagatgacgttaacgaagtccgtaacggcatggaatgtggtatcggcgtgaagaactacaacgacgttcgcgttggcgatatgatcgaagtgttcgaaatcatcgaaatccagcgtagcatcgattaatcatttgatggctaagcagccggggaagcgaagcgccacccggcaatcattttaaaaaggggcttttggccccttttttgtctttattctggagaacttattatggcgaaagaatttggtcgcccgcagcgtgtggcccaggagatgcaaaaagagattgccatcatcctgcagcgtgaaattaaagatccgcgtctgggcatgatgaccaccgtttccggtgtggaaatgtcccgtgacctggcctatgccaaggtgtatgtcaccttccttaacgacaaagatgaagccgcggtgaaagcgggcatcaaagcgctgcaggaagcttctggctttatccgctctctgctggggaaagcgatgcgtctgcgcatcgtaccggaactgactttcttctacgacaactcactggtggaagggatgcgtatgtccaacctggtcaccagcgtggtgaaacacgacgatgagcgtcgtgtgaacccggacgacagcaaggaggactgatgagtcgtcctcgtcgtcgcggccgcgacgtgcatggcgtattgttgctggacaagcctcagggcgcctccagtaacgatgtgctgcaaaaagtaaaacgtatttataacgccaaccgcgccgggcataccggcgcgctggatccgctggcgaccggtatgctgccgatctgccttggcgaagcgaccaagttttcccagtatctgctggactccgataagcgttaccgcgtgatcgccaaacttggccagcgcacggatacctccgatgccgacggtcaggtggtggaagagcgcccgctgacttttagcgacgaacagctggcggcggcgctggacagcttccgcggcgagacgcagcaggtgccgtcgatgtattcggcgctgaaatatcagggcaagaagctatacgaatatgctcgccagggtattgaagttccgcgggaagcccggccgataaccgtctatgagctgctgtttattcgccgcgaaggcgatgagctggagctggagatccactgctcgaaaggcacctacatccggacgattatcgatgatttaggtgagaagctcggctgcggcgcgcacgtgattttcctgcgtcgcctggcggtaagcaaatacccggtcgagcggatggtgaccctcgagcagctgcaggcgctggtcgatgaggcggcggcgcaggatattcctgccgctcagttgcttgatccactgctgatgccgatggacagcccggcctcggattacccgctggttaatattccagaaacctccgcagtctactttaagaacggcaacccggtacgtcagtcaggcgcgccgcttaacgggctggtgcgggtgatggagagcgagtccggcaagtttctcggcatgggcgaaattgacgatgaaggccgcgtggccccgcgtcgtctggtggtggaatacccggcgtaagcgcttttcttgcgataaaagcctgctacgagtagaatatcgccgcttaacgtccgctaacgtgttttaacattttcgggcgttgcatcaggggtcgctgaattagagatcggcaccctttctttcttttaatttttggagttataaaatgtctctaagcgttgaagctaaagcaaaaatcgtttctgagtttggtcgtggcgaaaacgacagcggttctaccgaagttcaggttgcactgctgaccgcacagatcaaccacctgcagggccactttgcagagcacaaaaaagatcaccacagccgtcgtggtctgctgcgcatggtttctcagcgtcgtaaactgctcgactacctgaaacgtaaagatgttgcccgttactctgcgctgattgagcgtctgggtctgcgtcgctaattctgcgagtttcagaaaaaggggcctgacggccccttttttcgaccgggcggcagcaattcattcaaaactcatgtattgttgctagtaatgatcttcatgcagaggttcgcgcggctaatgagaggcttcatccgcaggggcgggtaaaggttgtcattagtcgcgaggatgcagaagatcgggtcaatagacgctatgtcgtggatatggcgtgatttatagataaaaaggatagaattttgcttaatccgatcgttcgtaaattccagtacggccagcataccgtgaccctggaaaccggcatgatggcgcgccaggcaacggccgctgtgatggttagcatggatgacactgcggtattcgttaccgttgtgggtcagaaaaaagcgaagccaggccaggactttttcccgctgaccgttaactaccaggagcgtacctacgctgccggtaaaatcccgggtggtttcttccgtcgtgaaggccgtccaagcgaaggcgaaaccctgatcgcgcgtctgattgaccgcccggttcgcccgctgttcccggaaggcttcgttaacgaagttcaggttatcgccaccgtcgtttccgttaacccgcaggttaacccagacatcgtcgcgatgatcggtgcttccgctgcgctgtcgctgtctggtattccgttcaatggcccaatcggcgctgcgcgcgtgggttacatcaacgaccagtacgtactgaacccaacccaggaagaactgaagtccagcaaactggacctggtggttgccggtaccgaagcggccgtgctgatggtggaatccgaagcggaactgctgagcgaagaccagatgctgggcgcggtggtcttcggccacgagcagcagcagattgttattcagaacatcaacgacctggtgaaagaagccggtaaaccgcgttgggactggcagccggaagcggtcaacgaagcgctgaacgcgcgcgtggctgcgctggctgaatcccgtctgagcgatgcttaccgtatcaccgacaaacaagagcgttacgctcaggttgacgtgatcaaatctgaaaccatcgccacgctggttgctgaagatgaaaccctggacgctaacgagctgggtgaaatcctgcacgccatcgagaaaaacgtggttcgtagccgcgtactggccggcgagccgcgtatcgatggccgtgaaaaagatatgatccgtggtctggacgttcgtaccggcgttctgccgcgtactcacggttccgcgctgttcacccgtggcgaaacgcaggcgctggttaccgcgactctgggtaccgcacgcgatgcgcagaacatcgacgaactgatgggcgagcgcaccgactccttcctgttccactacaacttccctccgtactccgtaggcgaaactggcatggtggggtctccgaagcgtcgtgaaatcggtcacggtcgtctggcgaagcgcggcgtactggccgtgatgccgactattgaagaattcccgtacaccgtgcgcgtggtatcggaaatcaccgaatctaacggttcctcttccatggcttccgtctgcggcgcctctctggcgctgatggacgcgggcgtgccggtaaaagccgctgtggcgggtatcgcaatgggtctggtgaaagaaggcgacaacttcgtcgtgctgtctgacatcctcggtgacgaagaccacctcggcgatatggacttcaaagttgcgggttcccgcgacggtatctctgcgctgcagatggatatcaaaattgaaggtatcaccaaagaaatcatgcaggttgcattgaaccaggctaaaggtgcgcgtctgcacatcctgggcgtgatggagcaggcgattaacgcgccgcgcggcgatatctctgaattcgcaccgcgtatccacaccatcaagatcaacccggacaagatcaaagacgttatcggtaaaggcggttctgttatccgtgccctgaccgaagagaccggtactaccatcgagatcgaagatgacggtaccgtgaagatcgcagcgaccgacggcgacaaagcgcagcatgctatccgtcgtatcgaagagatcaccgctgagatcgaagttggccgcatctacaatggtaaagtgacccgtatcgttgactttggcgcattcgttgccatcggcggcggtaaagaaggtctggttcacatctcgcagatcgctgacaagcgcgttgagaaagtgactgactacctgcagatgggtcaggaagtaccggttaaggttctggaagttgaccgccagggccgtgtccgtctgagcattaaagaagcaactgaacagactccgtctgccgcagcgccggaagctccggctgccgagcagggcgagtaaggttgccgttagccctccgtttttgcggagggcgttttacgggcaggacgcctcgtttgcagccggggaacaggacgttcatccaatcgttgtcttcgggagtgggaaatgaagccttttttgcgctggtgtttcgtggcgacagctctcacgctggcaggatgcagtagcaccgcctggcgtaaggacgccgtcctcgcagtaccattgcaaccgactttacagcaagaagtgattctggcacgcatggaacaaattcttgccagtcgggctttatccgatgacgaacgcgcacagcttttatatgagcgcggagtgttgtatgatagtctcggtctgagggcactagcgcgaaatgatttttcacaagcgctggcaatccgacccgatatgccggaagtattcaattacttaggcatttacttaacgcaggcaggcaattttgatgctgcctatgaagcgtttgattctgtacttgagcttgatccaacttacaactacgcgcacttgaaccgcggtatcgccctgtattacggcggccgggctaagttagcgcaagatgatctgctggcgttttatcaagacgatcccaatgatcctttccgtagcctgtggctttatatcgccgagcgtaaactcgacgagaagcgggcgcttgaagcactcagagagcgcttaaacaagtcggataaagagcaatggggatggaacattgtcgagttctaccttggcgacattagcgaaaaagagctgatgactcgtctgaaggcagacgcaacggataacacctcgctcgctgagcatctcagtgaaaccaacttctatttaggtaagtactacctaagtctgggggacaaggacagcgctacggcactgttcaaactggcggtcgccaacaacgtacacaactacgttgagcaccgatacgcattgttggaattatcgctcttgggccaggagcaagatgacctggcagaatcggaccagcaatagctgacgaacacatcagcccatagttttttgcttgccatcaccttcgcgggtgagggcgttgttgttcgttaatacacctactttgagccggttcacacttttcaatgaaaattaccgtaaattttcacgatgagttatgtagactggccgccattaattttgaggcacacgtactacatggctgaattcgaaaccacttttgcagatctgggcctgaaggctcctatccttgaagcgctcaccgatctgggttacgaaaaaccatctccgatccaggctgagtgcattccgcatctgctggacggccgcgacgttctgggtatggcccagaccggtagcggtaaaaccgcagcattctctttaccgctgctgaacaacatcgatcctgagctgagagcaccgcagattctggtgctggcgccgacccgcgagctggcggtacaggttgctgaagcaatgacggaattctctaaacatatgcgcggcgtgaacgtggttgccctgtacggcggccagcgttatgacgtgcagctgcgcgccctgcgtcagggtccgcagatcgtcgtcggtaccccgggtcgtctgctggaccacctgaagcgcggcaccctggacctctccaaactgagcggcctggtactggatgaagcagatgaaatgctgcgcatgggctttatcgaagatgtagaaaccattatggcgcagatcccggaagggcatcagaccgcgctgttctccgccaccatgccggaagctatccgtcgcattacccgtcgctttatgaaagagccgcaggaagtgcgcattcagtccagcgtgacgactcgcccggatatcagccagagctactggactgcctacggcatgcgtaaaaacgaagcgctggtgcgtttcctggaagcggaagactttgatgcggcgattatcttcgtccgtaccaaaaacgcgaccctggaagtagctgaagcgctggagcgtaatggctacaacagcgcggcgctgaacggcgacatgaaccaggcgctgcgtgagcagactctggaacgcctgaaagatggtcgtctggatatcctgattgcgactgacgttgcggcccgtggcctggacgttgagcgtatcagcctggtggtgaactacgacatcccaatggattctgaatcctacgttcaccgtatcggccgtactggtcgtgccggtcgtgctggccgcgcgctgctgttcgttgagaaccgcgagcgtcgtctgctgcgcaacatcgaacgcactatgaagctgaccattcctgaagtggaactgcctaacgcggagctgctgagcaagcgtcgtctggaaaaattcgccgcgaaagttcagcagcagctggaaagcagcgatctggatcagtaccgtgcactgctggcgaaaatccagccgacggcggaaggtgaagagctggacgtggaaacgctggctgctgcgctgctgaagatggctcagggcgaacgttcgctgatcgttccgccggacgcgccgatgcgtccacgtcgtgaattccgcgatcgtgacgatcgtttcgaccgtcgtggcgaccgtaatgatcgcggcccgcgcggcgatcgcgaagatcgtccgaagcgtgagcgtcgtgacgtgggtgacatggagctgtatcgcattgaagtgggtcgcgatgacggcgttgaagtgcgtcatatcgttggcgcgatcgccaatgaaggcgatatcagcagccgttacatcggtaacatcaagctgttcgcttctcactccaccattgagctgccgaaagggatgccgggcgaagtgctgcagcactttactcgtacccgtatcctgaacaagccgatgaacatgcagctgctgggcgatgcgcagccgcgcaccgaacgtcgtggcggcggtgagcgtcgcgaaggcggccgtggcttcggcggcgagcgtcgtgaaggcggccgtggcttcggtggcgaacgtcgtgaaggcggtcgtggtgaaggacgtcgtttcagcggcgaacgtcgtgaaggccgtgcgccgcgtcgtgacgatgcatccgcgccgcgccgcgatgactcagccggtcgccgtcgcttcggtggcgatgcgtaatcaacgccgcccgctagcgtaaactaaataatacagccccgatcgtcatgattggggctttttttattccctttgtactcgtgtactggtacagtgcgtcatgctcaacgtgagcgaagtattttcgactggagaattcggtaaatggcgacactaaccactacggcaacccgtccgtctctgtttggcggcgtggtgattatcggcggcacgattatcggcgcgggcatgttctcgctgccggtggtgatgtccggcgcgtggtttttctggtcgctggcggcgctgatcttcacctggttctgcatgctgcactccggtttgatgatcctcgaggccaatcttaactaccgcatcggctccagcttcgacaccattaccaaagacctgctcggcaagggctggaacctggtgaacggtgtatcaatcgcctttgtgctctatatcctgacctacgcctatatttcggcgagcggttcgatcctccaccacaccttcagtgaactgtcgctgaaggtgccggcgcgcgcggcgggcttcggctttgcgctgctggtggcgtttatcgtctggatgagcaccaaagcggtgagccgcatgacggctatcgtactgggcgctaaggtgatcaccttcttcctgaccttcggtagcctgctcgggcacgtcgagccgacgacgctatttaacgttgcggagaagaatgcctcctatgcgccatacctgctgatgacgctcccgttctgcctggcctcgtttggctatcacggcaacgtgccgagcctgatgaaatactacggaaaagatccgcgcaccatcatccgctgcttaacctacggtacgctgctggcgctgggtctgtacgtggtctggctgctggtgacgatgggtaacatccctcgtccgcagtttatcgacattgcgcagaagggcggcaacattgatgtgctggtgcaggcgttgagcggcgtgctgaatagtcggagtctggatctgctgctggtggtgttctcgaactttgccgtcgccagttcattcctcggcgtgacgctggggctgttcgactacctggcggatctgtttggctttgacgatagcgcgatgggacgctttaaaaccgcgctgctgacctttatcccgccgatgattggcggactggtcaaacccgatggtttcctctacgccatcggctatgctggcctggcggcgacgatctgggcggcgattgtaccggcgctgctggctcgcgcctcacgcaaacgcttcggcagcccacagttccgcgtctggggcggaacgccaatgattgtgctgatcctgctctttggcctcggcaatgcggttgtacatatcctgtcgagcgtcaatctgctgccggtttatcagtaaagctattgcccggtggcgcgacgtccaccgggctgacgtgtgtgttaccccaacagctcctctttcacctgcatcgctaaatcgaaagaatgcagacgcgcctggtggtcgaagatctggccattgaccatgatttcgtccgcctcggtttcacgcagaatcgactctagcccatggcggactttagttttatcgccgaccagcgacatgctcagtgcctgctgcacaccatactgctcggatgctgaccacagctgatgcatattttccaccggcggcggcaactgcccggtctcgccgcgacgcagcttcacaaacgcctgctgcatggaggtgaagagaaactccgcatcgcggttgctgtcggcggcgatgatattgatacacaccatcgcgtacggtttttccagccgcgccgaaggtttgaaattgctgcgatacagatgtagggcctggaacaacatatccggcgcgaagtgcgaggcgaaggcaaacggcaggccgagctgcgccgccagttgcgcgctatagaggcttgagcccagcagccatactggaatgcgctccccgtagccgggaaccgggcgcacgtgcgggttcggatcgcgggcgtcaaaccagtccaccagttccgctacatcgcgcgggaaattatcgacatcgccgctcatatggcgacgcagggcgcgcatggtcggctgatcgctgcccggcgcgcggccaaggccgaggtcgatccgcccggggtaaagggtgttcagggtgccgaactgctcagctatcaccagtggagagtggttaggcagcatcacgccgccggacccgagatgcagggtggtggtgttggcggcgagatagccaatcagcaccgaggtcgctgcgctggcaatgccgaccatattatggtgctccgccagccagtagcgatgatagccgcgcgattcggccagccgggcgagatccagagagtgggtaaaggcttctttggcagaagatccttgcgggatcggcgccagatcgagcaccgagaatggaacagatttgtcagtcataaaggctcactttgctacagcatcgtcatcagattgaaggtcttcttccagcctggcgcatcctggacgcgccagccagaaaagctgcatctttaataatgcattaaaatctgagcactgttgttaacaaagtgagcggtttatcaggcctgaagcaccagtcctggcaatcgtttccagtagccgttgcaatcgctattgctggtgagatccagcggcgcagcgccgttttcgttggcgcggaaggcctcgagcatggcgaaggtctcgttgcccatcggcgacaggcgcaccatatccaccaggccgtgcatggaggtcagctcattgcccaggttatagacgtagccgctcatggtctgaataccattgagcacgaacacctgctggttctcctgcgacagcatgctgcgcccggtagggtacttgatgcagcaggtttcgcactcgtcctttggccggtcttccgagcgggcggtaaagcagcgcgcggaataagccagcggcagatggccgtagctcagcacttcgacttcaaactggttgcggatacccagctcttcgcactgggtcagtaaattagccagccagtcgcgggagagttccaccggcatgcaccagcgcaccatgccctgtttccgcagcaggcgcagggtaacggcgttgtagcagttcagcgcatgcccggcgacgaacggtagcttgcgttcggcgcagagatttaccacgcccaaatcactggcctcaatcagaaattcgccgttatcgacatagcgcttcagctcgcccagttcagaagaggcctgcaccagcgcgagagtggagagcaccacctgcttgccgctagcggccagcgttttcgccatttcgatccagtcgccaactttggtggcgcggcgtttgctgcataccgcttcgccgagataaatggtgtcggcgctgcagtttgccgcctgctggtaaaaatcttccagcgtctcttttggccagtagtacagcaccggccctaatgaatatttcatgtttctcactgccatttacggtgataagcgccaagggtagtttgtgtcccctcggacatggcgcccagggtctccatccaggcggactgcggtacgaaattctgcggatcggctttgcagcgatcgatcgcctggcgccagactttcgccacctgggtcacgtaagccgggctgcgctgacggccttcgattttcaccgaggcgatattggcggccatcaattccggcaacagttccagagtgttgaggctggtgggctcctccagcgcgtgatagcgctcgccatcaaccaggtagcggcctttgcacagcgtcggataaccggcattttcgccatcctgataacggtcaatcagcacttcattgagacgcgattccagcccctgcggcgtttgctgccagcgtacgaagcgggcaggcgaacaggcgccgacggtgttgggcgattcgccggtcaggtaggaagagagatagcagcggccttccgccatgatgcacaggctgccgaaggcgaagacttccagcggcaccggcgtggcgcgggccaactgtttcacctgatgaatagacaacacgcgcggcagtacgacgcgcgcgacgtcgaagttgcgatgatagaagcgaatggcctcttcattggtggcggaagcctgcaccgaaacgtgacgctcaatgtgtgggtaacgctccgcagcgtactccagcatggcgatatcggccagaatgagcgcatcggcgcccaattgagcggccatatccactgctcgctgccagcgggcgtagccgtcgggatgagcgaaggtattgatggcgatatgcagcttacgacggtgctgatgcacaaagctgacggcttcctgcagtttcttttcggtgaaattaaggccggcaaagtggcgggcgttggtgtcatctttcagcccgatatagacggcatcggcgccgttttcgatggccgccttaagcgccggaaggttaccggctgggcagagcagctccataatttttcctgaaaaatgcggcccgtcagggacgctgaatggttaacgagcagggattttagttaaccttctggtgacaatttttgatttgaggcagttaaaagtgtattggcggcgccaataactggcggccgtcatcgcgtttttgttgatttacgccgctatgttgtttatgtgatatggcacaatagcggaactattgcattcatggagtaaagcttgtgttggataaactgcgttcccggctggtccactttggcccgtctttaatgagcgtgccggttaagctggcgccttttgccctcaagcgccaggtgctggagcaagtgctgagctggcagtttcgccaggctctggcggagggggagctggagtttcttgaggggcgttggttaagtattcatgtgcgtgacatcggtctgctgtggtatacctcggtagtcgatggtcgactggtggtcagccagcaggccgacgccgacgtcagcttcagcgccgacgccagcgatctgttaatgatcgccgcgcgcaagcaggatccggatacgctattcttccagcgtcgtctggtcattgaaggcgatacggagctggggctgtatgtaaaaaatttgatggacgccattgagctcgagcagatgccaaaagcgctgcgcgtgatgttgctgcaactggcggattttgtcgaagctggactgaagagcccgcagaaacctgaacagacatcggtaggtgaggcatgctgattcgagtggagattgggattgatgcaccgggaatcgacgcgctgctgcgtcgtaccttcggccgcgatgccgaagcgcagctggtgcacgatctgcgtgaagatggactgatcacgctgggggtagtggcgacggatgatgaaggccaggtgatcggctacgttgccttcagcccggtggcggtggaaggtgaagagctgcagtgggtcggcctggcgccgctggcggtagatgaacgctaccgcggacagggcattggtcggcagctggtttatgaagggctggactcgctgaatgagtttggctacgccgcggtggtgacgctgggcgacccggatttataccgtcgcttcggctttgaatcggccgcgcgcttcgatctccgctgccgctggccggacagcgccgaggcgttccaggttcaccgtctggcggatgacgccctcgacggcgtccatggccaggtagaatacagcgagcactttaatcgtctttaagccttgccagcagggtttcgaaggcatcctctccggcaacgaggcgctctttttcgcgcttcgttagctgcttgacgcgatattccagtcgcaatgcaagtgagtgttcaccaacttcgtggctaaaggccagctgcaggtcgcctttgccgcgcaacgcctttgcgccttttcccgcctgatgctggcgaaagcggcgtggcacgtcggtggtgatgccggtataaaggcgattatccgcggttcgaatgagatacagaaaccagcacacggtcacaaagtcactatggtaaggtgtgtgcaccatagcataatggagaagaaagatggatacgcttgccgccattggtcgctggctgagtaaacagcacgtcgtcacctggtgcgtctcccgtgaagacgagctgtggtgcgcgaatgccttttacgtctatgacccggataccgtggccttttatctgctcagcgaggagcacacccgccatggccagatgaccggacagagggcgaaggtggccggcacggtcaacggccagccaaaaaccgtggctctgatccgcggcgtgcagttcaaaggcgagatccgtcgtctgagcggtgacgaagaggcgcgaatgcgccagcgctacgtcaagcgcttcccggtggcccgcatgctgtcggcgccggtatgggagattcgtccggacgaaatcaaatttaccgacaacacgctgggtttcgggaagaaattacactggcggcgtgatgccggcgccgagcaggcgtagcgcttcgcgattgaaggccggcagatcgtccggcgttctgctggtgaccagctgttcgttatcgaccaccacctcctggtcgtaaaactcgcccccggcgtttttcacatccaccacaatcggtttcaccgccgtgagcttacgtccgcggatcacatcggcgctgatcagcagctgcgggccgtggcagatggcaaacaccggcttaccgccgttgacaaaatcgcgggtaaaggtgacgaagcgttcatcaccacgcagctggtcgggagagtagcccccgggcagcaataaggcatcaaattcacccggtgtgacgtcatcgatggctctgtcgatggcgacctcggcttctccctgcttacccttcaccgttttgccagcctgcttttcgatcgtgatgacctgatgcccggcgagcttaaaggcttcggcgggagaggtaaattcagaatcttcaaagtcgtcggtaatgaggacggctatctttttactcatgcttcctccactgtctggatggtcaatgaggtaattccatgatgatggtggatacttaccttgtaaggtattaagcctggaacatgagcccgaaagtgcaaggcggagaattctgtaaaggagaaccaatgagtcaggtattattaaccggcgcgaccgggttagttggcggtcacttactccggctgctgcagaatgagccccgtataagcaccatcgccgcgccgacgcgtcgcccgctggcgccagcgaaaggtgtttttaatcctcacgatccccagctgaccgatgccctggcgcaggtggttgacccggtggatatcgtcttctgttgcctgggaacgacgcgccgggaggccgggagcaaagaggccttcgtccatgctgactacacgctggtggttgataccgcgctgaccggcaaacgactgggtgcgcaacatatgctggtggttagcgcgatgggcgccaacgcccactcgccgtttttctacaatcgggtgaagggggaaatggaggcggcgctgattgagcaagactggccgcggctgaccatcgccaggccgtcgatgctgtcaggcgagcgggaaaaaaagcgggccaatgagaccttcctcgcaccattgttccggctcttgccggggaactggaaatccattgcggcccgcgatgtggcgatcgccctgctggcggaggcgctgtcgcccacccacgaaggggtgcgaattctgacatcatcggaactacgggagcgcgccgcgcggcaggctgaatagcggtttgcaaacgcaggcttccggcgtagtattcacggcttcaattcatatccacatttcttgctggggaatgctatggctggtcagtcttcatctcaggcggcgtcaccatttcaatggtggaaacccgcgcttttctttctcgtcgtgattgttggtctgtggtacgtcaaatggcagccgtactacgggaaagccttcaccgctgcggaaacccacagtatcggtaaatctattctcgcccaggccgacgctaacccgctgatggcggcgtgggactatgcgatggtttacttccttgccgtctggaaagcggcggtgctcggcgtgctgctcgggtcgttgattcaggtactcattccgcgcgactggctgctacgcaccctgggacaatcgcggtttcagggcacgctgctgggagcgattttctcgctgccgggcatgatgtgcacctgctgcgccgcgccggtcgcggccgggatgcgcaaacagcaggtgtcgatgggcggggcgctggcgttctggatggggaacccgctgctcaacccggcgacgctggtgtttatgggctttgttctgggctggcagtttgcgctggttcgcctggtggcgggcctggcgacagtattaactgtggcgacgctggtgcagaaatgggtgaaagaggcggcgacgcagccggtagcggtgcctgctgcaccgtcggaagcgactcagggcggcttctttagccgctggctgcgggcgctgtggacgctgttctggaacacgatcccggtttatatcctcgcggtgctggtgctgggagcggcgcgcgtctggctgttcccgcacgccgatggcgtggtggataatacgttgttctgggttatcgcgatggcgatcgccggctgcctgtttgtgatccctaccgcggcggaaattccgattgtgcagacaatgatgctggcgggtatggggacggcgcccgcgctggcgctgctcatcactctgccggcagtgagcgtgccgtcgctgattatgctgcgtaaagccttcccggccaaagcgctgtggctgacgggcggactggtggcgctgtgcggggcgattgtcggtgcgctggcgctggtgtagtttgccgtaaacgtacgcatagccggattggatgccgggtggcggctacgccttacccggcacacaacgtacagggggcggtagcccggctaagcgcagcgccagccgggaaactgcagctttatttaatgtaggtaaaggcggtggtcacccgggatacgccgcttacccggctggcaatatccgccgccgcccggccttcgcggtcggtcaccagccccatcaggaagacttcgctgttttccgtggttactttcacgttcgaggatttgacctgatcggtgctcaggagctgcgaacgcaccttggtggtaatccaggtatcagacgaggcggtgcctaaaccaatcggctggccctggcgcacttcattaaacacttccgtggtcccttccacgcccatggcgatttgcttggcgcgcgcggagaggtccggcgtcggcgactggccggtcagcaggactttgccctgataagcggtgacgttgatacgggcctgtttcttaatctgttcatctttcgacaaggcgctattgacgcgcagttccagggtactgtcatcgacctgggttcccaccgtacgcgggtccgttgcggctttggtgccgactgctgccgttccgactaccgcggcggcaacgcagccctgcagcagtagtgcagaaagcaggatggcgaggggcgagagagccttcatgtgttctccttaatcgtcctggtgtggaaaaagagtgttatctatcaaatcgcacagacagttgacggtcagcatgtgcatctcctggatacgcgcgctgcgatgggaggggatgcggatttcgacatcctgttgacctaacaggcccgccagctcaccgccgtcatagccggttaacgcgacgatggtcatgtcgcgggtcacggcggcttccaccgccttgacgatgtcccgactatttccgcgcgtagagatcgccagcagcacatcgccggcgtgtcccagggcgcgcacctgcttggcgtagatctcgtcatgcaagcgatcgttagcgatggcggttaagaccacattatcggtatttagtgcaatggcaggtaaaccagggcgttccgtttcaaagcgattaatcatgctggcagcaaaatgctgtgcgttggcggcggaggtgccattaccacaacagaggattttgttgccgttaagcagggactggacgagcgtcatcgccgcccgggagatggcgtccgggagtgcttccgctgcggcaatttgggtttgaatgctttcggtaaagcaggctttgattctgtcgagcacgggatcccttacttctggtattacgctattcgccaaaggcgttttttagccattggatgtcgtttccggtgaaggctaccacatcgaaacggcaatccacagtctcaaagctcccattctgtcggcagagccacaaacgggcggctttaagcagtcgttgttgtttttgcggagtgacgctggctgccgcatcaccgtaccgggcgctacggcggtagcgcacttcgataaaaacggtgaccgtgccgtcgcgcatgataaggtcaatttcgccgccacgctcgcgggcattggcggcgataaaacgcaggccctggccttccagccagcggcgcgcctggttttcccaggcatcgccggtctgtttgcttagctggccggaacgatttttccctgctggtacttgagccatgacagtttcctgttaatcacgcaatcctggttggccgtcagatcgccggtattgccgttcagctcgaagccaggcgtctggcgcatttgcgtgaagtgatttgccagtgaccaggcgtcagcgcccatggcatacagacgcgccagcgagtagtcattacgcaccgcggacagcgcctgctgcattagcgacggattgctgccggccagcattgggatctcactatactgcaagccttccatctccagacggaaatccggccccgcggtgccctgggcgctgcgcgagctggcgtacagggtgacattgctctggctgccgttgcgcatggcgatcatcggtttgatataggcaatctgttccggggtggcgaggatataggccgcatcgacgctgccgccgctgcttaccggcatctcatccgcactgccgaggatgctgttctgcgctgatggcagggtggagaccggggtgccgctcagcgcaatgcccccgccgccgttcacgccggcgcgcagctcggccgtggatccaaaacgctgctgcaggacgctggcgccgcccagcttcagccactcgtcggcaaaagcgctaaccacacgatcgcccagcgcgccgcgcggaaccagcagcagcggggtctgtttcccctgttggtggatatgtcgggcggcgtcacgcgcttcgtcttccggagaaagcgcgaaatagcagaggttagcgcggctttcgactttttccggctggttgagggccagcacattgagcggcgtgttgctcttgataacctcttcaacgttttctttcagcaacggcccaaccaccagggtggcgccatcctgctgcgcctgggcgagcagctggcttatcggctggctggtggtgtcgtaaattttcagttccgcagaagggttagcggcggttgcgaccacgggctgcggctgtgcggccggcgcggtaaccggctgggtggccggggaagcggtagtctgcggcgtggtggatgttgccggcgcctgggctgccggttccgcagcaggcgctgcctggtcctgcgtcggggcctgaaccggatccgcgcggcttccggtggcggtaagatcgctgatttctgcctgcgacggactcaccacatcatcattaccggagacattcgccgcctgggcgacctgggcgggaaccgcgctgcccgtcaccgacggcgcgccgtttttggcggcttcaaagccctgctggattgtgcggccgaagatcgacgcctgaccgtttagcggcagaaaaagcgcaatcttgttgatggacgcaggcttatagttttgcatattcacaagcgccgtcggcagcattttagcgcccgggttttgcggatagcgcgtctgccagtctttaacgcccgctttcagtagcgtcggatcgttgcggttgtcaaaccacatccgctgcagatccagccagccctggaggatattttcatcggcgttgatcaccagcgcattggcctggtcctggggcatcgaggtgagtgcttgccaggtcgcatcaatatttttctgacgctgtttggcgtcactcagcagcggctgctgggcgattaaggcgcgcagcagggtcagcgatggtttgccctggctggcatcgatttgcgcctgccagtagcgcgcctgttgaggctgctcaaggcttgtcggatcgatcttagccagcagattacgggcggcctgataatcgttctgcgccagcttcacttccaccgccagcagcgactgttcacgggcctgagtgctgttcaggttcgccggcagctggttaaacaggtcgatagcctgctgcttcttcccttcctgcagtagtgcacgaatggcgagtaattgccagttggtcttgctatcattcgtgctttgctgcatctgctgtaagtagaaactggagttggcctgcgacgtaccctgcataaacgccgcgctttgatcctgcgtgtgggtgccgcagccagcaaaaataagagtcgccagcaatacgggcaggcagcgcgcgggcttagaacgaagaaatgttgacggtaccataagtgtccagtgatatttttttggctcaatgctcaatattaaatcggcaatacggacgagacaatgaaacaacacgaatcagcggataattctcaggggcagctctatattgtgcccactccgataggaaatctgtctgatatcacgcagcgtgcactggaagtgctgcaagccgttgatttaattgcagcggaagatacccgtcataccggtttgctgctgcaacattttgcgataaacgcccgtttgtttgcgcttcacgaccataatgagcagcaaaaggcggaaaccctgcttgccaaactgaaagaagggcaaaacatcgcgctggtttccgatgccggcacgccgctgattaacgatcctggttaccatctggtgcgcacctgccgcgaagcgaatattcgcgtggtgccgctgccgggcccctgtgcggctatcgccgccctgagcgccgccggcctgccttccgaccgtttctgttatgaaggcttcctgccggcgaaatcgaaaggccgccgcgataccctgaaagcgctggaagaagagccgcgcacccttattttctatgagtcgacccaccgtctggtggagagtctggaggatatctgcgcggtactgggagaatcccgctatgtggtgctggctcgtgagctgaccaaaacctgggagtcgatccatggcgcgccgattggtgagctggtggcgtgggtgaaggaagatgaaaaccgtcgcaaaggcgagatggtgctgatcgtcgaaggtttcaaggctcaggaagaggcgctgccggcggccgcgctgcgtactctggcgctgctgcaggcggagctgccgctgaagaaagccgccgcgctggccgcggaaatccacggcgtgaagaaaaatgcgttgtataagtacgccctggagcagcagggggagtaaacgatgagccgttaccaaccgccgtttagcatcacaccctcggtcctcaaccttgtcgttgagattggggaattgcttgggcattggtcggcgaaacgtggacaagcatcgccgttgctgcgtaaagaaaaccgcattcgtactattcaggcgtcactcgcgattgaacataatagcctgagcatggaacaggtaacggcgctgctggaaggcaaacgggttctggcgccggctaaggatattcaggaagtgagaaatgccattcgtgcttatgaattaatgcccggatggcatgcggcaaacattagcgatcttctgacggcgcataaaacgctgatgaccgggctggttgatcgtccaggcgctttacgtggcggaaacgtcggcatttatcgcggtacgcaggtgatacatatggctccgcctgctgcccaggtcccaagattgatcgctgatttactcagttggctggaacacaccgagctacatcctttaattgccagttcagtttttcactacgagtttgagttcattcaccctttcgctgatggcaatggtcggatggggcgtttatggcagacgttgattctaagccagtggcgtcaggaattggcctggctgccggttgaaacgctgatccaccatcagcaagaacgttattacgacattttaggtgcttgtgataaaaccagtgattgcacgctattcgtgacctggatgttgcaaaatatcctggcggcgctgaaagaaggtctggaaacttcattcatcgtgtcggaagaaatgtcggaagaaatgtcggaagaaatgtcggaagaaatcgacgtcaaattagccccaccggaaaacgcaattttgcgtttgctaaccgaaaagccggaattaacggcgagagcgctggcggagatcttggggatatcagcacgtacggttgagcgtcatctgcaagggctacaggcgaaagggagattgattcgcataggcgccaaaaaaggtggaagctggctggttaagtagaaccagccgccatgatgttccactcagcgtgcaattacactatcttcagttccacctttttgctgcttaacgctgcacggtcattttcactaatgccgtcgtcggtgatcacgcagtctatcttttccatcggcagtacctggttaaagccccggcgattgaatttgctggcgtcgagcacggcgatcacctgatgcgcggcggcggccatcacgctgctgatggagtagccttcgttaaaggtggtgatgccattggtggcgtcgataccgtcggcgccgacaaacatcaaatcggcgcaaataccttgcagcgaacgttcggcaatcgtgccgtgcatcgaatgcgttttgtgccgcacggtaccgccgcacaccaccagggtgatatctttattttctgccagagtaaacgcggcgggcaggctgttggtgatgacggtgatattggtcatccgtactaatgcttcggcgataagaagagtggtgctaccgctatcgaggatcaccgtcataccttcacggatcatcgctgccgcggcatgggcgatgcgctttttgggatcgctggcaagctgatagcggtcttcaagcaccacttcctgattctcggcgtcggtcaggtcgctacccgcacgggcggcgccgccgtgaaaacgggttaacagtcctttttcttccagtaagcggagatcggcgcggatcgttacctcagagatgccaaagagattcgaaaggtctagaaccaatacgctaccctgcgtattcaccatatcgacaattttgttccttcgttcaaatgagttcatcttgatttgcctgataattaactcatctcagtgtaatcgaagggtaacgaaaggtgaacgataattttcgaaaggttggatgagccagcgctgatggctggctcgggcggtcaagagagtttgagcaggattttgccttgcattggcgcgccgttgagcgcctgcactgcacgagcgaagctttctgcgtcgccacgatgggcgatcagcggcgccagctgcaggcgtttttcagtcagcagacgggtggccgtttgccactcttctcccggccacgggccagagtagttcatccagctacccacaatattcaactccttacgcagaatctgcccgaaggtggctgccgggagggttaaatcgtgatgaagcgtgccaaccagcgccagctgcgcccgcggaccggcggcctcaatcgccagcgcgacggtctgcggcgtaccggcggtctcgaggactaactggtcgaactgaatggattccagcgcctgctgaatcgcctggccgctcatctcgcgactgttgaacacatgggttgcgccgagggttttggccagctccagcttctgcggattgatatcgatcgccgtgacgctgttggcgcccagttcgcgggcgcactgtagcgccagcaggccgatggtgccggcgccgataataatcacgtttttaccttcacagccctgcgccagatgaaaagcgtgcaggccaacggttatcggttctataaacgcgccatcatcaattggcatctggtccggcaggcggaacaggttggcgcgctttaccaccacatattcggcgttgccgccttcgctgcgtgagccgacgaactgatactgtttacataaagagaaatactcgcgctggcattgcgggcactggaagcagggcagcagcggcacgcaggcgacggcatcgccgggctgcaggtcggttaccgccgcgccgtaggattccacataaccgctgaattcgtgccccagcgtaatagggtagtaatgcgcccctttggcgaaaatgcgcgggatatcggagccgcataacccggaactgaccactttgaccaggacatcgttttccgtttgcagcgtggggatagggcgttcttcaacgcagacgttcccctcagcatggattaccactgatttcataacattctccagctataagattcaggggagcgaacgctccccttttagatcaagacatgcctgtactttgttgcggggcagcgcttttttctgctttttccgcggcgatgaagccgcgagcgcgacgccaggtcagtaaaacgccggccagatagatgatgccgatgaccgcgaagccaaccacattttgccaggtaaagagctggatcagcagccaggtaatcggcgaaccaccctggtccattgaggccaccatgccgccggctttcagggtcccggcgtttgccgccagctgggtgtgcaggccaatggtctgggtggcgatccacagggtgattcccataatgatgaccccggaaatcaacgtgcggaacagattgccctgatgtacagccactgccatcgctacgaagaagccgatggtggccaggtcaccaaatggcagaacctggttgccagggaccacgacggcgataagaatggtcagcgggatgaaaatcaggctggccgagactaccgaggtatgaccgagcagcagcgccggatcgagaccaatcaggaattcctggccgccgaatttagcctgcagacgtttacgcgcctgtttggctatcggggtgaggccatccataatcggtttgatcacccggggcatcagcagcatcaccgctgcggttttcaccgccagctgaagaatgcccttcaggtcgtaacccgccagcgcgccaatcaccagccccatgacgaagccaacggtaaccggttcaccgaaggggccgaagcgtttctgaatgtcatcggcgctaaagtgaatacggttaagaccggggatcttgtcgatgatggtatccacgaggacggcaactggccctaaatacgccgaactgccgtgcgggatcgcaataccctcgaggccgaagaaatcgcgggtatctttggcaaaccaatcgcccagcttatacacaaaagcagcatgcaccaccacgccgagaatacctatccagtacgacccggtcgcgatatgcagcattgcgccggtaaaggtcatatgccagatgttccagatatcaacattcaccacgcgggtcatacgggtaaccagcatcacgatattgaccgcgatggccaccgggatcgccaccagggcgatttgcgacgcccaggtcatcggtgatgaacccggccaaccgatatcgatcacgtgaagattaatctggaaatgctccgccatcgcctttgccgccgggccgatggagtcgagcatcaggccaatgaccaacccgatgccgacaaacccgatcccgatatgtagaccggatttaaaacaatccccgagcttcatccccagtaatttggagaagataatgatcacgatcggcagcatcaccgtcggaccgagatcgaggatataacgcatgatttcgctaaacatggcgtttactccgcgaggatgccgaggattttctgttgtaaggcttcaatgccgacgcccgagacgaatggcatgccgtgcaccaccggaatgtcgccgaaggtccgctccacgcgcgcagtggtgcagatcaggtccgccccgtccatgtaggtttcgatttcattgacccggcactgcaccaaatccagttcaatattgtggtctgcacacagctctttaatctcttctgccgccatcgtggaggtggcgacggcaccgccgcaggcgacgataactttacgtttcatagggtaccccttttattatcagtatcttatgaagccacggcgctaagctcgggctcaaggattaattgctggaaccgcaccggcagccgatcgtcggaagcggcgagcagtgcctccagcgtgtgcggattttgtagctcactaaataaccggcgcagcagcttcagctgtgccgccgggttttcaacaatcagcgcgatgatgagcgaaacgtcgatttcgccgtcgtcgtcagcgcgctgaaaagagaccggcatgtccggacgtatcaggtaaatggccggtgatttcgcgtggatcgcttcgcagtgcgggatagcgacagcatgcttctccagggcgatgccggtgggaaaagtcgcttcgcgttcgagcagggcggcgggatagctgtcatgtacgacgcctcgcgccagcatctctgcgccaatgtgttccagtgcctgctgactggaactgaaatgaatgccggtacgaacaaacagttgactcatatatcctcttaacttcacgcggtttcagaagaacagccgtagcgataggcacgcaggacatcctggattttgtcgaggatcagcgcgtgcggctcggcgttcagttcattcagcgacagtcgttcaaactgcaccggcatatactggctgataagccccagcggtagcttagcgtcggtcagattagcgataagtttctcaacgctttggcgaatacgcggatgcggccagtaataacggatacggtcggaaaggctgaagtggatatcgaccatcgcctggctccaggtggggcgatagtattttttccagtagccgggttcgttaagcatcacttcgtcgatcacctccatcacgcgactgcgagactccggggcgatcagctcattttccatttgggcgagggcaaagatggcttcacgcagggcaaaggtgagcgccgggccgactttcagaatggcgaagtggtcgcggaccagcgcacgataagcctggcgggtttggtagtcggttgagtgcgcttcgtagaccatcggggtgctttcgatccaggcggagagcgctttcgcttcctgcggctggtaatgaatgatttgcgtatggtcgaactccacgccgggctgcacgacgatggcgataactcgctccagcgcggcgtcgagccccagcttacggaaggcggcttcatgggtttcgagcgtcgcggcggcatcctgcgcccgggtgacatgtacgctgccgatggtgctggcctcgccgccgggaaccggaacttcggtcccgatgacgtaggtcaggtggcgcttttgctcatcgctggcggtctcctcggcagcctgacacaggcgagcggcgcgctcagcaaccacaccaggatccagcggcaccggatcgtcagcacaggacattgatgcatcgagatggattttactaaagccggcggcgacgtaggctttgatcaggtcgattgatttttccatcgccacggcggccggttcgtcttgccagcagttcggtccaagatggtcgccgccaagaataatgcgctccgccggaaaaccgacggtacgcgcgatgttgtagacgaagtcgcggaaatcggccggctgcatgccggtgtagccaccaaactgattcacctggttggacgtcgcttcgatcagcaccttattgttggtcgacaggtcgaaacgtaacgccgcttcgataaccagcggatgcgccgaacatactgaacagatgccgatatgttcgcctgacttatggcgagtgataatgtctttcatttacaacctccgttttctttcgaatatattcgttatgttttgttttggtcgcaaatggctttgttttgatttgtgatctgcatcgataaatagtgttgtaacgcagtgaaaggtatcgtctttcgagacaaaaacgccctgaccaggaagacagggcgtttttaattaattgaaaattaactaaatattcgggatagccagctgcgtttcgttttgacggcttcctgggagacctgctgcggctgggcggcaatttcgccgagaccggcgttaaaagcgtcaccaatggcttttaacgcctgctgcgcatcgttgccgctggccataaagtgcagacgatgaccctgtttggcgcccagcgatacgacgcgcatcagattcttggcatcaacaatggcggagcgcgtatcaaggttttcaacccggatttgcgatcgccactgcttgacggctttcaccagcaccgcgctgggacgggcatgtagcccgtgcggattacgcagggtaaaggtggcctcttcgtcaaattgcggcgcgggttgtggttcttcgcctgctggcagaggaatgtcgccggcgagaatttccagcaccgcctggggggtatcagcgcgcgtcagcgcctcaggtactcgatcatcgcccagagcatgggtgagctggcgcaaaatatcgagatgctcattgtcctgagccgcgataccgacaatcagataggcggtttgctcctcaccccagtcaaccccctgcggacaagccagcaccttaacgcccgttttaagcactgcgtcgcgactgtgcggcgtaccgtggggaatggcaatgccgttgcccagataggtgctgatttgcccctcgcgctcgcgcatgccttgtagatagtctgcccgcgtatgtccggcatgggtcagggctgcaacgacacgctgtagcgcctcgtcttttgttttgacctgacgatcgaaacaaatatcggcagaagtcagttgcatagcttgctccttatttcatggcgccagcaagagctgtcgctttgtcagtgcgtttttgccacagccgccagcatcccagcataagtgccccgcaggcggaaccggcgagaatgcacagcacccacatcaacggtttactgaccagcggcaggattaagaagccgccgtgcggtgccggaacctgaatatgcaggctgtagctgagtaccgcagaaattgaggaggcgatcatcatcatcgggatcacccgcagcggatccttggcggcaaagggaatcgcaccttcggtaatgtgcgtacagccgaggatatagttgaccatcccggcggcgcgttcctcctcgctaaagcctttcggaaagaacgtggtcgccagagcgatgaccagcggcggcgtgatgcaggcggcagatacaccggccataaaaaagtagttaccttgacccagcagcaacgtaccggtgacataggccgctttgttgaccggcccgccgaagtcgaaggagcacattgcgcctaccacgatccccagcaggatcgggttggcttcctgtaaagagctgagccagttcatcatgccattgttgatcgctgccaccggctggccgagcaggaccatcatcacgccgatcaccaggacgcctatcagcggcataataaagatcgacttcagcccttcgtactggcgcggcagaccgtcgagcagatgacggatcagcagcataaaatacccggcggcaaaaccggcgatgatcccaccgaggaatccggcgccggtggcgttcgccagcagaccgccgacaaaaccggcaaccatgccagggcggccagatatcgaccaggcaatgtaggcggtaaacaccggcaccatgatcgagaacgcctgctgaccgactttcatcagcgtggcggcaatcacgttatactgcggtgaattcgggtcggcggagtagataccccataagaaagaaacagcgattaagatcccgccggcgacaacgaacggtagcatgttggaaacgccgctcatcagatgtttgtaaatctgtcggccgaacgattctcgctcatatttctcgtctggatccgttgccgcggagaatccctgacgacgcggcgcctgaccgttaacgactttattaattaattccgccggatggtgaatggcttctttaaccggcacctcaataaccggtaaaccattaaaacgttcggcattaacatctttatcggcagcgataatcacgccataaatatccttcaggtcttccgacgtaatggcgttttctacgccggaagcgccattggtttcgacttttatttcaacatttaattttttcgctgcggtttttaaggcctcttcagccataaatgtatgagcaatacctgtagggcagccggtcacggcaataatttttttcataatcggacctttataattggacgatctgaagttgttgtaataattcttgcgtacggtttaatttacccagcccggcggaggcggccacatcagcgccggtggcgctggccagcgccagggcctggggaatatcgtctgtgttaagccaatggctgaggaatgcacccagcgcggcatcgccggcgcaggccgagctgaccagttcgattttcggtgccgagcagaaccacagttgcgcgccgttcgaaaaatagagcccttgcgcgccaagggtcagcagaacattgcgagccccgagctggtggagcgtttgcattgcttcgcgtacccgccgggggctgctgacatccagaccaaagatctctttcagctcgtcgtcattgggtttaatcaatagtggacgccactctaacagctggcgcagcaccgggtggctgatatctaagatgacttcacaccctttctgctggcacagcaccagaatctcgctatagaaccggctctctattcccggtggcagactgccgctgataactaaataatcaccgggcgcgacgcactgtaaatggtgaagaatttgttcttttccttcatcatcaatccgcgcgccgggatttaccagtttgtattcatcactgccgtcgttaataaatatatttatacgggtcggttcagcgacccatgccggtgtgacattaatatgctgtttgcgtagttcctcaacgatatagcggccggtaaaaccgccgaatatgcccatgacatgggttggctgctggtaatgatgtaataccagcgagacgttaacccctttaccattcgggcaatattccgtttgccgggtgcggttgactgccgccggctggagcggatcgcaaaagatattcatatcgatcgcggtattcagtgtcagggtgtggatcacagcaaggctccttcgatccgctgattacagttgtccttcgcagccacaaacgtgaatgactttgcgaacgacctctttcattgccgctttcgccggtttcatatagtgacgaggatcgttggcgcccggattttccaggaagtaggctttcagcgcatccgagaaagcgatttttagttcggtggcgacgttgactttgcatacgcccagagaaatggcgcgacgaatatcactatccggcaggccggaagcgccatgcagaaccagcggaacgtcaacgcagtcgcgaatagccgccaggcgctcaaaatcaagcttcggttcggcggtgtaaaggccgtgcgcggtaccgatggcgacggccagcgaatcaataccggtacgagcgacaaattcgcgggcctgttcggggttggtatagagcgcatctttagcatcgaccaccagatcgtcttcaactccgcccagacggcccagctcggcttcaacgctggcatcatagcggtggctcaactccaccacgctttttaccagtgccacattctcctcgaacggtgagtgagagccatcgatcatgaccgagcggatccctgcctgcactttgcgcgtgatatcagccagatcctcgtgatgatcgaggtgcagggcgagcgggagatcccacttttttgccagatcgcgggcgatcgccaccacgttgccggtgccggcatagctgtaggtaccgggggtgccggcaaggatcaagggggagcgcaactcagccgccgtttcaacaacgacctgcatggtttcgaggttatggatattgaaagccggcacggcataactctgtcgctgagcttttaatagcatgtttttactggaaatgatgtacattttagtcctctgttttcatcttgtaagttatttttggttaataaccttcagtttgaaagtaatgtaacgatcgtctcgccttttaggtgtgatccaccgcacacaatgatgaattgatttttaaaatgaaagttaatagtatttataaggtttcttttttaaagtttgagttggtaaggtgccaatttgtaactacatgattaatatcgatttgctgattgatggcgggatagggctacagccgcggtttgacattgcaagagggaaatttaaaaatgaaagttattccaggagaaaataataaggcataaaccgtggcaaaaccgtcaaccagcttgctgaaaaggcgcttggacatcgcagagatcgttcgtaagaacggcgagatcaaagtcgacgatctggcagaaatgctggctgtttccggggtgacaatccgtaacgatctcaactacctcgagcagcagggctacttgaaacgctcttttggcggggcgatttataccgcccaggctggcgcgccggttgcgatgacccgagaagcgcctgccgtcagagataaagcgctggagacggaaatggctcgccaggtggcggcgcagatagaaaatggcgaaacgctgtttctaggccagggttccattttgcgtaaagtgatcccctttctggccaacagagaagagctttgcctgctattaaatgatctgggccacgtcgcgctggcgcaggagtttttaaatggggaaaccgttctgcttggcggggtgttgtccggtcaggggcggattgtggagggcgaactggcgctgaaggcgttgggtcattaccgcccttcacgtgcgctgatagcggtggaccacattgctgaagacggcacgctaagcgtgcgtaacgaggttacggcacatttgttaagcgaagcggtggcccagagtaaacgagtcattgcgattgtcgcttcccggccggtctatggcgagaaacgttatgctgtgggtgaattacagcagatcagcagcgtcgtgacccctcaggtcgtcgcggcagagtaccatgcctgcttcctcgccgcgggtttgaccaacagctataccaacaatgaatgcctgacatggctcaacacggctttgcataagacaaaccaggagcggtgatgaacgtaaccatttgcaccatcggcgagctgctggtggagtttctcgccaaggaagagaatcaggggttttcccgtcccggtgaattttgggggccctatcccagcggggcgccggcaatatttgccgatcaggtggcaaagctgggtttcggctccgtgttgtttagctgtgtgggcaacgacgcatttggcgagatgaatattgcgcggctggagaaagacggcgtcaacgtcaacggcatcgctatgctgcagaaagcgactaccggtagcgccttcgtcagctatcgtagccaggcgcagcgcgattttatttttaatatgcctaacagcgcctgcggtctgctgactgccgaccacattgacgaagcgttgctaaatcagtgtcagcattttcatattatggggtcatcgctattctcgtttcgtattatcgatgcgatgcgtaaagcgattgaaaacattaaaggccgcagcggcacagtatcgttcgacccaaatattcgcaaagagatgctgaacatcccggagatgtcgcaggcctttgaatatatcctcgactacaccgatatcttcctgccgagcgatggcgagctggattactttggtctcaatccggaacgcaatgagcaggtcctggttgataagctactgaaacgcggcgtgaagcatgtggtgattaaacgcgggccgcgtggcgcaagctactttagtgccaacgagacgcaccatgtcgccggcttcagcgtgccggtggtggatccgactggtgccggggattgctttggcgccacttttgttagtctgttcctcaatggcgccacgccccgggaggcgctgagatgggcaaacgccagcggctcgctggcgattagccaacgcggccccatggaaggcacctcgacgcaggcggagatcagcgcttttcttgccgcccagcatccctaaccaacaagcccggatagatccgggctaaaagtggttaaatccttacgctctcgatcaggttaccggcgccgggttaaataccgccagctggttgtgcaggccccattgatcggagaaggtttttttgcgtccgctggcgacgtcgagaataaattcgaacagcttccgcccgacatcctcaatcgtctcttcgccagtggcgatggtcccggcgttaatgtccattaagtcataccagcggttggccagctcggtacgggtcgccatttttatcaccggtaccgccatcagtccgtacggcgtaccgcgaccggtggtgaatacctgcaccgtgatgccagaggctacctgctgggtgccgcagacaaaatcgctggcgggggttgcggcgtaaatgaggccgcgtttggtcggacgctgacccggagagagcacctcaacgatggcgcttttccctgatttggcaatcgaccccagcgctttttccaccacgttggccagaccgcctttcttgttgccgggggaggggttagcgctgcggtcggttttgcccatatcaagatagttatcgtaccaggccatctcttccagcagacgtttaccgacctcttcgttaatcgcccgcggggtcaacagatgaatggcgtcgcgtacttcggtcacttccgagaacatcaccgtcgccccgcagcgcaccagcaggtcggacgcgtaacctaccgccgggttggcggtcacgcctgaaaaggcgtcgctgccgccgcactgcatcccgaccaccagctcagaggccgggcaggtttcccgctggcgctggttcagtttcgccaggtggcgctcggcgacctgcagaatgtcatcgaccatcgatttaaaaccaacatgcttttcatcctgcaggctgacgatgctggcgctgtccaccgggatacttttgacgtcttccgtgccctgcagcaggcgttccggctgcagcttctcacagccgaggccaatgaccatcacctcgccgccgaagtttgggttgagggcgatattatgaatggtgcgaatcggcactaccgccgccggcgcattaatcgccacgccgcagccgtagagatgattcaggcccaccacgccatcgacgttgggatagtttggcagcaggtcgcgttcaatgattttcaccacgtaatcgaccacgccagcgacgcagtgcacgctggtggtaatacccagcagattcttggtacccacgctgccgtcagcattgcggtagccttcgaaggtgtaaccttccagcggcggtagcggttcaggcactttagtggccagcggcagggtattcagcggcggggcggtgggcagctccaccagcgactcgtcaatccagcttccctgcgggatatcgcgtacggcatagccaatgacttcgccgtagcggatgatttcaccatgggcggggatatccaccagggcaactttgtgaccctgcgggatatgctcgacgagcgtcaggccgtccgggaaacgcgttccggcggttaagccgcgatcgttgacaataatcgccacattatctgtcgggtcaactttaatataaaacgcggtcggcgattgttgtcgaattgcaatgtcagccattgtccagtcatctccaaacaggtgctaataataaaataaaacgctaattcatttgctacatatcagtatgatggaataaaggatgtcagctgagttgattttaaaatgtgatcggcatcactcctttttatgacgctaacctctgcaggacaggcaatcgtaagaagtgtggattagcgcccatgacttatggcatgagcacaattatggctttaaataataactttatattgtgggtatgcatagtgtctggcgggggcgtgctgattatactgagtcatgtttttgaggtgatcgatatgcgaatagacagtttcaatatcgtcttttaaataaatcagaaaccacttaaaacaattataaaaggtgttctgtgcccgaggaatgtctaaatgattttggattctacattagatgaaaaaaaaggaataccgacccgctatttaattctgttgatgatatttgtggtgacggcagtgaactatggcgaccgcgcgaccttgtctatcgccggtactgaagtcgcgaaagagctggggctcagcgcggtgtcgatgggatacattttttccgccttcggctgggcttatctgctgatgcagatccctggcggctggctgctggataaatttggctcgaaaaaggtttattcatacagtctgtttttctggtcactgtttaccttcctgcaaggctttattgatgtgttcccgctcgcctgggccggggtctccatgttctttatgcgttttatgctgggcttttccgaagcgccctcgtttcccgccaacgcccgcattgtggcggcctggtttccggccaaagagcggggtacggcttcagctatctttaatgccgctcagtacttctcgctggctctgttctcgccgctgctcggctggctgaccttcgcgctgggctgggaacatgtctttaccgtgatggggataatagggtttgtgctcaccatcatctgggtgaagtttgtgcataaccccaccgatcatccgcgaatgtcggccgcggagctgaaatatatctcagaaggcggcgcagtggtcgatatggaccataaaaaagaggccaccccggcggccgggccgaagatggactatatccgccagttgctgactaaccgaatgatgttaggcgtatttttcggtcagtatttcctgaataccattacatggttcttcctgacgtggtttccgatctacctcgtgcaggacaagggaatgtcgattctgaaagtggggtttgtggcttcgattccggcgctgtttggctttgctggcggtgtactgggcgggctgttttcggattatctgattggccgcggctgcacgctgacttttgcgcgtaagctgcctattgtgctgggaatgctgctggcgtcgtccatcatcctgtgtaactacacggccagcacgccgctggtcattacgcttatggcgctggcgttctttggcaaaggctttggcgcgctgggctggccggtcatctcggatgtcgcgccgaaggagattgttggcctgtgcggcggggtattcaacgtctttggcaatgtggcctcgatcgccacgccgctggttattggctacatcgtgagcgaactgcactcatttaatggcgcactgatttttgttggcggctccgcgctgatgatgatggtctgctacctgtttgtggttggcgatatcaaacgtatggaattgcagaagtaagcaacgattaacgcaaggtaaaaatcatggataacgcaatttttccgaacaaatttaaggccgcgctggcggcgcatcaggtgcagattggctgctggtgcgctttggctaacccgattagcaccgaggtgctgggtctggcggggttcgactggctggtgctggacgcggaacacgcgccaaacgacgtcaccacgctcattccgcagctgatggccctgaaagatagctccagcgcgcaggtagtccgtgtgccgaccaatgaacccatcatcatcaagcgcatgctggacatcggcttctataacttcctggtgccgtttgtcgagacggctgaacaggcggcgcaggcggtggcttcgacccgttatccgccggaagggatccgcggggtctccgtttcccaccgcggcaatatgtttggcaccgtgccggactatttcgcccagtccaacaagaacatttccattctggtgcagattgagagccagaccggagtggaaaacgtcgaggcgattgccgcgaccgagggcgtggacggtgtgtttgtcggcccgagcgacctggccgccgccttaggccatttgggcaatgccgcccatcctgaggtgcagcgcgctatccagcatatcttcgccagcgcgaagaagcacggtaagccaagcggcattctggcgccagtggaagccgatgcgcgccgctatctggaatggggcgcgaccttcgtcgccgttggcagcgatctgggcgtcttccgttctgcaacccagaaacttgccgacgcgtttaaaaaataatcaccaggatgaagagagagaacattatgacaatcaaagtaggttttatcggtcttggcattatgggcaaaccgatgagcaaaaatttgctgaaagcgggttactcgctggtggtgtctgaccgtaacccggaagcgattgccgacgtgatcgccgctggcgctgagaccgcgacgacgccgaaagcgattgccgaacagtgcgaggtgatcatcaccatgctgccgaactctccgcatgttaaagaggtggcgctgggtgaaaacggcattattgaaggggcgaaaccgggcaccgtagtgatcgatatgagctccattgcgccgctggcgagtcgggaaatcagcgaagcgctgaaagccaaaggtattgatatgctggatgcgccggtgagcggcggcgaaccgaaagccatcgacggcacgctgtcggtcatggtcggcggcgataaagcgatcttcgataaatactacgatctgatgaaagcgatggccggctccgtagtgcataccggcgatattggcgcgggcaacgtcaccaaactggctaaccaggtgattgtcgcgctgaacatcgcggcgatgtctgaagcgctgaccctggcgactaaagccggcgtcaatccggatctggtttatcaggctattcgcggcggtctggcgggcagtaccgtgctggatgcgaaagctccgatggtgatggaccgtaacttcaaaccgggtttccgtatcgacctgcatattaaagatctggccaatgcgttggatacctcacacggcgtgggcgcccaactgccgctgacggcggcggtgatggagatgatgcaggcgctgcgcgcggacggtctcggcactgcagaccatagcgcgctggcgtgctattacgaaaaactggcgaaagtggaagtcactcgctaacaagaagggcgccctgcgcgccctgttatgcttgccttgcgcggcactgtcaggctacaaaattatgaaaatcgtcattgccccagactcttacaaagaaagcctttctgccagcgaggtagctcaggcgatagaaaaaggatttcgggaaattttccctgatgcacagtatgtttccctgcccgtcgccgacggcggcgaggggacggtggaagccatgattgccgccacccagggaaaggaacatttcgcatgggtaacgggtccgctgggtgagagagtgaaggcctgctggggcatgtccggcgacggcgtcaccgcgtttattgagatggcggcagccagcggtctggggctcgttccgcccgacaaacgtaacccgctcatcaccacttcacggggtaccggggagctaatattacaggcgctggagcatggtgcggaacggatcattatcggcatcggcggtagtgcgaccaacgacggtggggcgggtatgatgcaggcgctaggcgcccgcctctgtgacgccgagggacaagagatcggccatggcgggggcagtttgagccgtctgagccggatcgatctttccgccatcgatccgcgcttacgtgacaggatgatccacgtggcctgcgatgttaccaatccgctggtaggcgagcgtggggcgtcgcggatctttggcccacagaaaggggcgaccgaggcgatgatcgtcgagctggatcgtaatctggcgcattatgccgacgtcattaagacgtcgctgcaggtggacgtgaagtcgatccccggcgcgggagcggccggcggcatgggtgcggcgctgatggcctttctcaatgcggagctgcgcagcgggattgagatcgttaccgaggcgctgaagctggaagaacaaatccatgactgctcactggtggtcaccggggaagggcggctcgatagccagtctgttcacggtaaggtgccggtgggggtggcccgggtggcgaagaaataccgtaagccggtgatcggtattgctggcagcctgactcacgatgtcggcgtggttcaccagcacggtatcgatgccgtattcagcgtgttaacttccgtttcgacgctggaagaggcatttcgcggggcgtttgataatatttaccgcgcgtcgcgtaatattgctgccaccctgcaggttgggatgaccactgagggatgacaacgggcggtaaaccctctatactgcgcgccgaagctgaccagacagtcgccgcttcgtcgtcgtcctccttcggggggagacgggcggaggggaggaaagtccgggctccatagggcaaggtgccaggtaacgcctggggggtgtcacagcccacgaccagtgcaacagagagcaaaccgccgatggcccgcgcaagcgggatcaggtaagggtgaaagggtgcggtaagagcgcaccgcgcggctggtaacagtccgcggcacggtaaactccacccggagcaaggccaaataggggttcataaggtacggcccgtactgaacccgggtaggctgcttgagccagtgagcgattgctggcctagatgaatgactgtccacgacagaacccggcttatcggtcagtttcacctttttatgtcaaaaccccgcttcggcggggtttttgctatctgaacccgtgacgcggatgaataactgtccacgacgctataccaaaagaaggcggcttctcggtcagctaccgttatttaaccaccttaggattctgtagcgtcgggatcgtggaatcttgcacctgatgaacctggccgacgatcgtagcgacgctgccgttgcttaaagcctctacgtctgcgctgttatgcgagccaaaattaaaggtaagacgtttatccgttttattctgttcatctcgcatggtcacgataaaatagtagctgccggcgataccgctcttccgacgaatgtcgacaatcaccccgcgtaccttgacccatttacccagataatcgctgctggccttcgccgggttgagagtaaacggctgcaggaactgagccactgaatacgtctgcatcgaagcgacggcgtcatctccaggttgaaataatttgtctcccgcggaataaaaggctttagaagccaggccgcagccgcttaacagcgagatgacaaaaaccagcggtaatacgcgaaaacgtaataacatctcaatctccttatctatttttaaatgatatccttgatgcgctggataacgtaatatgcgctaattaaattaaaggaaaagtcaccactgtcaaatattttgcttgctgttgaaattaaaataaaacctggtgatgttagggcgtcaactatataagttaacacggtattcatattttatatgttttagtgaagtatattagtgctgtggatatatataatgtttggctatcattttttacatttattcactgcgccctggaaaataataatccgctatttctgccacctttacttcaggaaaaaaaatgaaattgataacccgtattgcctttgccacgctgttgaccaccggtttctctatcacggctcaggccgcagacgttaaggcggcgccagcaccggcgcaggatcctattgttcagcacttaaaacttaccaacgatcaggtcgcgaaaattaaaagcctgcatcagcagttggagagtaatgtccagcagatttcccaacaggaaattaaagacggggctctgataaacgtgattgattccggtaaatgggatgaaaaagcggtcaacgatcagctggcggccttcagcaagattgatcagcaggtgcgttattaccgcgtgaagtactattttgaggtgaataaggtactgacgccggagcagcgcacgcaggtgaaaaaagatcttgccgacgcgctgagtgaataatgccatcggcccctcgcggggccgatatcttcttcaggccattaatgaaaatcaacccagccattttgccgtttcaggcgagactttcttcatcccgcaggcggatctccgcttcggcaacaatggcttccagttcgctaagcatctcatcataaccaaagctggcggccccggcgacttgcggttgcaccggggctaacggcgttggtgacgccttttttctgtttttcttcttactcactgacagactccatcacttccgttgttacaccggtaaatctatcagcaaagcgcgcagcggcgtatcggcgacgagggtaatgttagcttcgtcacgaataaatgcgccgtcaccgcaggtgagagcctgcttttgctgttcctgtgcgacggcatggacggagccgtgaatcgactgcaggtaggcgcgtggaccatgtaattgcacgttgatctgctcacctttctccagcgcgatatggtagacccaggcctgttggcgaagctggaggctgttatccccgccctccggagaggccagcagctgcagcgtcgcgtctgcgacattgattttctgctgcagcgggttttcccgctgcgggcaggcatcaagccaaagttgcattcgcgttaacgactgctctttactcagattatgctcgctatagctcacgccaggctgggtggcgatcagcagcgcttcaccggctttggcctgcacgtggttgccgtcgctgtcgcgatactccgcttcgccttccagaatcaggttcaggatatcgacttttgggtacgttctggcctggaaggaagcgccgggcgccagcacttcctggttgaggacgcgcaaggatgcgaagcccagtaatttcgggtcgaagtagtggccaaaggagaaggtgtagcgggcctgcagccagccgaagtctgcttgtccgcattgtttggctgttcgggtagtaatcatgttcttgacctctctttacactaaatcaatggtaaaggtatggacgctgtattgttagccagatattctgcccggtatgttcaaatttcctgaatgagaaagcgatggccaaagagagagcattaacgctggaagcgttacgcgtgatggatgcgatcgaccggcgcggaagcttcgctgccgcagctgatgagctgggacgcgtgccttccgccctgagctacaccatgcaaaaactggaggaggaactggacgtggtgctgtttgaccgctcaggtcatcgcacgaagttcactaacgttggaagaatgctgctggagcgcgggcgcgtgctgcttgaagcggcggataaactcaccaccgatgctgaagccctgtcgcgtggttgggaaacccacctgacgatcgttaccgaagcgctggtgcccactccggatctgtttccgctgattgagaaactggcgactaaatcaaacacccagctgtcgattatcactgaggtactggccggcgcctgggagcggctggagcaggggcgggcggatatcgttgtcgcaccggatatgcattttcgttcctcttcggagattaactcgcgcaaactctattcggtgctcagtgtgtacgtcgcggcgccggatcacccgatccatcaggagccggagccgctctctgaggttacccgcgtgaaataccgcggcgtcgcggtggcggataccgcgcgcgagcggcccgtcctcaccgttcaactgctggataaacagccgcgtttaacggtgagtacgatagaagataaacgtcaggcgctactggccggactgggcgtggcgactatgccctatccgctggtggagaaggatattgccgaaggtcgcctgcgggtcgtcagcccggaatacaccaatgaaattgacattatcatggcctggcgacgggacagtatgggcgaagcgaagtcctggtgtctgcgtgagatccccaagctgtttgccggcagatagtgatgaagaccctcctcccgctagcgggaggagcaggaagattagtaggaaaagggtttcggatcgggcccgaagcgattattgccttcggtgccgcgctggcagttaaagatcaggatcaccagccagccgatgaccgggatcaacagcagcaatagccaccaggccgaacgatcggtgtcatgcagacggcgaaattgcaccgcccaccacggtaaaaagaccagtacgccatagatagtggtcagaatgccttcgccgccagcccgctgccagcccagcattttatcgatgatgctcaatacgccggtcaggatgaggttgaccagaataaacatccagtactctttgcgccgcgcacggccgccaaatcctatatagttttttaataccttgagataccagtccatttctacgcctcaattaaccgtcaatcacttgttttttaagcgatcgcaataagaatagacgtgaatgaatggtgggtaaatatctgttttctgaattattgggcgccatcactggcgcccgacagatcaacggaagcgctgatcgcgaccgtgcggttcgttgagatcctgctgcggcccaatggaaataataccggtagggttaatggttttatggctgcggtaatagtggtgacggatatgcggaaaactcaccgtctcggcgatacccggcatctggtagatgtcgcgcaggaaaccgtacagattgaggtaatcactgatgcgccgtttatcgcatttaaaatgggtcacatataccgggtcgaagcgtaccagcgttgtccacaggcgaatgtcggcttccgttagctgattgcccgtcagatagcgatgctggccgaggatctgctccagccgctccagcgaggtaaagaccgcatccaccgcttcgtcgtaagcttgctggctggtggcaaagccggctttatacacgccgttgttgacgttgtcatagatccagccgttcagctcatcgatttgttcccgcagcgctggcgggtagtaatccccggcccgggcgccaaggccatcgaaggcggtattgaacatgcggatgatttctgccgactcattgctgacgatggtctgctgttttttatcccacagcaccggcacggtcacgcgtccggtgtagtgcgggtcggcgtgcagatacagctgatagagaaagtcatgctggtagagggtatcgccggtggcttccgggaagctatcgtcaaaggtccagccgttttccagcatcagcggattgaccacggatacggggagaaaaggttccagaccttttaatttacgcataattaacgtgcgatgcgcccacgggcaggcgagagaaacatacaaatgatagcgatccttttccgcggcaaaaccgccttcaccgctggggccagccgcgccgtcggcggtcagccagttacggaaggcggaaacggaacgtttaaaacgcccaccggtggattttgtgtcataccaggtatcctgccagacgccgtcaactaattgtcccatctttgctcctccttcagactacagatagcaaaagcgaggagtggtctcctcgcttttttcattcattcagtatagtgcgcttaccatttcttattcagtacacggtcaatactgaaggcgcccggtccggtaatggccagcagcaggtaaccgcccgcaatggtcaggttcttcatgaacatcagggagttcacgccttccgcaaagttgctatggaacaggaacgcggtcagcagcgtaaagcccgcagtgaacagcgcggtggtccgggtcaggaaaccgaacagaatcgccagaccgccgccgaactcaaggaggatggtcagcggcagcagcgcacccgggacgcccatggcttccatatactgctgggttcccgcataaccggtgattttgccccatcctgcagtgataaacagaatcggcatcagaatacgcgctaccaatacaccaacatcttctaattttttcatttgttactccagaaaacccaaagggcggcggttttttttttagtgcaatcccgcgtagttacgcggtgttgctgtcgatggagaggatagtagcgaggcggagagggaattgttagcaaggaaaactgtagatctatttcaaagtttctgagcaatcagtacgcggaggcgaaagtgtaccgaacgcgatgggccaccaccggtcctggtatggcgtgaggtaaagggcgtcgtagagaagggcgcgctacggaaaaggcgcatgttgctgcgaacagggtgcggtaacggacagggaaatggcagagcgtgggcgccagggaaagcgctcacgctcagggccgctagcgaactgccgactggcgcaggatcccgcgcaccaggcgccaggtgctccacagtccgagtccgcgtttggtccagcgcattaaaaaatgcggatgtcgtacggaccatacggccatcagaccgctgccaaccatcagccacgaacgtaaactcagcagcgtatgccagccgcggtcgaggggcgcagtcgcctcgtgccagtgacggcggcaggcgctgagctccagccgttgctgctggatctggcgcagcagctgcgtcttttgccgttcacgctcctgtcggccattcacgatttatcctcctccagaagggcacggtcgttctccagctctttacgcgttagacgcagcagcgtggagcggcgcgccttacgtagggttaggatacccacgatcgcggcggcaaggagcagcacaacggtggtggcgatcatcacgtgcaggcggtactgagcgtcaacggcccagataaccagcaccagcagactcatgaggccaaacgcggcaaacagcagcgtcagtccggtcatgatcagcagctggaagaggttggctttctcctcctccagctccacgacgaccagacgcagccgcgtttccaccatttcgaccagcagcgtgacgatgcgctgaccaatggagaaaacgcgctgacccggtccctgcgtgtgttgagtattcgccataatcagcgacgcgacagcaggacacccagcaccagcccgacggcggcgccaattcctaccccagtccacggattttcgcgaacataatcatccgctcgcgcggcggtctcacgagtttgacgaagaatcgcttcgctggtttcacccaaacgagcgcggctctctttcagcgcgctctcggctttactgcgcagtttacccatctcttctttcgacttgtccgccgaggaatttagtacttcctccagggtatccgccagcgttttcagttctgcacgaaggtcgtcagtcacattctctttagccatgtcgttctcctgtagcgtggtccgtgttgcgaaagttaatggtgattagtaatcccgagactccagcgtttttaactcctgttgcgcttcattgagtttatgctggcgtttgttaattttgtccgcatcgcctttcttccgggcttcctgcagatcgcgctgacgttcagcgatctcttcccgctgtttggcaattttttgctgatgatcggctttgagtttactgtcgctacagttttcccgaacctgacgtagcgcggtatttagcccatcaatgcgactttgattatgatgcttttcggcgtagctgatctctcgttgaatatcctgctctttttcctggcagggagaggcggctagggcgctggcgctaagtgaagtcaggaccagaagcagagcgatgcggtgtttcatggatagtaccttccattgtctgaggggatacccggaggatatacccgttcccgttggtgaacgtgaatgcgttgattcccgcaggtttaagcatagtaacaaatgcgggaaaccaccagactgggttaaaaacgcagtctggcggcagcttacccgaggcgatgcggcgcgtcgcgcaggcgggatagccaggcggtgggcgagttatcgtcctccagaagggcaataatataaccatgtggcagagcgcggccgagaacttctttcgccgccgcgccctgggcggtggaatcgaacttaatcagcagaccatccttctgcggcgtgatgcttttaaagcggatgccgttggcatcgagatgatgccagacggagaaaccgtccggcattccgataccctggccaaccgggcgtatcgccagcgtggcctcctgctgctgcaccgccagccaaagccagaacagggcgccgagcagaagagaaccacccagcagccagctgaactggcgcagggaagggcgtttcatgaccatcattagccccggcttctgtattttttcttccacagcaccaccagcgagccgatcagtccgaagaccaacagggcaaccggcaggagcatcaggcaggacatcagctgatcttcatacttgaggaataccggggttttacccagcagatagccaagcgaggtcaggatgagcacccacagcaggccgctcatccagttgaaaaactgaaaacgggcgttattaaggccggaaagcccggcgatggtgggcagcagcgtgcgtacgaaggcgataaagcggccaatcagcagcgcggagagcccatgcttatgaaacaagtgatgcgcacgctggtgatagtgcgaaggcaggtgtgacagccagttttgcacgatccgcgtattacccagccaacgcccctgaatatagcttagccagcagccgaggctggcggcggcggtgagcagcagcaaggtttccggaaaacccatcgcccctttggcgatcagcacgcccacgagcacgagcagactatcccccggtaaaaacgcggcaggcaataacccgttctcaaggaacaaaatcataaacaagacaaaatacagcatgcctatcatggagggattcgcgagcgtttcgtaatcctgagcccacaaggcattcaataactgggtaaatagttccattcacgattcctggtacatcggttaacggcacgtctgagcgcgtggcatatagggcgacaagatttttatgagattatggtcgctgcttaggcgctctgaacgcttccctgtataagactgaagtaagtaaatacctacccccagaacgacaaaatgcatctaattgtaacaaatcacctgactttccgtcagagaaattgcaacgtgttgctcgttgattttgctgattgcggagatgggaggcgagaggatttacacaggctgacactatatatgacttgcttactccagcctcactgtcagacaggcgcgcaggggggcgcgccggagggataaggccttatttcgcgccgttgactgcggtatcgagatgaacgactgggttttcggcaaataagtagcgatcggcattaaattcaaagtcatcgctggtttcgttaaacaacatttgcttggtattttccagatgctgccacatcgccagcttggcggcgttgggatcttttcgcagcagagcttttaggatctgatcgtggtcgtcgcaccagttatcgaccgtacgcaggtcgatatgctcatgcagctttttccagtaggggttatgcacgcgctgggtccacatcttttccacgatcgccgccagcgcgctgttctgcgtcgccagcgccacctggacgtgaaactgcaggtcccactcggagtcgcggaaacatttctcgttacgcgctttctcctgaatctccatcagcttcatgatgtcctgtttggtcacctgagtcgccgcgaattcggcaatattgctttcaattagctgccgcgcctgcagcagttcaaaggggccatagttggcgaactcaaggctttcatcggccacctgctggtatttcggatggttggagataacgtggatacccgaccctttgcggacttcgacatacccttccacttccagcatgataatggcttcacgaaccacggtgcggctgacgtttttttcatcggcgatgaagcgctcggcgggcagcttatcccctacaaggtagacaccttgttcgatgcgcgtcttcagctcagcggcaagctgctgatatagacggcgtggttcaatgatttccatattcgctcccggaagatggcgacaatattcgatttgttataccacttttacgcgctttccaccactggcaggcatgaaaaagccgcctgagaaggcggcttgatcggcgattaccttgccattcgatctaactctgcgtgaccggtttgcggctgctaagcggcgtcgagtcatcgtcagccggtttgtttttcagcaccgtccagataaccagcgcgcccagcaggtcaaagacggccagtaccgcaaacagcgggctaaagccgatggtgtctgccagcgcgccgacgaccagggcgaacatggtgctcgccagccaggcggccatcccggtcagaccgttggcggtagcgacttcgttacggccaaagacatcggaagagagggtaatcagcgccccggacagtgcctggtgagcgaacccgccgatgcacagcagggcaatcgccacgtacgggctggtgaacaggccgatcatccccgggccaatcatcagcagggcgcccatggtgaccaccattttacgcgacacgatcaggttgacgccaaaccagcgctggaacagcggcggcagatatccgccgacgatgcagccgaggtcggcgaacagcatcggcatccaggcgaacatggcgatctctttcaggttaaaaccgtaaactttgaacatgaacagcgggatccaggcgttaaaggtcccccaggccggctcggcgaggaagcgcggcagggcgataccccagaactgacggttgcgcaggatttgccacggcgacattttcttcgcgttattggtctgatgctgagactcctgaccgccaatgatgtagtcacgttcttcgtcagataattttttctggtcgcgcgggtgtttgtagaagataagccaggcgatggcccaggcgaagctcaataccccggagatgatgaacgccatctgccagctgtgcatgacaatcgcccacaccaccaacggcggcgcgatcatggcgccaatagaggaacccacgttgaagtagcccactgcgatagagcgctcttttgccgggaaccactctgagctggccttcaggccggcggggatcattgcggcctccgctgcgccgactgcgccacgggccagcgccagtccaccccagctgccggccagcgcggttgagccgcagaataccgcccaggcgatggcgaagaaggcatagccaattttggtccccagaatatcaaggacataccccgcgacgggctgcataacggtataggcagcggaataggctgcaatgatataggagtactgttgggtcgaaatgtgtaactcttccatcagcgtcggcgcggccgccgctacggtgttacgggtcaggtagcccagcacggtgcccagcgtcaccagcgcgatcatgtaccaacgtaaccctttaattttacgcatgtaaacctcatcgtctgttatctttccgcatcaggtgcggcctttaccgagcgcaataagcggccgggaaagcgaaacggaggattcaggagggtagtcccctctggcctgaaccttaccatcagttgttatgttgaaagtcggtatccattccgtataagccgatgccataagcaccggtaatgcattccgtcggtttatatgttgcgacggcagaaagataacttgtcatacaactttaaaagttgagagctgtcacaaaagtgggaaagttagtgtggtctttatcccttgcctggaaagccagagatggcgcgctctggcgaggtgttttgctccagggcggtcatttttttatcgacgtttattgatctaactcacgaaaaacagttcggtctgtagaaattggtgtgataactttgtcagcattgtagtcaatcatctgaaaggctcccacactggagcgaagaggacacgcgaatgacatcgtttatgactgaagattttctacttgataccgagtttgcccgccgtctgtaccatgattacgccaaagatcagccgattttcgactaccactgccaccttccgccgcagcaggttgccgaaaactatcgctttaaaaacctgtatgacatctggctgaaaggcgatcactataaatggcgcgcaatgcgcactaacggcgtgccggagcgtctgtgtaccggtgatgcgtccgatcgcgagaaatttgacgcctgggcggccacggttccgcacactattggcaacccgttataccactggacccatttagagctgcgtcgaccttttggtattacaggtaagctgttgtcgccatccaccgccgatgagatctgggaccagtgtaatgatttgctggctcaggatgccttctccgcccgcggaatcatgaaacagatgaatgtgaagatggtcggtaccaccgacgatccgattgattctcttgagcaccacgcggctgtcgccaaagacaactcctttgacatcaaagtgctgccgagctggcgcccggataaagcgttcaacatcgagttggcgaccttcaatgattatatggctaagctgggcgaggtatccgataccgatattcgccgcttcgctgatctgcaaagcgccctgaccaaacgtctggatcattttgccgcacacggctgcaaagtctccgatcatgcgctcgacgtggtgctgtttgccgaagcgaccgacgccgagctggatgaaattctggcgcgccgcctggctggcgagacccttagcgaacacgaagtggcgcagtttaaaaccgcggtgctggtgttcctcggcgcagagtatgcccgtcgcggctgggtccagcagtaccacattggcgcgctgcgtaacaacaacctccgtcagttcaaactgttagggccagacgtcggcttcgactcgatcaacgatcgtccgatggcggaagagctgtctaagctgctgagcaagcagaacgaagaaaacctgctgccgaaaacgattctctactgcctgaacccgcgtgataacgaagtgctgggcaccatgatcggtaacttccagggtgaaggcatgccaggcaagatgcagttcggctccggctggtggttcaacgatcagaaagacggtatggagcggcagatgacccagctggcgcagctcgggctgctgagccgcttcgtcgggatgttgaccgacagtcgcagcttcctctcctacacgcgccacgaatacttccgccgcattctgtgccagatgatcggccgttgggtggctgccggcgaagcgcctgcggatatcgcgctgctgggcgagatggtgaaaaacatttgctttaacaatgcgcgtgactatttcgccattgaactgaactaaggccagaggtcggttgatatgcaatacatcaaaatccattcgcaggataacgtcgcggtcgcgctgacggatatcgctgccggtagcgtggtgacgattgataatgactcggtcaccctcggccaggatatcgttcgcggccacaagtttgcactgcgcgctatcgcgaaaggggaaaacgtcgttaagtacgggttgccgattggccatgcgctggcggatatcgcgccgggcgagcatgttcatgcgcacaatacgcgcaccaatctcagcgaccttgacgcgtatcgctatcaaccggacctggttgcccaaccgccacagcctgcggatcgcgaagtacagatttatcgtcgcgccaacggtgacgtcggcgtgcgcaatgagctgtggatcctgccgaccgtcggctgcgtcaacgcgatggccagacaaatgcagaaccgtttcctgaaagagacgtatggcgctgaggatatcgatggggtacatctcttcagccacacctatggctgctcgcagcttggggacgatcacatcaacactcgcaccatgctgcaaaatatggttcgtcacccgaacgccggggcggtgctggtggttggccttggctgtgaaaacaaccaggtggaggcctttcgcgagacgctgggcgagtttgacccgcagcgcgtgcactttatggtttgccagcatcaggacgatgaagtggaggcggggattgagcatctgcatcagctgtatgaagtgatgcgtcaggataaacgccagccgggcaagctcagcgagctgaagtttggcctcgagtgcgggggatcggacggcctgtcgggcattaccgctaatccgatgctgggccgcttctcagactatgtgatcgccaacggcggcactaccgtgctgaccgaagtgccggagatgttcggcgctgaacagttgctgatgagccactgccgcgacgaagcgaccttcgacaagctggtgaccatggtcaatgactttaagcagtactttattgctcacgaccagcctatttacgaaaacccctcgccgggtaataaggccggagggatcactaccctcgaagataagtcgctgggctgtactcagaaagcgggctccagccaggtggtggatgttctgcgctacggcgagcgcctgaaggttcatggtctgaatttactgagcgcgccgggcaacgacgcggtcgccaccagcgcgctggccggcgccggctgccatatggtgctgttcagcaccggtcgcggcacgccgtacggcggctttgtgccaacggtgaagatcgccaccaacagcgagctggcggcgaagaaaaagcactggatcgactttgatgccgggcagctgctccacggcaaaacgatgccgcagctgctggaagagtttgtggatgccattgtagccttcgccaacggtaaaccgacctgtaatgagcagaatgacttccgcgagctggccatctttaaaagcggtgttaccctgtaaaggcgtatttgcgttggcgcccagaggcttggtttgtgtatcggcctgatagcgtagcgccatcgggctcgtaacagcggcgtttcagccagtgaagcgccgtttgtttttttcagtcagggagcttacatgaccgcgtattggctggcccagggggtcggcgtcatcgcctttcttatcggcattaccacctttatcaaccgcgatgaacgccgtttcaggctacagctggcggtctatagcgctattatcggcgttcattttttcctgatgggcgccgggccggctggaatgagcgccgggctcaatgcgcttcgcacggtcatttccttacgcacccgtagcctgtgggtgatgacagtctttatcctcctgacgttgattctcggcctgggtaaactgcagcatgccatggagctgctgccgatcattggcaccgtcgccagcacctgggcgctgtttcgctgcaaagggctaaccgtccgctgcgtgatgtggtgctccaccgcctgctgggtcacgcataatctgtggttgggttccattggcgggacgctgatagaaggcagtttcctgatcgtcaacgggctgaatatcattcgcttccgccggatgcaaaagcgcggtatcgatccgtttaaggttgaaaacgcagtacaggaagagagtccctccgcccgatagcggaggggaaaggcgttatccgcgcagggcgtttttcgccagctggtcgtcttccgccatgcaggccgcggcggtaaacagggcgtcggtggaggagttcagcgcggtttcgcaggagtcctgcagcacgccgataataaagccaacggcaaccacttgcatcgccacatcgttcgggatcccaaacatattacaggccagcgggatcagcagcagcgagccgcccgccacgccggaggcgccgcaggcgcacagcgaagcgaccacgctcagcagcagcgccgtcggcagatccaccggaatattcagcgtatgcaccgccgccagcgtcagcacggtgatggtgattgccgcgccagccatattaatggtcgcccccagtggaatagagaccgaataggtgtcgcgatccagattcagcttctcgcacagcgccatattcactggaatgttggcggcggagctgcgggtgaagaacgcgtaaacgccgctttcgcgcaggcaggtgagcaccagcggataggggttgcggcggatcttccagaacaccagcagcggattaatcaccagcgctaccagcagcatacagcccaccagcaccagcagcagctgggcatagccccacagggtctcgaaaccggtggtcgccagggtggaagataccaggccgaagatccccagcggcgcaaagcggatcaccactttaacgataaaggtcaccgcgtgggagacgtcgttgatcaggtttttggtggtgtcgttaccatgacgcagggcgaagccaagccccaccgcccacaccagaatgccgatatagttggcgttcagcagagcgtcgatcgggttggacaccatgctcatcagcaggccgcgcagcacctcaacaatccccgacggcggcgtgatgctgtcggcggcggtggttaagtgcagggtcgagggaaagagaaaactgaacaacaccgcggtcagcgccgcgctaaaggtgcccagcagatagagaaacagaatggggcgtatactggttttttgtccgtgctgatggttggcgatcgaggccatgacaagcatcaataccagcaccggcgctaccgcttttaacgcgccgacgaacagggtccccagcagaccgacggcgatagccgcaggcttagagaccagcgccaacagtacgccaagcaccaggccgattaaaatttgtttcaccaggctgccttgcgccaggcgggagagccaccctgatgagggagtgcgtgttgtcataattcattccttccagtgatgtagcaagccatcccagccacgtattattttttacgtttatgtcaggatgtaagtagatgtttgcatagtcgagtatacggaaagaaagactggcgggaagcgtaaaatactgtgattttaatatggatcttattttttaactgcgtagcaacataattgtgacatgagcaggtattctcgttacgagaacgtctgctatagctgattaccgcgccgccagcgagggccgacggcgcggtagcagattactctggcagtttgcgctgcttgtcgtgctgcctgttgacccaggcgttaatcagcagcgtgacggccaggatgccgcccaccacgcccagcgagatggcaaccgggatatggtagaagtcgacgatcagcatcttcacgccaataaacaccaggatcaccgacagaccgtatttgagcatcgagaagcgctcagcgacccccgccagcaggaagtacatggcgcgcaggccgaggatggcgaacaggttcgaggtcagcacgataaacggatcggtggtgaccgcgaagattgccgggatactgtcgacggcgaaaatcacgtcgctcagttccaccagaatcagcaccagcagcagcggggtggcgaacagcaccccgtttttacgggtgaagaagcgctcgctctcgattttatcggtcatccgcagatggctgcggatccagcgcaccagcggtttatcgccgatgccggagtcgtcctctttcgccagcgccatcttcacgccggtaaacagcaggaaggcgccaaagacgtacagcagccagtcgaactgcgaaatcagccagctgccggcgaagatcataatggtacgcagaacgatcgcgcccagtacgccatacaccaacacccggcgctgcagagcaggcggtacggcgaaatagctgaacagcatcaaccagacgaagacgttatcgaccgccagcgctttttcaatcagataacctgtgaggaaggctaaggcctgcggatcggcgacggcccggccctgggtttgcaccagataccaccagaaggcggcgttgaacagcagagaaagcgtgacccagaggattgaccagccagcggcctgtttcatggtcatgctatgcgaaccgcgtcgtccctgaagcagcaggtcgattgccaacatgatcgcgacaacgacagcgaatccaccccatagcaacggcgtgccgacagtattcatttgatattccttacataaaaacaaaacggctgacgtcggaagacggcagccgctgcgcttttatgcatagacctcgccttccggcaaggtctcacttacaacaaccaaagtacatcgcgatgggctttggttattgcccggcgaccggatgcggtattgcacgcatcgtaatgacgatcaaccggcaaggaagttactcccctttgcacgtaacaaaatatgtcacagggcggttttcgtcaatggcggccggtcaggcctttacactcttttacgccagcggctgcgtatcggccgggaagatcaccccggtctggcgacgaatttcgctggacagtttggcggtgatccggctcaccgccaggcccgggtgatccacatcctgtgtctccaccagccgcgcaaaggtctccgcctcatacagcatggtattaatgtgctggggctgcgtcaggtcctgggctttaccgccgcgcggcacaaacgccagcttctgacattcggagattttttcgatcactaacgcgccgtcttcgccctgaatttcactggggatcgcggaatcgctaactttggagtgatgcagcgtcacgtcgaagtcgccatagctcagcaccacggtgccctgggcgtctacgccgctgtccagcaggctggcggtggcaagaacggcctgcggctcgccccacagcgccacagcggacgccaggcaatagaagccgatatccataatcgaaccgttagagaacgccgggttaaaggtgttggggttttcgccgtcaaggtagcgctgatagcgcgaggagtactgacagtagttgataaaggctttgcgtagtttgcccactttagcgagcgtttctttcagtaggagaaagttaggcagactggcggttttaaaggcttcaaacagcaccacgttattttctttcgccagcgctatcgccgcctcgacttcctgcaggttcgacgccagcggcttttcgcaaatgacgtgcttcttatggctcaggaacagccgggtctgcggaaagtgcagcgagttcgggctggcaatatagaccgcgtcaacgtcagggctctgtgccagttcatcgagcgaggtaaacagatgctcgacaggatagtctttggcgaaggcttgcgcctgttcgaggctgcgggagtagatggcggtaagtttatatttgccggtttcatgggcggcatcgacaaactgcttggtgatccagtttgtgccaacaactgcgaaacgtatcataaacgttgacgaactccgttaaagggaacctgccgccactctatcatgccgtcatgacaaaaccagtgcgtcactacgcagaacgatttaacgaaaggtgcgtcagccacaggcgggtgtcgaactccagctggtggtactgcggctccatatggcagcacagctgataaaaagccttgttgtgatccttctctttcagatgcgccagttcatgaaccacgatcatccgcagaaaggcttccggcgcgtcgcgaaataccgtcgctacgcgaatttccgctttagctttcagcttaccgccctgcacgcgggaaatggcggtatgcaggccgagcgcattgttcagcacgtggatcttactgtcatacatcactttgttgatcggcgccgcgccgcgcagaaagcggtttttcaagtcctgggtgtactgatacagcgctttatcgctgttaacgtcgtgcccttgcggatagcgcttttgcagcacctcgccgaggcggtcttgctcgattaacgtggtcacctgcgccagcagcgattcaggatagccctgtaaataaatgagttttgtcatcgtcttatcattatgtctgtcaggagggcagttcagccacggtcatggtaaagaccagcggcgcggtaccctcattgcggtaaccgtgctctatttcggtgcgggccaccgccgattccccggccgccaccgtgcggcaggtctcgccaagcgtcagcgtcagcgcgccggcttccacgtgcagcagctcgaaggttgttgccgggtggccaggcgaggcaaaggcttcgccgggctgcatctcccagcgccacagctcaatcatattcggcccggcggtgccggcgaggagcctggcgctgccccccagcgggccttgccagagggtggggatctgctcggcgggaataatatgcaacgcgggttcgcttgacacattgacaatatccgccaccgagacgcccagcgcggcggcgagtttgcagaggatcgcaatgctgggattggcggcctctttttccatctcgaccagcatacctttgctgatgctggcccggcgcgacagctcgtccagcgacatttttttcgctttacggtaggccttcagccgcgtggcgacggcgcgacttacctggtcgacatcagatcctgaatcggtcgttatattgacttttacgttcattggtcactatgatgaaacaaattggtcattacaggattatcgaatgcgtagcgtaacgccgtcaatcgaatctgcggtcagccgcctggcgccgggctttcgggcattaagtattgtggtggagagcgcgccggtggccgatcccgccgtcgcggagcaggcgctggccgaggcctgcctggcggtgcagcaggatgatgtgccctgggcgcaagcgcacctggcggcatgggatgaagcgttcagcgccttcggcgcgaaggcgaaacgtaccccctgttcggcgcaggcgctgcgcaagcgggtgctgaaagaggggagcctgccggccatcgatccggtggtggatatctacaacgcgatcagcattcgctatgccgtcccggtcggtggggaaaatctggccgcctaccgtggcgaaccgcggctggccattgcccgcggcgatgagccattcgatacgctaaaatcggcagagccggtagtggaatatccggagccgggcgaagtcatctggcgggatgatataggcgtaacctgccgacgctggaactggcgacagggcgtgcgcacccggctggacagcggcgcgcagacgatgtggtttattctcgaaagcctgccggcgatgccgttgtcggccctgcatgaggcgggagagcggctggtaggttatctgcagcagctgatgcccggcgctcgcgcgtcgataacgctgctgcgagccgatgacgagggcgatctacgctgagcggcgatgatcagcgatctctcttcaactggacaggatttgcgtataaactcgcgggttttactattccggaggcggagaggcgatgagccaggcagagttaaacggtgagttattcacattagagcggttcccacctaacgctgaagaagaagcgcttcaggcatgggaagcggcggatgaatatctgctgcaacaggtgaatgacgtcgacggcctgacgctcatcttcaacgacggcttcggcgcgctcgcctgcgcgctggcggagcgcaacccggtcagtatcaacgactcctttatttccgagctggcgacccgccacaacctgcggatgaacggtatcgatgaagagagcgtgcgctttcaggatagcctgagcccgctaccggccgcgccggcgctggtgctgattaaggtgccaaaacagctggcgctgctggaacagcagctgcgcgccctgcgcgaagtagtcacgccggaaacccgcatcatcgccgcggcgaaagcccgtgatgtgcacaactcgacgctggcgctgtttgaaaaaatcctcggcaccaccaccacctcgctggcgtggaaaaaagcgcgtttgatccactgcgttttcaccgctcctgagcttgccgatgcgccgcaaacctacagctggaagctggacggcacgccgtggaccatccataaccacgccaacgtttttgcccgcagcgggctggatatcggcgcgcgtttcttcctgcagcatttaccgtctgatctagaaggcgagatcgccgatctcggctgcggcaacggggtgattggcctgcaggcgctggcgcaaaatccaaacgccagcgtgatgttcaccgatgagtcgcacatggcggtggcttccagccggttgaacgtcgagcgcaatctgccggacgatatcgcacgctgtgaatttatggtcaacaactcgctctccggcattgagcctgaccgctttacggcgattctgtgtaatccgccgttccatcagcaacacgctattaccgaccatatcgcctggcagatgtttaacgatgcccgccgcagcctgaaatacggcggcgagctgtacgtcgtcggcaaccgccacctcgattacttccgtaagctgaagcgcgcgtttggtaattgcacgacgattgcgacgaacaataagtttgtcattttgaaagcaacgaaggtgcgtaagcagcgctgattcttgtcgcggtttccccctgctcgcggctgtcgccttagccgggctagcgtgcgggattatcgtggtagcccggggaaggcgcatcgcgccgcccccgggacagggctaaatcgccagcgccagtttagtgccctgggcaatcgcccgacgcgcatccagctccgccgccacgtcgcaaccgccgatgagatgcaccgttttccccgccgcgcgcagcggatccgccagctcgcggcgcggctcctgaccggcgcagatcaccacctgatcgaccgccagcagttggcgctcgccgccgatagtgacatgtaacccttcatcatcgatcttttcatagctgaccgccgggatcattttcaccccgcgcgccagcagcgtcgcgcggtggatccagccggtggttttgccgagcccttcgcccggtttgctggctttgcgctgcagcatcacaatctgtcgcgggcttttactcaactgcgggccttcagcactcagccctcccgccgtttgcaggctggtatcgataccccattcgcggcagaactcgccgatatcctggctggtggccgcgcccgactggcttaaaaacatcgcggtgtcgaagccgatgccgccgcagccgataatcgccaccttcgcgccaaccggcgctttatcgcgcaagacatcaaggtagctcagcacttttggatgatcgatcccgtcgatcgccggcaggcgcggggcgataccggtggcgaggatcgtctcatcgaacgccagcagatcgtctgtcgtgacgcgggtgttcaggcgtagatcgacaccatgaagatcgagcatggtgcggtagtaacgcagcgtctcgtgaaactcctctttgccggggatctgtttggcgatattaaactgaccgccgatctccgggagcgcatcaaacaacgtgacgtgatgaccgcgggcggcagcgtttacggcgaaggccagaccggcaggcccggcgccgaccaccgccagccgtttaggcgcgttggccggcaggaccggcatcagggtttcatgacacgcgcgcgggttgaccagacaggaggtgactttgccgacgaagatacgatcgagacacgcctgattgcagccgatgcaggtgttgatctgatcggcgcgatcgtcctgcgcttttgatataaattcggcgtcggcaaggaacgggcgggccatcgataccatatcggcatcgccgcgggcgagaatatcctccgcgacctgcggatcgttaatgcggttggtggtgatcaacgggatcgacaccgcgcccttcagcttgcgggtgacccagctgaaagctccgcgcggtaccggcgtggcgatggtcggaatgcgcgcttcgtgccagccaatcccggtgttgatgatggtcgctcccgccgcttcaatcgctttggccagttcggtgacttccgccagcgtgctgccgtcgttgaccagatcgagcatcgacagacggtaaatgataatgaaatcgtggccggcgcgctggcgcaccgccttaaccacctctacggcgaaacgcatgcgcctggcataatcgccgccccattggtcgtcgcgctggttagtgcgcgcggcgagaaattcgttaatcagatagccctcagagcccatcacctcgacgccgtcatagcccgcttcgcgcgccagctgggcgcagtgggcaaaatcatcgatcagcgtcaggatctcatcgtggctcagttcatggggggtaaaacggttgatcggcgcctgtagcgccgagggggccaccagcgcgggctggtagctgtaacggccggtgtgcaggatctgcagagcgattttgccgccttcctgatgtaccgcatcggtaatatggcgatgatgcgccagatggctggcgtcgttgagtaccgcgccgccggccatggtgacgccagagggcgccggagcgatgccgccggtgacgatcagcgccacgccgtgacgggcgcgctcggcgtaaaaggccgccagccgctgcgcgccgtccggcagctcttccagcccggtgtgcattgagcccatcaacacgcggtttttgagcgttgtgaagcccagctcaagcggggcgaaaagcgacggatagcggctcatagtggcttccaatgtaaaattattgttatgtggtcggatgagttactaatttagccatcgtggagaaaaagggaaaaggggagtgcggtgattgtgatgggattcaaagaacggcgaagcgttgccccacaccccggccctctcccaaagggagaggggggaaaggcggagcggcaccggtagttagggtgagggggaagacacaacgcgctggcggcgctccagacccggcgcctgccacatcgacgttgtcagtccgctatcgacaaggccaagctgatcggcgtacaccgtctgccatttgctcatcatctcctgatacagctcgcgatgctgcggatttggggtgaaatcgcggtgccagctcactaaccgctctccggtgctggccatatcgtcatacatcccggcgccggttccggcggcgatggcgcagcccagagcggtggcttcgcggaccaccggcacccgcaccggcaggccggtgacgtcgctgaggatctggctccacagcgcgcctttagagccgccgccggcaaacaccaggctgtcgaatgtcaccccggagaactgcgagatctgcgcgaggttgcaggcggagacaatcgccgcgttctcctccagcgcgcggaacagggtcgctttattgcacttttccggatcgatggagaggttaataaacgacggcgcggcgtggtaccactgcttaaagtgcatagcgtcggaaaaaataggcatcacgccgtgggaaccggcggggacgcggctggccatctcctccagcagcgaataggcatcgacgccgagccgctcggcaatcagtttttcttcagcgcagaaggcgtcgcgaaaccagcgcatggtcaggccggtaaagaagctgatcgattccgcctgcgccatgccgggaatcacgtgaggattaacgcgaatattcatctgcggatcggtgcgcacctgcggcaggttgaccacctgctgccagaaagtgccgccgagtaccgcggtttgcccggcgcgcaccaccccaaggcccaggcagccgagctggacgtcgccgccgcccatcaccaccggcgtcccggcgcgcaggccgctctgctgcgccgccgcttcggtgacggcgcccagcagggtaccggtctctttgaccggcgacagcatatcggcgcgcagcccggccatatccagcagcgccggacgccagtcgcggctgaacagatcgagcatgccggtggtgccggcgtttgacgggtcgaccgacagctcgccggaaagcttcgccgccagccagtcgctgatcatggtgatggttgccgctttgcggtagatatcggggcggtggtgcgccagccacagcaggcgcggcatggcgctgagcgccagggtttgtcccgagacctcgtatacctcggattcgaagcgatagtcgtggatctccttaagctccgccacttcgcggctggcgcgggcatcgacgttggcgcaggcccagatggcctcgccgttgcggtcatagagaacgatgccttcgcgcatcgaacagcaggcgacggactgaatatcggcggcagagagccgggcggcgtcgagcgcctggcgaatgcactggcaggccagctgccagttggtggtaaggtcgaactccatcgagccggggacgttatcaacgctcaggtgtttccattcggcctggcctaccgccagctggcggccattaagatcgaaaataaccgcccgaatgctgccggtcccggcatctaacgctaacaggtaactcatgacatgcgcctcgctgttgtcgcgcggcgccaggccgtcaggaggccagggtaagcaccgcgcgtgctgttgtctcttccgttaccaggccattaatgcgcttgccaatcagagcggcataaatcgcctgcgctttttcttctcccccggcgacgccaacgatggtcggcagctgcgctagctcatcaagggtcacgccgagcagttcccgatggatctccagtccttctaccggcctgccgtcggcctgcaggaaataacctaaaatgtcgccgaccgcgcctttgcgggcgtacatcagctgttcgccctcgctgatatagccggagcgtaaaatggtggcgtcgcgccgctgatcgatggcgccgatgccaaccaccgccgcgtccgccgccgtcgccgcgaggatcacgtcgcgcacgctcgactcgcggcgcaggatctcggcgacctccgccgaagagacccgcagcggcgccgggataatgctgacgctgcaggcggcatccagctggccaataccggtcatatacgggccgacgccgccggagagggtcaccagccgcacctgctgcgagccgataaagccgctgagatgctgcaggcagctcatggtggcttcgccgaagccgaccgccagcagctgtcccggctgcagaatgcccatcagcgactgcgccgcgccgatccccagccgggtattcatcggcggggtgttgagcgccggcagtacgcgggcaatcttgaggccaaaacgctgctggagttcactttccagcgccagacagccctcatagcgcgagttgatctgcacgcggatcaccccggactggcggcctttctccagcaggcgggaaatcttcagccgcggcagccccaaacgctcgccgatgtcattttgcgtcaggccgtcgtggtagtagcaccacgccacccgcgccaccagctcttcctcggctaacgccagcccggcgtagcggttctcttccgtaatgcgtttttcgctcataaattgaactcttataaaaatttagatcatatgttcgctattgcgcggccggaaagtgtgagccgactggcaaaacggatctttcatcgctggcccattttttcctgaggatctaaagcgccaaactgtgatcttcgcacggttgtaaatatagttcaccgtctacgcttttgaacattattaaatttaaaaatcatttgttcaaacgaggcgcgacgatgaagccactgcttgaagctcgccagatccgcaaacagttctccggcgttgccgtgctgaagggcatcgactttacgctatgcgcgggccaggtgcatgccctgatgggaggcaatggcgcgggtaaatcgacgctgatgaagatcatcgccggcgtcgaaaccccggatagcggtgagctgacgatcggcgaccgcgcgtttgcgcgcctcagcccggcgctggcccaccagctgggcatttatctggtgccgcaggagccgatgctgtttcccaacctcagcgtgcgcgagaacattctctttcgtttgccgaagcgggcggataccgccgcgcgactgcaggaaaaactgcagcagctgaactgccagatcaacctcgatgccagcgccagcacgctcgaggtagccgatcaacagatggtcgagatcctgcgcggcctgatgcgcgaagcgcggatcctgatccttgatgaacccaccgcctctttaaccccgggcgaaacggagaggttgtttagccagatccgcgcgttacaggcgctggacgtggggatcgtgtttatctcgcacaaactgcccgaaatccgccagcttgccagccatatttcggtgatgcgcgacggggcggtagtgctgagcggcgagaccgcaacttaccgcgatgagcaactgattagcgctatgacgccggccagccgcgaccatacgctgagcgacacgcaaaagctgtggctggcgctgccgggcaaccgccgcacccaggcgcaggattttcccgtgctgcgggtggaggatcttaccggagaaggctttatcgatctcaatctggagatccgcgccggggagatcgtcggcctcgccgggctggtgggatccgggcgcaccgaatttgccgaaaccttatacggcctgcgtccaccgcgcgccgggctgatctggctggagaatcgcgagattagcaatgacagcacccgcgcccggctggccagcgggctggtctatctgccggaagaccgccaggtctcggggctgtttcttgatgcgccggtgcgctggaacacggtgatgttcaatcagccgtcgtggtggcagcaggggaaacgggaggcggcggtggttgagcgctatcaccgggcgctggggatcaagctggccgatggcgatcagccggtgcgcactctctctggcggtaaccagcagaaggtgctgctggcgcgctgtctggaggccaacccgctgctgctaattgtcgatgagccgacgcgcggcgtggatgtctccgcccgcgccgatatctatcagctgctgaaaagcgtcgccgcgcaaaatgtggcagtgctgatgatctcctccgatctggatgagttcatcggcctggccgaccgggtgctggtgatgcatcagggccgctacagcggcgagctggcgcggcaggcggtgaccgtcgatcgcatgatgaccctggccttcggagggcaggcatgaaaacgttactcaagaatcgcgaactgagcgccttctttgccatcgtggcgctctttgttgtgctggtggcgctcaatccggcctatttcagcctgcagaccctggcgatgattttcgccagctcgcaaatcctctgcctgctggcattgggcgcgaccctggtgatgctgacccgcaatattgacgtgtcggtaggctccaccgttgggctatgcgccatcgccgtcggcgtggcgctgaacaacggctacgggttggcgacggccatcgccttcgcgctggctattggcgcgctggccggggcgtttaacggcctgctggtggtggggctgcgcattccggcgatcgtcgcgacgctcggcacgctggggttgtatcgcggggtaatgctgctgtggaccggcgggaaatggatcgagggcttgccagacagcctgaaatcgctctcggagcctgcgtttatcggcgtgtcgccgctgggctggctggtgctggcgctgctgctggcgggcggctggctgctgtcgcgcaccgcctttggtcgtgatttttacgccgttggcgataacctcgccgccgcgcgccagctgggcgtggcggtcaaccgcacgcggatgctggcctttaccctcaacggtatgctggcggcctgcgccgggatcgtcttcgccgcgcagattggttttgtgcctaatcagaccggcagcggcctggagatgaaagccatcgccgcctgcgtactgggcgggatctcgctgcttggcggtaccggtacgctgctcggcgcgtttctcggcgcctttttccttacccaaatcgacaccgtactggtgctgttccgccttcccgcctggtggaatgactttatcgccggcctggtgctgctcggcgtgctggtgctcgatggccgcctgcgccaggcgctggcccgccatcagcgggcgctaaagtacagccgtttccagccgggtaacaaaggggggaaacaggttgcccgctttcccgaacgcaaaagcaaagaggtggcttaaatgaagctgaagcttaactgggaaagcgcgctgctggcgttgctgatcgtggagatcctgctgttcggcgcgctgaatccgcgcatgctggatctcaatatgctgctctttagcaccagcgactttatctgcatcggcatcgtcgcgctgccgctgacgctggtgatcatcagcggcgggatcgatatttcgctgggctcgaccatcggcctgtgcgccatcgccctcggggtgatgacccaggcgggctggccgctgtggctcgcggtatcgctgacgttgctcttgggactgctgtgcgggttattcaacgccgcgctgatccactacaccggcatcagcccgctggtgatcacgcttggtacgctgtatctgtacggcggcggcgcgctgctgctttccgggatggccggcgcgaccggttacgaggggattggcggttttcccgatagcttcaccgccttcgccaatttaaccctcgccggactgccgctgccgctggtgctgttcgcgattatcacctctttcttctggctgctgacccatcgcgggcgctttggccgccacctctttttactcgggcaaaacccgcgcgccgcgcgctatgccgcgctgtcggtgaacggcatcccgtacgtgctgtatggcctggttggcgtcgcctcggcggtcgcggcgctggtgatggtttcctacttcggctcggcacgttcggatttaggccgcgacctgctgatgccggcgctgaccgcggcggtgctcggcggggccaatatttacggcggctcgggatcgatactgggttccgcgctggcggcattgctggtggggtatctgcaacagggtttacagatggtcggcatccccaaccaggtgtcgagcgcgctgtcaggggcgctgttggttgtggtggtgatggggcgttcgctgagcctgcaccgtgaatgggtgcgcgcgacctggcggcgtcttttctcgcataaaacaatcggagcataaaatgaaattaaaactgatcgtgctggcgctggcgatgagcgtggttaccgcgaaggcggcggaccgcatcgcctttattcctaagctggtcggcgtcggcttctttaccagcggcggcaacggcgcgaaagaggcggggaaagcgctgggcgtggatgtcacctatgacggcccaaccgagcccagcgtctccggccaggtgcagcttatcaacaacttcgtcaaccagggctacaacgcgattatcgtttccgctgtctcgccggacggcctgtgtccggcgctgaagcgggcgatgcagcgcggggggaaagtcctgacctgggattccgataccaggccggagtgccgcagcatctatatcaatcagggcacgccgcagcagcttggcggcctgctggtcgagatggcggaaaagcaggtgacgaagcctactgccaaggtagcgtttttctactccagcccgacggtgaccgaccagaaccagtgggtgaaggaagccaaagccaaaatcgaaaaagaacatccgcagtggcaaatcgtcaccacccagtttggctataacgatgccaccaaatcgctacaaaccgccgaggggatcttaaaagcctatccggatctcgacgccattatcgcgccggatgccaatgcgctgccggcggcggcgcaggcggcagagaacctcaagcgtcagggcgtggcgattgtcggctttagtacgccgaacgtgatgcgtccgtacgttgagcgcggcacggtgaaagcgttcggcctgtgggatgtggttcagcagggcaaaattgcggttaacgtcgccgatcgattactgaaaaagggcgatcttaacgtaggcgacagcgttgaggtgaaagatatcggttcgctgaaggtcgaaccgaacagcgtgcagggctatcagtatgaggcgaagggcaacggtatcgtgctgctgccggagcgcgtggtgttcagcaaagagaacatcaacaactacgacttctgacggaggatgagatggcagatttagacgatatcaaagaggggaaggacttcggcatcgaccgcccgcagcagaatacgctgtataccctgaaaggctgcggctcgctggattggggcatgcagtcgcggctggcgcgcatttttaatccgcacagcaaccgcacggtgatgctggccttcgatcacggctacttccaggggccaacgaccgggcttgagcgtatcgacctgtcgattgcgccgctgtttgccgacaccgacgtgctgatgtgcacccgcggcgtactgcgcagccaggtaccggcggccaccaataagccggtggtgctccgcgcctccggcggcaattcgattttgagcgaactctccaacgaatgcgtggcggtggcgatggaagacgcgctgcggctcaacgtatgcgcggtggcggcgcaggtctatatcggcagcgaatacgaacatcagtcgatcaataacatcatcaaactggtggacgccggcaatcgctacggtatgccggtcctggcggttaccggcgtcggcaaagagatgacccgcgatgcgcgctacttctcgctggccagccggattgccgccgaaatgggggcgcagtttgtgaagacctatttcgttgaggaaggctttgaaaaagtgaccgccagctgtccggtgccgatcgttatcgccggcggtaaaaaactgccggagcatgaggcgctggagatgtgctggcgggcgatcgaccagggggcttccggggtggatatggggcgcaatatcttccagtccagcgccccgcgcgcgatgctgaaggcggtgaaaaaggtggtgcatgagaatctgaacgcgcgcgaagcgtatcagttctggcaggaagaaaaacagggagagctgaaatgaacgtcacgctggtggaaatcaatattaaacccgagcgggtggatgagtttctcgaggtgtttcgcgccaaccacgagggcgcgctacaggagccaggcaacctgcgctttgatgtcctgcaggatcctgaggtgaaaacccgcttttttatctacgaagcctataaagacgatgaggcggtgctggcgcataagaagacgccgcactatttagcctgcgtcgaaaagctggaggagatgatgtcgcagccgcggcagaagcgcagctttatcggcctgttaccgcaggtgtgagggttatccttcaccctctcagagggagagggtgaaggacactttattacgcttcttcaaccgaaacgcgcagggccgccagcgccttgcgcgccgccttcagcacctgttcgcactgctcaagggtgagcgtcagcggtggttcaatgcggatcgtcttggcgttgtttaacgtcccggcgaccagcacccgctgtctgaacatctcgctggcaaagtcgtagccaatctcgttatcaacaaactcgatagccatcagcatgcctttcccgcgcacttcattcaccaggtccggatactcctgcgccagcaggcggaaaccgtccagcagcatatcgcctttctgcgccgcctgcgccggcaggttttgcgtcagcagcacgttgatcgtcgccagcgccgccgcacaggccaacgggttgccgccgaaggtggtggtgtgcaggaacgggttatcgaagagcaccgagaagacctcttccgtcgccaccgtcgcgccgatcggcatcacaccgccgccgagcgctttcgccagacacagaatgtccggctggacgttctcatgctcgcaggcgaacatcttgccggtgcggcccatgccggtctgcacttcgtcgaggatcagcaatgcgccaaactcgtcgcacagtttacgcaccgccggcaaataccccgttggcgggaggatcacgcccccttcgccctgaatcggctcgaggatcaccgccgcgacgtcgtcgccggttttcttgcactcgctcagcatggtgcgcatggcgttgatatcgccgaacggcacgtggcggaagcccggcagcagcggcataaagggtttgcggaaggtcgacttggcggtggccgacagcgcgcccagcgatttaccgtggaaggcgccgctggtggcgatgaaggtaaatttaccgcgcggcgactgataggctttcgccagcttgatggccgcctctaccgattcggtaccgctgttgcagaagaaactgtactttagtttcccgggcgttaaggctgccagggttttcgccagcatcgcgcgtagcgggtccagcagctcctgactgtgaagcggttgtttcgcgagttgattctcgacggcggataccacaactggattacggtgccctacattgaagatgccaaacccaccaaggcagtcgataaactcctgtccctgggtgtcgacaagcgtatttaaccctcccgcttgccactctacggctccgtaatccccgccggctgtgaccgattttcgatactctaaaaaccccggattcacatgctctttaaagtattccctgacctcctggttaagtgctttcatttcctcatgatcaagcgtgcgcttttcaatgagattcagtgcgtgtgcgctgcaggccagagccgatgcgctggaaggtaacctgttcaaaatgtgctcctggggcggacgtatcacacgatactggattaagtattgcagggattacgccagttcggcagaagcggtgaaaatcgggataaatgcaaagtaaaagacgaattgtgtaaaatttaatctcattgcgccactattggcacgttttattcctgagctgacgagattttctgcctggcggcaatagacggggcgatccgccgtggtgcgagctgccccagcgcggggcagccggtgatgaaaaaagaggcttagtcgagctgagagatctccatcgccgcccggtcaataatgccgatgatctgcttgagctgggcggcactgctggcctgctggttcactttcaggtcgaggaccgctttgaagttttccagcgcgcgcttcatctgcggatcgcggcgcagctcgcagccgaccatccgcgcctgcaggcgctcctggatatgggccaggtgctcctggttctcggcgtgcagctgttttccttcctcgctgataaggattttcttgcgtccgttgtcgtcttccacgctgataaggccctggtcctggagcagatccagcgtcggatagatcacccccgggctggggctgtagttcccctgggtaagcgtttcgatctctttgatcagctcatagccatggctggcgctgcggctgaggatatccagaatgatcagccgcagttcgccgtggccaaagaaacgctggcgacgtccgccgccgcggcggccatggtcgccgtgttcgctagggtcaccgtggcgcccgcgtggcccacgcccttcttcatgatgatgtcgcatggttacctcctgctgttttgatatatctaatttatatctaaaaaatgaatgttcgcaatgctggttgctatttattttttaatatattgatatatataaaattattttctgactgtggattttgatgcggtttgttttgactatatcaaaaaaagacttgcattcttattagttggcaatcattatcatttgcatcaagtttagatatatctatttaccgttcacgaaggcaatcgatgatgacaaaaaccaaagcagacaagtacccgcagcgtgtccgcaatgagctgcgtttccgtgagctgacggtgctgcgcgtggagcgcgcaggcgcggcgttccagcgtatcgtgctgggaggcgaggcgctggaaggcttcgcctctcacggctttgacgaccataccaagctttttttccccgagccgggcgcggcatttaccccgccgcaggtgaccgaggaggggattgactggggggaaggcgtgcggcctgccacccgcgactatacgccgctgtacgatgccgaacgtcacgagctggcttacgatttctatatccacgatggcggtatcgccagccgttgggcgctggaagcaaaagtgggcgataagctggtgatcggcggcccgcgtggctcgctggtggtgccggaagattatgcctggcagctgtatgtttgcgatgagtccggcatgccggcgctgcgccgtcgtctgctgggattacgccagctgccggcgaggccgcaggtgacggccatcgttactatcgccgatgcgtcgtataaagattatctggcggatctcgacggctttaacatcgagtgggtggtgggccacaatccggccttcgtcgccgagcgtctggcgcaggtgaaggtgccggcggaggattattttatctggctgaccggcgaaggcgcggtggtgaaatcgctgctggcgcgctttgaagacgagagcatcgatcagcagctggtgcgttcccaggcgtactggcacagcaagtaaaaagccatcgtggtaaaacccggatagcggcgcgtcgcgccttatccgggctaccggcggtgccgttttttgtcgggtggcggcttacgccttacccgacctgctattcggcggtgttacatcgccccgataagcgcagcgccaccggggaaggcttagcgttccgccagcgccttaaacaccatcgccaccgcgtgggcgccggggtccatgttgccgagcaggctatcgctgttgagataggacgcgcgtccggcgccggctttgcttgactggcaggtgcgatccgccccggcctgcgccgcggcgaaagcggcctgcagattctccggttcggccagcagcgccgccagggccggctgcagagcgtcgatcatcgtccggtctccctcatcggcgccgccgtaaaacttcatctgttccagaccggcgttcagcgcctcggccacgctggcgccttgccccagcttctgcccggcagcggtgaagaagatagacatcaataccccgctggagccgcccatcaccaccgtcaggcgttcgccgatcagcgcgaagagcgttggcagatcgttcaggggcagctgctgacgctcgagccgctcggcaatctcgcgcgccccggcggcgaaggtggagccggtatcgccgtcgcctactttggcatccagcgcgttgagatgttcttcaagatcgatgagggcgccggtcacctgcgccacgtaatcgcccacctgtgggttggccgagggcgtaaaatccacccgggcgctgtcgagggtggacggcacgacgttgatagtccgcggctgcaccggcttctgccagctggcggtttccacatccgaaagcagcgctttctcaatactctcctccagcacgatggtggtcagcgagaagcctttcatatccagcgccgtcaccagcgaggccgggcctattaaccagtcaatgcgcgcctgcagcggggtgttggccagctcgcgggtcagaatcgccatctcagccaccgacacgccgccgaggttattgagcatcaccgccaggcggccggtttccggtagggcggcggtcagtttttccaccatcaggttaacgatctccgcactgttttgcgtggcgatcgtcgaggcgcccggctcaccgtggatgcccattcccagctcggcgtgaccggcctgatggcgcggcgcgctggcggcttcctgcggcaggtggcagctggccagcgccaccccgatgctggcggtatggctggcggcgtattgcgcttcgcgcaggacggtggcgaggttgaagccgcgctcggcgaaatagccagccactttatgcaccagaatggtcccggcgatgccgcgcggctgtttgttatccggcagcgaaatatcgtcgccgacgatcagcatctccacgttgtagccgagtcggcgcgctttctccgccgccagaccgaagttaagccgatcgccggtgtagtttttgacgatcagcaggcagcccgcctcgccggtcactgcctgaatggcggtgagcaccgcgtcgacgcccggcgaggcgaacagatcgccgcagaccgcggcggtcagcatgcctttaccaataaagccgacgtgcgccgggtcatggccggcgccgccgccggagatcaccgccacgttgtttttattcagatcgcgacggaccaccacccggatcgccgggtcgctctccagacgggcggggttattccacgggctggcgataatggtaccctcaatcacatcgttgacgaggctggcgcgctggttaaaaaagaattgagacatagtggttcctgaagagtaagcgaaaactcaccctccggaggcaggcccccggagcggtaacggtcaacgtgaattttagtcacggataaggcgctggtggcgcatatcgagcacgatagtctcgccgggctgcacgctgttcagcgcctcgccctgctggctcagccaggcgatccccgccgcgcgggcgataatcgcgccgtgagcctgttcgctgccatcgcgcaggcacaggcctttaacgaagctggcatccagctgtaagacggttgagggataaatgttgtcggcaataataattgttggctcgccgggcgtcggcactctctcctgaacgccctgcagatggcgcagggtgcgctgcaaaatatcttcgatatcgatatagcgcgcctgcaggtaggggtcatccagctggcgatactgctggctgagctccatcaacacctgatgccatgcccattccgccgtgcattgttcggtgagcagacgatcgttggcggcatcaaacagatcgtcatcgtcgagcagggtgtggtgcccggcgaagatcgccgcgatatcggcgtgaaatttattttccgccagctcggtcagggcgataagatccgccagcgtctggtcaatggcctggcgcaggcgctgctgctcgcgggcggcatcggcggcagccgggcggagcggctggatcagggccagcggatagcgcagggcagcgccttcgacgcgctcgggcgttgccggagccgctgccggttgcgccgcaggcgattcaccgaagttatcggcggccagcgcctgaaacgccgccagcgccgcgtcggcatccggaccgcgggccagcaggcgcagcttatcgttgcggcggacctgcaatagcgcgatttggttgaggctgtccggtttgacgcacttcccgtttttctccagcagcagatcggcgttaaagcccgccagcgcggcgaccagcttcgacgccggacgcacgtgcaggccgttatgattgttaataatgactgacaccgattttgtgtcgccgtcgtcggcaagcatcggcgccggcgcggcgtcagaagttggcgaaggtaaacccagctgaacccgcttggcctccagggcgctcatggcgtcggcgatcaccttgtcgatccccgcgccggaggcagcgctgacggtggccgccagcgccccttccaccagcggcgcggcgcacagtcgcaccttcgcggcaatcgccggatcgagcagatcgagggcggtttcggcgctgagcaacgcgctgccgatatccatcatcaccagcacgtgatcggtatcggccacggattcgatcgcctccatgactttaagcggatcggtgccgatcgggctgtcgggatcgtcgatcccggcggcgatcgccagtttgcagccatcgttgattaacatctgccgggccagttctccgacaccttcgcccagccgggcgctatgagaaacaataaccaggtttaccatcgcaatttccttactctttggcggcggcggccagcatctgaaccataaacagcaccgaggtcgcgccgggatcctgatgtccgatgctgcgctcgccgagatagctggcgcggcctttacgcgcctgcatagtgatggtggcgtgggccgcacgctcggccacttcgcaggcggcatccagcgcggcggcgatcgacaggtgctgctcgctggactggcgcagggagtccaccaccggcagccagacgtcgcacatggttttatcccctggctccgctttgccgcggttgacgacaccgtccgcaccttcgcggatcatcaggtacagctcgtcgagcgtcaggctctggtgggcctgggtcacctgcgcggcgcgaatgaagaaggtgccgaacagcgggccgctggcaccgccgacgttggagagcagcgtcatgccggtgtttttgaggataaagccaatatctttatcggcaatcgacggcagcttttcgaccactttactgaaaccgcggtgcatattgagaccgtggtcggcgtcgccaatctctttatcgaggccggtgagaaaatcgctctctttggtgaaaatatcgccgcagcggtacagccagtcgacgatttgcgttctgttcagtgacatgtcgtgctccttagtttccccagttcagcgccggggtgtgaaccggggcgtcccatagcgtcagcgtctcgtcatccactttcagcagagtgatggagaagcccgccatatccagcgaagtacagtagctgccgatgaggttgcgttcgatgatgatgccggacgcttcgcagcgctgggcgaggcggttatacacgccatacagttcggaaagcggagtggcgccgaggttattaaccagcgcgataacccggtcgccgttttgcagcgcggttttgctctgctgcacttcctgccacgcgcccttgacggtatcccactggcgcagcgtgcggctgtaagcgccgttttccagcagggtatcgaacatctcatcgacggtttggtccagcgagctgaagcggcggcggtcgatgcccggctcgccgtgaatgccgacgccgaactccatctcgtcatctttcagcgtaaaggagggttgcccggcagccggtacggtgcaggcgccgagggcgataccaatcgagtggccgagattgttcaggcggcggcccagttcagcgcaggcttccagcgagtcgccgcgctcggcggcggcgccgaccagtttttcgatcagtacggtgttggcaacgccgcgacgaccggcggtatagaggctgtctttcactgccacgtcgtcgtcgaccaccacggtggtgactttaatgccgctctcatgcagcagctcggtggcggtctcaaaattcaggatgtcgccggtatagtttttgataattagcaagacgccttcgccgccgtcaatttgcatcgcgcattcaaacattttgtccggcgtcggcgaggtgaagatttcccccggacaggcgccggagagcatgccctggccgatatagccgcagtgcatcggttcatgtccgctgccgccgccggagagcagggccaccttgccagccaccggcgcgtcggtgcgggtcacatacagcgggtcctgatgcagggtcagctgcggatgggctttagccagcccctgtaattgttcattcagtacatcttcaacacggttaatcagctttttcattattcagtgctccgttggagaaggttcgatgccgcctctctgctggcggaggcggtcatcgcgtaggggtatcgtctgacggtggagcgtgcctggcgatatgatgattctggctgagcggacgaaaaaaagaatgccccgacgatcgggtttcattacgaaacattgcctccttgttttgtttctttatggaacgtttttgctgaggatatggtgaaaatgcgagctggcgcgctttttttcttctgccataagcggcggtcaggatagccggcgaagcgggtgggaaaaaattttttgctgattttctgccgactgcgggagaaaaggcggtcaaacacggaggattgtaagggcattatgcggcaaaggagcggatcgggatcgcaatcctgacagagattagggttttttgttccaatatggaacgtaaaaaattaacctgtgtttcatatcagaacaaaaaggcgaaagatttttttgttccctgccggccctacagtgatcgcactgctccggtacgctccgttcaggccgcgcttcactggccggcgcggataacgccagggctcatcatgtctacatgcgcacttatttgagggtgaaaggaatgctaaaagttattcaatctccagccaaatatcttcagggtcctgatgctgctgttctgttcggtcaatatgccaaaaacctggcggagagcttcttcgtcatcgccgacgatttcgtaatgaagctggcgggagagaaagtggtgaatggcctgcagagccacgatattcgctgccatgcggaacggtttaacggcgaatgcagccatgcggaaatcaaccgtctgatggcgattttgcaaaaacagggctgccgcggcgtggtcgggatcggcggtggtaaaaccctcgataccgcgaaggcgatcggttactaccagaagctgccggtggtggtgatcccgaccatcgcctcgaccgatgcgccaaccagcgcgctgtcggtgatctacaccgaagcgggcgagtttgaagagtatctgatctatccgaaaaacccggatatggtggtgatggacacggcgattatcgccaaagcgccggtacgcctgctggtctccggcatgggcgatgcgctctccacctggttcgaggccaaagcttgctacgatgcgcgcgccaccagcatggccggaggacagtccaccgaggcggcgttgagcctcgcccgcctgtgctatgatacgctgctggcggagggcgaaaaggcccgtctggcggcgcaggccggggtagtgaccgaagcgctggagcgcatcatcgaggcgaacacttatctcagcggcattggctttgaaagcagtggcctggccgctgcccatgcaatccacaacggtttcaccattcttgaagagtgccaccatctgtatcacggtgagaaagtggccttcggtaccctggcgcagctggtgctgcagaacagcccgatggacgagattgaaacggtgctgggcttctgccagcgcgtcggcctgccggtgacgctcgcgcagatgggcgtcaaagaggggatcgacgagaaaatcgccgcggtggcgaaagccacctgcgcggaaggggaaaccatccataatatgccgtttgcggtgaccccggagagcgtccatgccgctatcctcaccgccgatctgttaggccagcagtggctggcgcgttaattcgcggtggctaaaccgctggcccaggtcagcggtttttctttctcccctccggcagtcgctgccggaggggttctctatggtacaacgcggaaaaggatatgactgttcagactcaggataccgggaaggcggtctcttccgtcatcgcccagtcatggcaccgctgcagcaagtttatgcagcgcgaaacctggcaaacgccgcaccaggcccagggcctgaccttcgactccatctgtcggcgtaaaaccgcgctgctgaccatcggccaggcggcgctggaagacgcctgggagtttatggacggccgcccctgcgcgctgtttattcttgatgagtctgcctgcatcctcagccgttgcggcgagccgcaaaccctggcccagctggctgccctgggatttcgcgacggcagctactgcgcggagagcattatcggcacctgcgcgctgtcgctggccgcgatgcagggccagccgatcaacaccgccggcgatcggcattttaagcaggcgctacagccatggagtttttgctcgacgccggtgtttgataaccacgggcggctgttcggctctatctcgctttgctgtctggtcgagcaccagtccagcgccgacctctccctgacgctggccatcgcccgcgaggtgggtaactccctgcttaccgacagcctgctggcggaatccaaccgccacctcaatcagatgtacggcctgctggagagcatggacgatggggtgatggcgtggaacgaacagggcgtgctgcagtttctcaatgttcaggcggcgagactgctgcatcttgatgttcaggccagccaggggaaaaatatcgccgatctggtgaccctcccggcgctgctgcgccgcgccatcaaacacgcccgcggcctgaatcacgtcgaagtcacctttgaaagtcagcatcagtttgtcgacgcggtgatcaccttaaaaccgattgtcgaggcgcaaggcaacagttttattctgctgctgcacccggtggagcagatgcggcagctgatgaccagccagctcggtaaagtcagccacacctttgaacagatgtctgccgacgatccggaaacccgacgcctgatccactttggccgccaggcggcgcgcggtggcttcccggtgctgctgtgcggtgaagagggggttgggaaagagctgctgagccaggctatccacaatgaaagcgaacgggcgggcggcccctatatcgccgtcaactgccagctatatgccgacagcgtgctgggccaggactttatgggcagcgcccctaccgacgatgaaaatggtcgcctgagccgccttgagctggccaacggcggcaccctgtttctggaaaagatcgagtatctggcgccggagctgcagtcggctctgctgcaggtgattaagcagggcgtgctcacccgcctcgacgcccggcgcctgatcccggtggatgtgaaggtgattgccaccaccaccgtcgatctggccaatctggtggaacagaaccgctttagccgccagctgtactatgcgcttcactcctttgagatcgtcatcccgccgctgcgcgcccgacgcaacagtattccgtcgctggtgcataaccggttgaagagcctggagaagcgtttctcttcgcgactgaaagtggacgatgacgcgctggcgcagctggtggcctactcgtggccggggaatgattttgagctcaatagcgtcattgagaatatcgccatcagcagcgacaacggccacattcgcctgagtaatctgccggaatatctcttttccgagcggccgggcggggatagcgcgtcatcgctgctgccggccagcctgacttttagcgccatcgaaaaggaagctattattcacgccgcccgggtgaccagcgggcgggtgcaggagatgtcgcagctgctcaatattggccgcaccaccctgtggcgcaaaatgaagcagtacgatattgacgccagccagttcaagcgcaagcatcaggcctagtctcctcgatacgcgccatggagaacagggcatccgacaggcgattgctgtagcgtttgagcgcgtcgcgcagcggatgcgcgcggtccatggccgtcagcaggcgttcgagccgacgggactgggtgcgcgccacgtgcagctgggcagaggcgagattcctccccgggatcacgaactgttttaacgggccgctctcggccatattgcggtcgataagccgctccagggcggtgatctcctcttcgccgatcgtctggctcaggcgggtcaggccccgcgcatcgctggccagttcagcccccagcacgaacagcgtctgctgaatatggtgcaggctttcccgcagcccggcgtcgcgggtcgtggcgtagcagacgcccagctgggatatcagttcatcgacggtaccgtaggcctcgacgcgaatatggtctttctcgatgcggctgccgccgtacagggcggtggtgcctttatccccggtgcgggtatagatacgatacattcagtttctctcacttaacggcaggactttaaccagctgcccggcgttggcgccgagcgtacgcagatgatcgtcgctatcggtgacgtgtccggtagccaacggcgcgtccgccggcagctgggcatgagtgagggctatctcgccggacgcgctgagcccgatacccacccgcaggggcgagcttctggccgccagggcgcccagcgcagcggcgtcaccgcctccgtcataggttatagtctggcaggggaccccctgctcctccagcccccagcacagctcattgatggcgccggcgtggtgcccgcgcggatcgtaaaacaggcgtacgcctggcggtgaaagcgacatgacggtcccctcgttaacactcagaatgcctggcggaaaatcgcggcaatctcctgctcgttgcctttacgcgggttcgagaacgcattgccgtctttcagagccatctccgccatgtaggggaagtcggcctcttttacccccagatcgcgcagatgctgcggaataccgatatccatcgacagacgcgtgatagcggcgatggctttttccgccgcgtcgagggtggacagtccggtgatattttcgcccatcagttcagcgatatcggcgaatttctccgggttggcgatcaggttgtagcgggccacatgcggcagcaggacagcgttggccacgccgtgcggcatgtcgtacaggccgcccagctggtgcgccatggcgtgcacgtagccgaggttggcgttattgaaagccatcccggccagcagagaggcataggccatgttttcccgcgcctgcagattgctgccgagggccacggcctggcgcaggttgcgggcgatgaggcggatcgcctgcatggcggcggcgtccgtcaccgggttagcgtctttggagagataggcctctacggcgtgggtcagggcatccatcccggtcgccgcggtcagggcggccggtttaccgatcatcagcagcggatcgttgatagagaccgacggcaggttgcgccagctgacgatcacaaacttcactttggtttcggtgttggtcaggacgcagtggcgggtgacctcgctggcggtgccggcggtggtattgaccgcgacgataggcggcagcgggttggtcagggtctcgattccggcatactggtacagatcgccctcatgggtggcggcgatgccgatgcctttgccgcaatcgtgcgggctgccgccgcccacggtgacgatgatgtcgcactgttcgcggcgaaacacggcgaggccgtcgcgcacgttggtgtctttcgggttcggctcgacgccgtcaaagatcgccacctcgatcccggcctcccgcagataatgcagggttttgtccaccgcgccatctttaattgcccgcaggcctttgtcggtgaccagcagggcttttttcccccccagcagctggcagcgttcgccgactacagaaatggcgttggggccaaaaaagttaacgtttggcaccagataatcaaacatacgatagctcataatataccttctcgcttcaggttataatgcggaaaaacaatccagggcgcactgggctaataattgatcctgctcgaccgtaccgccgctaacgccgacggcgccaattacctgctcattaaaaataactggcaggccgccgccaaaaataataattcgctgttggttggttagctgcagaccgtacagagattgtcctggctggaccgctgacgtaatttcatgggtaccttgcttcaggctgcaggcgctccaggctttattcagggaaatatcgcagctggagacgaaggcctcgtccatccgctggataagcagcgtgttgcctccgcggtcaactacggaaaacaccaccgccacgttgatctcagtggcttttttttccaccgccgccgccatttgctgggcggcggccagggtgattgtctgaacttgttggctcttgttcatcattctctcccgcaccagggtaacgctggcgcgaatagtcagtagggggcgatagtaaaaaactattaccattcggttggcttgctttattttagtcagcgttattttgtcgcccgccatgatttagtcaatagggttaaaatagcgtcggcaaaacgtaattaagggcgttttttattaattgatttatatcattgcgggcgatcacattttttatttttgccggcggagtaaagtttcatagtgaaactgtcggtagatttcgtgtgccaaattgaaacgaaattaaatttatttttttcaccactggctcatttaaagttccgctattgccggtaatggccgggcggcaacgacgctggcccggcgtattcgctaccgtctgcggatttcaccttttgagccgatgaacaatgaaaagatcaaaacgatttgcagtactggcccagcgccccgtcaatcaggacgggctgattggcgagtggcctgaagaggggctgatcgccatggacagcccctttgacccggtctcttcagtaaaagtggacaacggtctgatcgtcgaactggacggcaaacgccgggaccagtttgacatgatcgaccggtttatcgccgattacgcgatcaacgttgagcgcacagagcaggcaatgcgcctggaggcggtggaaatagcccgtatgctggtggatattcacgtcagccgggaggagatcattgccatcactaccgccatcacgccggccaaagcggtcgaggtgatggcgcagatgaacgtggtggagatgatgatggcgctgcagaagatgcgtgcccgccggaccccctccaaccagtgccacgtcaccaatctcaaagataatccggtgcagattgccgctgacgccgccgaggccgggatccgcggcttctcagaacaggagaccacggtcggtatcgcgcgctacgcgccgtttaacgccctggcgctgttggtcggttcgcagtgcggccgccccggcgtgttgacgcagtgctcggtggaagaggccaccgagctggagctgggcatgcgtggcttaaccagctacgccgagacggtgtcggtctacggcacggaagcggtatttaccgacggcgatgatacgccgtggtcaaaggcgttcctcgcctcggcctacgcctcccgcgggttgaaaatgcgctacacctccggcaccggatccgaagcgctgatgggctattcggagagcaagtcgatgctctacctcgaatcgcgctgcatcttcattaccaaaggcgccggggttcaggggctgcaaaacggcgcggtgagctgtatcggcatgaccggcgctgtgccgtcgggcattcgggcggtgctggcggaaaacctgatcgcctctatgctcgacctcgaagtggcgtccgccaacgaccagactttctcccactcggatattcgccgcaccgcgcgcaccctgatgcagatgctgccgggcaccgactttattttctccggctacagcgcggtgccgaactacgacaacatgttcgccggctcgaacttcgatgcggaagattttgatgattacaacatcctgcagcgtgacctgatggttgacggcggcctgcgtccggtgaccgaggcggaaaccattgccattcgccagaaagcggcgcgggcgatccaggcggttttccgcgagctggggctgccgccaatcgccgacgaggaggtggaggccgccacctacgcgcacggcagcaacgagatgccgccgcgtaacgtggtggaggatctgagtgcggtggaagagatgatgaagcgcaacatcaccggcctcgatattgtcggcgcgctgagccgcagcggctttgaggatatcgccagcaatattctcaatatgctgcgccagcgggtcaccggcgattacctgcagacctcggccattctcgatcggcagttcgaggtggtgagtgcggtcaacgacatcaatgactatcaggggccgggcaccggctatcgcatctctgccgaacgctgggcggagatcaaaaatattccgggcgtggttcagcccgacaccattgaataaggcggtattcctgtgcaacagacaacccaaattcagccctcttttaccctgaaaacccgcgagggcggggtagcttctgccgatgaacgcgccgatgaagtggtgatcggcgtcggccctgccttcgataaacaccagcatcacactctgatcgatatgccccatggcgcgatcctcaaagagctgattgccggggtggaagaagaggggcttcacgcccgggtggtgcgcattctgcgcacgtccgacgtctcctttatggcctgggatgcggccaacctgagcggctcggggatcggcatcggtatccagtcgaaggggaccacggtcatccatcagcgcgatctgctgccgctcagcaacctggagctgttctcccaggcgccgctgctgacgctggagacctaccggcagattggcaaaaacgccgcgcgctatgcgcgcaaagagtcaccttcgccggtgccggtggtgaacgatcagatggtgcggccgaaatttatggccaaagccgcgctatttcatatcaaagagaccaaacatgtggtgcaggacgccgagcccgtcaccctgcacgtcgacttagtaagggagtgaccatgagcgagaaaaccatgcgcgtgcaggattatccgttagccacccgctgcccggagcatatcctgacgcctaccggtaaaccattgaccgatattaccctcgagaaggtgctctctggcgaggtgggcccgcaggatgtgcggatctcccgccagacccttgagtaccaggcgcagattgccgagcagatgcagcgccatgcggtggcgcgcaatttccgccgcgcggcggagcttatcgccattcctgacgagcgcattctggctatctataacgcgctgcgcccgttccgctcctcgcaggcggagctgctggcgatcgccgacgagctggagcacacctggcatgcgacagtgaatgccgcctttgtccgggagtcggcggaagtgtatcagcagcggcataagctgcgtaaaggaagctaagcggaggtcagcatgccgttaatagccgggattgatatcggcaacgccaccaccgaggtggcgctggcgtccgatgacccgcaggcgagggcgtttgttgccagcgggatcgtcgcgacgacgggcatgaaagggacgcgggacaatatcgccgggaccctcgccgcgctggagcaggccctggcgaaaacaccgtggtcgatgagcgatgtctctcgcatctatcttaacgaagccgcgccggtgattggcgatgtggcgatggagaccatcaccgagaccattatcaccgaatcgaccatgatcggtcataacccgcagacgccgggcggggtgggcgttggcgtggggacgactatcgccctcgggcggctggcgacgctgccggcggcgcagtatgccgaggggtggatcgtactgattgacgacgccgtcgatttccttgacgccgtgtggtggctcaatgaggcgctcgaccgggggatcaacgtggtggcggcgatcctcaaaaaggacgacggcgtgctggtgaacaaccgcctgcgtaaaaccctgccggtggtagatgaagtgacgctgctggagcaggtccccgagggggtgatggcggcggtggaagtggccgcgccgggccaggtggtgcggatcctgtcgaatccctacgggatcgccaccttcttcgggctaagcccggaagagacccaggccatcgtccccatcgcccgcgccctgattggcaaccgttccgcggtggtgctcaagaccccgcagggggacgtgcagtcgcgggtgatcccggcgggcaacctctacattagcggcgaaaagcgccgcggagaggccgatgtcgccgagggcgcggaagccatcatgcaggcgatgagcgcctgcgctccggtacgcgacatccgcggcgaaccgggcactcacgccggcggcatgcttgagcgggtgcgcaaggtaatggcgtccctgaccggccatgagatgagcgcgatatacatccaggatctgctggcggtggatacgtttattccgcgcaaggtgcagggcgggatggccggcgagtgcgccatggaaaatgccgtcgggatggcggcgatggtgaaagcggatcgtctgcaaatgcaggtcatcgcccgcgaactgagcgcccgactgcagaccgaggtggtggtgggcggcgtggaggccaacatggccatcgccggggcgttaaccactcccggctgtgcggcgccgctggcgatcctcgacctcggcgccggctcgacggatgcggcgatcgtcaacgcggaggggcagataacggcggtccatctcgccggggcggggaatatggtcagcctgttgattaaaaccgagctgggcctcgaggatctttcgctggcggaagcgataaaaaaatacccgctggccaaagtggaaagcctgttcagtattcgtcacgagaatggcgcggtggagttctttcgggaagccctcagcccggcggtgttcgccaaagtggtgtacatcaaggagggcgaactggtgccgatcgataacgccagcccgctggaaaaaattcgtctcgtgcgccggcaggcgaaagagaaagtgtttgtcaccaactgcctgcgcgcgctgcgccaggtctcacccggcggttccattcgcgatatcgcctttgtggtgctggtgggcggctcatcgctggactttgagatcccgcagcttatcacggaagccttgtcgcactatggcgtggtcgccgggcagggcaatattcggggaacagaagggccgcgcaatgcggtcgccaccgggctgctactggccggtcaggcgaattaaacgggcgctcgcgccagcctctctctttaacgtgctatttcaggatgccgataatgaaccagacttctaccttaaccgggcagtgcgtggccgagtttcttggcaccggattgctcattttcttcggcgcgggctgcgtcgctgcgctgcgggtcgccggggccagctttggtcagtgggagatcagtattatctggggccttggcgtcgccatggccatctacctgacggccggtgtctccggcgcgcaccttaatccggcggtgaccattgccctgtggctgttcgcctgttttgaacgccgcaaggtgctgccgtttattgttgcccagacggccggggccttctgcgccgccgcgctggtgtatgggctctatcgccagctgtttctcgatcttgaacagagtcagcatatcgtgcgcggcactgccgccagtcttaacctggccggggtcttttccacgtacccgcatccacatatcacttttatacaagcgtttgccgtggagaccaccatcacggcaatcctgatggcgatgatcatggccctgaccgacgacggcaacggaattccgcgcgggccgctggcgccgttgctgattggcttgctgatcgccgtgatcggcgcgtcgatggggccgctaaccggctttgcgctgaatccggcgcgcgacttcggcccaaaactgtttaccagtctggccgggtggggctcgatcgcttttaccggtggcctagcgatcccttactttctggtgccgctgctggcgccggtggtgggggcgattatcggggcgtttttgtatcgcaagcttatcggccgccatctgccgtgcgaatgcggtatcgatgagtaaagcgggacccgccgcagcgcggcgggtttccccggcctgatgccgggggggttattttttgatgaccgcgctgagatcgccaagtttagcggcggggttcttgtggcactcctgcagcattttcggtaccgaaacggtctcgacttcatgccagtcaacatagtcgccgccgctaaagtcggtgttgcgattcactacccagaaggccaccggggtcatgctttttgggttcatatccataaattcctgacaggtcatattctgcggcgtggtttcctcaaccgcgaacgccgggctggtcatcagacagaatgtggtagccgccacggtcaatacgagtgctttaggtaaattcattttcttctccagtgtcaaaatagggcttaagcctcagcgtgcttcattttattgcgcaggaccaacaagccgatggcgctaaatatcatttcaacgccgataaaggcggtaataaataaccagctttgctgcgggttcatggccagccacaggcaggcgataagtaaatccaacaggccgataaaaatattccagccagcgccgctttgtttgcgggtttgacatccgttaacgatgcgggaaataccgccgagaacaaataaaaagccaaataaaatggccagactgctcataccgttgaggggattgacgacaaagctcaggccgagcacgatccaggcgatggcgaagatcagcgccaccaggcgtgatttccagtgctgctggcggaagacaatcaggctgtacagcgaatagaagccgcagatcatcaataacatgccggttactgtggcgagataccagccggcgaccaacggccaggccagacaacaggctccgcagataaacagcaataccgccatcaggcaggcatgccgtttatatcgaatgaagacgcgtgggctaaacgcatttaaggtgtaatggctaaacataaacataattgctccgcagatcccggttggcggcctgacgctgaataaaaagcgtgagggtttattcagcgggccaaaagaaaggtctgaggaaaatagtaggccgcgcgatcggcaggcgtaaataagagcgccgaggccactttatacgcctggtctgacagctgtcagaccaggcccgcaatattacttccgggctctgattctcaatgcccgcgatattttttaagctggctgcgtttggtgatgcttaccgattttaatcaggagtcaacgatgaaaaaagtcattctggcgagcctgctggcaaccatgatgagtacctctccggtatgggcaacagatagcgcgacggcagcgccagccgcgccagccgcggcagccacgacgcaggtacagaaagaagccgccgatgtgctgcaggtggcggtgcagggcgcgaatgcgatgcgcgacatccagttcgcccgtctggcgctgttccatggccagccggatagcgccaaaaaactgacagacgacgccgccgcgctgctggccgccgatgatgccagctgggcgaagtttgtgaaaactgatgctaaagccaaaatgatcgccgatcgctatgtgatcattaacgcctctatcgccctgtctgaagactatgtggccacgccggaaaaagagagcgctatccaatccgccaacgaaaagctggcgaaaggcgatcagaaaggggctatcgataccctgcgcctggccggtattggggtgattgagaaccagtatctgatgccgcttaaccagacccgtaaggcggtagcgcaggcgcaagaactgctgaaagccggtaaatattacgaagcgaatctggtgctgaagggcgctgaagagggcattgtggtggatagcgagatgctggtggcaggcaactgatacttgttccaccctgagagagcgcagaggaaaaaactgacaaggatgtccccttaacgctcgggcaggcggactgcccgagcggaacggctagcggccgatcagggcgtcgatttcgccatcgatctcgcgcatgacgccggtgatgcgctgtaccacctccagacagcttgccggcgtcagcgaatcaggccgctttgcctcaaaaggggcgcacagttgttgtagcgcagtaatccccagaatttgtgctgaaccgtgcaggcggtgcagcgcccgcagaaaggtctgcggctcatgccgggcgattgcctgtccggcagcctgtaaatccgcggccgacgcatcgcggaacgtctccagcatctcattcatcagcgcctggtctccccccgtattctcgctcagcacgctgagcttcaggtgccgggtagcgtgaggtgatgcgcggcccaccgctaaacggctgagctcatgactcagcgtctggaccgacaccggcttaaacagacacatattcatgccgctggccagacacgcctcccgcgactgcggcagcgcgctggcagtcacgccccaaattaccaggcccggatagcgacggcgtagcgaggccgccagcgccaggccatctttcttcggcatattgagctccgttatcagcagatcgtaatgtttgctggcgagcttattctctgcctcttcaccgtcgcaggcttcatcgacgctatagccgatagtgctgagctggcgcttgagcagtagccggttggtggggtgatcgtccgctatcagtatcgccagcccgggtagagcctgcggtctggcgggcgacgcctgcggcgcgtggatcgcgcagcggctcgccttgaccggcagcgtgatggtgaaagtggtccccacgcccggacggctgaccatctccaggcgaccctgcatcagcgcaaccagctctttgcaaatgaccagccccagtccggagccggtctgctgtcgtccctggcgcgcctgggcatagcggtggaagagggtggcctgctctgcttcactgatcccgcagccgctgtcgctaaccatgagggccagctctccctgtgtctcattcgccggcgtcagccggcaggagacctgaattgcgccttcgacggtaaacttcagcgcattgccgatgagattattgaggatttgccgtagcgcctgcgggtcgacccacagcatggtaccttcctgcagcgcgttatggtagtgcagatcgatgcccttttgctgcgccagcgcgtcgaaggtatgacactgctgcgacactaactgtgcgacatcgctccactgcggggtaacctggtattttcccgattcaatcttgtcgatatcaagaatattgccgataagtcccagcagggtttgcgccgtcgaccccgccagctcgatcgcctctttacgctggccgacgttcagctcaggtttcgccagcagctccagaaagccgacgatggcgctcaccggcgtgcgcagctcgtggctcatgctggccagaaagcggctcttggcttttgtcgcctgaatcgctttgtctttttcgcgctccagcgcacaggagagggcctccttctgcgccagctcctcctcgagccgctgctgggagtctttacgtttgcgcacttcccgacacagggagagtccccagccgaggctgatggcgatcagcaccagcgcaaaggcgatcagctggtaaaactggcggctgtactggctccagttctctatttgctgactggagattttcgaccacttctcggtcatctgcagaatatcccgtggcggaataacctgcagcgctttgttaagaatggcggccagcaccggttcatcgcgcgggatggccagccgaatggccgcgacggggagtccatcaatgcgggtgtagtgcagaccctgtggatagtagtggtcgatcatatagcgggcggaaagctccgaggctacggcggcatccacttcgccttcctctaccatcttcatggcgacgccaacgttatccgtttccacccagttaatcagcggaaaacgcgctttcagatcatgggcggcgataggcccgaccggcagggcgatccgcgccgagcgcgtcagcagatgctggtcgggggcgctgccgcgggcgaccagcacaaaggccacgttaatgagcggatcgctgagggtgacgtaggcctgcggctgtggggtcagggtggcggcgggcatgatcgcccagtcctctttttccatgcgctttgccagagcctgacggttgcgcaccagaatggggtcaaactgcaggccggtctggagtgagacaatattcagcatatcggccatgatgccgcgcagttcatcctcgttatccaccagggtaaatggcggaaaataggggttcaccagcaggcggacgcgacgatgcttctgcagccagcgctgctcttcggggctaaaggtaagcggggtattgagaaacgacagatcgccacggttgagccagttttgcatgatccgcatcgcggtgtcgctgtcgacggcatggataaaacggtcgaagagttgatgcagctctggccgatcgtcacgggtgacaaagcggttgtgttgctcctgctgacgaaaatagtgcgcgataaccagcgattgcgagaaatatttcgagatgcagtggccagtggtgatgttgttgccgataaaatactgattctcgccgctgaccaccgaggcgagagcctgatagtcgctatcataaagggtgattttggcgttgggaaacgcctgctgaataatatcgaaaaaagcgcaatcgcgggtgcaggccagcgtgacgcggcggtcagtggtcagcggcggcagaggggatttcagcgaggtgaccagcgtcggccaggttttaagcagcggcgcggattgatccaggcccggggcgagcgcatcccggtgcgccacctgagtgagcagggtatccacctgacggtcggccagggcggtgagcgcctgctgctcggtgtcatactggcggataatcaccttcagtccgaggctgtgcgccatcagcgccagatagtcggcgttaatgccctgataacttttctcgtcgccgtcatagacgatgggcgtcctctcgggaagccaggtcccgacggtcagcgtaggctgcgccgccagccatgctttctccttaccgctaagcgggatatcgatcgccgcgatatgagaatggctcttcagctccagctgtttcatggcatacgcggcaggcgagaggctcagcgccagcccgacaacgacggataaaataagacgaaccgccatgccatcaccctattttattgcgttgcgcaaagtcatatagctcaagcagggtgctgcagcctaatttatccatcagacggaccttataggtacttaccgttttattgctgatattcattttgctgccgatggtggtgtagtcgacgccgctgagaatatagcggaacaccttcatctcctgcgttgacagcgtatccagccggtcctgatcggtgatgccgtgggtgcagaagcgttccagtgaaaaggggaaatagctgtagccattattggctgcgtcgattgcggcgaggatattattcattccctcttttttactcacaaaaccatttgctccgcagtcggcgctgcgtttgccgtagaacagttcattcttagcggaaatgatgatgattgttccctggtagcggcgtttgcgcagctgctccagcacctcgataccgctgagctccggaatatcgacgtcgacgatgagcaggtcaggctgcatgctttccgcggtctgcacggcatgagcgccgctgtcgagctctgccgcgacggtaataccgttgctgtcgagaaggttgcgaatggcgatacgtgccaatggatgatcgtcaatgattatcgcattcatgggggcgtaaatcctgatatgaaaaaagaagggcgatgcctggtgcaggtgcggcgggggttatttttatcgatgccgttataaggcgtaattgtaacacaaatcgttttgggccagggaaatattgtggagctgagccagacgaatatatttgcatagctggatgacagctgtaggaacgggcgttcacttgcttcagcgcggtctgctgttaaaaaaaatgcaaacgattaatctgctcttattaaggtgagttctcggaatatcgtccggcgacaactggcaggtaaaataataacaatggcgaaagaaaaacgcgccttctggcgaaaatgggtttggaaacatctgatggcaggaataacagtactggcaatgagtagcgccgcggtgggaaaggatgtcgaccccgatgaggcgcggacccgagatatgatgcgctgtcaggattatctgcaactggatccgcgcgcctggacgccgatggtgatttggctgatgaacgatcctttttcactggagccgccggagtggaccgacttccatgaagccgagctggtgctgacgccgatcctcaccgaaatctgccgtcaggagccggatgtctggctcacctcgctgcgggaacggctcaattcttatcagcaggtgcggtcgctgaactaagcgaccgcggtaaaacggcagaaaaagtgactaaatgcgcagttagcggccttcttctgcgcaaaggctcagcagcggcccgctttttgcgacagggcgtcgcaggttttgctcgctagcgtcgggttggcgccggcgcagatggcatccgagacggtgctaccgccgcccagcgggatcagcccgtaaagcttcggctcggcggccttcgtcacatagcagcgatggctggttttgccgatggtgaccacaaagttggttttcacatcctgctgcctcgcatcggaaattgtcacctgcgaagcatcgacattaaaagcaaacgcggcggcctctttcatttcattttccgtcgccatgggtggtttagctacgcaacccattaataacagtgccagacaggtactgattgatatatcccgtattttcatcatttcatcctttttgtaagtcagcgggttatatataagagcggggggaggaacgcgttgatttcgaacagctggcgcaggctatggttattattcggaaattgacctgtgttgttacatttatcgtgagtagtatgaattccagcattgcaggaatgaaagatattttaagactacgttgcgtagttagacagaagtcaacaggagtgcggcggttatgggctgcccgagatgctctgagcaatattttgctaaggcagaatgctatctgttttagcgtaagcgcaaattttccctgcgttataacggactttttatcctcttaatgggatagcgacaacacgctaagccatgcgcgctgctcagcggtttgtggtgccattttaaaattcaggaacaaaaaagccactctttcgagtggcttaattatatgattttaaatctaaaatttggtggcccctgttgggtttgaaccaacgaccaagcgattatgagtcgcctgctctaaccactgagctaaggggccgtggcgagggattataaagtaactggcgattgcaatccagcgtaaagcgcgcagctgctgtttttataaacaatgcattttcaatcctttataatcatgttttagccatacagccggagaaaacatgattagcgatatccttgcgccgggcctgcgcgttgtcttttgcggtatcaacccggggaagtcctccgcccataccggctttcattttgcccatcctggcaatcgcttctggaaggtcatccatcaggccgggttcaccgatcggcagctcaggccggaagaggagctgcagctgctggatacgcgctgcggcatcaccatgctggtagagcgtccgacggtgcaggccagcgaggtcgccttgcaggagctgcgcagcggcggccgtgagctggtgcggaagattgaggagtatcagccgcaggcgctggcggtgctcggcaagcaggccttcgagctggcctttaaccagcgcggcgcgaagtgggggaaacaggctatgaccatcgggacgacccaggtgtgggtgctgcctaatcccagcggcttaaaccgggcgacgctcgataagctggtggcggcctatcgtgaactggacgatgccctggcaacccgcggccagtagcggagagaggcgactttcccgggatggccacctgaacgccataaaaaaagctccccgcagggagctttttaacaggctgtagacgatgccccgcgacgattaatcgtcgaggaagctacgcagcacttcagaacgactcgggtggcgcagtttacgcagcgccttcgcttcgatctgacggatacgttcgcgggtaacgtcgaactgtttacccacttcttccagcgtgtggtcggtgttcatgtcgataccgaaacgcatacgcagcactttcgcttcacgagcggtgaggccggccagcacgtcatgcgttgccgcgcgcaggctctcggtggtcgcagaatccagcggcagctcgagggtggtatcctcgatgaaatcccccagatgcgaatcttcatcgtcgccgatcggcgtttccatggagataggctctttggcgatcttcagcactttacggattttgtcttccggcatcagcatacgctcagccagctcttccggggtcggttcacggcccatctcctgcagcatctgacgggagatacggttgagcttgttaatggtctcaatcatatgcaccggaatacggatggtgcgcgcctggtccgcgatagagcgggtgatggcctgacggatccaccaggtggcgtaggtcgagaacttgtagccgcgacggtattcgaacttatcgaccgctttcatcagaccgatgttgccttcctgaatcaggtcgaggaactgcagaccgcggttggtgtatttcttggcgatagagataaccagacgcaggttcgcttcaaccatctctttcttcgcacgacgggctttcgcttcgccgatggacatgcgacggttgatatctttaacctgctcgatggtcaggccggtctcttcttcaatctgctgcagcttctgcaggccgcgctgcacatcttctttcacttccagcagcttctcagaccacggcttgttcattgccaccgcggcgttgaaccaggtttcgctggtttcgttgccggtgaacagggtgatgaagtttttcttcggcattttgcactgctcaacgcacagcttcatgatgatacgttcctgagtacgaacgcgatccatcatgctgcgcatgctgttgaccaggtaatcgaactgcttcggcaccaggcggaactgcttgaagacttcagacagcttcaggatctcttcctgggcggcggcatggctacgacctttggctttgatggtgtcgcgcgtcagctcgtactgggtacgcagctcggcgaatttctcacgggccagctctgggtcgatgctgttgtcgtcatcgctgttgtcgtcggcgtcttcatcttcgtcttcgtcttcgtcgtcatccatctcttcctgagacagctcggagccaacgtgggtggcggttggcgccatatcttcttcggcgttcggatcgacgaaaccggtgatcagatcggacagacgggcttcttccgcttcaacgcggtcgtactgctcaagcaggtaggtgatcgcttccggatattcggcaacggagcactgcacctgattgatgccgtcttcgatgcgtttggcgatgtcaatttcgccttcacgggtcagtagctctacggtacccatttcacgcatgtacatacgcaccgggtcggtcgtgcgcccgatttcggattccacgctggagagcacctgcgcggcggcttcggcagcatcttcatccgcggtgttttcggcaagcatcagatcatcggcatccggtgcttcttccatcacctgaatacccatgtcgttgatcatttggatgatgtcttcgatctgatcggaatcgacgatatcttccggcagatggtcattgacctcggcataggtcagatagccttgctccttaccacgttggacaagaagcttcagctgtgactgcgggttttgctccataagacggtatccacacttaattcgtttgattggtgtcggcagacgggctgtcgacatttaaagcgagggcgtacttatattattgccgctgcgcctctgcgcggctgtcgggggcttcccgatcgatactcggcacttaagccgttaaatacttttccttcacgttgttctgcgttttcttactgctttgatacaacgtgaaggatattgtctgtcatttattttttcgccagctcctggctgatggtccagagctcccggcgttcttcactgcttaaaccgtgtgtgcgatcgcgagctatcaactcttcctgtcgcagttccagcagtgaatcaaacatatggttgagcgagtcggtgaaggtttgttcagcgatgtctttatctgctatatcgtcccacatcgacagtttttcaagggttgccgcctcttttgtgccgcgatattgctctaaaagttgcccggttgtcagaccaggctgcgccagacagctcttcaccagttcgctgaacaggctcagtcccggcattttgcgcgagtccagtccctccagcggcgggactaacggcgccagatccgggttttgcaccagcagtcctatcagtatacgcatggtcgtgcgttttagctgcggtgcgggacgcggcgcgccattttccgcctgttttggcattaatcgttcaagctgcgcgtcatctaaaatgcccagcttattgcccaactcctgacgcaaatagatgcgcagcgtttcgcccgggacctgggttatcagcggcagcgccagcgtgctcagctgcgcgcgcccgtccggagtactcagatcgacctgcggcagcaggctgttaaacaagaacgtggagagcggctgagcctgctccatccgcgcctcgaacgccgctttgccctctttacgcaccagcgtatccgggtcttcgccgtcaggcagaaacataaagcgtagctggcgaccatcggtcatgtacggcagcgccgtctccagcgcgcgccaggcggcatcgcggccggcccggtcgccgtcgtagcagcagatgacgttattcgtcacccggaacagcagctggatatggtcggccgtggtcgaggtacccagcgaggccacggcataattaatgtcgtactgcgccagcgccacgacgtccatatacccttcgacaaccagcaaacgcggtggttcggggttatcctgctgcgcttcatacaggccatacagctggcggcctttatggaatatgtcggtttccggggagttcagatacttcggcagggcatcgcccagcacccgtccgccaaacccaatcacccggcctcgcttatcgcggatggggaacatcacccgttcgcggaagcggtcgtaactgcgtccctgatcgttggtgaccaacatgccggcatcaataagcgactggcggttttcctgattgccgccaaaccgttttaaaacgttatcccaacctgggggagcatagccgatggcaaagcgcgtaatcacctcgctgcttaacccccgtttcgccaggtactggcgcgcaggatcggcggcgggctgcatcagagactgttgataaaacgcattcagaccatccagtaactggtagaggttctgccgttgatggcgctctatctggctgggtccgttgcctgcttcataaggcacttcgaggttgtgcatggcggccagctcttcgaccgtttccacgaactcgagcttgtcgtagttcatcaggaagtcgatagcattgccgtgcgccccgcagccgaagcagtggtaaaactgtttttcaccgttgacggtgaaagagggggttttttcgttatggaacggacagcacgcgtgaaaatttttgccctgctttttcagctttacccgcgcatcgatcagatcgacgatgtcggttctggcaagcagatcgctaataaatacacgtggaattcgtccagccataagccccgttatttctgatgactataaacgaaaataagccgcgcattcctttcggaagcacggccttacaactacaactcggtctgaattgagagcgtcgctctcaacagattagtacagacgagtacggcgtgcgttttcgcgagccagtttcttcgcgtgacgtttcactgcagaagctttagcgcgcttacgttcggtagtcggtttttcatagaactcacgacgacgaacttccgccagaacacctgctttttcgcaggaacgcttgaagcgacgcagagctacgtcgaacggctcgttttcacgtactttaattaccggcatgtgcctctcacctttgattaattcggtttgccgctggccgcaatgccagcttatttcaaaatggtgcggaattttactgcaactactgctgctttgtaaagcaccggcgccttttttgaaagggacttttataagggtgaggagtatacacgaagagagcaccaggggtgagcaaagttttacatcgccgttcattggacctacactgcgcggtattgaagcgaggtaaaacaactcatgcgtgtactgggcattgaaacatcctgcgatgaaaccggcatcgcgatttatgacgaccagcaaggtctgttagccaaccaattgtatagtcaggtgaaactgcatgcggattacggcggcgtggtgccggagctggcatcgcgcgaccacgtgcgcaaaacggtgccgctgatccaggcggcgctgaaagaagccggtctgacggcgaaagatatcgacgccgtcgcctatacggtgggtccaggcctggtcggcgcgctgctggtcggggcggccgttggccggtcgctagccttcgcctggaacgtgccggcgatcccggtacaccatatggaagggcatctgctggcgccgatgctggaagataatccgccggcgttcccgttcgtcgcgctgctggtttccggcggccacacccagttgattagcgtcgccggtattggtcagtatgaactgttgggcgagtcgattgacgatgcggcgggcgaagcctttgataagacggcgaagctgctgggactggattatcccggcgggccgatgctgtcgaaaatggcgtcccagggcaccgaaggccgctttgtcttcccgcggccgatgaccgaccgtccggggctggacttcagcttctccggcctgaagaccttcgccgccaacaccattcgcagcaacggcgacgatgagcaaacccgcgccgacatcgcccgggcgtttgaggatgcggtcgtcgatacgctgatgattaaatgtcgccgcgcgctggagcaaaccggctttaagcgtctggtgatggcgggaggcgtgagcgccaaccgtaccctgcgggcgaagctggcggagatgatgcaaaaacgcggcggcgaggtgttctacgcccgccctgagttctgtactgacaacggcgcgatgatcgcctacgccggcatggtgcgtctgcaaaccggcgccaaagccgagctcggcgtgacggttcgcccgcgctggccgctggccgagctgcctgccgcctaacgcatcctgaaacaggccgacgtcacgtcggcctgccttcctgactactccatacttttacacagcgagcagatggctccctgatgcttgtgcgagtgcatcacgtccgggcgctcgtactcttcctcacagctaacgcattgatacgcggtggtggaggcgttccccgccgcgtcatagcgcggctcggcgatgccgtcatccacctgcttaatatagtagcgtccgcgggtaaggagccccatcagcggggtcatgacaaaggcaacgaccagcgcaatcagcggcgagaacggcgccagcgtcgcccctaacagaccgaagaaggcgcagatcgacagcccggcggccagaccaaaggagaccacgcccaccgggttaacgttgtagatcatgccgcgacgatactccggctgcgccggcgccagcttgagcaagcctttattaaaggtgatgtcggtcgccaccaccacgacccaggcgatagcgaagttggagtaaaagccgaggatccacgacagggcgctgaacatatcgccctccatcagcgccagggcaatcgccaggttgaccaccacaaaaataatccgtcccggatagcgtttggtggtgcgggtccaggcgctggtccacgccagcgagccggagtaggcattggtgacgttaattttgatctgcgagatcaccaccagcaccaccgccagcgtcagggccagccagccgggcaccaggttatcgaagacgctgacgaactgctgcaccggttcggtattgtgcaccgccgggaaacgggtcaacagatagaagccgaggaaggcgccgatgatctgtttgatcgcccctaacaccacccagcccgggccggcggaaaagaccgccagccaccagcttttacgattctccgcggtcttaggcggcataaagcgcaggtaatcaatttgctcgccaatctgcatgatcagcgacaggcataccccggcgccgagcatgatggcggtaatatccaccgtcgacgcgctgtttttaccggcgaaatgcaggaagccgtccaccagctgcggatctttgacaatcagccacaccaccggcaccaccatcagcaccagccacagtggcgtggtccacacctgcaggcgggtcagggctttcatgccatagaccaccagcgggagcaccatcagggtggcgatcagatatcccatccacagcgggatcccgaggcccaccagcaggccctgggccatgatcgagccttcgagggcgaagaagataaaggtgaagccggcaaaaataatgctggtgatcaccgagccgaaatagccgaagccggcgctgcgggtgatcaggtcaaggtcaatgttgtagcgcgcggcggtgatcgccagcggaatgccggtgaggaagatcaccagcgccgccaccaggatcgaatagatggcgttgctggtgccccaggccataccgatgctggcgccgatggaaaagtcggccagataggcaatgccgcccagcgcggtgaccgcgacgacgcccggaccccagcggcgaaagctcagcggggcgtaacgtaaggtgtaatcttctaaggtttcccgggagccggaagtccgcgttgtcgcgggtaattcagggttaagatccagtgatgacatagtcattccttaatggttaggcatgacttgaattagcaaaccttatgccatattgcagggcaggcgtggcgcggaggtggaggcaggatgatataaagagagagcagaggctgcaccatccggacgcgcttgcgcccggctggtgcaacaggcctatttgccaagcatgcctttgtcttcgaggaaggcgataatggtgctcaggccgtcgccctgcttcagattggtgaaggtccatgggcgatcgccgcgcatacgctgggtatcgctcgccatcacctccagcgacgcgcccacatagggggcaaggtcggttttattgatcaccagaaaatcggatttggtgatccccggtccgcctttgcgcgggatcttctccccttcggccacatcgatgacgtagatggtcagatccgccagctccgggctgaaggtggcgctcaggttatcgccgccgctttccacgaagataaggtcgaggttaccgaacttttcactcagcgcttccacggcggcgaggttcattgaggcatcttcgcggatcgccgtatgcgggcagccgccggtttccacaccgacgatgcgttcaggcgccagcgcgcccgcttcggtgaggatgcgctgatcttctttggtatagatgtcgttagtgaccaccgccagctgccaggtatcgcgcatcgctttacacagcgcttccagcagagcggttttaccggagccgaccgggccgccgacgccgacgcgcagcgggtgtttataagagttcatggcttctcctaggaacggaataatcgagagtattgggtttcatgccgggcagaggcgatggcggcgagcggggtggccgatccgatatcgccgtccggcgcggccagcgcgcggggcatctcggccgcgtagtggtcacaaagacgtaaaatcagctgctgggcggcctgctggccgaaggggaccagcttgacgccggccatcacggcgctctcaatccagctgtagcccaggctgagggccatctcgggcagggcgatacgccagcgcacgccgagccaggccatcccggcgagctggctttgctggcacagggagcgccacggcggcggacagtccggctgccagtcgctcagcagacgggcaaacgccgcgccgcggttgcgctcttcctcccgcagttcacgagtttcccggcaggccagcagataggcggtccagcgctgggccgcagcgatatcgccttgttcgcaggcgcggtacaggcgggcgaacagcggcaggtcaacggtaaaaaagccttccgtcatctggcgtcgctgccagcgctcgaaggccgcgacgtccggcacccagccggcttccacagcccactccagcccctgggaccagctgtaaccccctaccggcaggttgctgctggccagctgcatcagccgcaggcgttgttccgctgtcgacatgctagtggctgtgagcgtggtggtcatgatgagcatgatgatgaccgtggctctcgctggcgtaagcgccggcttccggctcgaacggcagctggccaaaggtcaccgtcaggccgaactggcgcagcatatcgtccagcacgtgatcgtgatggtagcgcagctcgcccggcataatctgcagcggcacgtgacggttgccgaggtggtagcaggccttcgccagcataaacggatcgtcgcagcgcactaccgacaccccttcatcagcggcaatcacctgcacaaactcggtgccttcttcgttgctgagcacatcgccgccgcgcagcagcaggccgcggggcagcagcaggccggcttcccggccatcgttgagggtgaccttaacccggcttttgacgcgaacatcaatcggcagcgtaacgctggcggtcacggcggcggggatctccagacgttgagttaaataaagcatccgctctccttaaaacagaaaatatcgttgcgccatcggcagaacgtctgccggctcgctggtgataagttcgccatccacccgcacctcataggtctgggcgtcgacggtgatgttaggctgcaggctgttgtgcaccatgtcggctttctgcaccgtacggcagcctttcaccacggcgatcgcgctgcgcaggttcagccgcccggcaacgccattggctgccgccgcctgcgacaggaaggtgaggcggcagtgatggcgggcgctgcccagcgcgccaaacatcgggcggtagtgcaccggctgcggggtcggaatagaggcattgatatcgcccatcggcgcgatggcgatcatgccgcctttgatcacggtggccggtttcacgccgaagaaggctggtgaccagaccacgaggtcagccagcttacccacctcaatggatccgacttcgtgtgcgatgccgtgggtcagcgccgggttgatggtgtatttggcgatgtagcgcttcacgcggaagttgtcgttatccccggtctcctccgccagcgcgccgcgctgcaccttcatgcgatgcgccacctgccaggtgcggagaatcacttctccgacgcggcccatggcctgcgaatcggaggaggtgagcgagaaggcgccgagatcgtgcagcacgtcttccgcagcgatggtttcccggcgaatgcgcgactcggcaaaggccacgtcctcggcaatgtccgggtccagatggtggcagaccatcagcatatcgagatgttcatcgatggtgttgagggtgtagggcagcgttgggttggtggacgacggcaaaatgtttggatgggcgcaggcggtgatgatgtccggcgcatggccgccgccggccccttcggtatggaaggtgtggatggtgcgtccgccgatggcggcgagggtgtcttccacaaaaccggattcattgagggtgtcgctgtgcagggcgacctgaatgtccatttcatcggcgacggttaacgcacagtcgatcgccgccggggtggcgccccagtcctcatggatcttcaggccaatgacgcccgccgccacctgctcgcgcagggcgtccggctgagaaacgttgcccttgcccagcaggccgatattgaccggcaggctgtcggccgcctgcagcatgcgtgagatataccacgggcccggggtacaggtggtggcgtgggtgcccgcggccgggccggtgccgccgccgaccatggggggcacgccggagaccagcgcctcttccgcctgctgcggacagatccagtgaatatgggtatcgatcccgccggcggtgacaatttttccttcggcggcaattacttccgtcgcggcgccgatggggatggtgacgttgggctggatgtcggggttgccggctttgccgatggcgaagatccggccgtccttcacgccgatatcggccttaacgatcccccagtgatcgacgatcaacgcgttggtgagcaccaggtcgacacagtcggcggccagcatctgcccctggcccatgccgtcgcggatcactttgccgccgccgaatttgacctcttccccgtaggtggtcaaatcgtcctccacctcgatccacagctcggtatccgccaggcgcaccttgtcgccgacggtggggccgaacatatcggcataggcctggcgtgaaatattactcatcgtttacctccagagggcccatgacctcgccgcggaagccgaagacggcgcggtgaccagcgaaggccaccagctcgacctcgcgtttctggccgggttcaaagcgtaccgccgtgcccgccgggatattcaggcgatagccggcggcctgctgacggtcgaacttcagcgccgggttaacctcggcgaaatggtagtgcgaaccgacctgaatcggccgatcgccgtggttctcaacgaccacgcgacaggttgcccggccggtattcagggctatctgaccgggcttaacgtgatattcaccggggatcatggcgctacctcagataatcgggttgtgaacggtgaccagcttcgagccgtccgggaaggtggcttcgacctggatatccgggatcatttccgggacgccctccatcacctgctcgcgggtcaggacgtgacggccttcctccatcagcgaggccacgcttttgccgtcccgagcgccttccataataaaggcgctgatcagggccacggactccggatagttgagcttcaggccgcgggccaggcgacgctccgccaccagcgcggcggtaaacagcaacagcttgtctttttctcggggggtcagttccataacgttctcttaagtcagccagattcggggaagtacgggagatttaccggtgagatgagggcgcagaaactgccatacgtcgcgcatcacccgctggcaaatcagattatcgtcactgaggaaacgcaccgtcagcaggcggtcggtcaggctggcgccggcgtagagaccgagcggcgccagcgcgtcgcgcaccccgtcgagcagggcatcggtagccggatagcacagcaaagtgccgacccagggacgttcggcgacgctggagagctctccctcctgcagctgcaggcgctcgaccagcagcggctcatcgtccacccatacctccagccggttgctgagggtgccgtggctgaaggtttcgccaatcaccgggcggccaaggcagagcagatcccaggccagcagcctgctggaggcgcaaagatgaaaggtagtgaacagccgggcattcgccccgggaaagaagatggcatcctgcgggagccactccagggtcgcctgcggggcaagggtcaactgctggcgaactagcgcttgcgcgccgctgctgcggtaaaacttgctggcgccaggcatggttatcagcgtatggcagccgggggcaaggtgcgcgctaattgtcagctcatcaccgccgacgatgccgccgggcgggtgaagcagatagaggtgacaggtctcttcttccgggtaaaacgggcgctggacggtcagcgggccgacatgttgggcgctggcgagaacggtcttgccgccggcctgctgaaagcggagatccagcgtggcctgccagccttttttgagtggtggtaacacggtgccgtgcaatgttgcgcccctgcaaaatcaagataaaacagcagcaatgagtattgatcggcgggagtttatcccggtcatacgaaacgcttatgtcatccgtaacccggagcgtcgcgacgggcgcgaggggaaagcggcataaccgctccggattattcacccggataatctttgccgtcaatatcctgatccgcagcctgggcgcggcggaaaaggcggcggatcgcgttgcgccgcgccgccagccgccagcgcaacttttgcctttccatgctgctaacgtattgttacaaaaggaggatgtggcgatgatcgcctttgatggcgaggaagcgtaaaagggcgggtgaaaggcgcgattagcgcaggggagttccccggctggcggagccgggaggggagattacttctgctctggcgtttttttcttcttcacgcgggtccagattttgctctcctggcgacgccacagacgctgaatgttgtcgtgatggcgcaggaggatcaggcaggagagcatcgacaccggaaaggtatactgcggtttgaaccaccagacgtagaacggggcgatcagcgcgctgacgatagcgcccagggaagagtagccgctgagcaggatggtcagcagccaggtcccggccatcaccccggtgagatcgagcccgatgggggcgatagcgccgaaggccgtggcgacgcctttaccgccgcggaaatgaaagaagactggccagatatggcccacgcaggcggcaatcgccactaaccccagccagaacggcgtaaggcccagcgcccaggcgccccacaccgggagcatgcccttcagcacatcaaaaataagtaccgctacggccgccccttttccgccaattcgtagtacgttagtggccccggggttgcctgagccgctgtcgcgtgggtcgggcaggccagcaaggcgacataccagaatggcgctggaaatggagccgcagaggtaggcgaggagtaccagtccaggcgcgattgcactcataacgctgttccgttttgaaaatgtcgttgtattctctgcatctgtggataatacgcataattcgccggaagtggtatccggtttagctaaaaagcaggcagggcgtgatggatattgtatttatagagcaactttcggtaatcaccaccattggtgtttatgactgggaacaaaccattgagcagaagctggtgttcgatatcgaaattgcatgggataaccgcaaggcggccgccagcgatgatgtcagcgattgcctcagctatgctgatatcagcgagcgcgtgatcgcgcatgtggaggggggaaaatttgcgttagtggagcgggtggcggaagaggtggccgacctgctgctggaaacattccagtcgccctgggtgcgcataaaagtcagcaaacctggcgccgtggctcgcgcggcaaacgtcggggtgattattgaacgtggccttaatctgaaacaaaacttttcaggtcatacttgttaaacaaattgcgtttataccggtcatagcatccggtcatcaggcaattttactggcgatgtccttccagaacggtggacgaatccgtgtgtacttcctgtacgctgcggattacgcgcgctctggcagccgggttgtgcctgttgaacgataccgtgttcctggtttttttcattttacttttttaaagggtttaattggatgagcgatatacactcgctgctggtggcggcaatattgggtgtggttgagggtttgacagagtttttacctgtttccagtaccggtcatatgattattgttggtcacctgctggggtttgaaggtgataccgcaaatacctttgaagtggtgattcagttaggttcgatactcgccgtggtggtgatgttctggcgtcgcctgttcggcctgatcggcatccatttcgggaaaccgccggcgcatgaaggccagggcagcggccgtttgtcgcttatccatatccttctcggcatgatccccgcggtggtgatggggctgattttccatgacaccattaaatccttgtttaacccggtgaacgtgatgtacgccctgattgtcggcggcgtattgctgattgcagcggaagtgctgaagccgaaacagccgcgcgcggtcgggattgacgatatgacctaccgtcaggcgttcgtcatcggctgctttcagtgcctggcgctgtggccaggtttctcccgctcgggggcgactatctccggcggcatgctgatgggcgtcagccgctatgcggcctcggagttctctttcctgctggcggtaccgatgatgatgggcgccaccgtgctggacgtctacaagagcatcggcttcctgaacatgggcgacgtcccgatgttcgccgtcggcttcgtgatggcgtttatcgtggcgctgattgcgattaaaaccttcctgcagctgatcaaacggatctcgttcattccgttcgctatctaccgctttatcgtcgcggcagcggtgtacgtggtcttcttctaaggcctgcgccctcagccttgcggctgggggcaacgctgttccttccactgcgctaccgccgcaattctccgccgcgtcagctcctcgcgaatttccgcccctttaaagcccgccgccacgacctctttagtggagaccgactgcgccacttcccaggcctccagcagcaggcgcctctgcgggtaatcgctggcctcgaaaccggtgcgtccgcggacgtcggcttcgctggtgagcgcgatctgctgcacgcgctgcggtttgcgccacgcgtcaatgctgtcgaagagtttgacgagggttttcggctgcagaattggcagggtgtggattaggtcatggtactccgccaccagtttcgcgagatcgcggatatcgttcggcacccgcagacgcgcgcagagctgctccaccagcttgactcccgccggaccatggccgtggtgacgcggccagagcgccttcggcgtcagccctttgccgaggtcatggcacagggtggcgaaacgtacgtcgacatccggcgacagcatcgcggccatcgtgacggtcatcagggtgtgcaggccggtgtcgatttccggatgccatttcgccggggccggcacgccgtacagggcgtcaatctccgggaacagcaccttgagggcctgacagtcgcgcagcgtctggaaaaagacctgcgggttgcgagtagttaatgcgctttccgtctctttccacacccgctccggcgttaaatgcgccagctcgccggcctcaaccatcgcggccatcagggcctgagtctcttcggcaatgcgaaaaccgaggtgggcgtagcgggcggcaaaacgcgcgacgcgcagcacgcgcagcggatcttcactaaacgcgggagagacatggcgcagcaggcgctgacggagatcgttctgtccgccgtaggggtcgataattgcgccgtcggcatcctgggcgagggcattgaccgtcaggtcgcggcgcagcagatcggcttcgagggtgacgtccggggcggcatagcaggtaaaaccggtatagcccgcgccggatttgcgctcggtgcgggccagggcatactcttcccggctttgcggatggaggaacacgggaaaatcgcggcctacctgttgatagcccgcgtctagcatctgttgcggggtggcgcccaccaccacccagtctcggtctttgaccggcagccctaacagcgcgtcacgcaccgcgccaccgaccagataactcttcacgcctgattctcccgtatccgtttttcgcaagatgatacgtaagtctggcagagaagacgaattagttcatccaccggtctttacgtttgcggcttggcaccagatgtggcagcaccagaccgagcagcagaccgacgcccagcacaccgccgccgtacataaaccactgcatgataatggtgcgctgtttatcatcaagctgcagatttgccgcattcaccttcttctgcgcgacaaccagctcgtttttcaacttttggttctcgtccttcagcgcgttaatcacgctgtcgctgccggcgactttcttctgcatatccgccgtgcgctggttccaggtggcatcgatgttattcagcttatcggtcagcgttttgacctggttttccagatccgggacgcgggtgcgcaggctgggctcgttgctcagctctttcagcgggatccaggcggtacggccgttgctgtcgcgaatttgcgcgtaactggtgctgtcgttcgtttgcagtaccgacacttcttccccggcgttgatggtgccgaccagacgataattatcgcccgggccgctgcgaacccaggtgttcagctcatcggaaacgtagcgcttttcttctgcgtgaaccgccgtggcggcgctaagcgcgagcaaagtaaaagtaatcaggcgtaattttggcatcaggtcatcgtttggtcataaaaagtggaacgatagtagaggcatcgccagagcgacgcaaagttttccgccacaatcggaatcatccaggaggtggcccggcaaaaagcgcgttgcatggcgattcaccgcaaaatactatctactgacaaaaaatatcgtcgtaagttcgccgcaatttgtcggcgcagcacagaagcggaagaattcagtcatggctcaagaaatcgaactcaagtttatcgtcgctcaggatggggtagagacgctgcgcgagcagctcaatgcgctcgaggcgaaacatacgcccgcgggccagttgctgaacatttattacgaaaccgccgataactggctgcgtcgtcacgatatggggctgcgcatccgcggcgatcaggggcgttatgagatgacgctgaaaatcgccggtcgggaggtcggcggcctgcaccagcgcccggaatataatattccactggataaaccggagctggcgcttgagcgcctgccggcggaggtctggccgcaaggggaacttccggccgcgctggcggagcacgtccagccgctgttcagcaccgattttgcccgtgaacgctgggtgatccaggaaggaaagagtgagattgagattgccctcgatcgcggcgaagtcaaggcgggcgaacatcaggagccgatctgcgaactggagctggagctgctcgccggggagaccgccgatctgctgcgcctcgcgcatcgtttgctggagagcggcgtcctgcgtcaggggagcctgagcaaagccgcgcgcgggtatcatctggcgcaaggtaacaatgagcgtccggtgacccggctggcggtgctgccggtggcagcgaaggccagcgtggagcaggggctggaggcggcgctggagagcgccctggtgcattggctgtatcacgacgagatctggctgcgcggcaacgcaaaagccaaagcggaaattctgctggcgatagcccgcgtgcgccatgccctcgtgctgtttggcggcatcgtgccgcgtaaggcgaccccccccctccgcgcgttgctgaacgacgccgacgccgttctgctggctgcggacaccgccgacgaagcgttattccgcaccgaggtcgttggcgccaaactggccctgaccgaatggctggtccagcgcgggtggcgttcgttcctcaacgaggcgggagagaaaaaaatagccggatcgttcaaacggtttgccgatattcacctctcgcgggtggcggccgagctgcgcagcgccgtgcagcatctggcggtagaagatgccgctgaccagttgccgaagctgtcccgcgacatcgacagcgtccagctgctggcgggcgcctatggcgacgccgtcgcgccctggctggagaactggcaggaacttcagcgtgcgatagagcatgacgaccgcagcgtgtttgaatatttccgtcgccaggcgctggctgccgagccgttctggctgcatagtggaaaacgataattacaggccagggagcccttatgatgccgctttctccgcagttacagcagcactggcagacggtcgctgaccgtctgccaacggattttcccgttgccgaactgagcccacaggccaggtcggtgatggcgttcagcgattttgtcgaacagggtgtgatcgctcagccgggctggctgaatgagcttgcggactccgcgccggcggcggaagagtggcggcattacgaagcctggctgcaggagcgcctgcaggccgtcactgacgaagcggggttgatgcgagagctgcgtctcttccgccgccagatgatggtccgcatcgcctgggcgcaggcgttgtcgctggtgcgcgaagaagagacgctgcagcagctgagcgtcctggcggagaccctgattgtcgccgcccgcgactggctgtacgccgcctgctgtaaagagtggggaacgccatgcaacgccgagggtcagccgcagccgctgctgatcctcgggatgggaaagctgggcggcggcgagctgaacttctcttccgatatcgatctgatctttgcctggccggagcatggcgccacccgcggcggccgtcgcgagctggataatgcccagttctttacccgcctggggcagcggcttatcaaggcgctggatcagccgacgcaggacggctttgtttatcgggtggatatgcgcctgcggccctttggcgacagcggaccgctggtactcagctttgcggcgctggaggattattaccaggagcaggggcgggactgggaacgctacgcgatggtgaaagcgcggatcatgggcgataacgacggcgcctacgccagcgaactgcgcgcgatgcttcgccccttcgtcttccgccgctatatcgacttcagcgtgatccagtcgctgcgtaacatgaaaggcatgatcgcccgtgaagtgcggcgtcgcgggctgaaagacaacatcaagctcggcgccggcggcattcgtgaaattgaatttatcgttcaggtctttcagctgatccgcggcggtcgcgaacctgcgctgcagcagcgcgcgctattgccgacactggcggcgattgatgagctgcatctgctgccggaaggcgacgcgacgctgctgcgcgcggcctatctgttcctgcgccggctggaaaacctgctgcaaagtatcaacgatgaacagacccagaccctgccgcaggatgaactgaaccgcgccagactggcgtgggggatgcataccgatgactgggagacgctgagcgcgcagctggcgaaccatatggccaacgtacggcgggtgtttaatgaactgatcggcgatgacgaggctcagtcgccagatgagcagctggccgagtactggcgcgagctgtggcaggatgcgctggaagaagatgacgccagtccggcgctggcgcatttaaacgacgccgaccgccgcagcgtgctggcgctgattgccgatttccgcaaagagctggatcggcgcaccatcggcccgcgcggccgccaggtgctggatcagctgatgccgcatctgctgagcgaaatctgctcgcgcgccgatgcgccgctgcctctggcgcggatcacgccgctgttgaccgggatcgtcacccgcaccacctatcttgaactgctgagcgaattccccggcgcgctgaaacacctgattacgctctgcgcggcatcgccgatggtcgccagccagctggcgcgccacccgctgctgctggatgagctgctggatcccaacaccctctatcagccgacggcgaccgatgcctatcgcgacgagctgcgtcagtatctgctgcgggtgccggaagaggatgaagagcagcagctggaggcgttgcgccagttcaagcaggcgcagcagctacatatcgcggcggcggatatcgccggcaccctaccggtgatgaaggtcagcgaccatttaacctggcttgccgaagcgatcctcgatgcggtggtgcagcaggcatgggggcagatggtggctcgctacggcctgccgacccacctgcacgatcgccaggggcgcggcttcgccgtcgtcggctacggcaagctcggcggttgggagctgggctacagctccgatctcgacctggtgttcctccatgactgtccggcggaggtgatgaccgacggcgagcgggagattgacggccgtcagttctacctgcggctggcccagcggatcatgcatctgttcagcacccgcacctcgtccggtattctctacgaagtggacgcccggctgcgcccttccggcgcggcggggatgctggttaccaccgctgacgcgtttgccgactatcagcagaacgaggcctggacgtgggagcatcaggcgctggtgcgcgcccgtgtggtctatggcgacccggcgttgcaggcgcgctttgacgccattcgtcgcgatatcctgaccaccccgcgggagggcgcaaccctgcagaccgaggttcgcgagatgcgcgagaagatgcgcgcccacctcggcaacaagcatcccaatcgttttgatatcaaagccgatgccggcgggatcacggatattgaatttattacccagtatctggtcctacgctatgccagcgacaagccgaagctgacccgctggtctgataatgtgcgtattctcgagctgctggcgcagaacgacatcatggacgaggaggaagcgcgcgccttaacgcacgcgtacaccaccttgcgtgacgcgctccatcacctggccctgcaggagctgccgggacacgtggcgccagaggccttcagccgggagcgcgagcaggtcagcgccagctggcagaaatggctgatggcttaactataaaatcgggtgtgctattatcgcgcgcaaagtttgcgtctcgcaggagagagtcatgaaagtaacgctgccggagtttgaacgtgcaggagtgttggtggtgggtgatgtgatgctggaccgctactggtacggccccaccagtcgtatttccccggaagccccggtgccggtggtgaaggtggaaaatatcgaagaacgtcctggcggcgcggcaaacgtagcgatgaacattgcctcgctgggggcaacctcgcgcctggtgggattgaccgggattgatgacgccgcccgcgcgctgagccaggcgctggccaacgtcaatgtgaagtgcgacttcgtctccgtcccgactcacccgactatcaccaagctgcgggtgctgtcgcgcaatcaacagctgatccgcctcgactttgaagagggcttctccggcgtcgatccgcagccgatgcacgagcgcattcagcaggcgctgggctctattggcgcgctggtcctttcggactatgccaaaggggcgctgaccagcgtccagaccatgatccgactcgcacgtgaagcgggcgtgccggtgctgatcgatccgaaaggcaccgatttcgaacgctatcgcggcgcgacgttgctcaccccgaacctctctgagtttgaagcggtggtgggcaagtgccaggatgaagcgcagatcgttgagcgcggcatgaagctcatcgccgaattcgaactgtcggcgctgctggtgacgcgctctgagcaggggatgacgctgctgcagccggggcgtccgccgctgcatatgccgacccaggcccaggaagtgtacgacgtgaccggcgccggcgacacggtgattggcgtgctggcggcgcccctggcgtccggcaacaccctggaagaggcctgctatttcgctaacgccgcggcgggcgtggtggtcggtaagctgggtacatccaccgtttcccctgtcgagctggaaaacgcggtccgcggccgggctgagaccggctttggcgtgatgagcgaagaggaactcaaacaggcggttgcggcggcgcgcaagcgcggcgagaaagtggtgatgaccaacggcgtcttcgacattctgcatgccggtcatgtctcctatctggcgaatgcgcgcaagctgggcgaccgtctgatcgtggcggtcaacagcgatgcctccaccaaacgtctgaaaggcgaaacccgcccggtgaacccgctggaacagcggatgatcgtgctgggggcgctggaggccgtcgactgggtggtctccttcgaagaagatactccgcagcgcctgatcgctggcatcctgccggatctgctggtcaagggcggcgactacaaaccggagcaaatcgccggcagcgaagaggtatgggcgaacggtggcgaagtgctggtgctcaactttgaagatggctgctcaactaccaatattattaagaaaatacaaaaagatagcgacaaataagcttttcgctattcaccggtttgtacggtgaagcatcacggcctgcgatagacgtatcgcgggccgtttttatttaatcatgtggaaaatgatttagcgcaataaataatcatgttaagcgcatttttcgtacaaatcgcgttaaggtaagcgtaaatactgaagtgagtaaaaggcatatgactgatcagaacatccaccgctgaaggagtatgcgcatgaaccataacgatatgtattcaatgaagaattttgattttttggcgcggagtttcgccagaatgcacgcccagggccagccagttgatcttcaggccattgtcggcaatatggatgaagaacatcgtgaatggttttgccagcgctatgaactgtactgtcgccaggtgagtagccaggcggaagccgcccattaagccaaacgcaaaacgagcccccaggggcccgttttttactgctgctcttcgctgcccggcgtcgccgccgggcggttttcgaggtcattcaggcgctgctccagcagcgcccgtttttcccgggtccgcagcagcacctgagtctgcacgtcaaactcttcgcggctaaccagatccagacgggtcagctgcgactgcagcgcctggcggattttcttctcaacatcctcacccagatcgcgaagtccttttggcatcgactcatggacctggcgggcgatttgttcaatttttttcgggtcaatcatggtggtttcctgctcgggtcggatgattgatcattgtagtgcgaaccaggccgcctataaaccagaaatgtttgaagcttatgcattgccgaggatagtcaatagcgttatagttatctcgcttattctcagggcggggcgaaattccccaccggcggtaaatcaaccatggcgttgaaagcccgcgagcgcttcccgtgactacgggaaggtcagcagatccggtgtaattccggggccgacggttaaagtccggatgggagagagtaacggcacagtcgggcccaggcccgctcgcgttgacttttgccgctaaaccggcgctcctaagactgccctgattctggtaaccataattttaatgaggtttttttaccatgaatcagacgctcctttcttcttttggtaccgcttttgaacgtgtggaacacgctttgaacgccctgcgcgaaggccgcggcgtgatggtgcttgatgatgaagaccgtgaaaacgaaggcgatatgatcttcgccgctgaaaccatgaccgttgagcagatggcgctgaccattcgtcacggcagcggcattgtgtgcctgtgcctgaccgaagaacgccgcaaacagctggatctgccgatgatggtagagaacaacaccagcgcctacggcaccggcttcaccgtgaccatcgaagcggccgaaggtgtgaccaccggcgtctccgctgccgaccgcgtgaccaccgtccgcgcggccatcgccgacggcgcgaaaccttccgatcttaaccgtccaggtcacgtcttcccgctgcgtgcgcagccgggcggcgtactgacccgcggcggtcacaccgaagccactatcgacctcgtgaccctggctggctttaaaccggcaggcgtgctgtgcgagctgaccaatgacgatggcaccatggcccgcgcgccggagtgcatcaagttcgctcagcagcacaatatggcggtagtcacgattgaagatctggtggcctatcgtcgcgaacatgagcgtaaagccagctaaatagcggttcgctacgcccgagcacagcccacttgttagtgggctgtgttgtttctgcgctttaaccgatgcccatcgtctggagtaccaccaggctcagccccatgaccgacatcccgcacaggacgccgtagcttggattgctttgcggatcgatctctttcgccagcggcatcagttcatcgaccgacagcgccaccataatcccggcgacggcagccatgatcgcgcccatcaccagcggcgagaccaggctccccagaatcaaccacgccagcacgccgcccaaaatttccgccatgccggaaagcccggcccagagcaccgctttgctgcgcgagccggtggcggcatacaccggtccggcaaccgccagtccttccggaatattgtgcagggcgacggcaagggcgacgcccatgccaagctcgaggttgttgctggccgtgacataggtggcgatcccttccggaaagttatgcaggctgatccccagcgtcagaagaatagcggtgcggcgtaagttgcgcgggcgcggcatggcgggagtcatcagatcctgcgggtgggcgtgcggcagcaggcggtcaaggccaaagtagcccagcaggccgacaacaaacattccgtagccgagcagcggcgacatgccctcggcggccagcgcggcaggcagcatttccatcaacgaaatcaatagcataatcccggcggcaaagccgagggagaagccaagcaggcggttagagggtttctggccaatcacgccgaatatggcgccaatgaaggttgcgctaccggctaacagcgtcaatattaagggtgatgacatcgcttctctccctgtgaaaataattacatacgagtatattgcctgaggatgcgcgtacgggacacgtccctttaccgcgaattacattcaaattttctgacgatcatcatcatggttatctgagtttatcctggcgcaaaagcgcgtaatgtgagcacatcacattgacaccctaaggatatcatcatgtcccgtacccgaatgcccgcgttgtttctcggccatggcagcccaatgaacgtgctggaagacaaccgttatacccgcgcctgggctcaactgggcgaaaccctgccgcgtccgaaagcgatcgtggtggtctctgcgcactggtttacgcgcggtacgggcgtaacggcgatggaggcgccgaagaccattcatgacttcggcggttttccgcaggcgctgtatgacacgcattatccggcgccgggctctccggcgctggcgcaacggctggtggagctgctctcgccggtgccggtcaccctcgatacagaagcctggggatttgaccatggctcgtggggcgtgctgattaaaatgtatccgcaggcggatatcccgatggttcagttgagcatcgacagcaccaaaccgccggcctggcatctcgaaatggggcggaaactggcctcgctgcgtgatgaaggcattatgctggtggccagcggcaacgtggtgcataacctgcgcaccgcccgctggcatggcgagaacacgccgtacccttgggcagagtccttcaataactacgtgaaggcgaatctgcaatggcaggggctggacgagcagcacccgctggttaactacctggcacacgaagggggctcgctctccaacccgacggcggagcatttcctgccgctgctgtatgtcctggggacgtgggatggcgttgaggcgatgacgatcccagtcgatggcatcgagatgggctcgctgagcatgctgtcggtgttggttggcgcctgatgatagcgcgctccggcggcatttaccgtcgccggagcgcggcattattcgacgaaaatgtgcggatagaagcgcgacagatcctgggtgatcagcgcccggtcttcgcgaataccgatccctgcaggctggtcgttgatgagccagctgccaatcagcgtatagctatcgccaaacttcggcagcgggtaaaacgcctgcacgatggtgccttcttccccgtacgggccttctactgcctccaccactttgccattttcaacgatcgacacgttagcgccttcgcgggagaagattggcttaatgacgtacttctccatctccgggtgagtatcttcgctgaagtaggccgccagcagattagggtgattggggaacatctcccacagcatcggcagcagcgccttgttggagataatgcttttccacgccggctccagccagcggacgccagcgtcttccagcttggtggagaacatctcccgcagcataaactcccacggatagagcttgaacagattgccaatcacctgatcctgcagatcggtaaactggcctttttcgcccaggccgatatcttcaacgtagaggaattccgtcgccagccccgcttcagcggcgcagtcctgcagatactgcacggtaccgcgatcttcaacggtatcgcggcagcaggccatatgcagcagctgaaagccaaactgctcgcgcagctcgccgaagcgatcgatcagcttttcctgcaaactgttgaactggtcgctgcccgccggcagcttgccggcgttgagctgatcttccagccagatccactggaagaaggccgcttcatacagcgaggtcggggtgtcggcattgttctccagcagcttcggttcgccgacgccatcccaggccaggtcgagacgtgagtagagcgacggctggttggttttccacgactgacgtacaaaaccccaggtgtgtttagggatgcggaatttggtcatcagctcatcgctggcgatcactttttccaccacctggaggcacatctgatgtagctcagcggtgaccgcttccagcttttccacctgcgcgagggtcagcttgtaatacgcctcttcgctccagtagggctcgccgtacatggtatggaagttgaaaccgtactcggtcgctttctcgcgccagtccgggcgctcggtaatactgactctttccatgttgcttagccgcccattgagcgagaagaggacgttgagcctgcggcgctacgctgcatggtcgactgtttcgctaccgactcgccaaagccgccgcgggtgacggtggtggtggtggctggcttcggcgccatcgcggttttcggcacattcatggtgcggcccggctgggcggcgccatagctcttgccgctggcgtcagtgtactgaccgtaggccgggctggccggatttttcgagctgaacagcggctgctgttgcgccatgccgccgcccatcaggcggcccatcatgtagccggccatcagcggcatccagaagctgccgctgctttgcgcctgcgcctggttttccggggcgacgcccgcctgggctggcgtctgctggcactggccttcgccaaactcggcgacgcagtcttcgcgggtggcatacttcggcgcagtgcgctctgcctcttttaccgcgttggtgtaggccgtggtgcattcggctgctttgcccgggttggcggcggagcagtcatcggcgttctggtacagcgacaccgtttcgtcgcttttttcacaaccggcgagcataaagaccgcggtaacggccagcgcgaccggcgtcagatggcgtgcgctccagcttttgcggaacgacgaatgattaatattttttgtccgtttcatatttgtcttccaggacccagtggtatggcgtgtgttaacgctcaggatagaggatgagtggtggaaaatgaagcgaagaggggcgctaagcgggggatctttacgttgccttacgtttaacgcatcgcctgtccgacggacaggcgatgcgcatcacagtatgagaattactgacggaacggattgctgccgctgctctgggtggtccgtgcggacgccggcttcaccgccgcggtagtgttgccgtagccatcagcggtggcatcctgttgcggattttccggcgcgacgctatctgcggaggtggagatgggtttacccagcgtgttgttcagggcgaccagatcctgctcgttcagggtacctaacgccgacttaatgttcagctcgttgatcaggtagttgtagcgcgcattcgagagctgctgcttagcgttatacagcgtagtggtggcgtcgaggacgtcaacgatcgtacgcgtacccaccgagtagccagcttccatggcatccagggagctttgcgcagagaccaccgcctgtttgtaggcgttgatgctgctgatggaggcgttcacgttgttaaacgatgaacgcacagtctgcacgacgctgcggtgggcgctttccagctgctcgctggcgccaacgaagttgtattgcgcctgtttgacctgcgaggtcaccgcgccgccctgatacagtggcagagagaagttcaggccgatttggttctgcccggcatcgttatcctggtattgctgaggattattatgggtttttgaaccactgtagctagtattcgatatcccactcgacgcggataggctgagcgtcggcaaatggccgtcctgcgcctggcgaatctgctcgcgagccaggtcctggttcagacgcgcctgcagcagcgacaggttgcggttctccgcttccttcagcagggcgttgaccgcctgcggcttgttggttttgaagccattcacgttcagggaggccagctccggatagtaattaccggtgacctgacgcagttcttcgacggcgttgtcgagatcgttacgcgcggtgacttcgttcgccagcacggcatcgtattgtgaacgggcgttctgtacgtcggtgatcgccaccaggcctacgttaaagcgctgcgtggtttgatccaactggcggtaaatagcctgtttctgcgcttcggtataggagagcgtgtcgatggcggccagcactttaaaataggccgtcgcggtattcagaatcagtgtttgctgatcggtctgatacgtgacatcctgaatccctgccgttttttcctgcagcgtcagggcgcgccatttcgacatatcaaacagaacctgcgttaactgcagcgagccgctggtgacgtttgaattgatgccgttgctgtcgcgatagccattgttataggtataatccgctcccagcccaagctgaggcagtaatggactgcgcgcttcgttgatcttttcgaacgcggcgtcacgatcggctgccgatttacgcagatcggggttgctgatgcgtgcctgctggtaaacctgaagcaggttttccgcctggctcatggcgctgaacccggtcaggctcaggccgataagaatggggagcaatttcttcatttgcattccttgttgtgaagcatttagcgctggtctaattctaagaaaaattccgctgattgtatcgattctgccgccgtaaaaagttggcgttacgtgccatccggcggtaatttgcaccaatctaacatacggaccgtaaaacggtagccaaacggtttggaaatccctaatttcagattcgcaggacatgacaatgagcaaacccacgcagcagggaattaccttctccaaaaatgatgtagaaattattgcacgcgaaacgctatatcgtggttttttttcgctcgatttataccgttttcgccaccgcctgtttaacggcggcatgagtggcgaaatcacccgtgaaatttttgagcgcgggcacgccgccgtcttgctaccctttgacccggtgcgcgacgaagtggtgctggtcgaacaaatccgtatcgccgcctatgataccagcgagagcccgtggctgctggagatggtcgccggcatgattgaagcgggtgaaacggtggaagatgttgcccgtcgggaagcgctggaggaggccgggcttgaagttgggcggacgaaaccaatattaagctatctggccagtcccggcggcaccagcgaacggttatcgatcctggtgggagaagttgatgcatcgacggcaaaaggcattcacggcctggccgaggaaaacgaggatattcgggtgcatgtggtgagtcgggagcaggcttaccagtgggtagaagaggggaaaatcgacaacgcagcctctgtcatcgccttgcaatggctgcaattgcattatcacaatttacgaaatgagtggacaaaatgaagcgttatacacctgacttccctgagatgatgcgcctgtgcgagaccaacttcgcgcagttgcgccgcctgttgccgcgaacggatgcagcgggtgagaaggtaagctatcaggtgggaagcgcgcagtatcggttaacgatagttgaatcgacccgctacactactctggtggcaatagagcagactctgcctgcagtgagctactggagcctgccatcgatgaccgtccgcctctaccatgacgccatggtggccgaagtgtgttcgagtcagcagatctttcgcttcaaagcgcgatatgattatcctaataaaaagttgcatcaacgcgacgaaaagcatcaaattaaccagtttttggccgactggctgcgttactgtttagcacatggagcgatggcgattccggtttgttagcgtcgttaaacctaaggacaccatttggaaagcctgttaaacctacctctggctggtgaggccagagtcaggatattacaaattactgatactcacctgtttgctgaaaagcatgaaacgttgttaggcatcaatacctgggatagctatcaggccgtactgtcggccattcatgcctcacagcgtccatgcgatctgattgtcgcaacaggcgatctggcgcaggaccactcctccgcggcctatcagcattttgctgagggcatcgcgagttttgctgcaccctgcgtctggctaccgggcaaccatgatttccagccggcgatgtacagcaccctgcaggaggcgggcatttcccctgccaagcgcgtgtttctcggcgatcgctggcagatcctgctgctcgacagccaggtgtttggcgttccccatggcgagctgagcgacttccagctggagtggctcgaacataagctggcggaggcgccggagcgctataccttactcctgctgcaccatcatccgctgccggccggctgcagctggctggatcagcatagtctgcgcaatgccggcgcgctggacagcgcgttgagcgcctggccgcgggtgaagcatcttttgtgcggccatattcatcaggaactggatctcgactggaatggccggcgcatgatggcgacgccgtcgacctgcgtccagtttaaaccgcactgtgccaatttcactctggatacggtgtcaccgggctggcgctggctggagcttcaccctgacgggacgctgaccaccgaagtgtgccgcctggaaggcgccgcgtttcatccggatattgcttcagaaggctactgatggcgacgctcctttatctgcatggctttaacagctctccgcgctcggcgaaggcgacggcgttaaagacctggctggcgcagcactatcctgagatcaccatggtggtgccggagttgccgccttacccggcggaaacggcggagctgttggagtccatcgtgctggagcacggcggcgagccgctgggggtcgtagggtcgtcgctgggcggctactacgcgacctggctttcgcagtgctttatgctgccggcggtggtggttaacccggcggtgcggccgtttgaactactaaacaattttctcggccacaatgagaatccatacaccgggcagcaatatgtgctagagtctcgccatatttacgatctcaaagtcatgcaaatcgacccgctcgaagcgccggatttactctggctgctgcagcagaccggggatgaagtgcttgattaccgccaggccgtgcattactacgcctcttgccggcagacggtagaggagggcggtaatcacgcatttgtcggctttgacgatcatttcactcagattatcgaatttctcggcctgcgctaaacggccctgaacgacctacgaatacacaccatgacgcaatcttcatataatgctgatgccattgaggtactcaccgggctagagccggtgcgccgccgtccgggcatgtataccgacaccactcgtcctaaccatcttggtcaggaagttattgataacagtgtggatgaagcgctggcaggccacgccaaacgtgtggaagttatccttcatgccgaccagtccctggaggtcattgacgatggccgcgggatgccggtcgacatccacccggaagagggcgtgccggcggttgagctgatcctctgccggctgcatgcgggcggtaagttttccaataaaaactatcagttttccggcggcctgcacggggtggggatctcggtggtcaacgccctgtcaaaacgcgtggaggtcaacgtgcgtcgcgacggtcaggtctacagcatcgcctttgaaaatggtgaaaaagtggaagacctgcacgtcaccggcacctgcggcaaacgcaataccgggaccagcgtccatttctggccggacgaaagcttcttcgacagcccgcgcttttccgtttcacgtctgacccacctgttaaaagcgaaagcggtgctgtgcccgggcgtggaaattgttttccgcgaccaggtgaacaacagcgagcagagctggtgctatgccgatggcctgaacgattacctgagcgaagcggtgaacggcctgccgctgctgccggaaaaaccattcgtcggcgccttctccggcgagacggaggcggtggactgggcgctgctgtggctgccggaaggcggcgagctgctgaccgagagctacgtgaacctgatcccgactatgcagggcgggacgcacgttaatggcctgcgtcaggggctgctcgacgcgatgcgtgagttctgcgagtaccgtaatatcctgccgcgcggcgtgaagctgtcagcggaagatatctgggatcgctgcgcctacgtgctgtcggtgaagatgcaggatccgcagttcgccgggcaaaccaaagagcgcctgtcgtcgcgccagtgcgcggcgttcgtctccggagtggtgaaggacgccttcagcctgtggctgaatcagaacgtgcaggccgcggagctgctggcggagatggccatctccagcgcccagcgccgtctgcgcgcggccaaaaaagtggtgcgcaaaaagctgaccagcggtccggcgctgccgggtaagctggcggactgtaccgcccaggatctgaaccgtaccgagctgttccttgtcgagggggattcggcgggcggctcagccaagcaggcgcgcgatcgcgaatatcaggcgatcatgccgctgaagggcaagatccttaatacctgggaagtctcttccgatgaagtgttagcttcgcaagaagtgcacgacatttcggtggcgattggtattgacccggatagcgatgatttaagccagctgcgctacggtaaaatttgtattctggcggatgcggactccgatggtctgcacattgccaccctgctgtgcgcgctgttcgtaagacatttccgtaccctcgtgaaagaggggcacgtctatgtggcgctaccgccgctgtaccgtatcgacctcggtaaagaggtttactacgcactgacggaagaagaaaaaaccggcgtgctggagcagctaaagcgcaagaagggcaagccaaacgtccagcgctttaaagggctcggtgagatgaacccgatgcagctgcgcgaaaccacccttgacccgaatacccgccgcctggtgcagctggtgataagcgatgaggacgagcagcagaccacggcgataatggatatgctgctggccaaaaagcgttcggaagatcgtcgcaactggctgcaggagaagggcgatatggcggatctggaagtgtaagtctgtacgctgcgccagacgtaaaagggagcctcaggctccctttttcatggcattactgagtcggcggacttaaacgccaggctgcagaatacggatgctggtctccagcacatcgcctttgaccgcttccgaccaggctttcatgtgcggggtttgcaggtgtgcttcaagatgcgcgacgctttcccactgctcgaccatgacgatagagtcgggcgctgtggtctggaagctgacgccggcggcatgatccaccagcggggcatagccgtggcagccggcctcctgcaaaacggtcggaataattttcgcgaactgatcgagaaccgcctggcggtggtgctggcccgggcgggtacggatttctgcaatcactgttaacatggttaactcaactccttctgtgtggatctcgtcatactccaggttcgaataactcgaaatatgtagagctagacctctagttaaccaaaaatttccgccagatgcttgcgatattctgcgatataccgtgggacatcaggcattttaatcacgtcgttggcgataaaggttggcaatgcctccatgccgaggaactgattggctttatggaacggcaggtaaacgccgtcaacgccgacgccgtggaagaactggtctttgtcggtgaaggcttccatcggcgcgttccaggtcagagaaagcatatattttttcccctgcaccaggccgccggagccatattttttgctggcgtcggagcgggtacggccatcgctggcgtacagcgagccgtggccttcggtaaagacgtcatccatatattttttcaccgtccacggagcgcccatccaccagcccggcatctgccagatcaccacatcggcccacaggaaattctgtacttcttcttttacgtcgtactcgctttcggcgcgaacgcttttaacatcgtgcccggcgtcgcgcagataactctccgcgacctcggtcagggtgtcgttcagttgaccattagagtgcgcgaactttttcgccccattgataatcaggatgttgctcattttttaccctcatatatgaaaatttgccgacgatcttaccccgcgaagcggggcagtaaaatgagcaaaatgtgcaaagtcttttgccaaatgagcaataatctcgctaccagtacacgcgggcctcgaagccgccgtcgcgcgcgttggcaaaatcaacctgcatgccgtgcagcgaggcgatgcgccggacgatcgacaagcccaggccgctgcccggcgcctcctgccccggcggacgataaaaacgctcaccaatgcgcgagagcgcctgcgggctaatgcctgggccgttatcgcgcacccggaactcgcgggcgttgagcgtgatatcgacctgactgccgcgcgggctatagcgcaccgcgttatccagcagattgcgcaccagcagactgagcagcagcggctggccggtgcggacgatatggctggcattaagatgcaggcgcagctcaatcccggactgctgcgccgggtgatacatctccatcactgccgactgcagcagatcggcgatagcgacctgctgcacatcatccagttgggcgagcgagtccagccgcgacagcgtcagcagctgatccaccagtcgggtggcgcgatcgatcccctggtggagctgatccaacgctttctcacgcccttcgggatcgtccagggagagttgggcgacttcggtctgcaccttcagcgccgccagcgggctgcgtagctcatgggcggcatcagaggtaaaccgacgctcgcgcagcatggcgtcgtgagtgcgtcggaacagctgattcagcgcttcgaccagcgggcgaacttcggcggggatcttctccacgctaagcgaatccgccgagtccggcgcgcgcaggcgcagcgtgcgcgccagatttttcaatggcgccagctcgcggcttaacagcacgatgagcagcacgaacatcagcggcagggcaaccatccacggggtgagctgcgaggtcacgatatccatcgccatttcgcgccggtaatcccactcctggccgacggcgatgcggtagcggccgtcggcggtggttaaccacaggaaacgccactcgtcatcgtcgtcacgcagatagccatcgctgaatccctcgcgctgcgaattccactgaatatcctctccgttctcgccgtcattaagcaccattttgccgtcgcgggtgaagatggcgaacgccagcgcgtcgtcgtcgatgtgcccgtggcgtacctttttcttttccccgagcgaggcgggcggggcgcgcagttcatcgaaatgcatgacgctcaggcggcgagcgaacagcagctgctgggtatcgaacagcttatccagctttttgctggtctgctgccaggcgataacgctggccatcccccaggcggcggcggtcagtacggcaaacagcagcgtcaggcgcaggcgcaggctcaggcgggcaagtcgtttcatgcgtcacccagggtatagccgatgccgtggacggtacggataaagtcgctgccgagcttgcggcgcagatgatggacgtgaacttccacggcgttgctggagacctcgtcgtcccaggtgtagagcttttcctcgataagcttacgcggcaatacgcgcccggcgttgcgcataagcagttccagcagggcgaactccttcggcttcagcgccaggctttcgccgtcgaggctggcggttaagcggttcggatcgaggatcaccttgccgtggcgcagttcgctgctgctctggccgtgcgcgcggcggatcaacgcttcgaggcgcgctgccacctcaatcagggcgaaaggtttgcacaggtagtcatcggcgcccaggcgcaggccctccacccgctggttgagggcatcgcgggcggtgaggatcagcaccggctcatggcggcctttatcgcgccattcgcgcagaatatcgaggccatcgatgccgggtagggtgaggtcaaggattgcggcgtcgtagggggcgctgtataaggcatttttgccctccagcccggcggtaaaccagtcaatgctaaagcccattttgctcagcccggctttgatgccgtcgccgataagcttgtcatcttccaccagtaatatgcgcatgtttccctccgacgatcccgtttctttgcgcagtaaaccgcgttgaagcgggtgatgtacagcattaaaatttcttttttccgcttaagaagtcgttaagttttgtcgggcgtaataggagccataccaccacaaaagggagaatataagatgaaaaaaattgctgcgatgaccgcgattattgctttggtttccatgccggtactggccgccgggcagggaggattcaccggaccgtctactaccactaccacccaggctggcggcttcaccgggccgagcggcgcggtgaccaccgtggcgaacgccaagtcgctgcgtgatgacacctgggtgaccctgcgcggtaaaatcgtcgagcgcatctctgatgacctgtataaattccaggatgcttccggggtgatcaatgtcgatatcgaccacaagcgctggaacggcgtgaccgtcggcccgcaggacacagtagaaattcagggggaagtcgataaggactggaactcggtagaaatcgacgttaaacagatccgtaaaatcgcgccataagtctccgtcggataagcgcaagatcggtcaggaatcgcgatcctcgctctgtcagagtatgtcgcgaggaggagacgatgaacgatattaaggccagcccggcgtatgtcgggcgcttccagcgtgtctgtaggtacattgcgcgccatcttgatgagccgctgtcgctggagacgctgagcgcgatagcgcacagttcgccttaccattttcaccggcaatttagcgcctataccggcattccattgtaccggtatattcagtggttgcgtctgcgacgcgcctgttggcgcctggcgttcaacccccgcgataaagtcatcgatattgcccttgatgccggatttcagaatgcggagtcgttcagtcgtgccttccgtaccgcgtttgaccaaagcccgacccaattccgtcaacaaccggactgggccgagtggcatcgacgcgtaccgaaacatacgctacaggagcaaacgtcgatggacgtcaacattatttcgtgcccctccacccggatagccgtactgcaacatcgcggtagcccggaccttgtcaacgccaccgccgcgcgttttatcgcctggcgtaagacgagcggattatcgcccgtcgccaccagctatacctgggggatcgcctgggacgatccgcagaccaccccgcaggaggcatttcgttttgatatctgcggtacggtcgattggccggttggtgaaaacgcctttggcgtgattaacggcgaaatccccggaggacgctgcgccgtcgtgcgccatcacggctcgctggacacgctggcgaacagcgtttggtttctctatcgcgactggttacccgcttcaggcgagacgttacgggattttccggtgtacttccgttacctcaattttgtccatgaggtggctgagcatgaactgcaaaccgatatttatctgccgctggcctgattaagcgtgacggaatcctcagccgatctcacggcctgtgactcagggcgtgagatcgggtattatcgcgggtagttttgccgtccgaacggtcggtacccagattgaggatccacgattaatgagcgatatggcagagcgccttgcgctgcatgaatttacggaaaatgcttacctgaactactccatgtacgtgatcatggacagggcattaccgtttattggcgatggcttaaaaccggtccagcgtcgcatcgtctatgcgatgtccgagctggggctgaacgccagcgcgaaattcaaaaagtccgcccgcaccgtcggcgacgtgttgggtaaatatcacccgcacggcgacagcgcctgctatgaagcgatggtgctgatggcgcagccgttctcttaccgctatccgctggtggatggtcagggaaactggggggcgccggacgatcccaaatctttcgccgccatgcgttacaccgaatcccgcctgtcgaagtatgccgagctgctgctcagcgagctggggcaggggacggtcgactgggtgccaaactttgacggcacgctgcaggagccgaaaatgctgccagcgcgtctgccgaacatcctgctgaacggcaccaccggcatcgcggtaggcatggcgaccgatattcctccgcacaacctgcgggaagtggccaaagcggcgattacgctgattgagcagccgaaaaccaccctcgacgaactgctggatatcgtacaggggccggatttcccgaccgaggcggagatcatcacctcgcgggcggaaattcgcaaaatctaccagaacgggcgcggctcagtgcgcatgcgcgcggtgtggagtaaagaggacggcgcggtggtgatcagcgcgctgccgcatcaggtctccggcgccaaagtgctggagcagattgcggcgcagatgcgcaataaaaagctgccgatggttgacgatctgcgcgacgaatcggaccacgaaaacccgacccgtctggtgattgtcccgcgctccagccgggtggatatggaacaggtgatgaaccacctgttcgccaccaccgatctggagaagagctaccgcatcaacctcaatatgatcggccttgacggccgcccggcggtgaaaaacctgctggagatcctcagcgagtggctggtgttccgtcgcgataccgtgcgtcgccgtctaaaccatcggttagagaaagtgctgaagcgcctgcatatcctcgaaggtttgctggtggcgtttcttaatatcgatgaagtgattgagatcatccgcactgaagatgaaccgaagccggccctgatgtcgcgctttggcatcagcgaaacccaggcggaagcgattctggaattaaaactgcgccacctcgccaaactggaagagatgaagatccgcggcgagcagagcgagctggaaaaagagcgcgaccagctgcaggcgattctggcgtctgaacgtaagatgaacaacctgctgaaaaaagagctgcaggccgatgccgatgccttcggcgacgaccgtcgctcgccgcttcacgagcgtgaagaagcgaaagcgatgagcgaacatgacatgctgccgtctgagccggtgactatcgttctgtcgcagatgggctgggtgcgcagcgccaaaggacacgacattgacgcccagggcttgagctataaggcgggcgacagctggaaagcctcggcgaagggcaagagcaaccagccggtggtgtttatcgataccaccggacgcagctatgccatcgatccgattactctgccttccgcgcgtggccagggtgaaccgcttaccggcaaactgaccctgccgccgggcgcgaccgtggagcatatgctaatggaaagcgacgatcagaaactgctgatggcttccgacgcgggctacggtttcgtctgtaccttcaacgatctggtggcgcgcaaccgtgccgggaaagcgctaatcaccctgcctgacaacgcgcacgtgatgccgccgctggtgattgaggatgagtccgatatgctgctggccatcaccgccgccgggcggatgctgatgttcccggtcagcgatctgccgcagctgtcgaaaggcaagggcaacaaaattatcagcattccggcggcggaagccgcagccggccaggacggtctggcacatctgtttgttctgccgccgcagagtacgctgaccattcacgtcggcaaacggaagatcaaactgcgtccggaagagctgcaaaaagtcaccggcgagcgcggccgccgcggttcgctgatgcgcgggctgcagaaaattgaccgcgtggaaattgactcgccgcgtcgtgccgcggcaggcgatagcgaagagtaagcgcgtctcctcccgtctttgacgggaggagacgaaaaaatgccgcaaaatcgttgtttattcaggcgttgcgattaacaatgtccatcatcagggacccaggaagaacggtcccggcctgcgcagaacttgtgagcctgccttctgccagcagcgaataattctaagcggtttgggttttagaggtagctatgctattcatttttcgagtaattttcgtggtcatttattgcatcgtagtgtgcgtacttggctgtctgtactgcttgttcagcccacgtaatccaaaacacgttgccactttcggccatctgtttggccgtttatctccggtatttggcctcaaggtagagctacgcaaacccgccgacgcggaaagctatggcaacgcgatctacatcgctaaccaccagaacaactatgatatggtgacggcgtcgaatatcgtgcaggctccgacggtcaccgtaggtaaaaagagcctgctgtggatcccgttctttggccaactgtactggctgacgggcaatttgctgattgaccgtaataaccgaaccaaagcgcacggcactattgccgaagtcgtcaacgcttttaaaaagcgtaaaatttcgttctggatgttcccggaagggacccgtagccgcggccgcggcctgctgccgtttaaaaccggggcttttcacgcggctattgccgctggggtgccgattattccggtgtgtgtctcgaatacatcgaataaaataaagctcaatcgctggaacaacggtctggtgattgtggaaatgctgccgccggtagataccactcagtttggtaaagacaacgtgcgtgcgctggcgacgcattgccgcgagctgatggccgccaaaatcgctgatctggacaacgaagtggccgagcgcgaagcggctggaaagcaataagacaggaaacgccgccaacgcgcgcgtattgctggcgggaaacgaattccctttttcatttgtcagtatgtcatggagttaatatgtcactcagtcggcgtcagtttattaaggcttccggcgtagcgctgtgcgctggcgccgcgccgctgaaggcccatgccgccggccagcagcctgcgctgccggttccgccgctgctggaatctcgtcgcggccagccgctgtttctgacgctgcagcgttcccactggtcgtttacccccggcacccgcgcccccgtctgggggatcaatggccgctatatggggccgacgatccgcgtctggaacggagacgacgtcaagcttatctacagcaaccgcctgacggagaacgtggcgatgaccatccgcggtctgcaggtgcctggcccgctgattggcggcgcggcgcgcatgatgtcgccgaacgccgactgggcgccggtgctgcctatccgccagagcgcggcgacgctgtggtatcaggccaacacgccgaaccggatggcgaaacaggtttacaacggtctggccggcatgtggctggtggaagacgaggtcagcaagaacctgccgatccctaaccactatggagtcgatgacttcccggtgattattcaggataaacggctggataacttcggcacgccggaatatagcgaaccgggcagcggcggctttgtgggcgacacgctgctggttaacggcgtgcagagcccgtatgttgaagtgtcgcgcggctgggtgcgcctgcgcctgctgaacgcttccaactcccggcgctatcagctgcagatgagcgatggccgactgctgcatgtgatttccggcgatcagggattcctgccggcgccggtttcgctcaagcagctatcgctggccccgggggagcggcgtgaaattctggtcgatatgactaacggcgatgaagtatccattacctgcggcgaagcggcgagcatcgtcgaccgtatccgcggtttttttgaaccgtcaagcatcctggtctccacgctggtgctgacgctgcgtccgaccgggctgctgccgctggtgaccgacagtctgccggtgcgcctgctgccgaccgagctgctctccggtacgccgatccgcagccgggatatcacccttggcgacgatccgggcatcaacggccagctgtgggatccgcagcgtatcgatatcacggcgcagcaggggacctgggagcgctggacggtgcgcgccgaccgcccgcagtcgttccatattgaaggggtgatgttccagatccgtaatgtcaacggctcgtctcctttcccggaagatcgcggctggaaggacaccgtgtgggtcgacgggcaggttgagctgctggtctattacgctcaaccgtcgtggccgcacttcccgttccagtatctgagccagacgctggagcttgccgatcgcggctcgatcggccagatgctggtgaatcccgcgccgtaatctctttgaccctggccggcgcacggtcagggtttgagaaaatcctccttcatttccactatcattccggcttataatccacgcccttttggttatttttttatcattttccccggaagcaatatgagcgcaatatccctgatccaaccggatcgtgaccttttttcctggccgcaatactgggctgcctgttttggccctgcgccttttttaccgatgtcgcgtgaagagatggatcaacttggctgggatagctgcgacattattctggttaccggcgacgcctatgtcgaccacccgagcttcgggatggctatctgcggccgcatgctggaagcgcagggtttccgggttgggatcatctcccagccggactggaacagcaaagacgactttatgcgtctgggaaaaccgaacctgttcttcggcgtgaccgccggcaacatggactcaatgatcaaccgttacaccgccgaccgtaaactacgtcatgacgatgcctatacggcgggtaacgtggcgggcaaacgtccggaccgcgctaccctcgtctatacccagcgctgtaaagaggcgtggaaagatgtgccggtgatcctcggcggcatcgaagccagcctgcgtcgtaccgcccactatgattactggtccgacaccgtgcgccgctcagtgctggtggactccaaggccgatatgctgatgttcggcaacggcgagcgtccgctggtggaagtggctcatcgcctggcgatgggcgaaaccatcgaccagatccgcgatgtgcgcaataccgccatcatggtgaaagaggcgctgccgggctggagcggcgtggactccacccgtctggatacgcccggtaaaattgaccccatcccgcatccgtacggtgaagatctgccgtgcgccgataacaaaccggtcgcgccgaaaaaacaggaagcgaaaagcattactgtgcaaccgccgcggcccaaaccgtgggaaaaaacctatgtgctgctgccttccttcgagaaggtgaaaggcgataaggtcctgtacgctcacgcctcgcgcattttgcaccacgaaaccaaccccggctgcgcccgggcgctgatgcaaaagcacggcgagcgctacatctggatcaatccgccggcaatcccgctctccaccgaagagatggacagcgtcttcgcgctgccgtacaagcgggtgccgcatccttcctatggcgatgcgcgtattccggcgtatgagatgatccgcttctcaatcaacatcatgcgcggctgcttcggcggctgttcgttctgctcgatcaccgagcacgaaggacgcataatccagagccgttctgaggattcgatcattaatgagatcgaagccattcgcgacaccgtgcccggctttaccggggtgatctccgatctcggcgggccaacggccaacatgtatatgctgcgctgtaaatcgccgcgtgctgagcagacctgccgccgtctctcctgcgtctatccggatatttgcccacacatggataccaaccatgaaccgacgatcaatctttatcgccgcgctcgcgagctgaagggcatcaagaagatccttatcgcctccggggtacgctatgacatcgcggtcgaagatccgcgctatatcaaagagctggcgacccaccacgtcggcggctatctgaagatcgccccggagcataccgaagagggaccgctgtcgaagatgatgaagccgggaatgggcagctacgaccgctttaaagagctgttcgacacctattcgaagcaggcgggtaaagagcagtatctgatcccgtactttatctccgctcatccggggacccgtgatgaagatatggtgaacctggcgctgtggctgaagaagcatcgcttccgtctcgaccaggtgcagaacttctatccgtcgccgctggcgaactcgaccaccatgtattacaccggcaagaacccgctgggtaaaattggttataagagcgaagaggtggtggtgccgaagggcgataaacagcgccttctgcacaaagcgctgctccgctaccacgatccggcaaactggccgctgatccgtcaggcgctggaggcgatgggcaagaagcacctgattggctcccgtcgcgactgcctggtgccagcgccaaccctggacgaaatgcgtgaagcgcgtcgccagaaccgccatactcgtccggcgctgaccaagcacacgccgatcgcccatcagcgccagacgcctgccgctgcgggcgcgaaaaaacgcgttaagccgaaggccgtatcacgctaagcggctggcccggcgggatcgctcgccgggaacatctgtgaaaaaaggagagaggtgatgacgccggtcatcctgtcgcgacaacaactggaccagctctgggagatagaccgcagcgaaattatcgatacgctctaccgtctcgataacggtcagctgcgggcttatcgggaatattatgacgtgcgtggctgggaccctcacgatcgtcaggtttatactccgattcacgaggcctgttacgatcgcggcggtatttttttcgccttttttgacgatgagcagatgattgccgcagcggcgctggatacgctgcctcgcggcatgaatggcgagctgcgccagctattattcttttatgtcggggcgggaaagcgcggccagggctgggggcggcgactgtttcagtatgccctgcaccagctgccagaaatgggggcgtccggcctctatatctcgtcgatccccaacaaaaacaccgtcgatttttatctggctcagggatgtcgcttagcggataagcccgacccggcgctgtttgcgctggagccagaggatattcatctggtctgcgatcgcctttaacgccgaggcgctaaaggcgatggcaagagagagcattatccgccgaactgatccgggtcaggaccgagacgtttaccctggtccagcttcgcgatcgctcccagctcatctttgtcgagacggaagtcccagacgtcaaagttttccgcgatacgcgacggcgtgacggatttcgggatcaccaccagaccgctgtcgagatgccagcggatgacgatttgcgccggcgttttgccgtacttatcggcgagctggtggatgactttttgatcgaagacgccttcgccgccctgggccagcgggctccaggattcggtctggatcttgtgggtggcgttccacgcgtgcagctgacgctgctgcataagtggatggagttctatctgattgatcaccggggcgacgccggtttcatcaatcagcttctgcagatgcggtacctggaaattacacacgccaatgcttttggtcagcccctgctgctgcagctcgatcagcgcctgccaggcctcgacgtaatggccgatagccggtaccggccagtggattaaatagagatccacatagtccagcttcagtttgctgaggctctctttcagcgcctcgtgcggccgtttttgatcgtcgttccacagcttagtggtgatgaagagctcatcgcggttgacgccagcgctgtgcagcgcattgccgacgccggtctcattttggtacgcggcggcggtgtcaaaagagcgataaccgacttccagcgccttatgaatggcggagacgacttcctcgttgccagctttccacacgccgagacccagctgcggcatcaggttgccgtcgtgcagttttataacggttggatgtgtcatgccttcctcctgttaatgaactcggcgaagcaggatccgccgaggggtagcattaagtctggacgaaatagctaaaaacggtagtaaaaacacctctccccggcgtttgtttaacgtaaggagaggtgaatcaggcggggagcgcttagcgtgcagcctcgtaaatacggcggctgacgtccagggtgatatcctgatgttcgccaagtttagtcatgccgtgctcttccagtttcgccagcagcgccgggatggagctaccgtcgagaccgtaatcggaaaggcgggtcggcacgcccatctgctcgaagaactgacgcgttgcggcgatggcggcatcgatacgttggtcgtcagagccttcggtaatattccacacgcgctcggcatactgcagcagcttctcgcgcttggcatcgcgtttctcattccacagcgccggcagcacgatagccagcgtctgggcgtgatccaggccgtgcatcgccgtcagctcgtggccgagcatatgcgtcgcccagtcctgtggcacgcctgcgccgatcaggccgttcagcgcctgcgtcgccgcccacataatattggcgcgcacgttatagttctccggttcctgcagggctttcgggccatcctcgatcagggtcaggagaatgccttcggcgaagcggtcctggattttgccgtcaaccgggtaggtcacgtactgctcgacggtatggacgaaggcgtcaaccacgccgttcgcgacctggcgcggcggcagggtataggtataaaccggatcgaggatcgcgaactgcggctggacgtgcgaagacataaacgcgcgtttgtcgccggtggttttccgcgatatgaccgcgcctttgttggattcagaaccggtcgccggcagagtcagtaccgagcccattggaatggcgctggcaattttgctgccataggtttccagaatttcccacggatcgatatccgcgtcgtagtgggctgctgcagcgataaacttggtgccatccagcaccgaaccgccgccgaccgccagcaggaaggtcactttctcttcccgggcgagtttcaccgcattcatcagggtttcgtaagacgggttcggctcgatgccgccaaattcaaggacatccaggccattcagagcggtgaggacctgatccaggacgcctgtttttttgacgctgccgccgccgtaggtgatcagtacgcgggcttccgccgggatctgttcacgcagcttttcaatcgcgcctttgccaaacagaatgcgggttggggtatgcaggtcgaaattattcattgcttaagtcctccaaagagtaaaaccgtcgacagggacgataccgctgcccgatgaaggttattgtggtcctggcgccgttgaccctcaatgcacattcctgccgatgtcttgcctatttctccatatggctggagaatttgtagcggcctgcgcacaatgtacaggtgaagaaacatcgggagagacggtggcaatgcaacacgcagagatatgtcggacattaacggagaagattaacctgctgaaagataagcacgaaatgttaagttcgttgctgcctgacgtccgtttgctgtacggaacgcaaccggggccccggacgccggtgatgtatcagccggggatcgtttttctcttttcgggccataaaattggttatatcaatgaacggacttttcgctacgatacaaacgaatatttactgctgaccgtgccgctacctttcgagtgcgaaacctttgccaccccggaggtgcccctcgccgggatgcgcctgaacgtcgatatcctgcaactgcaagagctgctgatggatattggcgaagatccgctgtttcagcccgcggtcgcctccagcgggataaactccgcggtactctcggaggatattctgtgcgctgccgaacggctgcttgacgtgatggagcggccgctggacgcacggatccttggcaagcaaatcgtccgcgaaattctgtattatgtgctgacggggccctgcggcggcgcgctgttggcgctggtcagccggcagacccacttcagcctgataagtcgcgtgctcaagcatatcgaaagccagtacaccgaaaacctcagcgtcgatcggctggcggcggaagcgaatatgagtgtgtcagcgtttcaccataattttaaagcggtgaccagcacttctcctttgcagtatctgaaaaactaccgtttgcacaaagcacgaatgctgatgatccatgacggcatgaaggccagcgcggcggcgatgcgcgtgggatatgaaagcccttcgcagttcagccgcgagtttaagcgctacttcggtttgacgccgggagaagacgccgcgcgtattcgcacgatgcaggggatgtaataccgggaaagggcggccgggcgggcgcaggccccccggcaggtaagcgtcaggcgctgcaatatttctttttaatgaccacgaacagcgtgccgagcaggccagccagcagcagggcaatcggcaggatcatcagacaggtcatcacctgatcttcatggcgcttcacaaacgggatcatgctcagcgcatagccaagacccgtcaccacacagacccacagcagggcgctcagccagttgaagaactggaagcggcggttcggcaggccagaaatcccggccatggttggcagcagggtgcggacaaacgccagaaaacggcccgcgagcagcgccagcaggccgtggcggtcaaacatgcaggtggcgcgctgatggtacttatgcggcagatgcgccagccagcctttcaccgtttgcgtattgcccagccagcgcccttgcacatagctcagccagcagccgaggctggcggcggcggtcagaatggcgatagtgggcacaaagtccatgacgcctttagcaatcagcgcgccggcgagcagcagcaggctgtctcccggtaaaaaggaggcgggcagcagcccgttttccagaaacagggtcgcgaacataaccagatatacaacgcccacaacgtgagggttcgccaatgcggcaaaatcatgttgccacagcgcggcgacaatctcttgaatgacaaccatggactttcctaagtggtaccgtattgttgactagtgtactcctgaagaggcccgagcaccttgatcccgggcgcaacaaaagcggccgctttgctaaaaagcgtccgctattgttgccactgactgtcactttacacgatacgcgcgaagcccgctgctaaatccgcctgcagatcgtcaacattttcgagaccaatgtgcaggcggatcagcgtgccgctgaagtcgacttcagcatccggtcgaatgtgggcgatttgctccggctggttggcgagaatcagcgactcaaagccgccccacgaataggccatactgaacaggctgaaattgtcgagatactccgccagttcggcatcattgaggcgcttgctgagcacaaacgagaatagcccgctgctgccggtgaaatcacgtttccagaactcatgacctttactgccgggcagggcggggtggtttacccgcgccacctgcgggtgctgcgccagccactcggcgatgcgcaggctgctttcatgatgctgacgcaggcgcacgcccagggtgcgcaggccgcggctggtcatataggcagtatcggcgtccagcatttgccccatcaggtaggcattttcacgcagctgcggccagcagcgcgcgttcgccaccgcggtgcccaccatggcgtcggaatggccgatcaggtatttggtgcctgcctgaatggaaatatcaatgccaaaatccagggctttaaacaggatccccgccgcccaggtgttatcgatcatgataatcgcttccggggcgacctgacgcacggcggcgactatcgccggcacatcgtgcacttccatggtgatcgagccgggcgattcgaggaacaccacgcgggtctcagggcgaaccagacgggcgatatcggcaccgattaagggatcgaaccagctggtggtgacgccgagtttggcgagaattttggtacaaaagtcctggcttggctcataggcggtattggtcatcagcacatggtcgccttgctcgacaaacgccaggatagtgttagccaccgccgcggcgccgcaggggaagagggcgcagccggcgccgccttccagctcgcacatcgcttcctgcagcgagaaatgggtcagggtgccgcgacgaccgtagaacagctcgccgttggcccgattgcgggtggcgtgctttttggcctcgacggtgtcgaaaaccagcgatgacgcgcgctggataacgctgttcactgagccctgggtgtactttttgctccgcccggcgttgaccagcgcggtatcaagatgtttatcagccatgttgacgaacctgtttttatacgtctggacgtctaaactaacatgaatctgcttttctgtaccagcgcaccgccgatacaggcgaaaattttaccaggcccgcggttagccgcttttttactgcgtaagcgcaaggaaaataaacgtgatttgctgcacagtgtaaatactaatgagaaccactatcaattcgatgtcgttttgatattattgtgggcagattttgtgattatcgtcgtggagatagagcgtgggtaataatttgatgcaggcggatctctccgtttggggtatgtatcatcatgccgatattgtcgttaaggtggtgatgattggcctgattctggcgtcggtcgtcacatgggccatcttcttcggtaaaggggcggaaatcctcgccagcaagcgtcgcctcaaacgtgaacagcagcagctggcggaagcccgctctctcgatcaggccagtgatatcgccagcgcctttgaggcgaaaagcctcaccacccagcttatcaatgaagcgcagaacgaactcgaactctctgccggtgccgaagacaatgaaggcatcaaggaacgaaccggttttcgccttgagcgccgcgttgcggcggtcggtcgccatatggggcgcggtaacggctacctggcgaccatcggcgccatttccccgtttgtgggcctgtttggtaccgtctggggcatcatgaacagctttatcggcatcgcccagacccagaccaccaatcttgcggtggtagcgccgggcatcgcagaagcgctgctggcgacggccatcggcctgttcgccgccatcccggcggtggtcatctataacatcttcgcccgcatgatcggcagctacaaggcctcgctcggcgacgtcgccgctcaggtactcctgctgcaaagccgcgatctggacctcagcgccagcggcgtgaagccggtgcgcagcgcgcagaaattacgggtaggttgatcggctatggcgatgcgtcttaatgaaaacctggacgataacggcgaaatgcatgagatcaacgtgacgccgtttatcgacgtcatgctggttctgctgattatctttatggtggccgcgccgctggcgacggtcgacgtgaaggtcaatctgccagcctcctccagccagccgcaaccgcgaccggaaaaacccatctacctgtcggtgaaggcggataagagcatgttcctcggcaacgacccggttaccgaagcgaatatgattaacgccctggatagcctgaccgccggcaaaaaagataccaccgtcttcttccgcgcggataaaaccgtcgattacgagacgatgatgaaagtgatggataccctgcatcaggcgggctatctcaagatcgggctggtgggcgaagagaccgtcaaagcgaagtaacctccccctttccacttttctcctcaggctggccttgcgccagctttttaataggtgacgcaataacttgtaagaccaatcttatagatgtgtgacaactttctcagttaacagaaaacataaacccgatgcgaaaaatgacaataggatagtttttatcctgcctctacagtgaataccacttcatctgagagggattatattgtgaatcacgataataaactgtcatttgcggagaagctgggatatggcatgggggatgcagcctgcggtatcgtttactcttcggtaaccatgtttctgacatggttttatacggatatttacgggctttctgctgccgcagtcggagtgatgttcctggtgacgcgggttctggatgcgattaccgatccgctaaccggcattgttgcagaccgtgtaaagacccgctggggccattttcgcccgtggcttatctggtttgccgtaccttatgccgtgctggcggtaatgaccttcacgactccggaatttggcgcatcgggtaaactggtttatgcctacctgacctacaccttactcatgctgtgttacacctttatcaatattccctactgcgcattgggcggagtcattacgcgtgatgagaaggatcgcctttcagcccagtcatatcgttttacgatctcatctctggccggtctgatggtttctgtcgcaaccctgttcctggtggattttttcggtaaagaaaataagcagtttggttttcaggcgacaatgggaatcatgggcgcgatcgctattgtaatgctggctttttgcttcttctctaccaaagaacgcgtggctccagctgttgaacagcaggggagcatacgcgaagacctccgtcagctgctggcgaatgaccagtggcgtattgtggcgataattacttttttctccagtatggccggggttatgcgcagcgccgccacgctctattatgcaacctacctgatgttaggcggtgtggagtcagcggcgggaacggccatgaaatcagcatttgtttccaccagtgtcgttggcacgattatcggcagcatcgccgccggatggctggccaagcgctatcgcgcggtatcgctgtttaaaaatatcaacctcctgctggtcctggttggcgtcgtaatgttctttgtgccgccgacctggctgccggtggtgttccctttatacttcctggtcggcttcttccatcagatgtaccagccgtttaaatggaacatgatggccaacgctgccgattatggcgaatggaagtttggccgtcgcatcacgggattatcctattccggtaatctgtttgctttgaaaatgggcatggcggttgctggcgccgccgtaggtttttcgcttgggctatttggctatcaggcgggcgtaacggcgcagactccgctggcgacaatgggaattgtggggctgttaaccctcggtccatcactatcttacctgctcctgtggtggctggcgcgtttctataagctggatgacaaaatgatgcagacaattcagcgcgagctgtccatgcgtcagcagcaggggcattcagagacgcatttgccgctaaacgccgttccggaaaaggcctgaggagatgcgaaatatgaccccttctgaataccagaatcctatcttatgcgccgattattccgacccggatatcgtgcgcgtaggcgatgatttctttatggtctcttccagttttaaccatgtgcccgctttaccgatcctgcattcaacggacctggttaattggactatcatcaaccacgttatggatgaactgccgctacctggttatgaccggtatcagccgggtaagggcgtatgggcgccgtcgattcgctggcacgatggcaagctgtgggtctgcttcagcacgccagatgaaggtatttttatctgccataccgaggatccgtggggggaatggagcgctccgcactgcctgcgcgaggccagaggttggatagatccctgcccgttctgggacgacaatggtcaggcctggttggtacatgccttcgcccatagccgcagcggcatcaagcataaactgcagttgtttgcgatggcgccggacgccagcgaattgctgggcgaagggcagattatctatgacggctgctgcgatttacctacccttgaggggccaaaggtttatcaacgcgccggttggtactacatctttgctcctgcgggcggggttgaaaatggctggcagacggtactgcgcgcgcgccagatgacggggccctgggaagccaaaaacgtgcttttccagggaaacacctcgataaacggaccacatcagggcggctgggtggagggtgaggagggcgaatgctggtttgttcatttccaggacttacacctctatggccgcgtggttcacctccagccgatgtcctggggtaacgatggctggccgcgtatcggtgagcagattggcaacggcggcgtcggacagccggttttacgttggccgcgtcctaaagggttaacgccttcaccggcaatggcgccgcaaaccagcgactattttgcgcaaggccaaccgggaatacagtggcagtggcaggctaaccccagccctgagtggctgctgccggcggaaggcgaacttcgattacgctgcgtcccattatccgaagtcgatggacagagagcgttatactgggcgccgcagctgttgctgcagaaattcccggcgctaacttttagcgcgaaaacaagcgtaacgttatatgccgctcaggacggtgatgccggaggcctgatcgtatacggcgaacgctacgccgctttgctggtggagtttgggcaagggggttaccggctcgtgtggcgacacggttggatgagcgatgcgggcgtggtgcgcgaaactcgtcaggttcttgctgagcttaagtgcggcaagtgtcagctgcaggtggccgtaggcgaaggcggcctgtgtcaattttcctggcgagccgaggaggagtggcggaaggttcctctttgttttgctgccgggaagggaaaatgggtcggtgcgaaatttggcctgctggctgcttcaatggttggcctacaaagcgagggctactccgctttgcaggactttgaggtcatactttaaagaaaccgtttctggccgcctgcggatgacgcgggcggctgatgttgcataagcgttaccctgttgcgatataatggcggccgtttatgttaactgacaggatcttatggaacgctttctggaaaatgctatgtacgcctcgcgctggctgctggcgccggtttattttggcctctcgctcggtctgattgcgctgaccatcaaattttttcaggagatcttccacatactgccgcatatttttagcgtcagtgagtcggatatgattctgaccctgctgtcgctggtggatatgaccctggtgggcggtttgctggtgatggtgatgttctccgggtatgaaaattttgtctcgcagctggatattaacgagggtaaagaaaaactcagctggctgggcaaaatggacgcgacttcgctgaaaaataaggttgccgcctccatcgtggcgatctcctctattcacctgttgcgtgtgtttatggatgcgaaaaacgtcccggacaataagctgatgtggtacgtgattatccacctgaccttcgtgctttcggcctttgtgatgggctaccttgatcgtctgaccaaagtgaaacactgatcccttctctcccggcggtgttagccgctgggctgttcctccccgttttatgcttttctgggctggcgtatgtccgggcttctgctttgcttaaagagcgcttaacaacggaggcagggtgatgacgcgattaacggccaaagatttcccgcagcagttgctcgagtattatgactactatgcccacggcaaaatcagtaaacgcgagtttctccagctggcggggaaatatactgtcggcgggatgaccgcgctggcgctgtttaatctgctgaagcccgactatgccctggcagagcaggtaccgttcaccgacccggatatccgcccggagtatattcattatccctctcctgacggtcacggcgaagtgcgggcttacctggtgacgccgacaaaaatagccgacaaagcgcccgctgtggtggtggtgcatgagaaccgcggcctgaacccctatattgaagatgtagcccggcgggtagcgaaagcggggtacatcgcgctggcgccggatggcctgagcgccgtcggcggctatccggggaatgatgatgaaggccgcgccctacagcagaaagtcgatcccgtgaagctgatgaatgatttttttgcggcggtcgcgtttatggcgaactatccacaggtgacggggaaggtcggtatcaccggtttttgctacggcggcggcgtcagcaacgcggcggcggtggcgatcccggagctggcctgcgcggtgccgttttacggtcgccagccgccgctgaaggaggttgataaaattaaagcaccgctgctgctgcactatgccggcctcgatagcggcattaatgaaggctggcctgcctatgaacaggcgttgaaggaacaccataaagtctacgaggcctatttctatcagggcgtgaatcacggctttcataatgattccacgccgcgctacgatcggactgcggctgatctggcctggcaacgcacgctggcatggtttgagaagtatttacgctagcgcaaccgtcataaatagcgctaccgctcgctcaaaaaaacgctatataatttattatataacgattgggagggcgcgatggaaaatcattttggcaaaggcttaatggcggggctacaggcatcctatgctgacaccgccgcgcatgcggcgaatttttgcgccgactataaacgcgggtttgtgctcggctactcgcaccgcatgtttgaaaaaaccggtgaccgtcagctcagcgcgtgggaggcggggatcctcacccgtcgctatggccttgacagagatatggtgatggatttcttcaaagaaggtgggtcgggtatggcgatgcgctattttctggcgggctatcggctggaaagctaaacaggacggcttcgcaggcggaaccgtcctgtggtgggaaccctttcccgtccacgggaaagggtgaagaccttacgcctggcgcttatcttccgtttgggtgtcaaagtctcgggcatcatggcgctcatgcagctgctcattgagcgggccgttggtgcggttgacgatgcgtccgcgcttgacggccgggcggttgccgacatcctgcgcccagcgcagcacgtttttatagctcccggcgtcgaggaactccgccgcgttatagacattgcccagcactacgttgccataccacggccagacagccatatcggcgatggtgtactcctcgccggccacatagcgaccgcgggcgagctgtttgtccagcacgtcgagctggcgtttggcttccatcgtaaagcggtcgatcgcgtactcgatcttcactggcgcatagttatagaagtggccgaagccgccgccgaggaacggcgccgcgccctgcagccagaacagccagttgagggtttcggtgcgaccggcaggatctttcggcaggaagaaaccaaatttttccgccagatagagaagaatgttgccggactcaaatacccgggtcggcggcgtggtggaatggtcgctgagggccgggatcttcgagttcgggttgatctcgacaaagccgctggaaaactgatccccttcgccaatgcgtatcagccaggcgtcgtactccgcgccgctgacgcccagcgccagcagctcttcaagcatgatcgtcaccttctggccgttgggtgtaccgagtgagtatagctggagcggatgggttcctaccggcaggacgcgttcatgagtcgcgccggaaacgggacggttgatgttggcgaacgcgccgccgctgttttgcttccattcccacacttttggtggctggtagttttgctctgacatgctggtttgcctttttcgtggatgtacaaaaagtgtagcaggtgacctcaggccataatccgcgcggcccacacgctgacatcatcgccgctgcccagatccggctgcaccaggccgttgaccataaaggtcggcgagacatggatgccgttctgacgggcgtatttactgtgccacttgatcacgtcctgcagctccgggcgggcaaaggcggcccccagcagcacgtgactgtagcgttcaatgcgctcaatgatttgctgcggcgtggcgttcatattcggcccgctgcagtgatcggtaaactcaaactcttcccgatggtcggccacggcctgcatcaccttatgcgcctgctctctgccgtgcggcagggtggacgcggcgaggatgcagcggacgataaccccggagaacagatgccacggctgcgactgcaggcgtatcttgatggtcacgttatcggcgccgacctcatcgagcagatcgtcgagtttattaaacgcgcggacagagtaggggcaggtgggctcaaggaacacctcaaacgtccgcgggccgtgtccccagaccagcggttgggcattcagatgcgagggtgtgctcattgtcgactcctgatgttgcgttgtttttttgttatatcaccgataacgatatcacttttgtttccggctgcagggttattttccttaacggcacgattagcgaaacgaatgagtggtatcatcgttacacctctgtctggtaagtgcctgcggcaggataagaagagggagttttgtttcgccaactgcccgggctgcattaatttgaggtcaggctaaatgagcaaaggatcgacaagcagtgacgccccgtttgggacattgttaggctatgcacccggtggcgtagcgatttattcatcgaattacagtagcttaaatccgcaggactacccggatgacgcgacgtttcgcagctacatcggtaatgagtatatggggcataaatggcagtgcgtggagtttgcgcgccgctttctgttcctgacctatggctttgtcttcaccgatgtggggatggcttatgaaatcttctccctgcgtttcctgcgcgaagtggtcaatgacaatattctgccgctgcaggccttcgccaacggctcccgccgtccgcctatcgctggttcgctgctgatctggcagaaggggggcgagtttaagcacaccggccatgtggcggtgatcacccagcttgtcgacaataaggtgcgtatcgccgagcagaacgtgattcactcgccgctgccgcagggccagcagtggacccgcgagctgaccctcgaggtcaacgacggccggtacaccatcaaagatacctttaccgataccgaaattttaggctggatgatccagaccgccgataccgaacacagcctgccgcagccggtgctgccgggcgaggcgatggccatcaaaggcgcgcggctgccaaacaacggccagtttcgcggtaaatggctgaacgagaaagacccgctgcagaaagcctacgtggcagccaacggtcatttcatcaaccaggatccctatcagtatttcaccatcagcgaaagtgccgaacaggagctgatcaaagccaccaacgagctgcacctgatgtatctgcacgccaccgataaggtgatgaaggatgacaacctgctggcgctgttcgatattccgaaaattctctggcctcgtctgcgcctctcgtggcagcgccgccgtcatcatatgatcaccgggcgcatggatttttgcatggacgagcgcgggctgaaggtgtacgagtacaatgccgattccgcttcctgccataccgaaggcgggctgatcctcgaacagtggctgaagcagggctactacggcaccggccacaatccggcggaaggtctgctcgatgagctggcgggggcgtggaaacacagccgggcgcggcccttcgtccacatcatgcaggacaaggatctggaagagaactaccacgcgcagtttattcagcgttcgctgacccaggccggttttgagagcaaaattctctttggccttgatgagctgcgctgggacgctgccggtcagctgatcgacgccgacgggcggctggtcaactgcgtctggaaaacctgggcatgggaaaccgccattgagcaggtgcgcgaagtcagcgccgaggagtacgcggcggtaccgattcgtaccggacatccgcagaatgaggtgcggctgattgacgtcctgctgcgtcctgaagtattggtattcgaacccctgtggacggtgatccccggcaacaaagccattctgccggtgctgtggtcgctgttcccgcatcatcgctatctgctggataccgattttgaggttaacgacgagctggcgaaaaccggctatgcggtgaagcctatttccgggcgctgcggcaacaatatcgacctgatcggccctcaggatgaacttctggataagaccagcggccagtttgtcgatcgcaagaatatctaccagcagctgtggtgcctgccgaaagtggacggtaagtacattcaggtgtgcacatttaccgtcggcggtaactacggcggtacctgcctgcgcggcgattcgtcgctggtggtgaaaaaagagagcgatatcgagccgttaatcgttttgaaagacaaagcatgacgtacgaaacccgggtagcggcatacccctgtccgggtgacaacgtactgaaaaggatagccccggcatggtaagcgccgccggggagcacctgcaacgaagccaagataattaacacaacaacaagacagaaaaggaaaatagtatgcacgatcggcgtctcgccgcccgcgcgggtgaactcaagccctccgccgtccgcgaacttctcaagcacagtaaactgcccggcgtgatttcgcttggcggcggcattccggccccggaactgtttgataccgaaggcctggagctggcggtgcagaaggtgatgagcgagcgttttaatgacgcattccagtacggtctgacggaaggctacccgccgctgcgccaggcggtgagtgaaatttgccactcccgtggcgtcgcctgttcagccgcccaggtctatatcacctccggctcccagcaatcgctggatatcgttgcccgtacgctgctcgatccgggcgatactatcgtcgttgagcgtcccacttatctggcggcgctgcaggtatttcagctggcgcaggccaatattctcagcgttgacaccgacgatgacgggatgctggtggagcagctggccgacctgctggagaccacccgcgtcaaagctgtttacctggtgccgacgttcggcaatcccggcggcaaaacgctgagcgaggcgcgtcgtcgccggttggttgagctggcgaaacaatatgatttcgtcattctggaagacgatccctacggcgaaattagctttactgacgccgttcggcgcccgctctatcagcatgctgtcgagctgggctgtgaagatcaggtggtttacacctcgactttttcgaaaatcctcgcgccagggatgcgtatcggctggatcgtcatgccggactggctggcgcagcagacggtgattgtgaagcaggcggcggatctgcataccaatatgctgtcgcaggtgatcactgcggaatacctcagtctgaaccggctggataaccagattgcgttgattcgcgaagactaccgcaagaagtgcgtggcgctggccgatgcgctggaaagccgccttggcgagcacctggaattcagccgcccgcagggggggatgttcctgtgggcgcgtttccgctatccgttcgataccatggaatggatgaagaaaacgctggaaaacggcgtggtgtacgtcccgggtgaagcgttctatcacgataagccggatacccgtaccctgcgtctttcttactccacggtgtcagaagccggattgctgacggccgttgagcggctggcggcctccctgtaacgtctctgctgtgcgccgcttttcggcggcgcgcagccctgcgtgacgttaacgtccagcgcagggtcaatccgtttcggcgatccggtcatcgagccagaccagcatcagcgctgcgagaaaagccagcgcaaaggttccaataaacaaccacatagacgtccctcgcgggttaattattttgctgattctaccggagagcgatcgttgcggtcggcgatggagattttagttccggcggaatggctggcgagagagaaaaagtcatcggcatcaatatcgaagttaagaataatttccctgtattttccaccgttaattaacgctttggcttctttaacactactggcaataatgacaggcatcagttttatctcattttgaaaactgtgaagcaaaataagagttagttcgtaccagatcaactactttttatcgtattccgccgcagaaaaaacgtcgtactgtgacgcgacgacgaccggatattttgtgacagcgatccggtcatcaacagcacaatcttattcgacgctggcgatatgctgcaattttgccaactcgtcaggatgatttcccctgttgtttttcgcgcaatatctcgccgcagcgctgcttgtcctgacgcagcgcctgctgttcctgcgggctgagctggcgccaggtatccagcatccgctgccccagcgccggaaggtaatgggttttatgcagcgcgtagtcagaatttcccccctcgacgatattctgcatatcgtggaggaactggcggctgtcgtcatgatcgattatgcaaaataccgcccggtagtaagcttcatcttcctcggtgtaatgcggggtgaaccaccagaccagcagcgcgataagcgccagtagcgggataattaaggataattttttcaacatcagtttttcggccggagacaatcagccgtcagtgtacctgcaacgacggcctgatgtaagcgccggccccggcgggccggcacaggctagtagccgaccgggtagatgcggccggtctgaacgccttcaatgctgcggcgataggcctgcgccacggcggcggcgggaacgctggggaagcccgggaaaaagtcgccgtaggccgccagcgactcgctgagcacggtggggctgatgagattgatgcggatcccgcgcggcagttcgcaggcggcggcgcggacaaagccttccagaccggcgttgaccgtcgtggcattgaccccctgagcaatgggttcctgcgcgacaataccgctgaccagggtaatcgcccccccgtcgcgcagaaaatgctggccgaccagcgccaggcgaatttgtcccagcagcttgtcctgcagtccgaggttgaactggctgtcggtcatggtgcttaacggcccaaagtgcagattgccggtggtggagacgatggcatctacttcacccgtttgggcaaatagcgcctcgacgctctcctgcgaggtgatatccacctgataatctccccgggtgcggccgacgcggataacctcatgtctctgactcagttcttcgctgaccgcgcgaccgatggtgccgctggcaccgataacgataattttcatggcagactcctgatgaggtgagaggctattttttaataaaagtaatctcggataaactggctaaaagttagaacattactaaccagaggttagcaatatggacaaattacgagggatggagacgtttattgccgtggtggagtgcggcagctttaccggggcggcgtcgcgcctggggctgtcggcggtgatggttgggaaatatatcgcccagttggaaagcctgctggcgacgcgtctgctggagcgtaacacccgacgccagagcctcaccgacgccgggcgagtctattttgacgaagcgaaacgggtgatggagcaggtctccatcgccgaaagcgcggtcgagcggctgcggctggcgccggccggcaccctgcgggtgagcgctcccacctcgttcggcgccagcgtgatcgcgcccctgaccgccaccttcctgcaggcctggcctgcggtccgggtggaactggatctgactaaccggatggtcgatctggtggatgagggggtcgatctggcgatccgtatcggcgagatccatcaggaggatctggtggctcgctacctggcgccgtatcggatggtgatctgcgccgcgccggcttatctggcgcgttacggaacgcccgggacgccggaagatctcaccgatcatctctgcctgtcccatacggtctggaccgcccgcaacgagtggcggctgccgggcgtagagggagaagtgcgctggaaacgcgatgcggttttgcgctgcaacgatggctacgcgctgcgccaggcggcgatcgccggggccgggctgctgatgcagccggaggtactgctggccgatgcgctggccagcggcagcctggtgcgcgtgctggaggcgtggactccgcagccgcggcctgtgcatctgctctggcgccaggatcgtcggcccctgccgaagctgacgcagtttatcgcccaccttcagcagggaatggccgacgcgctgacaacgatccgcgcgtcggaataatcactccgcccgcagcgcctgctgccagtcggcaatcagatcgttgggatcttcgatccccaccgacaggcggatcagctgcggtgtgataccgttcgccaggcgtttctccagcgggatcgaggcatgggtcatgctgaagggctggctcaccagactctccacgccgcccaggctctccgcaagcgtaaaccagcgcagcttgctgatgatgcgctcggcgtaaccttcatcgcccttcaccaccaccgaaatcatgccgccgggcagggccatttgctggcgcgccagctgatgatgcgggtgcgaggccagccagggaaaccagactcgctccacttccggctgctgttccagccattcggcgagctgcagcgcgttcgcgctgtggcgctccatccgcagcgccagggtacggatgccgcgcagcgtcaggaagctgctgaacgggtcaagcacgccgcctaccgcattctgcagatagccaagcttttccgcgagcccggagttatcgccaaccaccgccaggccggcgacgacatcggaatggccgttgaggtacttggtcgcggagtgcaccacaatatcaaacccatgctccagcgggcgatggatcgccggcgaagcaaaggtgttatcggcgacgctgatcaggttatggcggcgcgcgatggcggcgatggcgctgagatccgcgagcttcagcagcgggttggtgggcgtttccacccagatcatgcgggtgtcggggcggatcgccgcttcaattcccgccaggtcgtcgggtttcacccagctcacctgcagacccgcgctacggcggcgaacgttttccagcaggcggtaagtgccgccatacacatcatcgaccgccaccaggtgactgtccttatccagcagctccagcacggtggagatggcggccagcccggaggcgaacgcgtagccgcgcgtgccgttttccaggtcggcgatcgccgtctccagcgcgtggcgggtgggattcccgctgcgggaatattcataaccggtatgctgccccggcgctggctgagcaaaagtggaggtggcataaatcggcggcatcactgcgccgtggctgtcggtgaaggttccgctatgtacactcagggtgtggatagatgacataaaaaattccttattgtgcgactcggttacgccaggcggtcaatacatcgctgcgggtgaccaggccaagaaaaagcgcgttgtcagcgatcaccgccaccagaccgcgatcgagaatggcctgcagttcgctctcgggcgcatgcttatcgagggtttcaacatggcgactcatcgcttcgctaaccggtagggagaagcgttggcgatcgccctgtacgtggcggatcaaatcccactcatcgacgatgccgaccacgcggccatcctccagaaccggcagttgggagatgtcatacagccgcatgcgggtaaagaccgcggccagggtgtcgtccggcgcggccgtgacggtagcgccttcgtcatggcgcagggcgataaaatcactgagatcgccctgttcggggcgggcgatcagtccttgctggcgcatccagtcgtcgttgaacattttggacaggtatttattgccgctgtcgcaggcgaaggtcaccacccgcttcggacggctttgcgtccggcagtagcgcagcgcggcgctgagcagggtgccggtggaagagccggccagcactccttcgacctgcagcagctggcgcgcggtgtggaacgcttcgcggtcgctgacgcgatacgcggtatgtaccccctccagcctggccagcggcgggataaaatcttcgccgatcccttcgaccagccaggatcccgtttcgccgtagcgtccggtatcgacctgatcggcaaggatggaacccgccggatcggcgagaataaattccgttctcggcgagtgctcagcaaaccaggcctgaagcccacccagcgtgccgccggagccgacgccgacgacgatggcgtcgatgtcgccctccagctgctgataaagctccggcgcagtggaggtggcatgggcctgcggattggcgtcgttattaaactggtcgatataaaaggcgcccggcgtttcatcggcaaggcggcgggcataatcctggtagtaggccgggtggcctttattgacgtcggagcgggtgagcagcaccgtcgcgcccagcgcccgaaggtgaaagattttctcgcggctcattttgtccggcaccaccaggatcaggcggtaatttttctgcgccgcaatcagcgccagaccgaggccggtattgccggcggtggcttcgataatcgttcccccgggcgccagttttccctggcgctcggcttcattaatcatcgacagcgcaacccgatctttaattgacccgccggggttctgattttcgagttttaaaaacagactgcagggcccggtatccagtttgtgcaactggagcaggggagtatgaccgatcaggtcgctcacggaatgaaacagtgacataaccatttacccactcgtttaagatatttttgcatgctagaactgtgaaaacggttatttaaagaatatttctctgtcatttagcgcaaaatggaatataagatgctatttggccatctggagggaaagcagggcagccacctgggcggatcgatttccagaaaagggcgtttctagccgcttttagcgggaaaatggcgattttaatcagtgcgttatctgatatctgaaaatgtatttgcgaaaagattctatggagaataggcctgcgcttgtcgttaactagcagcgggctggccaggagaaaaacgcagcagggaaatcatgggttaacgcagttcgatggagagtccggatgcagaaaagcaaaaacccgccttgtgggcgggttctttaaatagtggtgcccggactcggaatcgaaccaaggacacggggattttcaatcccctgctctaccgactgagctatccgggcaacggggcgcattaaaccgtaatcgccgcgcctcgtcaacgaaatttatctgttttacagcagactgaacaatctatcaccacattgcgctaaaagcacgcgtcttcaggcaaaaaacagcgtccaggccgcggaaattggcatcgccagcaccagcgcaggcagcatattcactacggcaaacatttttatcccgcagatgcgcagcccggtggccaccagcagcatgccgccgacggcgctgaaatccgccagcatcatcggcgtggtaagcggcataatgatcgccgcgcaggctgcaagagtcagctggataagcagcatcggtacgctgatggcggcgacggcaatgcccagggtgcaggcgaagatggtggcggtgaaaaagtcgagaaacgctttggcaatcagaatgctggcgtcgccggtcatcccttcgcgcatggcgccgaagacgccggtgccgctggcgcagaacaggacgataatcgccacatagctctgaatataagactcatgagccgaagcctttttcttgcctttcgctgacatcaactgctggagtttactgaccagcgtattgatgcctttttccatattgcatatttcgccgagcagcgtccccaccagggtcgacagcaccatcaccggcagattggcgcacttaatgaccagtaaaatgccgatgcccaatgacgccaggccaaaaatagaggtcattgcggtgcggatccgttccggcaaccgttggctgagtaaggcgcccagcacaccgccgaccagcaccgcgctggcgttaataaaaggtcctgtaaccacgctgactcctgttaaaaatccctgataaccgcattattatggcgttaacttaccgggaaagcttgtgtatccgtgatataagtgcatacggttttcatcttgcgcctgttcgggaaaggtgccatgattgcgcgaattttctcctccctgatatgaggccgccgatgacgacacagccattatctcgccagcgacgccgcgcccagatgcgcgggctgcctcatcttgctacgcttacccctctgttcaccatgcggtgaaggacacgtatgctcactgtagggcaacagtaagatcggacgcgtctgcttttactgatgtccggcggtcggagctgaatccgtcagacccggacacatcgttgggcaaggtctcccttgtctgaggtttttacactcccgatacgggcatttgcgcttatgaaatccatgcacattgccgccagctgcgagctggtcacccgcttgtccacccaccgtcgcgttgtggcgctggacagtaccgattttaccgatgtggcggcagtcgtcatctccgtggccgacagtcgcagcggcatccttactctcctcaggcgtagcggatttaacctgccggtctacctgctgagtgagacggcggtcgacaagccggagggggtgcaggcggtgatcgccggtaaagatcaggagtggctggagctggaggcggcggcctgtgattatgaagcgcgtctgctgccgccgtttttcaataccctgacccagtacgtcgagatggataacagcacctttgcctgtccggggcatcagcacggggcgtttttcaaaaagcaccctgcaggccgtcagttctatgacttttttggcgaaaatgtctttcgcgccgacatgtgcaacgccgatgtgaaattaggcgatctgctgatccacgaaggatcggccaagcacgcgcagaagttcgctgcgaaggtgttcaacgcggataaaacctacttcgtcctcaacggcacctcggcggccaacaaagtcgtgaccaacgcgctgttgacccgcggcgatctggtgctgttcgatcgcaacaaccacaagtcaaaccatcacggggcgctgatccaggcgggggcgacgcctgtttacctggaagccgcgcgcaatccgttcggctttatcggcggcattgacgagcgctgctttgatgagcattacctgcgggatctcatccgcgaagcggcgcctgagaaagccaatgcctcccgcccgtttcgtctggcggtgatccagctggggacctacgacggcacggtctataacgcccgccaggtggtggataagatcggccacctctgcgattacatcctgttcgactcggcgtgggtgggctatgagcagtttatcccaatgatggccgactgctcgccgctgctgctggagctgacccccgacgatccgggtatttttgtcacccagtccgtgcacaagcagcaggccggcttctcacagacgtcgcagatccataaaaaggataaccatctgcgcggccaggcgcgtttctgtccgcacaagcggctgaataacgcctttatgctgcatgcctccaccagcccgttctatccgctgtttgccgcgctggacgtcaacgccaaaattcatgaaggtgagagcggccgccgcctgtgggccgagtgtgtggcgctgggcattgaggcgcgcaaagcgatcatcgccaactgcaagatgatccagccctttattccgccgatggtggcggggcgcccgtggcaggatcacccgaccgaggcgatcgcccgggagcgccgcttcttcagcttcgaacccgacgcgcgctggcatggttttgaaggctacgcggacgaccagtattttgtcgacccgtgcaaactgttgctgaccaccccgggcattgacgctgaaagtggggagtacagtgagtttggcatcccggcaaccattctggcgcattatctgcgtgaaaacggcatcgtgccggagaagtgcgatctcaactcgattctgttcctgctgacgccggcggagagcgccgaaaaaatggcgcagctggtggcgatgctggggcagtttgaacagcatattgaagcggatacgccgctggccgatgtgttgccgaccatctataacaaatatccggtgcgttatcgcgactataccctgcgcgagctgtgccaggagatgcacgatctgtacgttagctttgacgtgaagagcctgcaaaaagagatgttccgtaaacggagcttcccaagggtggtgatgaatccccaggatgccaaccacgagtttattcgcggcaacgttgagctggtgcgtctgagcgaggcggaaggccgcgtcgcggcggagggggcgctgccgtatccgccgggcgtgctgtgcgtggtgcccggcgaggtctggggcggtgccgtgctgcgctatttcctcgcgctggaggagggggtcaatatgctgcctggcttctcgccggagctgcagggggtttacagcgagacggatccggacggcattaagcggctgtatggctacgtgctgaagggataaaaaaacgccccgccgaacaggcggggcgttttacttttgccgatcacacgctctgctgggcggcggtcggttgtctgacgtgtttgtatttgaacagcgccacgaaggcaaaggccagcaccagcgaatagccggcgaaaatcagccacacgctctgccagtcagtgatcccctcgacggtaaagtgttcgacgactttgccgctcaccatcccgccgagaatacagccgaagccgttggtcatcatcaggaacatcccctgagcgctggcgcggatttccgggcgcacctctttctcaacgaacaccgaaccggagatgttaaagaagtcgaaggcgcagccgtagacgatcatcgacagcaccagcagtacagtgccgaacggcgtcgggtcgccaaaggcgaacaggccgaagcgcagcatccacgccacaatactgataagcatcacgttcttaatgccgtagcggctaaggaagaatgggatggtcaggataaacagcgtttcggaaatctgcgaaatcgacatcagcactgacgcgtgctcgacgataaagctgccggcaaacagcggatctttatcgaagctgtgcaggaaggtgttaccgaacatgttagtgatttgcagctcggcgccgagcatcatcgagaagataaagaagatagccatacgcttgtttttaaacagcgcaaaagcgttcaggccgagcatctccgtccagctttgattgcgctgggcgttggcgaccggaatatgcggcagcgtcagggtgaacagagtcagcaggaccgacagcgtcgcgccaatgtacagctgcatatggctcagttcaaagccggagaagctcacgccccacatggcgaggataaagccgatggtgccccagatacgaattggcgggaaatcggtgacaatatccagccccgccgactgcaggcggtagtaggagatggtattgatcaagccaagcgtcggcatataggccagcgagttaagcaggatcacgaggaacatctcgcccggcgtggtgacctgcgccgcgaggtacagcgttaacgcgccgaccaggtggcagatggcgtatacccatttggcgctgatccacttatcggcgacgatgccgagcagcgtcggcatcaacaccgcggcgataccgagcgagctatacactgcgccgattgccgcgccgtcaaacttcagcgtgacaaacatgtacgagccaagcgtggtgagccagctcccccaaaggcagaactgcaggaacgacagtattttgagctgcagcttaagattcatgtagttatcctcacaaatgtgggcttgttatgtttttaaaataacattaatcccgttattttgatgcgattctatcattcactagcttaatgcttctgttaactgccgcagaaaaccgaaagatattacagagtatggcggagaataagcgcggcctcagcgcggggctgaggccggagtcgggaggagggctatttacggcggtagcttttctgcgccgtattaactttgtacagatagcggcgcgattccgccgacggatggcgggtggtcagcgtctggtagacgtcccctggcgccatgctgttgataatattggccgcctgcactttatcgctggagaagacccgcagtacgctgccggcgccgccgttataggcagtgatcaccgcgtagcgacgcgaggtggggttatcgatgccggcgaggtaaacattgttcagcatcgccaggtaggcggtaccggtgtcgatgttattcgccgggtcaaacagatagctgcggcttggcaggccggatttaccctgggagcggaagacgtctctgccggcgctgtgctggaccacctgcatcagccccatggcgtcggcatggctgaccgcataggggttaaaggaggattcggtctgcataatcgcgaggatcagcgactcatcaaccccatacttacgcgaggcctgacgcaccatgccgaggtatttatgcgcacgtttgtcgaggtggttcggcaccaggttaatggtgatgctgtagaccacgcgcaggccgttgttgcggctcttcagacgggtttgcagcagatagtcggcaaagcgcgcggcgcgccactcccagcgaatcgacgccccggtgttatccaccacctggccatagaggaacggctctttggagatctggatgtcatcgacatcggaatagaggtcaatggagttggggtcatcgcccatcaacagggttttgacgatcgcctggcgcagtcgtccgcgagggtcggtgccggcaatggtctcgacggtgatcgtcccttcatcgaagttgatgtggctgcgggtttgatactggtcggtgtacttgacgtagtcctttggcccggcgagcaggacttcgttgtacccccaaatgttctcgatgttgtgggcgaactggcccatcaaaatatcgaatccgttcgtgtccttgacccaggcctcgttgtattcggcgccttttttattggagctggaacacgaaacgagcaacggcgcaatcagcgcgagcgctaagtattttttcatcattccgggcgtgcgtgttgtgtttgtttttttaaaggccgcagggcccttactgtttttccggcggcgtgtagccttcgatgtgcacgtctttcccttcaaacaggaactgcaccatctcctgctcaagcagtttgcggtgctccgggttcatcatgctgagctttttctcgttgatcagcatggtctgcttgtgctgccactgcgcccaggcttctttggagatttcgttgtaaatacgctttccgagctcgcccggatacagctggaaatcctggccgtccgcttcacgctgcaggaaggtacaaaaaatggttctgctcataattaatcctctttgatagccgaaaaatttataccggcgctccggcttttagctgttgcaacaagcgctccacgggggccgccagaccgaccgacggcggctgcgctaagttataccagagtgcgttgccttcatccatgcatgcgccagatgagtgcactgtaagccacatcggcacaatatccaggtggaaatggctgaaagtgtggcgaaaagcggttaattgcgtcagattatcggcctttatctggcgctgcgccagccactcgcgtagctccgcttcgtctgcaaactgcggaaaacagaacaacccgccccacagacccaccggcggacgctgggaaagaaacacctcgtcgccgtgctgcatcagcaggaagtagccggtgcgttccgggagggtctgcttcggttttttgcccggatattccgcccatgaatggttcgcgtaggccacgcagccgttgctcagcggacacagctcgcacttcggcttcgagcgggtgcaaaccattgccccgagatccatcatcgcctggttgaagcgctcgacgccctctgccggggtgacctcttcgctgatgtcccacagccgtttttccacctcttttttccccggccagccgctgacagcatagcagcgggcgagcacgcgcttcacgttgccgtcgagaatcggataatgctgaccgagcgaaagggataaaatcgcccccgccgttgagcgcccgacgccgggcagcgccgccacttcgtcaaaggtccgggggaattccccgccgtgcagtgtggcgacttgctgtgcggctttatgtaagttgcgcgcccgcgcgtagtagcccagaccggtccacagatgcagcacctcatccagcggcgcgttggctaaatcaaccaccgtggggaaacgcgccataaagcgttcaaaataggggattaccgtggtcacctgggtttgttgcaacatcacttcggagagccatactttgtagggcgtcttggcgatttgccagggcagggttttacgcccgtatttgtcgtaccagtccagaacctgggctgaaaattgcgtggcgagaaaagtcaaagctacggctccgggatcgcgattacaggggggcagattgcagcataagggcgagtggctgtaaacccttgcatccgccgggtaactttggataatgcccgttttccgaacacattcacaagcagaccaaacttttatgaaaaacgacgtcatctctccggaattcgatgaaaacggtcgcccgctgcgccgtattcgtagcttcgtccgtcgccagggccgcctgacgaaagggcagcagcatgcgctggataacatttggccggtgatgggcgttgaattcaacgatgcgccgctcgatttcgccgccctgtttggccgtgacgcgccggtcaccttagaaattggcttcgggatgggcgcctcgctggtggcgatggcgaaagccaaaccggaacagaatttcctcggcattgaagtacactccccgggcgttggcgcttgtctggcttccgcggaagaagaaggcgtacaaaacctgcgcgtaatgtgtcacgatgcggtggaagtgctgcataccatgatcccggataactcgctgaatatggtgcaactgtttttccctgatccgtggcataaagcgcgtcataataaacgtcgtatcgtgcagccgcctttcgctgagctggtgaaaagcaagctgaagctcggcggcgtcttccatatggcgaccgactgggaagcttatgccgtgcatatgctggaagtcatgtcctcgctggaaggctatcgtaaccagtcggcaagcaacgattacgtaccgcgcccggaatcgcgcccggtaaccaaatttgaacagcgtggccatcgtctcggccacggcgtatgggacttaatgttcgagagggtgaaataatggccaagaatcgtagccgtcgtctgcgtaaaaaaatgcatatcgatgagtttcaggagttaggcttctccgtcgcctggcgtttcccggaagggaccagcgaagagcagatcgaccagacggtcaacgatctgatcgaagaggtgatagagccgaacaagctggccttcgacggcagcggttatctctcctgggaagggctcatctgcatgcaggagattggtaagtgcactgaagagcatcaggctatcgtacgcaaatggctggaagcgcgtaagttagaggatgtgcgcaccagcgaactttttgacgtctggtgggactaagtttgacaagggtcggcaattgccggcccgttttgtcttaagggagttttatgatgcgtaaaacgctgctggcggtggcgctctccatcaccgctttgtctgcccatgcggactaccagtgtagcgtcacgccgcgtgacgatgtgatcctcagcccgcagcaggtgcaggtgaaaggggaaaacggcgatctggtgataaagccggacggcaatctgacctttaacggcaaggcctatgcgctcagcgccgcccagcgcgaacaggcgcaggattatcaggccagcctgcgcagcagcctgccgtggattgaccaaggcgcgcggtcgcgagtcgaaaaaagccgcaaggcgctggataaaatcattaccgaacaggttggcgccaacagcagcatgcacggtcgcctgaccaaactggacgcgcagctgaaagaacagatgaaccgcattatcgaacgtcgcagcgatggcctgaccttccactataaagctatcgaccaggtacgcgccgatggccagcagctggtgaatcaggcgatgggcggcattctgcaggacagcattaacgagatgggggcgaaagcggtgctcaaaggcggcggtaatccgctacagggcattctcggcagcctcggcggcctgcaaacggcgattcaggaggaatggaaaaaccaggaggccgatttccagcagttcggcaaagatgtttgcagccgggaggtatcgctggaggacagccgcaaagcgctggttggctcgttaaaataatcaaaatttcgcggcccgcatacctttgggccgcgcacttctccactcaggcgcggccgtgcgacacgcgtgaacggcgagccagagaatcaatgattaccgcaatcgccagtaccgcgccggtaatgatatagcgcagcgaagacggcaggttcaacagcgtcagcccatttgaaatcgactgaatcacgatgatccccaatagcgcggaccaggcgctgccgcgtccgccgaacaggctggtgccgccgatcaccgccgcggcgatggcgttgaggttgacgtcgccggtgccggcctgctggctggcggaagccagtcgcgacgccgcgagaatgccgccgaaggtcgcaagcgtggtacacaggacgaaagcgctcacataaatcgcccgcacgttaatgcccgaacggcgcgccgcttcacggttgccgccaaccgcgaacatcgagcgaccccattttgtccgtttcagcgcgtagctgaggatcatcacgcaggcgacaaagagaccgaaaatccatggaataccgcgcccctgattgaggtaaagcaccgcggcctcgaagataatcgtcagcgcgatcgcgcgcgccactagcgagctgactccctcggcggaaagattggccgccaggcgccgcgagcgttttttcaggccaaaaataaggatcgccagccctggcagcaatgccatcaggtgtgagaaccagccgggcatcaccagcagttggccaaagcgcaccagcggcgaagtatagggcaggttgatgctgccgctcggcccgaggatatacagctgcatacccagcagcgccagcaggccggcgagagtggcgacgaaactcggcattccgacgcgggtatacagcagcgcatagaccaacccgacggccacgccgcaggccagcgccacggcgatggctcccgccagcggccatcctgcgttcacccacagcacgccgacgatagccgatgccaggccgctcatggagccgaccgacaggtctatctcaccaagcattagcacgcagacgatgccgagcgagataaacccgaccgtcgcgcagtcaaacagcaggttcaccaggttattcggcgcgatatagaccgggttgaggaaggtgaaaaccagggaaatcacaatcagcccggctatcaccggcgcggtgccgagatcgccggttttgatgcgggttatctgcgcgcgtagggcgccgaacagcccctcgtcgtgacgaacgcgctcatcgctgcgatccagcgcggtgtgggatgcggtcttactgttcataaaattacatcgctccggaagtcgttggctgtgatttacgttcaacccggcgtgagacggcgttttccgtcgcgccggtgatcgcggcgaccagatcctgattagaagcatcgggcgtgaagatccctttgttgcgcccgagacgcagcaccacgatacggtcggcgacggcgcgaacgtcttccatgttgtgactgatgatgatgacgccaagcccgcgctcgcgaacgcgctcaatcaggttgagcacttccgcggtctgcgcgacgcccagcgccgcggtgggttcatcgagcataatgattttagggttcagcagcagcgaacgggcgatggcgacggtctgccgctggccgccggaaagcgatgccaccggttcgcgtaccgacggaatacgtgccgccagctcctgcagcagcgtccaggctttcacttccatcgccacttcatcgagctggaacggcgaaatttcatgacccagaaacaggtttgccaccacatcaaggttttcacacagcgccagatcctgaaacaccgtggcaataccgtattccagcgccttgccggggctatcgagggtgacagggttgccgtcaaactcaatggtgccggaggtcggctggtggacgccggcgaggatcttcaccagcgtggatttgcccgcgccgttgtcgccgaccagcgcgaccacctcgccggcgtggacttctaattcgatatccgtcagcgcggacaccgcgccaaaatgtttagagacgttgcgcagttgcagtattggccgcccggcggcggagttgtgttgttgttgcggcatacaaaacgacctcaataatggcgaaatcgcgcccgccgcggcgggcgcaggggcaaaagttacttgctgatgcctaacttctggcaggcggcggcgtactcgccgctacacacctgatcccaggtctggatttttttatcgaagatttccgctttgatgtttttggccgtcaccacttccggggtaaatagctgggaaggggtgttgtacagggtggtgctggcctgcggttttttgccctggataaaatcaaccgccactttggccgccgccgcggcgacgatctccgatggcttggagatggtgttgtactgatcgccagcgatgatcagctgcagcgcggcgatagtggcgtcattgccggtgaccggcggcagcggctggacgccggcagccttaaaggcggcaattgcgccgccgccggtaccgtcgtttgccgcgaccacgcccttaattttgtcgccaaagcgggtaacctgcccggcggtccactcctgggctttcggcggcgcccactccggggtgtcgaattcggccaacgttttgtaaccggactctttcaatccgcgatggataccgtcgcggatcagccctgcggcggcatcggttggcgaaccgttaatttgcagcacgccggcatcctgcggcacgccgctcgctttcagatggtcggtaagagattttgcgatggcgtagccaatgccctcgttatcaaatgagacgtagaaatcagccggtttgtctggtaccgggcgatcataggcaatgaccttgaccccctgcgcttgggcgttttcgaccagcgcggcggcggcggaagaatcaaccggatccaggacgatcactttcgccccctgggcgataaccgagttgaactgctgctgctggagcgacgcgttggcgttggcattctgatagatgaccttacaatccgcgcaaagcttgctcatttccgccttaaaaccggggaagtcgtgctgttcatagcgggtagaggcctgatcgggcattaaaaaggccacggtggcggactctgcagaccaggctgaagccgtgacggtgccggatagtgcggcgagtgtgataaaaatattacggtaattcattgtgttaccctcttttttataggcttaagcccgccgggttgcgccgacgttacagagacttttttaatcagagttaccaataattcacatgtaggatacgtcggttttacatttgctcaaccgatgaagcaggattaccactgcgcaaaaaatgagtcaagaaaaggaaaaaagtcgatcggattttgtgattcgctgcaaataagtgaacaaaaaaacgccagtcgatttgaccgtagcgggagaggatgtaaggggaaagatacgggcgacgacgtgccgcccgcagggattactcttcgctgaggaacagctccagcagcgaatttaaaaacagtttaccgtgctcggtaatttgccagttttgcgcatcttccagcagatagccttcggcgatagcggcatcgatttgctgacggataacctgctcatcaaggccggtatacaagctgaactccgcgcgcggcgcggcctccagcaggcgaaaacggttcataaagaactcaaacggtttatccgcttcttccacatcatgctgacgctcaaggtaacggccttccatatacccgcgcgggtggcgggttttggcggttcgcagaatgcgtccgtcagggaaggtgatcttgccgtgcgcgccgcagccgatgccgaggtagtcgccaaagcgccagtagttgagattatgctgacactggaagcctggcttagcataggcggacgtctcgtactgctgatagccggcggcgctcagcagctgatgcccctgctcgaaaatatcccatagcgcgtcgtcatccggcagcaccggcggccgggagccgaacaaggtgttcggctcaatggtcagctggtaccacgacaggtgcggcgggttgagggcaatcgcctgacgcagatcgtccagcgcctcctccagcgactggtccggcagaccgtgcatcaggtcgaggttgaagctgcgcaagccgaggccgctggcgagacgtgctgcgcgcttggcttcctccgggccgtggatccgccccaggcgctgcagcttcggttcgctaaagctttgtacgccgatggagatgcggttcaccccggcgcgctgataatcaacgaagcgatcggcctccacggtacccgggttggcttccatggtgatttccgccccggcggccagcggcaggcaggcgcggacgccatccagaagggtttgcatggccgggccggacagcaggctcggcgttccgccgccgataaaaatagtgcctatttcccgtccctgggcatagtgcgcatcagcctgcagatcgttcagcagatgctggacgtagtcatcatgcggcacctcgcctttcagcgcatgcgaattaaaatcacagtacgggcatttctgcacgcaccagggaatatggatatagagactcagcggcggcaaattagccattacgtaatgcttccagtaacagtttcagcgcctgcccgcgatgggaaatggcgctcttttcttcacggctcagttcggccgcggttttcccttctgacgggacgaagaagatcgggtcgtaaccgaagccgccatgaccggcggcttgtcgggtgattaccccaggccagctgccgtggcacaccagcggcgtgggatcctcggcatggcgcagatagaccagcacgcagtggaactgggcctgacgctggtcgtccggcacgtcttttaacgcgtcgagcagcttctcaagattctgctggtcgctggcatcgacgccggaatagcgtgcggagtaaatacccggcgcgccgccaagagcatcgacggccagaccggaatcgtcggcgatggccggcaggccggtgatctgcgccgcgtggcgcgctttcagaatcgcgttttcaatgaaggtcaggccggtctcttccgcagagtccacgccaagctcggtctgagcgacgatatcgagaccaaaatcttccagcagcgaggccagttcgcgcactttgccggcgttgccggtagcgaggacgactttttgcatgatgaatcctgtttattcagttagcgccgcgaccgcagtcgggatctgttgtggggcgatgattttaacttgcttatggcggcccagctcacctttttcaatcagtacctggcttttggcgacgcggaactgtttggcgagaaatttcaccaggtgggcattggcctggccatcaacgggcggggcggtaatggcgactttaagctcgtcgccatgtacgcccacgatgctatcgcggctggccttaggctgaatgtacagcctcagcaccagcccgtcagcgcaggtttcaacggcactcatagcgccatccacagccccggcagcagtacattaccggtggcctgcagcacttcggcgatgcccatattgattacgtacaacagcaataccagcaccatcggcgagaaatcgataccgcccatcgacggcagcaggttgcggatagggcgcagcagcgggtccgccagctgcatcagcacatactccaccgggctacggccctggctgacccagctcatgatcgccatcaacagcagtacccagaagatcaacgagccgatggttttcagcagaataagcagagcggagatccagatgatcggctggaaggtgatcaccataaacagcacgatcgctttgatgacgcagagaataaatgccaccagcagcgaggcgctgtcaatcggccccattgccgggataatccggcgcagcggtccgacaatcggctgcgtggctttcaccacaaactgcgaaaacgggttgtaaaagtcgcagcgcgcccactgcatccagacgcgtaacaacacgaccatcgtgtaaagctcaatgaccgttgaaagcaggaaagtcaacgtcttcatggcgttcctcagattccttattatttgctgtagtcgcgcgcaccaaaaatggcagtaccgatgcgcaccatcgtgcttcccgccgcgattgcggcttccatatcgtccgacattcccagagacaacgtatcgaccgtggggtaccgcgtttttaatcgcgcaaatgctaccgccatttgccgggcgacggcaaactgccttacatattctgactcaggcgcgggaatggccatcaggccgcgcagttccagatgaggtaactcagcgatctccgccgctaagccgtcgagcgcttccagcgggatgccggatttgctctgctcatcgctgatgttaatttgaatcagcaccttcagcggcggtaaatgcgccgggcgctgctcgttcaggcgggtggcgattttcagccgatcgacggtgtggcaccagtcaaaatgctctgccaccaaccggcttttgttggactgcagggggccaataaagtgccactgcagcccgctgacgccagcctgctggaaatggttaatcttctccacgccctcctggacgtagttttcaccaaatgcccgctggcctgccgcaatggcttcttcgatcgcgctcgcaggtttcgttttactcactgcaagcaatgtcacttcttctggcgcacgcccgcatcgggcggcagcaccggagattttgtcccggacctgtgccaggttatgcgcaatatcgttcatattccgaggatgagttatgaagctggaagaaatcgtagcccttagtgtaaagcataatgtctccgatctacacctgtgcaattccgccgcaccgcgctggcggcggcagggcaggctggagcccgcgccctttcccgcgccggatattgcgaatttactcaacgactggctcgatgccgcacagttactgcactggcaggaacacggccagattgactttgcgctgaacctggcctgcggtgcgcggctgcgcgccagcgccttcgcccatacgcgtgggatatcgctggtgctgcgcctccttcctgaacagtgcccgcgtctggatatgctcggcgccccgcctgcgctgagcgaactgctggcggaagagagtggtttgctgttggtcaccggagcgacgggcagcggcaagtcgaccaccctggcggcaatggtggggcacctcaatcagcatcttgatggccatattctgacgcttgaagatccggtggaatttattcatcacagcgagcgctgtctgatccagcagcgggaagttggccgtcactgtccttcgttcgccgcggcgctccgcgtggcgctgcgccaggatccggatgtgatcctgctcggagagctacgcgacagcgaaaccattcgcctggcgttaaccgcggcggagaccgggcacctggtaatggcgacattacatacccgcggcgcggcgccggcggtggagagattgatcgatgtctttccggcggaggagaaagatcaggttcgtagccagcttgccggaagcctgtgcgcggtgctggcgcaaaaattgttacctgcacgtcagggcgggagagttgcgctatacgagcttctggtcaacacgccagcggtggcgaatttgatccgtgaaggaaaagtacatcaattgcctggtgtgatgcagaccgggatgcaggccggaatgttgacctttacccagagttttcagcaacgtgtcgctgcaggcgcgctataagatgagaaagagattgatatgacaggttaaatgatatgttagatgaatgtttatttgttgtttattaatattatttggtaatacaaataacttttgattataaattcaaataacacattcagattagatatgtcgacagtgaatacgcatttccaggaaaaaagtttgattatcttttgacagctttgagtcattcgatttatgctgtttgtgggaataggatgattctcatggaataacgtttcagtttgtaaattaccttggtgatttataaattcacgactgtttgtatctttttttattcatttaaccaccatggcggtgggtaacagctaaggagagttttaagtgattaatttaaatggaaattcatcatcttctcgtcaggtaacctttattacccacccgtctattcaaagcaaagcctttgccagctatctgagcgaaaccctgatggcacaggtggttttacaaaatattaataaaccgctggcgcagcgtttggcaaaagattctgtaatattatttgatattgcagtgtcaaataagaaattaaacggggtgtggcgggatattattcgcctgcaggcagataatcctcgtttgttgattattaatagcgcacaaaagtatgagctatacgaaatggcgcagtggccggctttatatggcgtgttccgtcatgacgatgatgaatcgcgcttaattgagggcgttaaggccgtgctgaacggcgagcagacggctgaattgagcgtgatgcacccggcgatgtacgctgcggaccatgcatcgactccagtagagaactcgccgctgaccgagcgggaatgcgagatcctcaacgaactgcgctgcggcgcaacgaacctggatatcgcccgcgcgctgtttatcagcgagaacacggtgcggacgcacctgtacaatgtgtttcgtaaactgagcgtgaaaaatcgcacccaggcggtgagctgggctaacgaacatctgcgccactaagcgggtaaacgtgcgccgtcagcggtccgccggcggcgcaggagggcagagtttaaaagctctgctcgaagtagctttccagtatgactacggcagaggctgaatcgacgctgcctttattcagcgcccggtagccgccgtgttcaaacaggcccgcgcgggcctcaaccgtactcagccgttcatcgtggagaaggatcgcgacgccaaagcggccatgaattttattggcgaaattacgcgcgcgcgccgtcagcggttgctcggtgccgtccatattgagcggcaggccgacgattaccgcctcaggctgccactctttaagcagtttttcgatgacgttccagtccggtttaccatcctgcgccttcagcgccggtaatggtcgtgcggtcgcggtgatgcgttgtcccaccgccacgccgatgcttttggtgccaaagtcaaagccgagaaaggttccgctcatcacgcatgccccgcgacgcctggcatcgtcacaatgtcgataccaatcagtttagccgcctcgcgccagcgatcggcgatcggcgtacggaaaagaatattctgatccgccggggcggtgagccaggcattatctaaaatctcctgctccagctgccctttctcccacgaagagtagcccaacgcaaccagcacgttgcccggctgccgatcggttcctaaggtttcaagaacatcccgcgaggtggtaatcaccgtgttatccgagatgcgaatgctcgaggaaaagtcagagggcggggtatgcaaaatgaagccgcggtcttccgccagcgggcctcccagcatcaccggtttatccagacggatctctggattgcgcggctccgggacaattttgagcttctcaaggatcccttccacctgcagattttccagcggcttattgataataatgcccatggcaccctcgtcgttgtactcgcagatatagactacggagcggcggaaaatggggtcctgaagcgcgggcatggcaatcagaaagtgatgctgtaaattcattgtcagaggttcgttcctggttcaaaaaagcaacacccagtatgcgggcaaagtagaatggtgtcgatgcactttatctggctggcgcccgagtggcgtcaggctggcaacgtttcacgagcgcggtaatccgcgctcgctgcgccaaaagcggacgttggtccgccgtcgtgcttatttatcgatacgtctttcgatagcgtccatcagcataccggtgatcgaaatatccgggaaggcggcttcgatttcgcgtccgcaggtggggctggtgacgttaatttccgtcagacggtcgccgatgatatccaggccgacgaagataaggcctttggccttcagcgtcgggccgacgcggcgggcgatttcccagtcgctttcggtcaacgggcgggcttcgccgcggccgccggcggccagattgccgcgggtctcgccaccctgcggaattcgcgccaggcagtaaggcacgggctctccatccactaccaacacgcgcttgtcgccatctttaatggccggcagatagttctgcgccatgcagtagcggctgcccagttcggtcagcgtctcggcaatcaccccaaggtttggatcgccggctttaacacggaaaatagaggcgccgcccatgccgtcgagcggtttcatgatgatatcgccgtgcttttcccagaaggctttcagctgggctttattgcgggtgaccaacgtttccggggtcagttcagagaaccaggcggtgaacagcttctcgttacagtcgcgcagactctgcggcttgttgacgataagcgtgcctttctcttccgctcgctccaggatgtaggtggcataaataaattcggtatcaaacggcggatccttacgcatcaggatgacgtcaaggtccgccagcggcagatcctgctcgccggtgaagtcataccatttatcgtagttctgttcgacgctcagcgtgcgcgtccgggcgcgggcttcgccgttgatcaaatagaggtcgttcatctccatataatggagttcatagccgcgacgctgcgcctccagcaacatagcgaagctggtgtctttcttgatgttgatggttgcgatgggatccatcacgatgccgagcttgatcatggttcttctccgttaacgcctcaacctaagtcgccaaaacgcacctgtagggcggtgatggcggtgagcgcagtagtctctgtacgcagaacgcgcggtcccaacaggatatcagtaaactggtattgcgcggtcatcgctatctcttcagccgacagcccgccttccgggccaatcagcagacggacgcgttcaaccggcagcggcagcgtgttaatgctggcgctggcgcgcgggtgcaggttgagcttcagcccgctgtcctgctcggcgcaccacgcctccagctgcatcgccggacgtatttccggtaccacgttacgaccgctctgttcgcaggcggcaatagcgattttctgccactgctggatctttttctgcaaacgttcggcatccagtttaacgccgcagcgctcggaaaacagtggcgttatgaggcttaccccgagttcgatcgatttctggatggtgaattccattttttcgccgcgggacatcacctggcctaaatggatatgcagcggcgattcccgatcgtcaggttcgccactgagcacctcaaccgtaacgtttttcttaccggcctcggtgatgaccgcgtcaaacacctggttactgccgtcaaaaagctgtaggtgctgaccggcggtcatgcgcaggacgcggccgacgtggttggccgcgtcatcgctcagcgcgatctggctgccgacaatgaggcgttctggatgatggatgcgaggaatgcgcatgcttgatattccgttcgttgcgcagatgccagcttcccgccatcgggcgggaagcacagggctgcaaattaacaattgccgctagtgtaggttagctcttttgcgcctggcaagcctgctggacatacggattatggttgccctgcactttcgcgatgcgctcatcacgttcacattcccaggcggtgaccgggtactgtttattccaggcggtaaacagctgagtttgctggcgggaaagattcagctgatagcggtcgcgcatatagaagtaggtgcgggcgatggcgccgcgagcgcgggcagggggctcggcgattttatctttaaaatcgaccttcatggtgcactggccgtactggccttcaccgccgttccactggctgtacataaagttgccgcgatcgccattcacttctcccaccgccggctgcaggttgtgcatatcgctttccatcttgcggtattccggatctttggcgcagtttttacgtccaccctcctgccagcactgacgctgatggccgaactgccatgccggcactacgtgctcccattcaacccggctggcgcggttctcatttttacgcactttatagccgcaggattccaaatcgataacgccttttttcccctgccagtcgattttacagccgcaataaaaatcgcccggaacgtcggcattcactttgacgccagcggctttggcctgggaaaaactattaataccagcggccgcaagcggaccactgactgccgcgctcaataccgctacggctaaaacatgcatacgggacatcgttaactccgtgtcaaaacgagcccgcaacgtagcgaatgagggtgccggatgcaatcagtcagatcagaaagtttctaattaattccgatggttatttttcagccaccagcagatcgccgcagcgaacgcagcggtaggtggcctcgccgcgtaccacccggttatggcgacggacggtgagctggtgctgctgacagcgacagcgataggggaaggtgttctggcggaccgaagcgagttcaaagcggtgggtgcgacgcgcgggaacgccaaggacgctctccatcatccatttccactctttcccgtgcggcgcgacgcggccgaaatgctgccagaccagcaggtgcgccagctcatgcggcaccacttcatcgataaactcccgctgattttccagcagcagcaccgggtttaaacgaatttcgtttttctccagccaggcggtgccagcggaagtaccacgctgctggtagaccagcgtcggttccgcatagcggcgttccagcttgcgattcgcattggcgagatgctcccgcaggctgcgcatgacggcctgctgaatagcgatgggaatacggggcgttttcatagcgccagaggatagtgcggcggaggggggagagcaagaggaagcttcctcccgggatgggaggaagctcaggaaggttaatcgcgggcaccgatctcgcgcagtggacgaccctgcatcaggttacgttcaatatgttccagcgagacgtttttggtttccgggatcagccacagcgtcagcaggataaacagcacgttcagaccgccgtacacccagaaggtattggcgctgcccagcgagttgagcatggtcaggaaggtggcgccgacaatcatgttggcaatccagttggtcgctgtggagcaggtgataccgaagtcgcggcctttcagcggctggatttcggagcacagtacccaaatcagcgggccggcgctcatggcgaaaccgacgatgaacatcagcagcatcaggacggcgatgtactgcgcggtagaggagtgaatgccgatgtgcatcatggtacccaggacgcccatacccgcggccatcacgataaagccaaggatcagcgtcggtttacggccccagcggtcgaccagaccgatggcgataaaggtggccagcacgttagtcagaccgacgatcactgtcccccacatttgctcagtggtgttggcataacccgccagctcaaaaatcttcggcgcgtagtacatgatgacgttcatcccggtgaactgttgcatcacctgcagcaggatgccgaggaacaccgcgcggcggaagttgctgttgtctttaaacagcgaccagccggactgttttaccttcaggctttcacggatttcatcgagctcgcgtttcgcttcggcgctagtatcgcgcaggcgcagcagcacgcgttccgcatcgacaaagcgacgtttggcggcgaaccagcgcgggctgtccggcaggaagataacgccgatcagcagcaataccgccggaatgatgataaccccgagcatccagcgccatgcgccgctgtagctgaaagcggtgtcagagagataggcgccaaggatcccgatggtgatcatcagctggtacatggaaatcatactgccgcgaattttttctggggcgatttccgacagatacagcggagccgtatatgaggcgacgcccaccgccaggccgagcagcacacgggaaaccagcaggatctcgacgtttggcgcggcggcagagaacagcgaaccggcgacgaagaggattgcgccgatcatcaggctctttttccggcccagtttgaaagagagccagccgctgccgaccgcgccgacggcagctccgaacatcatggagctgaccacccactcctgggtgtgggcggaaatctggaactcattggcaataaagggtaaggcacccgcaataacaccgatatcaaggccgaacagcaggccagccagcgcggcgaggaaacagacgaagaacgtcatagtcttgttcgaacgcccttgttttttgttgtcaggcataacgccctccagttgagttattgattctgtcgatggttagggtaggacactcgtcggtaaaaaaacgtgactataatcacggctgtgtaatcgtttccacaaaggtaaagaaacgtaattcattaaatgctttttaaatcagcaatataaacaaggatagacgacattttgaaaaacggtaatcagagttgaccgaaacaatatgtaacattgtgaaaaatgagtacaggagatagcgtctttgggcagaaggtgacagtctttactatgtaatcgctttcattttttggcggccgcgcgttgaaatgggggcgcagaaaaggggggaggcgtaaataaaaaggccagcgcgaggctggccttgaagagaggaagcgcggagattatttcagaccggccgcttcccgcagcagcgccgctttgtcggttttttcccatgggaaatgttcgcgaccaaagtgaccgtaggctgcggtttctttgtagatcgggtgcagcagatccagcatctgaatcagaccgtatggacgcaggtcgaagaactcgcgcaccagcagggtcagctgttcagaaggcactttctcggtgccaaaggtttccaccatgatggacgtcggttctgcaacgccgatagcgtaggaaacctgaatttcgcaacgatcggccaggcctgcggcaacgatgttcttcgccacatagcgcgccgcgtaggctgcggaacggtcaactttagatggatctttaccggagaacgcgccgccgccgtggcgagccatgccgccgtaggtatcaacgatgatcttacgaccggtcaggccgcagtcgcccatcgggccgccaataacgaaacggccggtcgggttgatgaagaatttggtggacgcgttgagccattcggtcggcagaatcggcttgatgatctcttccatcactgcttcctgcagggatttctgattgatatcttccgcgtgctgagtcgacagaacgaccgcgtcgatgccgacgattttgccgtcgtcatactggaaggtcacctggcttttcgcatccgggcgcagccacggcagggtgccgtttttacgcacttcagcctgacgctgcaccagacggtgagcgtaagtcaccggcgccggcatcagcacgtcggtttcgttagtggcgtagccaaacatcagcccctggtcgccggcgccctgttccagcggatcggcacggtcaacgccctggttaatgtccggagactgtttgccaatggcgctcagtacggcgcacgagttggcgtcaaagcccatatcggaatgcacgtagccaatttcgcggacggtgttgcgggtgatctcttcgatatcaacccatgcgctggtggtgatttcgccgcctaccagcaccatgccggttttgacataggtttcacatgcgacacgcgctttcggatcctgctcgaggatcgcatccagcacggcatcggagatttggtcagcaattttgtcaggatgcccttctgatacggactcagacgtaaaaaggtgttttgccatattttatttcacctgtggacgattcggatagctcatactgttgtgtaatgtggctttggtggataatcagcgcaaagccgcgcaggtagcgacacgagcagtctgagtgttaatcagtatagacggattaacttctggacggccattttaggtcaaatcttgagcccatttccagccttttttgatggcggtcgcatttatgggaaaacccgcctggcaaaatttcctgacaaccgcgcaaacaggcacatttttattttgctttttaccccgcttctcggtataaaacgccgcgcgcggctcattaaaaaagcgcacggggcatggccctgtggtgccacttccagccgggttaagcagtctgtatttacagaatctcgcagcggcgtagcgcctgttgcccggtatgtatagctttggcttgtcgccgaccctgtcgcagggcggtgtggaggtgataccagataatgaaccaatgtttttcgtttgattcgtcgcgtcgttctgtcgcgcgtcagcactccgcaacctgcatctctctcatgcaaaccagccgatgttcaccccatctcggcgcttctcaggattccagggccggtcggccgtcagaaaactgaacaagggcgctcttgcctggcaagagttttctcgtggtttctccggactgtcatactctgttcggctacgtgttttacgatgatatgaataagaaaccggtcgcgcagtcgcaaaaccagcagatagtgctgggctttaggactgttcatgggttgttatcgcatctttggactgcgatagtagttaactgtcttacacttattattaaaaattgaggttcgctatgtctgacgacatgtctatggtttcgccttcgtcagcaggcgaacacggtgtactacgttccatgcaggaggtagcgatgagctcccaggaagccagcaagatgctgcgtacttataatattgcctggtggggcaataactattatgacgtcaacgaactgggccacatcagcgtttgcccggatccggacgttccggaagcgcgcgttgacctcgcggaattagtcaaagcgcgtgaagcgcaagggcagcgcttgccggcgctgttctgcttcccgcagatcctgcagcaccgcctgcgctcgatcaacgccgccttcaaacgcgcgcgtgaatcgtatggctataacggcgattacttcctcgtctacccgatcaaggttaaccagcaccgtcgcgtgattgaatcgctgatccattccggcgagccgctgggcctggaagccggttcgaaagcggaactgatggccgtgctggcgcacgccgggatgacccgcagcgtcatcgtctgtaatggttataaagaccgcgaatatatccgtctggcgctggtgggcgagaagatgggccacaaggtctatctggtcattgagaagatgtccgagatcgctatcgtactggaagaggccgagcgcctgaacgtggtgccgcgccttggcgtacgtgcgcgtctggcctcgcagggctccggtaaatggcagtcctccggcggcgagaagtccaagttcggcctcgcagcgacccaggtgctgcaactggtcgaaattctgcgcgaggcaggccatcttgagagcctgcaactgctgcacttccacctcggttcgcagatggctaacattcgcgatatcgccaccggcgtgcgtgaatcggcgcgtttctacgtcgaactacataagctgggtgtcaacattcagtgcttcgacgtcggcggcggcctgggcgtggactatgaaggcacccgctcgcagtccgattgctcggtgaactacggtctgaacgaatacgccaacaatatcatctgggcgatcggcgatgcctgcgaagagaatggcctgccgcacccgacggtgatcaccgagtccggccgcgcggtgaccgcgcaccataccgtgctggtttccaacatcatcggcgttgagcgtaacgaatacaccgaggcgaccccgccggcggaagacgctgcgcgtccgctgcagagcatgtgggaaacctggcttgagatgcacgagaccggcaaccgccgctcgctgcgcgaatggctgcacgacagccagatggacctgcacgatatccacatcggctactcctcaggcaccttcaacctgcaggagcgcgcgtgggcggaacagctgtatctgaacatgtgccatgaggtgcagaagcagctcgacccgagcaaccgcgcccatcgtcccatcatcgatgagctgcaggagcgaatggcggataaaatctacgtcaacttctcgttgttccagtcgatgccggatgcctgggggatcgatcagctgttcccggtgatgccgctggaagggctgaacaagtcgccggagcgccgcgcggtgctgctggacatcacctgcgattccgatggcgccatcgatcactacgtggacggcgacgggatcgccaccaccatgccgatgccagaatacgacccggagaacccgccgatgctgggcttcttcatggttggcgcctatcaggagatcctcggcaacatgcataacctgttcggcgataccgaggcggtggacgtgttcgtcttccctgacggcagcgttgaggttgagctgtccgacgagggcgataccgtggcggatatgctgcagtatgtgcagctggatccgaatacgctgctgacccagttccgcgatcaggtgaaaaataccggtctggacgacgcgctgcagcagcagttcctcgaggagttcgaggcgggactgtacggctatacttatctggaagacgagtagctgctgatgcccggtggcgctgcgctgaccgggcctgcgtatgtcggccggataaggcgaagccgtcatccggcagcatgcgatactcacttgaacccgtatgcattaccggcgataattcacgccaataagcgatttatctatcaaacccttcctcgtcgggcctaacgacgcggaggggtttttttatacttattttttacgttccacgactgtcaaaagaggtcatatccatgagcactttaggtcatcaatacgataactccctggtatccaatgcctttggctttctgcgtttgccaatgaactttatgccgtatgaaagcgatgcggactgggtcatcaccggcgtgccgttcgatatggcgacctccgggcgcgcgggcggccgtcatggcccggcggcgatccgtcaggtttctactaaccttgcctgggagcacaaccgtttcccgtggaacttcgatatgcgcgagcgcctgaacgtggtggactgcggggatctggtgtacgccttcggcgacgcgcgcgaaatgagcgagaagctgcaggctcacgccgagaagctgctggcggccggcaaacgtatgctctcctttggcggcgaccacttcgttaccctgccgctgctgcgcgcccatgccaagcactttggtaaaatggcgctggtgcacttcgatgctcacaccgatacctacgccaacggctgcgagttcgaccacggcaccatgttctataccgcgccgaatgaagggcttatcgatccgaaccactccgtacagatcgggatccgcaccgaattcgacaaagacaatggctttacggtgctcgacgccggccaggttaacgaccgcagcgttgatgacgtgattgcccaggtgaagcagatcgtcggcgacatgccggtgtacctgacctttgatatcgactgtctggatccggcgtttgcgccaggcaccggtaccccggttatcggtgggctgacctccgaccgcgcgatcaagctggtgcgcggcctgaaggacctgaacatcgtcgggatggacgtggtggaagtcgccccggcctacgatcagtccgaaattaccgctctggcggcggcgaccctggcgctggagatgctgtacatccaggcggcgaagaagggcgaataaccccggtaaccccctgtgccgtacggtacagggggttaatcaaggcgcaggccgctgggcccgcgaccgccgtcaaggcgcaccgcatactgggcgatacagtccacaccgaagccgaccggtccctgggtaaaccccgatttgaaggtggcgataatcccctggccccattcggctttatccggcaacccatcgcgataatcacgtttggtatataccctaaatatttcgagttgccggacaaaacggctagccgttttgaacagcgcttgcgctggccccgtaggggcgaggcccagggataggccgagttattgccaacgcacatgcagcttgaagtatgacgggtataagcgttacgtaaaaagagttccaagtggctgtcttcaataaagccctggctatttgattgttggctggcaaagattggtgaggaggcgctagcgcctcccgctgtcgcttatttaatgccgtcggccttcatgcgatcgcgaatatgctgggcgcgcgcttctgaggccgggtgatcgtcaaacatcgaactctgacgaccggcttccagcttggccagtttctcgaagctggtggccagtcccgacggattgataccgcgcttacgcagcaggtcgtaagagtaatcatccgcttccgattcctgacgctgggagaactgcgagttcaccagtttttcgcccagatcgcccaactgagactgcgacaggctaccgacgataccgcccgcggaggccgccgccgcacgcacggcgttggtacccagggcgacctgcatgcctttcttcacgtggcccagcgcgacgtggcccatttcgtggccgatcaccgcctcgacttcattatcgttcatcagatccatcagcccgctgtagacgcggatgcagccgttggccatggcgaaggcgttgacatccttggtctcatagaccttgtagttcacgggctgaccattgatgttatcgcccagcgcagccgcgattttgttcagccgctggctgtattcactgttggccggggcgattttcgctttggcgtccatctctttacaggcctggtcgcttaaggttttcacctgcgcgtcgctgagagagtatgcctggaaggcttcggcgcctgagctgagcagaccgttggagtccatgttctgacatccggtgagggttgctgcgatcccaagagcaagtacggttgagcgaattttcatttttatcttccacaatcttatggttgtttatccgaaaatacggcgacggcagggaaccgtattctgcgtaaattataaagagtatcgcaggatgcgggcgagcggattccggcgtagcacaacctgttccagagatttcttaaagggcaaaaggatgctccatgtacatgacttgtcgcttgggttacattgttcacacttttttccggcgtagcccaaaacgcgctctcgtcaagtcgttaagggcatggccttcaacagtccgaactggagtcaaaatgtcctcacgtaaagagcttgctaacgctattcgtgcgctgagcatggacgctgtacagaaagccaaatccggccacccgggggccccgatgggtatggctgacattgccgaagtgctgtggcgtgatttcctgaaccataacccgaacaatccggcctgggctg

SEQ ID NO: 60 - DNA, 292602 bp, Unknown
  source: /note="Description of Unknown: KP2-Mcoc1 Bacteria Sequence"
ttgagagaattttcagctctgatacagattaatcgatacgtcggtgagacgtattgataaaacagaatttgcctggcggcactagcgcggtggtcccacctgaccccatgccgaactcagaagtgaaacgccgtagcgccgatggtagtgtggggtctccccatgtgagagtagggaactgccaggcatcaaataaagcagaaagcccggtcgaaagaccgggctttttgtttttgcgtttaaaaagaaccccgtcccgaaaggtgcgggtttttttgctgtgtggggtatatctcccccggtggcgctgcgcttaccggggctacggatcctcggccacctgctggccgaggggacatcaatgccgcaaagttaccgacgtcaatcgtagtctgcttcagcctgctgctcatacatcaaattcaataacggatacggttgccccagatcgtccgtttcagagcgccctgtcaccctaaaacccatcttctgataaaacccgaccgcttgttcattctgctcatttacattggtcgtcagcttcggcgttaacgacagcgcatgctcaatcagcaacttccccacgccacagccgcggacatccggatcgacgaacagcgcatccatatgatctccggtcagcagcataaaggcgatcggctggtcttccgtattaaccgccacccacagcggagcctccggtaaaaatgcgcgtaccatctcctccaactcctttcgatacgcttttgtcagaaaatcatgcgtggcgtcgaccgaccgacaccagatcgcagtcagtttatccccttcatcaggccgggaacggcggatgttaataaccatactttctccttttctacattcttatattctaactcaacaagcgccgtgaaattttctcaccgtgtacatgcagactcgacattcacccgattcctggttatcttcagctatctggatgtctaaacgtttatacgtatgctatgaggtaatacagttatgccaattcgggtgcaggacgagctgccagccgtcaatttcttgcgcaatgaaaacgtcttcgtaatgacgacaacacgtgcaacgactcaggaaatccgccccctgaaggtgttaatcctcaacctgatgccgaagaaaatcgagacggaaaatcagttcctgcgtctgctatcaaactctccgctgcaggtggatatccagttattacgtatcgatgcgcgcgagtcgcgtaatacccctgcggagcatctgaataacttttactgtaatttcgatgagatctgcgatcagaactttgacggcctgattgttaccggcgctcctttaggcctggttgagtttaacgatgttgcttactggccgcagatcaaacaggtgctggagtgggccaaggatcacgtcacttcgacgctgttcgtctgttgggcggttcaggccgcgctgaacattctgtacggcattcccaagcagacccgcgccgaaaagatttccggcgtctatgaacaccatattcttcatccgcacgccttactgacccgcggtttcgacgactctttcctggccccgcactcacgctatgctgattttccggccggacttattcgcgactataccgatcttgagatcctcgcggagacggaagagggcgatgcgtatttgttcgccagcaaagataagcgcatcgcctttgtcaccggccacccggagtacgatgccaataccctggcaagtgaatatttccgcgatgtggaagccggtttgaaccctgagatacctcataactatttcccacaaaacgacccgcagaacaaaccgcgcgccacctggcgcagccacggcaatctgctgttcgctaactggcttaactattacgtctaccagattacgccatacgatctgcgtcatatgaatccgacgctggaataatactctatgtgagacgatcctaaagcgtttcagcattttgcctctggcaccttcgggtgccttttttatttccgaaattcacttcatacgcgaggataactttaatttcattgttatcaatgtgttaatgataaattaaaattaaaatggaaattgtttttgattttggaaattaattgagtagtcttaattgtgctgagcgaaaactgcacaacgatctttcgctcgcttccagcggatcaaccaagaggagcagcacaatgacgcagcaggcgacaatcaccgatgaactggcctttagtcagccctatggcgagcaggagaagcagatcttaacgcctgaggcggtagaatttctgacggaactggtgagccgctttacgccggcgcgcaataagctgctggccgcgcgtttgcagcaacagcaggctattgacgacgggcagcttccggattttatttcggaaactgcttccattagaaatggcgactggactattcgcggtatcccggctgatttgcaggatcgccgcgtggaaatcaccggccccgtcgagcgcaagatggtcattaacgcgctgaatgccaacgtcaaagtctttatggcggactttgaggattcgctggcgcctgactggcgcaaagtcattgatggtcaaatcaacctgcgcgatgccgtgaacggaaccatcagctacaccaacgaggccggcaaaatctatcagttgcagcccaatcccgctgtgctggtatgccgtgtgcgcggcctgcatctgccggaaaagcatgtgacctggcgtcatgaggccatccccgggagcctgttcgattttgcgctctatttctttcataactaccaggcgctgctggcgaaaggaagtggtccctacttctatctgccaaaaacacaggcctggcaggaggcggcatggtggaacgatgtcttcagttttacggaagatcgctttgacctgccgcggggcaccatcaaggccacgctgctgattgagacgctgccagcggtgttccagatggatgagatcctgcatgcgctgcgcgaccatattgttggcctgaactgcggccgctgggattacatcttcagctatatcaagacgctgaaaaaccatccggatcgcgtactgccggaccggcaggtggtgacgatggataaacccttcctcagcgcctactcacgcttgttgattaagacctgccataaacgcggcgcgtttgcgatgggcggtatggcggcgtttatcccgagcaaagataccgaacgtaaccgccaggtgctgagtaaagtcaccgccgataaagagctggaggccaacaacggtcacgatgggacctggatcgcccacccgggcctggcggataccgccatggcggtgtttgaccgcgtgctgggcgataagccgaatcagctctcggtcacccggagcgaggatgcgccaattaccgctgaacaactgctggctccctgcgagggcgaacgcacggaagccggaatgcgcgccaacattcgcgtggcggtgcagtacatcgaagcgtggatctccggcaacggctgcgtaccgatttatggcctgatggaagacgccgcaacggccgagatctcgcgcacctctatctggcagtggatccatcatcagaaaaccctgaacgacggcaccccggtcactaaggcgctgtttcgccagtggctggcggaagagctgatggtgattcaggaggagctgggagagcaccgcttcagccacggccgctttgacgatgcggcgcgactgatggagcagatcaccacctccgacgagctaattgattttctgacattgccgggctaccgcctgctggcctaatcgccagatggtgtggttcgccatttagtccttcacctatgagcctggggagccaggaaattatatggagcatctgcacatgaaaacccgtacccaacaaatcgaagaattaaacaaagaatggacgaacccgcgctgggaaggcattacccgtccctacagcgcggaagaggtggtgaagttacgcggctcggtgaatccggaatgcacgctggcgcagcttggcgcggcgaaactgtggcgtctgctgcacggggaggcgaaaaaagggtacgtcaacagtctcggcgcgctgaccggcggccaggccttgcagcaggcgaaggcgggtatcgaagccatttatctctccggctggcaggtggcggcggatgctaacctggcgtccagcatgtatccggatcaatcgctgtatccggccaactcggtaccggcggtggtggatcggatcaacaacaccttccgccgcgccgatcagatccagtggtcagcgggaattgaaccgaacgatccgcgctttatcgactacttcctgccgatcgtggcggatgcggaggccggttttggcggcgtcctgaacgcctttgagctgatgaaatcgatgattgaagccggtgcagcggctgttcacttcgaagatcagctggcatcggtgaagaagtgcggccatatgggcggtaaagtgctggttccgactcaggaggcgattcagaagctggtggcggcgcgtctggcggccgacgtgatgggggtcccgacgctggtcatcgcccgcaccgatgccgacgccgcggatttaattacctcagactgcgatccgtacgatcgtgagtttattaccggggatcgcaccagcgaagggttcttccgcacccacgccgggatcgagcaggcgatcagccgcgggctggcctacgcgccgtatgcggatctggtgtggtgtgaaacgtcgaaaccggatctcgagcaggcgcgccgctttgccgaggctatccatgcgcgtttcccgggcaaactgctggcctataactgctcgccgtcgtttaactggaagaaaaatctcgatgataaaaccatcgccagcttccagcagcagctgtcggacatgggatacaaataccagtttattaccctcgcggggatccacagcatgtggttcaacatgttcgacctcgcccatgcctacgctcagggtgaggggatgcgccactatgttgagaaagtgcagcagccggaattcgccgccggtccggaaggctacaccttcgtctcgcatcagcaggaggtgggcaccggctacttcgacaaggtcaccaccattatccagggtggcacctcgtcggtaacggcgctgaccggctcgaccgaagaagatcagttttaagccatgcccggtggcgcgacgctgaccgggcctgcaagaggacgcaggccggataagcgagcgcgccatccggcatgacgtggcgccggatgggggaaagcgatgacgcgtggtctggaattactgattgcccaaacgatattgcagggatttgacgcgcagtatgggcgttttcttgaagtcacttccggcgcgcagcagcgctttgaacaggctgactggcacgccgtgcagcaggcgatgaagcagcggatccatctctacgatcaccacgtgggcctggtagtagagcagctgcgctgcatcaccgaagggaaaagcaccgacgtcgattttcttctgcgggtgaaacagcagtacacccaacttttaccggattaccctcgctttgaaattgctgagagctttttcaattcggtctactgccgcctgtttgaccaccgctcgctgacccccgagcggctctttattttcagctcgcagcccgagcgaccctttcgtaccctcccgcgaccgctggcgaaagatttctttccggaacgcggttggtcgcacctgctgggtaaagtactgtccgatctgccgctgcggctaccgtggcaaaacaaagcgcgggatatcggctatatcattgccagtctgcaggaggcgctgggggaggaactgctcgccacctgtcatctgcaggtcgccaatgagctgttctaccgcaataaagccgcctggctggtgggcaaactggtcatgccgatggcgacgctgccttttttgctgccgatccaccgcagcgaagagggtgagctgtttgttgacacctgcctcacaacccatgccgaagcgagtatcgtttttggcttcgcgcgttcctattttatggtttatgcgccgttgcccggcgccctggtggaatggctgcgcgagatcttgccgggtaaaacgacggccgagctgtacatggcgattggctgtcagaagcacgccaaaaccgaaagctatcgcgaatatctacactacattactcgctgcgatgagcagtttattgaagcgccgggtattcgcgggatggtgatgctggtgtttaccctgccgggctttgaccgggtgtttaaggtgatcaaggaccgcttcgcgccgcagaaagagatgaccgccgcccatgtgcgggcttgctatcagctggtaaaggagcatgaccgcgtcgggcggatggcggacacccaggagtttgaaaatttcgtgctggataaacggcaaatcgcgccggcgctgctggcgctgctgcaggcggaagcggggaacaaactcaccgatctcggcgaccgcatcgtcatcagccatctctatattgaacggcgaatggtgccgctcaacctgtggctggagcaggttaacggccaggcattgcgtgatgcggtagaagagtatggcaatgctatccgccagctggccgccgccaacatctttcccggcgatatgttatttaaaaacttcggcgtcacccgccatggccgggtggtgttctacgactatgatgaaatctgctatatgacggaagtgaattttcgcgagatcccgccgccgcgctatccggaggatgagctggccagcgagccgtggtacagcgtttcgcctggcgatgtgtttccggaggagttccgccactggctgtgcgccgacccgcgcattgggccactgtttgaagagatgcatgccgacctgctgcgcgccgactactggcgcgcactgcagatgcggattaaaaacggccatgtggaagatgtctacgcctaccggcgcaagcagcgttttagcgtgcgctatggcgccgacagtaggccggataaggcgtttacgccgccatccggcaaggtgcgccgatctgcctgatggcgctacgcttatcaggcctacttaaaatgcccctctggggcatttttttatttaaccccgccatacgccagcgtcacttccttcgccgccttgatcaccagcgcgcccagctcagtcacccgatcatcggtcatacgcgagatggggcctgagatggagattgccgcgaacggttcgcgatgttcatcgtaaatgcaggcggcgacgcagcgcaggccgagcgcgtgctcctcatcatcgaaagagtagccccgcttgcgggtctgggctaaatcttccttcagatgcagcggggagaccagcgtggcatgcgtataggcatgcagccctttacgatgcagcagactggtgacctgctcttcgctcagctgcgcgagaaacgccttcccggcgccggaagcgtgcatcggcagtttaccgccgattggcgccgacatccgcatcagctgggtgcactgcacctgatcgataatgatcgcctggtggtcgctctggtcgagcaccgctaaattcaccgtttcaccggaatcttccatcagctggcgcaggatcgggtggacaatggccagcagattgcggctttgtagaaagctgctgccgaccacgaaagcatgcgcccctacggcccagtgacccagctcgccaacctggcggacgaagcccagctgttgcatggtggtcagcagacggtgagtcgtggagttgggcagacccgcctgctgcgccagttcggtcagcgcgacgctgctgtgggactcggcaatccattcgagtaatttcaggccgcgggtcagcgactgaacctgaccgccagcctgctgggcagtggcagccgcgggttttctgccgcgtttcgcgggaatgggggtagtggccatcgcgaactcctttttctgtatcgtggaaataattttcgttttatttggcaataatgcaatcacaaccggactcatcggatgagtgaagctgaacatgtctcatattgcccgttgttgtcttttccgctccggtggtttatgccagtatggtttgttggctatttggcctgagtcgagcgttgtcgggagcaagtgtgagcagcaaagttgagcaactgcatcagcagttaaaagaacgtattctggttctggatgggggcatgggcaccatgatccagggctatcgtctgagtgagcaggactttcgcggtgagcgctttgctgactggccgtgcgacctgaaaggcaacaacgacctgctggtgctcagcaaacccgaagtgatccgcgagatccacgacgcctatttcgaggccggcgcggatatcattgagaccaacacctttaactcgacgaccatcgcgatggcggattaccagatggaatccctgtcggccgagatcaactttgccgcggcgaagctggcccgcgccagcgccgacgcctggacggcccgcacgccggaaaaaccgcgctatgtcgcgggcgtgcttggcccgaccaaccgcaccgcctctatctcgcctgatgtgaacgatcctgcgttccgtaatattacctttgaccagctggtggccgcctatcgcgaatccacccgggcgctggtggaaggcggcgtggatctgatcctgattgaaacggtgtttgacaccctgaacgctaaagcggccatctatgcggtgaaagaggagctggaggcgttaggcgttgacctgccgctgatgatctccgggaccattaccgatgcctctggccgcacgctttccggacagaccaccgaagccttttataactcgctgcgtcacgccgaagccttatcgtttggtctgaactgcgccctcgggccggacgagctgcggcagtacgtccaggagctgtcgcgcattgccgaatgctacgtcaccgcgcacccgaacgccggcctgcccaacgccttcggcgaatacgatctggacgccgacaccatggcgacgcaaattcgcgaatgggcggaagccggtttcctcaatatcgttggcggctgctgcggtaccaccccggagcatatcgccgccatgagccgggcggtagcgggcctgcagccgcgtcagttgccggaaattgcggtggcctgccgcctcgccggcctggagccgttgaatatcggcgacgatagcctgttcgttaacgtcggtgaacgaactaacgtcaccggctcggcgaaatttaagcggctgattaaagaagagaagtacagcgaagcgctggacgttgcgcgtcagcaggtggaaagcggcgcgcagattatcgatatcaacatggacgaggggatgctcgacgcggaagcggcgatggtgcgtttccttaacctgattgccggcgagccggacattgcccgcgtgccgatcatgattgactcctccaagtgggaagtcattgaaaagggcctgaaatgtattcagggcaaaggcatcgttaactcaatttcgatgaaagagggcgtcgaatcctttatccaccatgcgaaactggttcgccgctacggcgccgcggtggtggtgatggctttcgacgaggttggtcaggccgacacccgcgaacgtaaaattgagatttgccgtcgcgcctacaaaatcctcaccgaagaggtcggcttcccgccggaagatattatcttcgaccccaatatctttgccgtcgccaccggtatcgaagagcataacaactacgcacaggactttatcggcgcctgcgaagacatcaaacgcgagctgccgcatgcgctaatctccggcggggtctccaacgtctccttctccttccgcggtaatgacccggtacgtgaggcgatccacgccgtattcctctactacgcgatccgcaacggcatggacatggggatcgtcaacgccggtcagctggccatctatgatgacctcccgggcgagctgcgcgacgcggtcgaagacgtgatcctcaaccgccgcgatgacagtaccgaacggttacttgagctggcggaaaaatatcgcggcagcaaagcggacgacggcgcgaatgcccagcaggcggagtggcgcacctgggaagtgaaaaaacgcctcgaatattcgctggtgaagggcattaccgaatttatcgaacaggacaccgaagaagcgcgtcagcaggccgcccgcccgattgaggtcattgaagggccgctgatggacggcatgaacgtggtcggcgatctgttcggcgaaggcaaaatgttcctgccgcaggtggtgaaatccgcccgtgtaatgaaacaggcggtggcctaccttgagccgtttattgaagccagtaaagagcagggctccagtaacggcaaaatggtgattgccacggtaaaaggcgacgttcatgacattggcaaaaacatcgtcggcgtggtgctgcagtgcaataactacgaaatcatcgatcttggcgtgatggtcccggcggataaaattctcaaaacggccaaagaggtaaacgcggatctaattggtctttccgggctgattaccccatcgctggacgagatggttaacgtggcgaaagagatggagcgccagggctttaccatcccgctgctgataggcggcgcgactacctcgaaagcgcatacggcggtgaaaatcgagcagaactacagcggcccgaccgtttacgtacagaacgcctcgcgcaccgtcggcgtggtgtctgcgctgctttcggacacgcagcgcgacgagtttgtcgcccgcacgcgcaaagagtatgaaacggtgcgtatccagcatgggcgtaaaaaaccgcgtactccgccggtgacccttgccgccgcgcgggaaaacgatctggcctttgactgggaaagctacacgccgccggtggctcatcgtctgggagtacagacggtggaagccagtatcgagactctgcgcaactacatcgactggacgccgttcttcatgacctggtcgctggcgggtaaatatccgcgcattctggaagatgaagtggtaggggaagaggcgcagcgcctgttcaaagacgctaacgagctgctggataagctgagcgcagagaaaaccctgaacccgcgcggcgtggtgggtctgttcccggccaaccgcgtgggcgacgatattgaaatctatcgcgatgaaacccgcacccacgtgctgacggtgagccatcatctgcgccagcagacggagaaggttggcttcgccaactactgcctcgccgattttgtcgcgccgaagctgagcggcaaggcggactacatcggcgccttcgccgtgaccggcggcctggaagaggacgcgctggcggacgcctatgaagcgcagcatgatgactataacaagatcatgatcaaggccatcgccgatcgcctggcggaggcctttgccgagtatctgcatgagaaagtgcgcaaggtttactggggatatgcggccaatgagaacctcagcaatgaggagcttattcgcgagaactaccaagggatccgaccggcgccgggatatccggcctgtccggagcacaccgaaaaggggaccatctggcagctactggacgtcgaagcccataccggcatgaagctcaccgaatcgttcgccatgtggccgggcgcatcggtttccggctggtacttcagccatccggatagcaagtacttcgccgtggcgcagatccagcgcgatcaggtcgaagattacgcgctgcgtaaaggaatgacgccggcggaggtcgagcgctggttagcgcctaatctgggctatgatgcggactagtcgtcatctttccttacaacaaacaaggcgctctgtgagcgccttgtctctttattgaggttaaccccttatactgagataggttcctgaacttcggaaaacctataacgataaggagaagctgattccgtgttaactctgctacacctgttgtccgcggttgctctgctggtgtggggcacgcatatcgtgcgtaccggggtgatgcgcgtctatggcgctcgcctgcgtaccgttctcagtagcagcgtagagaaaaagccgctcgccttctgcgcgggtcttggcgtgactgcgctggtgcaaagcagtaacgccaccaccatgctggtgacctcatttgtcgcccaggatttagtgggtctgatgccagcgctggtgatggtgctgggggccgacgtcgggacggcgctgatggcgagggtgttgaccttcgacctgtcgtggctgtcgccgttgttgatatttatcggggtgattttcttcctcggccgcaagcagacccgcgccgggcagcttggacgggtggggattggtctggggctgatcctgttggccctcgagctgattgtccaggccgtacaccccataacccaggcgaacggcgtgcaggtgattttcgcctcgctgaccggcgatatcatgctggatgctttgattggcgccgtatttgcaatcattagctactccagcctggcggcggtgctgttaacggcgacgctgaccgcggcgggagcgatctctttcccggtggcgctgtgtctggtgattggcgccaacctgggttcggggctgctggcgatgcttaacaacagcgcggcgaacgcggcggcgcgccgggtggcgctgggcagcctgctgtttaagctggtggggagcctgattattctgccgttcgtccatccgctggccgcggcgatgcacaagctgccgttggccgagtccgagctggttatctacttccacgtcttttacaacctgctgcgctgcatcgcgatggtgccctttgccggaccgatggcgaagctgtgccagcgtctgatccgcgatgagcccgagctggataaccatctcaaacccaagcatctcgacccgtcggcgctggacaccccggcgctggcgctggccaatgccgcgcgcgagacgctgcgtattggtgacgcgatggagcagatgctggagagcctgcacaaggtgatgcatggcgaaccgcgtcaggagaaagagctgcgtcgtatggcggatgatatcaacgtactttacaccgctattaagctctatctggcgcgaatgccaaaggatgagctggcggaagaggaatcccggcgctgggcggaaattattgagatgtcgttaaacctcgaacaggcgtccgatatcgtcgagcgaatgggcagcgagatcgccgataaatcgctggcggcgcggcgcgccttctcggtagaagggttaaaggagctggacgccctgtacgatctgctgctcagcaacctgcagctggcgatgtcggtcttcttctccagcgatgtgcccagcgcccgccgcctgcggcgcagcaaacaccggttccgcattcttaaccgccgctactcgcatgcgcacgttgaccgtctgcatcagcagaacgtgcagagcatcgaaaccagtacgttgcacctggcgctgctgggggatatgaagcgtctgaacagcctgttctgctcggtggcttacagcgtgatggagcagccggatgaagacgacgaacgggatgactactgagccattccccggcggcgctgtactaaccggggttttgcgtttggacgttccgttgaggcagcccggataaggcgcaatgcgccgctatccgggaaacgttagccacccaggctcagaagcggtggcccgcaggcagggttatcgcttcttcccccggtttgaacaacagcgtcgggttcgggccaccgagcgtcgcgtgaccatcggtgacctggatccagtttccttccggcaaaccaatcaccgttaattccggcgccacgaccagcagttcgcggatacgctgttcgcgggtttcgccctgatgcccggtcggcaacgcgttggtgaagtgcgggttaatctgtagcgggaacagccccagcgcatcaaatccctgcggatcgacaatcggcatatcgttggtggtgcgaatggtcgggcaggcaaggtttgaacctgcactccagccgatatacagcgccccgcgtttgacgacatcgacaatcggcgccaacaaaccgcgactgcggcactctttcaacagctggaaggtgttcccgccgccgacgatcaccatctcggtgctttcaatggcggcgatagggtcgtcgacgctgtggataccggttacgctgaccgccatgggcgccataaccgcagccactttggccgtataatcatcccaggattgcgtcacgccagcgaaggggatgaataccgccttacggcggcctttgacctgaccggcaatcagcggcagggcgtgttccagccaggctttccccggcagcgtggagttactgagtaacagcagttccatcttttcttcctgttttaaaaatattattgaagcagaaattctagcatcgcccccataccgacgcgctgatatggcgcatgatgtgggtaagcggaatgctgttcacaagcccgacgaagcttctggataatgaatcacacaatccaggttttttctcgcccacaaggtagggtatatttcgcttttacaggagaatctatgctgcccgactcatcaacccgattaaataaatacatcagtgaaagcggcatctgctcgcgtcgcgaagcggaccgctttattgaacaaggcaacgtctttatcaatggcaagcgcgccacgattggcgatcaggtgaagcctggcgatttagtcaaagtgaacggacggttgattgagccgcgcgaagcggatgatctggtactgattgcgctgaataagccggtcggcattgtgagcaccaccgaagatggcgagcgcgacaacattgtcgatttcgtcaatcacagcaagcgtatctttcctatcggccgtctggataaagactcccaggggctgatcttcctcaccaaccatggcgatctggtgaacaagatcctgcgcgccggcaacgaccatgaaaaagagtatctggtcacggtcgataagccggtgaccgatgagttcattcgcggcatgggcgcgggggtaccgattctcgggaccgtgaccaaaaaatgtaaggtaaagaaagaagcgccgttcgttttccgcatcacccttgtgcaggggttaaaccgccagatccgtcgcatgtgcgagcactttggctatgaagtgacgaagcttgagcgtacgcggatcatgaacgtcagcctgacggggatcccgctgggagagtggcgcgatctgaccgatgacgagctgatcgacctgttcaagctgattgaaaactcctcttccgaagcaaagccgaaagccaggccgaagcctaaagcggcgacccccgggatcaagcgcccggtagtgaaaatggaaaatagcaacgataagggccgcccggctggtaacgggaaacgtttcacccagccgggacgtaaaaagaaagggcgttaacgcctgccgcgggtcggcgtattcgccgaccaggaaaaggtcgcttccttgtccgttttataagcctgctgttttctcacctggcgggctttcttcgcttccgcttcacgctgcgccatcagcttatcgatatattcctttttcacgctgttcgtttccgcattgctcagcgggcggccatgcgcaatacgcgcgcggtcaagcagcgttttcaattcgcgctgttcgcgctcggtcatctctttttgtgtaatacgggggagtgccatggtggtgccctcagtcagaccagagcacccagtgtacggcaatgaatattttactgatagcctgtatggcaactaaagcaggcacacgcccgggcctgcgcccggacgtatcacgctcagcgcttgtcggcttttttggcgatgggctttcctgaccagtacccggccagcagcgaaccggacaggttatgccagacggagaacagcgcgcctggcagcgccgccagcgggccgaagtaaattttacccagcgcggccgccaggccggagttctgcatccccacctcgatcgccagcgtacggcaggtggattcatcaaaaccaaacagacgtccgccccagtacccgccaagcagaccaatagtgttatgcaggatcaccgcgataatcaccaccaggccgacggaggcgatatgggcggcggaacccgccaccaccgcgctgatgatcgccagaatgcacaccatcgagaaggcgggcaggaacggctctaccgctttcaccaccttcggcaacagatgatggacaatcagtcccagcgcgataggaatgaccacaatctgcagaatgctgagcaacatgcccatgacgtcgacctgaatatgcgcgtcgacgtacagacgggtgagcagcggtgtcgccacgacgccgacgagggtggagaccgaggagatggtcaccgacagcgccacatcccctttggcaagaaagatcatcacgttggaggcggtcccgctggcgacgctgccgaccagcaccatcccggcggaaagctccggcggcatatgaaacagcagcgccagcagccaggcggcgagcggcatcaccagatagtgcagaaatatccccgcagcgaccggcgccggacgcgacaggacgcgtttgaaatcctccagcttcagatgcacgcccataccgaacatgatcagcatcagcagggtggtgacccatgggccaattggggtgaaggtagtgggagtgtaataggccagaacggagagcagcagtgcccataacgggaacagccgcgtcagagttgcgagcatgttgtgttccttgctatacgcgaaccgggccgcgccatcccgatgggcggcgagcaggtcagctggttgtgttgatgttgttataaaaaagccgggttcgagcccggctataggtattgtttatcgtgctaaggaattttattcaaacaaattatgatgcagcttctgcacaaccttctccgcatcgtcgcccggcaccaggaagcacaggttgtggctggaggcgccatagcagatcatgcggatgttaaacggctcgaggacgccaaagacctctttgccgacgccgcaggctttcgacagctcattgccaatcagggcgaccagcgccagattttcttccacttccacgcggcacagcgaagagagctcggtcagcagcgcctgggtcagcagggtatcgcccgcagaggtcgagccggtggtgtccatggtcagggccacgctcacttcggaggtggtgatcaaatcaactgagatgttatggcgcgccagaataccgaacacttcggcgaggaagccgcgggagtgcagcatattcaggctgtgcagcgtcagcagcgtttgccggcgacgcagcgccagcgcgcggaacagcggcgggttctcggtggttttacacaccagcgtaccgcccgctttaggctctttactggagccgacaaacaccgggatatcgctgcgcacggcaggcagcagggtcgccggatgcagcactttggcgccaaaggtggccatttccgctgcctcttcaaaggcgatgacgtcgatgcgtttcgccgccggcgcgacgcgcgggtcggtagtatagatccccgggacatcggtccagatatcgacgcgggtggcattcagcgcttcgccgagcagagcggcggtataatcgctgccgccgcggccgagggtggtggtgcggcctttcgcttcgctgccgataaagccctgggtcaccaccaggccttccgccaggcgcggcgccagctgctgctgggtcagttcggcgacggcggcgatgtccggttcggcgcggccaaagcgatcgttagtgcgcagcactttacgggcgtcaaaccactgcgcctgaataccgcgttcacgcagaatttccacaaacagcagggtggacatcagttcgccatggctgaccagttcgtcggtcagggcggttgaggaggcgagcgcggcggcttccgccagcgtcgtgatattttccagcaagcgctcaatctcttcgcggatcacgttgggataacgcaaacgctccagaatattgaactggatctgacgcagagcgtccagctgggaaaaacgttcggtgggttccagccctcccgctaaggccaccagaatgttggtcacgccggcagaggcggagagcacaacaatacgggtattggcatcgagcagcgccacatcgatgctgcggttcattgcgtcaaaatcagcaacgctggtgccgccaaatttggcgacgactagatctgtcataacaacctcgtgtcagggggcctgacttattaaaacgattcctgagcaccgatcctggcaggggctggacgccgccggatcgcaacaaaatgtcttaataagccaggccaaattattcagccatggcacaagggaagagcgataaacagggtggcgcagagtgataaacaactacgatgtcacccagaagtgctccaccttgtagacccgactcaccgctttgggcgctgaggtgttcgggtatgaaacgcccgactgcgaacgtttctggtgacaacccaggggattcagcccctgtggccggcgaggagcgtgaccagacgctctttcacctcggcgttgctccccctcacgtatcttccccggactggttcctccaatacggttacctgggcaacgcacctcttctggcaattactgacgtctttcacctggccgggggaacagggacattatatcccccgcgaataccctttcgctgtagcgtgaaatgcgcgagcaatagatacctaccaatacgtaagcactgcggatatataaaggcttaacgccagctatgtcaacgctgcggttatgcggatttttcatgcctctgcggctaacagaaaaaagccttatgatagctatactaatggggctttttactccgttttgacccgattcctgaccggcgtcagggtcaagtcacaaaaatcatcacaattttccgtcaccggcgctacaatcgaccgaagtcacaatctcaaatcagaagagtattgctaatgaaaaacatcaacccaacgcagacctctgcctggcaggcattacagaaacacttcgacgaaatgaaagatgtcactatcagcgagcttttcgccaaagatagcgaccgtttttctaaattttccgcgacgttcgacgatctgatgctggtggacttctccaaaaaccgcatcactgaagagacgctggctaaactgcaggatctggcgaaagagactgacctggcgggcgctatcaagtcgatgttctcaggtgagaagatcaaccgcaccgaagaccgcgcggtactgcacgtcgcgctgcgtaaccgcagcaatacgccgattgtggttgatggcaaagatgtgatgccggaagtgaacgctgtgctggagaagatgaaaaccttctccgaagcgattatctccggtagctggaaaggctacaccggcaaaccgatcaccgacgtggttaacatcggcatcggcggctccgacctcggtcctttcatggtgaccgaggcgctgcgtccgtataaaaaccacctcaacatgcactttgtctctaacgtcgatggcacccatatcgccgaagtgctgaagaacgtgaatccggaaacgactctgttcctggtggcgtccaagactttcactacccaggaaaccatgaccaacgcccacagcgcgcgcgactggttcctggcaaccgcgggcgacgacaagcacgtggcgaaacacttcgccgcgctttccaccaacgcgaaagcggttggcgagttcggcatcgacaccgccaacatgttcgaattctgggactgggttggcggccgttactccctgtggtcggcgattggtctgtccatcattctctccgtgggcttcgacaacttcgttgagctgctgtccggcgcgcatgcgatggataagcacttctccaccactccggcggagaaaaacctgccggtgctgctggctctgatcggcatctggtacaacaacttcttcggtgcggaaaccgaagcgattctgccgtacgaccagtacatgcaccgctttgccgcttacttccagcagggcaacatggagtccaacggtaagtatgttgaccgtaacggccacgcggtagactaccagactggcccaatcatctggggtgagccgggcaccaacggtcagcacgcgttctaccagctgatccaccagggcaccaaaatggtaccgtgcgatttcatcgctccggctatcacccacaacccgctgtctgaccaccatcagaaactgctgtctaacttcttcgcccagaccgaggccctggcctttggtaaatcccgcgaagtggttgagcaggaatatcgcgatcagggtaaagacccggcgaccctggagcacgtggtgccgttcaaagtgttcgaaggtaaccgcccgactaactccatcctgctgcgtgagatcaccccgttcagcctcggggcgctgattgccctgtacgagcacaaaatcttcacccagggcgcgatcctcaacatcttcacctttgaccagtggggcgttgagctgggcaaacagctggctaaccgcatcctgccggagctgaaagacggcagcgaagttagcagccacgacagctctactaacggcctgattaaccgttataaagcctggcgcgcataacgcttgcgcagctaagacggaatgccgaccctttggtcggcatttttatttatagccgccgcagcagcctcgccggattccccgcccacacgcctttctcggtaatggacttcgttaccacgctgcccgcgcctatcaccaccccatcgcagatgctgacggccagaatcgtggcgccgctgccgatcgacacgtcatcgccaatctcgatccgcccccagctggcgcggtcggcgtttggtttaccctcgcgaaacaggtcgttggcaaacatcacgccgtgaccgataaagcagcgctggccgatggtgacgtactcgcagataaaggtatgggactgaattttactgttcgcgccgatgcgggtattcccctggatctcaacgaacggcccgacgaagacgttatcgccgagctggcaatcatagaggttggcgggctggtaaataacgacattttccccacaaacgacgttacgtacaccggtatcacgaagctcaggcatagttcctctcaaatcggtttggccagaatatgtaaggtgctttgctggctggcggagtggaaaatcgtgtctctgatgtgctgcatcccctggcgttcgtaaaaacggcgcgcggcgggattcgcggcgagtacttccagccacagccaactttcaccggccgtttttgctcgcgtctcgacggcgtgaaaaatatgctcgccgtagcggtggccagtcttccccggcatcaggtagagcttatgcagcagcgtaccaatcttgccgtcgtcagccattcgctgctgatagctatatttagcgaaaccaacaggagagggggcttcggcgatgagccagtgttgggtcgcatccgcaagactccgacgtagcgcatcttcggcatattcttgcttaagaaataacgccagttcatcggcatcgcgccagagatgagcaaagtggtgatgatagctggcatagcccatcgcgctaagctggggcgcgtcctcgggacatgcctgtcgaatagttaacatgctgcgttcctcgcgtcgttctgcggctatattgcctgtaaagtgaacaatgtggaacgacaaaaatcggtgggagaaggctggaggcgctccctccagcctgggggttagcgggcgaaagcgatcgcttcgatttcgacgccggcatctttcggtaaccttgctacctccacacaggagcgcgccggaaaggccgcctggtgttcgataaagaaggcctcgtaggcggcattgatggcggcaaaatccgccaggtctttgacaaacaccgtagttttaacgatctgcccgaccgtgagtccggcagcttcaacgatggctttcacattttccagtgattgccgcgcctgttcggcaatgtcctcgggcatggtgccgtccagcggattaatcggcagctgaccggaggtgatggtcatcgcgccgagattgacgccctgcacgtacgggccgatagcagcaggcgcgtcagcggtggtaataatcatacggtttatccttcaaacggttacataaaataatttaacaacaccagcgagccgacgccgctcactaccacccacaccaggcctaaacggaagctggcgagcgtgcagatgatggcggcgatcaccttcggattttttaagtcgaactccatgctgcaattcacgctcaggatctgaatggtgatgatggccggcagaacggtgaccggcacgaagcgtagcgttttggtcacccgctcggacatctggatcttgccggccaggccgataaacgagaaacggatgagaaaagtcaccgcggccatgcccagcgtcagggcgataaaatagctattactcattttccatcgcctccactaacggcatatcggattcggtttttgccatctgcttgcgctcttccgccaggtcgacgcacaggccggcgaggacgccaagcactgaggcgacgacgatacccagcgaatagggtaggaccactaacagcacgccggaaacggcggctacaaccgcggcgacggtgcaggcctggcttttaatttgcggcaccacgatggcgataaaggcggcgaccatggcgaaatcgagaccgtatttctcaatgtggggaaacgaggcgccgaccagcgcgccaagaaaatcagccagcacccaaatcgcccagaaggtaatcatcgccgaaccataaaacagatatttttcctttttatttccttccatctctttgacggtggtggcatacacctcgtcggtgagcgcataggacataaagcattttttaaagaatgaagcttcgcgcacggtgccggaaatagaggcgctatacagcacgtggcgaagatttataattaatgtggtgaaaataatcacgccgagcgtggcgccggtttttaacatattcagtgccagcatttgcgccgagccggcaatgacaatcgccgaccacgccgtactctgccagacgctcatgcccgcgctaacgcttaatgcgccgacaataaatgaaaatggaaagtcgccgatgcataggggcataatagcgctggcgccgcggaagatgacttttttattcatctgctatacctgctaatttataaataatagtgtgggtagagtacgttaatcggggcctgctctttcaggcccgtgaaatggtattatttagcgaccataatgctgataatttctttatcggtgagagtcattggtttaatcaccagacggcacaggttattaatagtctgctcgacatcggcgcacacaataccgtcattggcgccagcgcagctattttgcatggccattagtaccgccttaaaggcgctggataccactgacgagactttcatcgcgcagctgttggaagcgccatcacaaatcatgccggtaatatcgctgaccatattaataattgcggtattaatggtattgatgtcgcgggtaaacagccaggccataccggcggcggcgcccatagcggcggttgaggctgcgcatagcgcagataagcgcgtataacgagaatgaattgagatggcggtgagatgagagagagacaaagcgcgagccagggtctcttcatcgacgccgagatgctctgcaaccaccactaccggcatggttgctgtaatgccctgattgcctgagccgaagttagacatcgctaccaccggcgcgccgcccatgcgggcatctgaagcggcgacggtgttgatgatcaccttgcttaacagatcgttgctcatcaggccgtttttcactgcgtcagaaaaggtaccgttaatgttcaggccatatttttttgttttgccttctgccgccagcgcggagtttaagcgcgcggcgtcgagaataaagcgaatatcattaaagtcgacgcgattaataaattcgtaagcctgttgtagcgagaaagtgggcagcgtttcgcgctgggtgcgcgtattctgtttttcgcttaatggctgcggttggccattaatataaagttcgaccacgttggtgtgggttcctttgaccacgacacgacagtaattctcgccagcagagagggttaaatcgagatgaataaaatccggggtctcttcgacggcaatatcaacggcgttattggcgatcagcttctgcgccatttcaacgtgtcgcggagtgatatcttccagcgtttttaatcccttttgcgggtcgccgccaaatgcgccaattgcggctgccagcggtacaccgcaaacggtggtgccgggtatggtgacgcccatcgcgtttttataaagattggcggaaataaaaccgctaattttagtgcaaggctgatccagatattgtgcggcgtaggcggccgcgaaggaaatagcgacgggttcagtacaacctaaagccggggcgacctcttgtttgagccattttacgtacagggaagcgttatcggtgttcataatgatttaatgtccaaaattaaattttattcagctgcgataatgctaagacaaaagataagaaaaaacttaccctaataaccataaaaagactgtggtttggagaaaaattttatcttacgggaggttttaagatacatctgtttcaaaaagtaaactttttatatttcagttggttgggttgattcgttctaagcgtaacggatgattttgttaatctgctcacagcgttgctggaaggacaattttctcttgttcgtacttttcgaatcaatagcccggagatagcgtaaggcgaaggaatcataggtagatctggatcacacttttgcgctatacagatcgacaacgttcatgcatttgaggtgtcactatgccgtcggtatatcgtccgctggttaatttcgttgcgaaggccatgcaggccgtgctgaatctggcactgctgtgcctgggaattattctggtggtgttcctgggaaaagagaccctgcatctggcgcacgtactgtttacgccggagccggtgagtaagtacaagctggtcgaagggctggtggtctattttctctactttgagtttatcgcgctgattgttaaatattttgaatccggttttcactttccactgcgctatttcgtctatatcggtattaccgcaattgtgcggcttattatcgtcgatcatgagtcgccgctggcggttctcatttactccgcggcgatcctgatcctggtgattacgctctggctgtgtaactccaatcgcctgaaacgcgaataaaaaaaagcggcctccagggccgctgaccaacagtcacaaatagaatttatgtagggtccagttgaggatagcagtggcattgaccttactttttcagctgagggcgacggcgacaatacccggttggggtcgtgtattgcggctagaccgtcggccctcctctgaaatttggggccggtgttacaaaaaaattaacctttcactccacccgccgtcaggccattaaccagccagcgctgcgccagcaggaagacaaccgtgatcggaatggcggagagcaccgccgcggcggcaaagtcgccccacagatagttctgcgggttgagatactgttgcatacctaccgccagggtatagctgttcacatcgcgcagcagcagcgaggcgaccggcacttcggtgatggccgcgatgaacgacagaataaacacgactgccagaatcggcaccgacagcggcagcagcaccagacggaaagcctgccatggggtcgcgccatccagcgccgccgcttcttccagcgagccatcgatggtttcgaagtagcctttaatcgtccagacgtgcagcgcgataccgcccatgtaggcaaagatgacgccgccgtgggtgttgaggccgacgaacgggatgtactggcccaggcggtcaaacaacgcgtacagggcaaccagcgacagcaccgccgggaacatctggaaaatcagcatccctttcagcagggccgctttccccgggaagcgcatacgggcgaaagcgtaggcgcaggtggtggagagagcgacgataccgatcgcggtgatcccggcgaccttaatcgagttccacagccacagcaggaccgggaacggcggcggcgtgacgcggccatcggcgtgttcgacgctgaagcctaacgccagacgccagtgctcccaggagatggtatccgggatcaggctgccggtggcgaagttgccttcgcgcagcgagatggcgataaccatcagcagcggaaacataatcgcggcgataaaaatcagtagcaggagatgcgtggtaaataaacgtagcttctgcgatttgggttggaccatagccattatcgttatctcccttaatcaaacttcatgcgcgtggctttcagattcacaatcgctaacgcgccaaccagcaggaagataagcgttgcgatagccgccgccaggccgaagtcctgaccgccgccgccttcaaaggcgatgcgataggtgtagctcaccagcaggtcggtataaccggccggggtggtggtgccgagacggtccggaccgccgttggtcaacaattgaatcaggacgaagttgttaaagttaaaggcgaagctggcgatcatcagcggcgttagcggcttaatcagcagcgggaaggtaattttaaagaagttctggaacgggccggcgccatccattgccgacgcttcgtacagatcgtccggaatcgccttcagtagccccatgcacaggatcatcatgtacgggtagcccagccaggtgttgacgatgatgatcatggtgcgcgcggtggtcgggtcgctaaaccatgccggcttaatgccgaacagcgtgctgagcatcatgttgatttcaccaaagctctggttgaacagccctttgaaaatcagaatcgaaataaacgacggtacggcgtacggcagaatcagcaggacgcgataaatcgctttgcctttcagcgcttcccactgcaccaggcaggcgaggatcatccccaccgcgacggtcagcatcacggtcagcaccgagaacaccaccgtccagacgaagatcgcgaagaacggtttctgaatgccttcatcgtggaagacgcgggtaaagttgtcccagccgatagtcacagtgtagcccgggctcagcttctcattgccccagctgccgtcggcgttaattgcctggtagaagccgacgtcgttgttcgggcggtatttaacgtgggtctgattgttggtcagtaccccgtcttcgccgagggtatacagaggctgggtaccggagaactggcgcagggagctcatgatgactttgctgtcatccggcagcacagcggtcagctggttcagcgcggtgcgattctgggtaatcacgcgcaggttggcgcgctcgccttccggcagggcgtcggtttcttttaacgccagcttctgctcgccgccaaatttaaaggcgtcagaaaggtagtttttaccgctttcgccgtcggtgagcgccagcttccactcgtcacccgcagggatcagcgtgaaattataggctttgccggcctggaaggaacgatccatcagcacctgctgcgcacgctcaaaggtcagctggttggtgctgctgtagttggtaaacgcgatagcgatagtgcagatcagcggaaacaggacaaacaggcccatgccggcgaggccgggataaacatagcgccaggcataagccttgcgattagcgaaaatatacaggccaactgagcttaaaatcagcgtcatgatggcgaacaggtactccccctgggcgtacatcaaaacaacaaggtaacccaccagcaggcacagtaagccaatcacagaccatgtgagttgcgggctttgccaccagtgtctctttttaacggcatccatggggatcatcctctacagcggtgaaaacttatttgtcaggtggcgcttcgcttacctgacctacggtccgagccgtagtggtagggcgggtaggcgcgcgcgccacccgccgttttcttacttagtgatacggctctgtgcatctttcagcgcagcatcgacagtctggcgaccgctggcggcgttgataaccgcggtacgaacggcataccagaaggcagacatctgcgggatgttaggcatgatttcgcctttctgggcgttcgccatggtggcagcgatgcgcggatctttttccagtttttcctggaaggatttcagcgccacggcacccagcggtttgtcgttgttaacggcttccagaccctgatcggtcatcaggtagttttcgaggaactctttggccagctctttgttcgggctggcggcgttgatccccgcgctcagcacgccaacgaacggtttcgatggtttgcctttaaaggttggcagcagggtcacgccgtagttaaccttgctcttatcgatgttagaccacgcccacggaccgttgatggtcatcgcggtttcgcctttgttgaaggccgcttccgcgatggagtagtcggtgtcggcattcatgtgcttgttcttgatcaggtcaaccaggaaggtcaggcccgctttcgcgcctgcgctgtccacgccgacgtctttcacatcgtacttgccgttttcaaacttgaacgcgtatccgccgtcggcagcgatcagcggccaggtgaagtacggttcctgcaggttgaacatcagcgcgctcttacctttcgctttcagttctttatccagcgccgggatctcttcccaggtcttcggcgggttcggcaccaggtctttgttgtaaatcagggacagggcttcgactgcgatcgggtaggcgatcagtttgccgttatagcgaaccgcatcccaggtgaacggatagagtttgtcctggaacgctttgtccggggtgatttccgccagcaggcccgactgcgcgtagccgccgaaacggtcatgcgcccagaagatgatgtccgggccgtcgccggtcgccgcaacctgcgggaatttctcttccagcttgtccgggtgttctacggaaactttaatgccggtgtctttttcaaactttttacccacttcagcgaggccgttgtagcctttgtcgccgttaatccagataaccagcttaccttcttcaatttttgcgagggcagaggcggaaaacatcatcgtggtcagtgccgacagcgcgaggatgcgagcgccagttttgattttcatatacccgtcctttttggtgttgtactcgtggatacacttcggtggcttaacgatgatgagtttccttttttaacaacccctttccatcctccccaggtctacgccccacccgctggttgtgtgatctccattgcaaaaacggccgtattgcgtcctggagcacagaaaaaagcgcccaattttgtcgcctccatcacgaaatcacgctccgcccgccatcccccgcggcgagagccaatctctcatcctcccatctcctcccccataaaaaagccggggggtggaggatttgcctgcgtaatgaatgccgcatagtcgacccatcttgaatgtgactgttagtgacaggttgtaacgaagggagaagggcatggcgagcgtacagctgcgaaatgtaacgaaagcctggggtgacgtggtggtatcgaaagatatcaatctcgatatccacgaaggggaattcgtcgtgtttgtcgggccatcgggctgcggcaaatctaccctgctgcgtatgattgccgggttagaaactattaccagcggggacctgtttatcggtgacacccgcatgaacgagatcccaccggcagaacgcggcgttgggatggtattccagtcttatgcactctatccccacctttccgttgcggaaaatatgtcgtttggcctgaagctggccggcgcgaaaaaagatctgattaaccagcgggtgactcaggttgcggaagtgctgcagctggcccatctgctggagcgtaaaccgaaagccctctccggcggtcagcgccagcgcgtggcgattggtcgtacgctggtggcagagccaagcgttttcctgctggatgagccgctttccaacctcgatgccgccctgcgcgtccagatgcgtatcgaaatctcccgtctgcataagcgactgggccgcaccatgatctatgtcacccacgatcaggtggaagcgatgaccctcgccgacaagatcgtggtcctcgacgccggccgtgtggcgcaggttgggaaaccgctggagctctatcactatccggctgaccgcttcgttgccggcttcattggttcaccgaagatgaacttcctgccggtcaaagtcaccgcgacggctatcgatcaggtgcaggttgaactgccgaaccgtcagcaaatctggctaccggtggacagcgccaacgtgcaggcgggcgccaatatgtccttaggtattcgaccggagcatttactgcccagcgatatcgccgatgtaacccttgaaggcgaggtccaggtcgtcgaacagctcggtcacgaaacgcaaattcatatccagatccccgccatccgtcagaacctggtttaccgccagaacgacgtggtgttggtagaagagggagccacattcgctatcggtttgccgccagaacgttgccatttattccgtgaggatggcaccgcttgtcgtcggctgcataaagagccgggcgtgtaaggcttcccattaaaaaagcgcgaacccggctggcgatataccggcgaagcgtgcaaagaaaagcaatgatctcaggagatagaatgatgattactctgcgcaaacttcctctggcggtcgccgtcgcagcaggcgtgatgtctgctcaggcgctggctgtcgatttccatggctacgcgcgttccggcattggctggaccggcagcggcggcgagcaacagtgcttcaaagcgaccggcgctcaaagtaaataccgtcttggtaacgaatgtgaaacctatgcggaactgaagctgggccaggagctgtggaaggaaggggataagagtttttatttcgatactaacgttgcctattccgtgaatcaggaagatgactgggaaagcacctctccggcgttccgtgaagccaacatccagggtaaaaacctgatcgactggctgccgggctccacgctgtgggcgggtaaacgcttctatcagcgtcatgacgttcacatgatcgacttctactactgggatatctccggcccgggtgcaggtctggaaaacgttgaccttggcttcggtaagctctctctggccgctacccgtaactcagaaagcggcggctcttatactttctccagcgatgacaccaaaaaatatgctgcgaaaactgccaacgacgtctttgatatccgtctggcgggtctggaaaccaacccgggcggcgtgctggagttaggggtcgattacggccgtgctaacccgcaggatgactatcgcctggaagacggcgcgtcgaaagacggctggatgtggaccggtgaacatactcagtctatctggggcggcttcaacaagtttgtggttcagtacgccactgacgcaatgacctcctggaacagcggccactctcaggggaccagcatcgataacaacggcagcatgatccgcgttctggatcacggcgcgatggacttcaacgatgactggggcctgatgtacgtggcaatgtaccaggacgtggatctggacagcaagaacggttctacctggtacaccgtgggtgtccgtccgatgtacaaatggacgccgatcatgagcacccagctggaaatcggttacgacaacgtgaaatcccagcgtaccagcgaaaacaacaaccagtacaaaattactctggctcaacagtggcaggcaggcaacagcgtctggtctcgtccggctatccgtatcttcgcaacctacgcgaagtgggatgaaaactggggctacagcaacacctccggtctgcagacgaaagacagcagcggaagcggcgctttcacctccagccgcggtgacgacagcgaagttaccttcggtgcccagatggaagtgtggtggtaataccgtccgcaggacgggtgtaacctgggaggggcgtcagcccctcctgattattcagggttagcgcgctattgcctggctaccgctaaaccgatgctatccaaggtgagaagaatgaaaatgaagaaaactctcgtcgctctgtgtttatccgcagggatgttggcatgcgtgccggggatgagccttgccgatgttaactttgtaccgcagaacaccagcgccgcgccggctattccagccagcgcgctgcagcagctgatctggacgcctgccgatcaatcaaagacgcagagcgttgatttaaccaccggcggtcaacgcctggatgtcccggggatcgtcggaccggtcgccgcctggagcgtgccggccaatatcggtgagctgaccctgacgctcgacagcgaactgaacaaacataaacagatttttgcgccgaacgtgctgattctcgaccagaacatgacgcccgcggcgttcttccccagcaattactttacctatcagcagccgggcgtgatgaccgctgaccgcctgggcggcgtgatgcgcctgaccccggcgctgggccagcaaaagctctatgtgctggtgtttaccactgaaaaagatctccagcagaccacgaccctgctggatccggcgaaagcctatgccaaaggcgctggcaatgcggccccggatatcccggatccgatcgctaaacataccaccgatggcgtgctgaagctgaaagtgaaaactaatagcacttccagcgtgctggtagggccgctgttcggctcttccggcccgggtccggtaaccgtcggcaacaccgcggcgccggtagccgcgccagccgccgccgcggcgccggccgccaaaagcgaaccgatgctcagcgataccgaaacctacttcaacaatggtattaagcaggcggtgaaacaaggtgacatcgacaaagccctgaaattgatgaacgaagctgagcgcctcggctcgaaatccgctcgttccacctttatcagcagtgtaaaaggcaaggggtaatcgtctccccacaatgctgatgtttaggcacagcctttaggtgcatcctccgggatgcacctttttttgcacgcgcggcagcctgttgcatgactgttgcgtgaatgatcgtatattgacgtttgcccgccaccaaccgcctattctgcgatacaatgctttcacgttatgtaccggagaatcaggcatgtcccatcctgcgcttacgcgactgcgtgcgctgcgctattttgccgttatgccatccctgccgccgccgctaagtgactggctgctgctggaggactcaatgacccagcgctttgaacaacaaggaaagcaggtcaccgtgaccctggttaacgaagggtatatcggccgtgacgcgctgactgacgaagcggcgctgctgcccgacgagccgcgctactggctgcgggagattatactcaatgccgatggcgagccctggctggccgggcgcacggtggcgccggagtcgacgctgtgtggtccggagctggcgctacagcagctcgggcaaactccgctgggccgatacctgtttacgtcgtccacattaacccgcgattttattgaaattggtcgcgatgcagcgctgtgggggcgtcgttcccgcctgcggctgagcggcaaacccctgctgctgaccgagctttttttgcctgcgtcgccgttgtactaagaggaagaaaaaatggagtggagtctgtcgcagaataagctgttggcgtttcatcgcctgatgcgcactgacaaaccgatcggcgctttgctgctgctgtggccgacgctgtgggcgctatgggtggcctcgccgggcgtcccgccgctgtggatcctggcggtattcgtcgccggcgtctggctgatgcgcgccgccggctgcgtggtgaatgactatgccgaccgaaaatttgatggtcacgtaaagcgtaccgcccgccgtccgctgccgagcggcgatgttaccgagaaagaggcgcgaacgctgtttatcgtgctggtgctgctctctttcctgttggtgctcaccctcaacaccatgactattttgctgtcggtggcggcgctggcgctggcgtgggtctatccgtttatgaagcgctacactcatctgccgcaggtggtgctgggcgcggcctttggctggtcgatcccgatggccttctcggccgtcagcgaatcgctaccgctgagctgctggctgatgttcctcgccaatattctgtgggcggtggcctacgatacccagtatgcgatggtggatcgcgatgacgacgttaagatcggcatcaagtcgacggcgatcctgtttggcgaaaacgatcgtctgattatcggtatcctgcaggtggccgtactggcgctgatgggcgcggtgggttggctgaatgggctgggctgggaatattactggtcgctgttcgtggcggcgggtctgtttggctggcagcagaagcttatcttcaatcgcgaccgcgataactgcttcaaagcgtttatgaacaataactacgtcgggctggtgctgttcctcggcctggcgatgagctatctgtaacctcctgtccgctgccccccggcattccggggggcagcaaacgccgcgttacgcgtcgtcctgcgtgacgctctcaatggtcagtcggacatccgacgtaatcaaatccgccagcatccgataaaccttcagggtctcttccggctcggcgtcgccggtgtcgctgatatagccttcatcgcgcagggtcaacaccagggtgctgaacaccgctttgtcgaagaactccggcgcattgatgccgtgtagcaccgacagacgctgggccacggtgcgactctctttttccagcgagctgcggttgatcgccgggttagcgctcagcagccagaaggtgatggcatagcgctgcagcgtctcgcgggcgccagcggccagcagctgcagggagcgagagtgcgacgggttgaggctcatgacatcgccatcgacgacgatcagctcctgacgcagcatctcggcaatcagcgcatccaccactccggccagctccgctttttcccagcgcaggaacagctcggccttgaggaacggatagagtgtttccacatgacgcagcacttcggcgcggctgagatgacgatgctgagtcaccagagcggctaacagcgacggcatcaccagcatatgggcgatattgttgcgatagtaggtcatcagcaccgcctgctcgcgcggcaggatgatgatgtcgccaatggtgtccttctccacttcgaacttgttcatctgcagcgcatgatcgatgagctcgctggccgaagcggatggggcggtcgcatccggagaatagggcacattgcgcagcagcgcgaggtagcactctaactgctgggtgagctgctcacgggtcagcgaacgttggcgggaggccagtagcgccgtacagcacaggttcatggcgttggccgcgccggcgttattgatgcgcaccatcaggtcagcggcgatgctattcaccgtcggcgtcagccaggaggggcgaaccgcttcgatcgggtcgatcgcttcccgccaatccggcacatgctggttaagataggtcatcagcggcagcggttcgccgaagttaacgtaaccctggcccaggttgcgcagcttgcttaaaccgcgcaccatctgcggcagactctctttctctttagtggcgccgcgcagctctttggcgtaggttcctacctccatcacgtgctcatagccgatgtaaatcggcaccagggtgatcggtcgggttccgccgcgcagcatcgcctggatggtcatcgacagcgtaccggtcttcggatcgagcaggcggccggtacgggagcggccgccttcgacgaaatactccacggaatagccgcggctgaacagttcgccaaggtattcgcggaacacggtggaatagagtttgttgcccttaaaggtgcggcgaataaagaaggcgccgaggcggcggaagatcggtccggccggccagaagttgaggttgatgcccgccgcgatatgcggagggaccagcccctgatggtacaggacgtaggagagcagcagatagtccatgtggctgcggtggcaggggacatagacaatttcatggccgtcgtgcgccagctggcgtacgcgctcggcgttatgcacgttgatgccctggtacaggcggttccaggtgaagccgagaatgcggtctgtcaggcggatcatctcgtatgagaagttcgccgcaatctcttccatcagcgcgatagcgttctgctgtgccttctcgtgcgaaattttcttgctgcgcgcttcgtcttccaccgcgcgggcaatcgctttcgaggccagcagtttattaaacagatcctggcgggccggcagacgcgggccgacggcggccagccgctggcgggcaaaatgcatgcgagcgacgcgagccagcttctgggcgatgatcttatcggtaccgtgctcatccgccatgcggcgcagcgaaacggacggcgagaagcgcacgaagctgtcgcggccgagccaggagacggcgaaaaatttctgaatgccgttcagcatccgcagcggcggattgacttctcctttctcgcgacccggcgaacggccgaacatgaccgaaaccggcaccatttgcacatcgaggtccggatggttgcggtgcagatcgaggtaatcgtggaacagcttgatggactcttcttttggcgtgtaataagtaaatacgcgcggcccaccgtggatgaatacgtaacgcggcagcagggcgccgtcgatttccagcggttcaagcgggtcaggtaaatcatgcgccaggcattgggcgcgcagcgtcagcaggtccgccttcgaattatagggcaggacgtacatgaccggacgcgaggtatcgagtcctaattcctgggcaggctctgccggaatagacttgctttttaccagcacctgtaatggtaaattcagtaatttatagtaaattcgttgccagccggacataaacgatgtgaagcctctggttaatcatgcaaatgcgcggcaagaataacagaaagtgggcaaaatttccgttaccacgcggcaaacgcgcacactcatcgacgtcatttacgtaaaaaggttttgtgatggccaataataccaccgggttaacccggatcattaaggcggcaggttactcctggaaaggatttcgcgcggcgtggatcaacgaggctgcgtttcgtcaggaaggcgtcgccgctatcgtggccgtcgcggtagcctgctggctggacgtcgacgccatcacccgcgtattgctgattggctcggtcctgctggtgatgatagtcgaaattctcaacagcgcgattgaagcggttgtggaccgtatcggctcggattttcacgagctttcagggcgcgccaaagatatggggtcggcggcggttctgctggcgattatcatcgcgctgatcacctggggaacgctgctgtggagccattatcactaacgttcttcgctaaacctcgcaaaatatgaacaatccgccgatttttgtgtgccatgtggttccaaaatcaccgttagctgtatatactcacagcataactgtatatacacccagggggcggaatgaaagcgttaacgaccaggcagcaagaggtgtttgatctcattagggatcatatcagccagacgggcatgccgccgacgcgtgcggaaattgctcagcgcttggggttccgttccccaaacgcggcggaagaacacctgaaagcgctggcgcgtaaaggcgcgatcgagatcgtctccggcgcttctcgcggtattcgcctgctgacggaagaagagcaaggcctgccgctgatcggccgcgtcgccgccggtgagccgctgctggcgcagcagcatattgaaggccactatcaggtcgacccgtcgatgtttaagcccaacgccgatttcctgctgcgcgtcagtgggatgtcgatgaaagacatcggtattctggatggcgatttgctggcggtccacaaaacccaggatgtgcgtaacggccaggtggttgtcgcgcgtatcgatgaagaagtgacggtgaagcgcctgaaaaagcagggcaatgtcgttgaactgttgccggaaaacagcgagttttccccgatcgtcgtcgatctgcgccagcagagttttaccattgagggtctggccgttggcgtgatccgtaatggagaatggctgtagcgcctgcctctgcgcagcgtcatctgttgcgtgacgctgcgacgtttttcctcaatcaggtcctcaaacatgctgctcaacgctgccgataaagcgctgtggcgtcttgccctccctatgattttctccaacatcaccgtcccgctgctggggctggtggatacggcggtgatcggccacctggacagcccggtatacctcggcggcgtagcggtcggggcgacggccaccagtttcctcttcatgctgctgctgttcctgcgcatgagcaccaccgggctcaccgctcaggcctggggcgccaaagatccgcagcgcctggcgcgggcgctggtgcagccgctggccctggcgctgggcgccggggtgctgattatcctgcttcgcctgccgctaattgacctcgctctacatattgtcggcggcagcgaggcggtgcttgagcaggcgagacggtttctcgaaattcgctggctcagcgcccccgcctcgctggccaacctggtgctgctcggctggctgctgggcgtccagtacgcccgggcgccggttattctgctggtggtgggtaatctgttgaatattgtgctcgatctgtggctggtgatgggcctgcggatgaacgtccagggagcggcgctggccacggtcaccgcggagtacgccaccctcattattggcctgctgatggcgaagcgggtgctgacgctgcgcggcgtgtcgctggcgatgctgaaaaatgcctggcgcggggatctgcgccgtttattggcgttgaatcgggacatcatgctgcgctcgctgctgctgcagctgtgctttggcgcgctgaccgtattcggcgcccgtctgggcagcgacatcgtggcggttaacgccgtactgatgaccatgctgacctttaccgcctacgcgctggatggctttgcctatgccgtggaggctcactccggccaggcctacggcgcgcgcgacggtagccagttgctggaggtgtggcgggcggcctgccggcagtccggcatggtggcgctggcgtttgccctgatttacagcctggcggggcagtacattatcgcgttgttaacctcactgccttccctgcagcagctggccgatcgctatctgatctggcagacgatcctgccggtggtcggcgtctggtgctatctgctggacggcatgtttatcggcgcgacgcgcggcgctgagatgaggaacagtatggcggtcgccgcggcggggtttgctgtgacgctgcttacgctaccggtgcttggcaaccatggtctgtggctggcgctggcggtgttcctcgccctgcgcggcctgtcgctggcgctgatctggcgtcgtcactggcgacgcggcacatggtttagttagtcatctcccgtcattgccggtagccgtgaccttccccggtcgcgctacgtttacagggcgattcaatagcccggctcagcgtggcgcaggccgggaacatcctcttcgcgttatcccgcggtgcgatggttaaaaattccgaataacgaatcgacgccagcattctcatctatagttaataccatgtccggcacaaaacgggctgtaaacccaccgaatgatgaggacgttattatgaataaagacgaaataggcggtaactggaaacagtttaaaggtaaagccaaggaacagtggggcaaacttaccgatgatgatatgaccgtaatcgaagggaagcgcgaccagctggtcggcaaaattcaggagcgttacggttatgagaaagatcaggctgagaaagaagtctcagactgggagcataagaacgactatcgctggtagcgttccttgatccgaagaatgaagcatttgtgttagtgcctgtctgaatggcgcagggacgcgccgttaaccctttttcccgctgcggcagccgctcagcgggctttctttttgagctgaatagtatgatcgtgctggcagtgtcccggggtgctgcaggcttcgacttccacgcagcccgcgcaaagcccgtgagcttctatcacattgtggcgcagggcaaaccccatgcgggccgccagcgtatgcatgatatcttccaccccttccgccgcttcttcttttaccacgccgcagcggtcgcagataaacatggccgagctatgggtcggctggtcgaacagatggcacagcacatagctattggttgactctaccttatggacaaaaccctgctcgagtaaaaactccagcgcacggtaaaccgtcggcggcttcgcctgcggctctttctcacgtagcaagtccagcagatcgtaggcgctgattgccccttgctgcaggctcatcaggcgcaacacttccagacgctgtggagtcaggcgtacgccgcgctgtgcgcaaagcttttcagcatgcgctaacatctcttgcgaaggggtcttatccatgagcatcctcgggttgcgtgaatttgaatctgttactttatcacgttcctcagaaaacaccgagagccggcaggtgatacgggtcatacttcaggttgtcggcaccggcgcccgtcccgagcgctggccgcttattctcgagcagactacgccttagccgctcgctaaaaccaccatgtccgatttaatcacaacacgcccgaccctgggtatgctatatctgaagtgtctcattttcgggagaaaacgatgaaacgacctgattgcattcgccactggcgcgaactggaagggcccgacgatgctacttatcccgacagcccggagcgtttttcaatcggcgcgccgctggggcgaggtttacgtctcaaccggctggggatccaccacgagcggctgccgcccgggcggcgcacctcttatccacacgcggagagcgatgaggaagagttcatctacgtgctggagggctatccggaagtgtggataaacggctatctctggaagctggagcccggcgacagcgtgggttttcccgctggtaccggcatctgccacacctttctcaataataccgagcaggaagttcgtctgctggtggtgggcgaggccaacaagaagtacaaccgcatttattacccgctcaatcccggctatgccgcgacgcgccaggatcgttgggttgaccatccgccgcagttcttcggtccacacgacggcaagccgcggaaaaagtaatcatttcaggtgaggggcgaagcgcggcgcactatgcgcctgtggtgtatctttatgctatagtagcgcccctttttacccggatgcttatttattcgccatgatgcctgaatcaacgtcacctgttttccctgctcaccgcttctccatcgcgccgatgctcgactggaccgaccgacactgccgctacttcctgcggctgctgtcgcggcatacgctgctgtataccgaaatggtgaccaccggggcgattattcacggcaaaggggactatctggcctatagcgaagaagagcacccggttgctctgcagctcggcggcagcgatccccaggccctggcgcagtgcgcgaagctggccgaggcgcgcggctatgatgagatcaacctcaacgtcggctgcccctccgaccgcgtgcagaacgggatgtttggcgcttgcctgatgggcaatgcgccactggtggccgactgcatcaaggcgatgcgcgatgtggtgtcgattccggtcacggtgaaaacccgtatcggcattgacgaccaggacagctatgagtttctgtgcgatttcattgagacggtctccggcaagggcgagtgtgagatgtttattattcacgcccgcaaagcctggctctccggcctgagtccaaaagagaaccgcgagatcccgccgctggattacccccgcgtctggcagctgaagcgcgatttcccccaccttacgatggcgatcaacggcggcatcaaatcgctggacgaagccagagtacagcttgagcatatggatggggtgatggtcgggcgtgaggcctatcagaacccgggcattctggcctcggtcgaccgcgaaattttcggcgtcgccggcgcggatgccgatccggtagcggtggtgcgagccatgtacccctatattgagcgcgagctcagcaagggcacctatctgggccatattacccgccatatgctggggctgtttcaggggatccccggcgctcgccagtggcgtcgctacctgagcgaaaatgcgcataaagccggcgccgatattgcagtgctggagcaagccctgaagctggtggcagataaacgttaatttctgaccaaaacctggtgaaattgaccacgcctcgcgcaccgtcgcggggcgttttcttttaaagtcaagtgcttatgtttggcatgctttttgtaatacctgcagagtgaagtattcattctttggggagagaaccatgctggaactgctatttgtcattggattttttgtcatgctgctggtcaccggcgtatcgctgctggggattatcgcggcaatcgtggtggcgacggcgctgatgttcgtcggcgggttgttcgccttgatgatcaaattactgccgtggctgctgctggcggtggcggtggtgtggattattcgggcgctgaaatccccgaacggaaatgcttttcgcgacaataaccgttggcgttactaaggtattgaggggtgcgtcacaacctgaacaattttgcagacaaccgcgtaggcattgctgcgcaaatctgtcactattagcgcgttaacgaattcatcgcgctgtaccctacatacagccgaactaaaaaaaagtaagggcttcccaggtggaagccctaaacttttgccccttctgccaacttatggcagcagcaaactcgaaccctgcgtcacccggctctccagaacttcatgcgcccgccgcgcttcgctcagcggatagatctgactttcagccacgtccactttaatcaccccgctggcgatcagcgaaaacaattcactgcaggcttcctccagttcttcccggttggtgatatagccctgcagcgatgggcgagtgacgtacagggagcctttttgattcaggatccccagattaacgccggtcaccggaccggaggagttaccaaagctgaccatcaggccgcggcgctgcaggcagtccagagaggcctcccaggtatctttccccaccgagtcgtagacgacggccactttcttaccgtcggtgagcgccttgagccgctccacgatagactcctcgcgatagttaatcacctgccaggcgcccgcctctttggcgcgctgcgctttctgcgcgctgccgacggtaccgataagtttcgcccccagcgctttcgcccactgacaggctatcagccccacgccgccagcggccgcgtgaaacaggaacatctcatcaggcttaatttcataggttttgcgcagcagataccagaccgttaatcctttgaggaacgacgcggcggcctgttcgaaagagatagcgtccggcaggaccgccgctttgtcggccagcacattgtgtaccgtgctgtaggcgccgagcgccgactgggcgtacaccacccgatcgcctaccttaatatgcgtgaccccatggccaactttactgacgatgccggccgcctcggtgcccaggccgctcggcagcgacggcggcggatagaggccgctgcgaacataggtgtcgatatagttgatgccgatggctttgttttcgacctgaatctcatgttctgcgggatcgcgtggcgtgaactcaaccgcctgaagcacctccggtcccccgtgtttcgaaaattcgatgcgtgttgccatgttcgctcctgtgttgttccaagattattcagtaagcttaacagcctgcgccggcggcgacggattttcttacccgcctcaggcctgccacgcttaatgggttctttagcggcaatggctttctcgctatactgtcacgctcttttccggatcggtgaaatgttaggctatggcaggaaataaacccttcaacaaaccacagacagaaacccgcgaacgcgatccgcagctcgccgggctgaaagtcccgccgcactcgattgaagcggagcagtcggtgttgggcggtttaatgctggataacgagcgctgggacgacgtcgccgaacgcgtcgttgccgacgacttttatacccgtccgcaccgtcatatttttaccgagatggcgcgcctgcaggagtccggcagtccgattgacctgattacgctcgccgagtcgctggagcgtcaggggcagctggacagcgtgggcggcttcgcctatctggccgaactgtccaaaaacacgcccagcgcggctaacatcagcgcctatgccgacatcgtgcgcgaacgcgcggtggtgcgcgaaatgatttcggtggccaacgagatcgccgaagccggcttcgacccgcaggggcgaaccagcgaagatctgctcgacctcgccgaatcccgggttttcaaaatcgccgaaagccgggccaacaaagacgaagggccgaagaacatcgccgatgtcctcgatgccaccgtcgcccgtatcgaacagctgttccagcagccccatgacggcgtcaccggggtcaacaccggctacgacgacctcaacaaaaagaccgccggcctgcaaccgtcggatctgattatcgtcgccgcccgtccatcgatgggtaaaacgaccttcgcgatgaacctcgtggaaaacgcggcgatgctgcaggacaagccggtattaatctttagtctcgagatgccctcggaacagatcatgatgcgttctctggcctcgctgtcgcgcgtcgatcagacccgcattcgtaccggtcaactggacgacgaagactgggcgcggatctccggcaccatgggcatcctgctggaaaagcgcaatatctatatcgatgactcctccggcctgacgccgacggaggtgcgctcccgcgcgcggcgtatcgcccgcgagcacggcggcatcggactgattatgatcgactacctgcagctgatgcgcgtgccgtcgctctccgacaaccgtacccttgagattgccgaaatctcccgctcgctgaaggcgctggcgaaagagctgcaggtgccggtggtggcgctgtcgcagcttaaccgctcgctggagcagcgcgccgataagcgcccggtcaactccgacctgcgtgagtccggctctatcgaacaggatgccgacttaatcatgttcatttaccgtgatgaggtctatcacgagaacagcgatcttaaaggcatcgcggaaattatcattggtaaacaacgtaacggcccgatcggcaccgtgcgactgacctttaacggccagtggtcgcgtttcgataattatgccggtcctcagtatgatgatgagtaatccttccgccttcttttattaaggaattcaaatgcaagcggcaactgtagttatcaaccgccgcgctctgcgacacaacctgcaacgtctgcgtgaactggcgcccgccagcaaactggttgcggtagtgaaagcgaacgcctacggacacggtcttctcgagaccgcgcgaacgctgaccgacgccgacgcctttggcgtcgcccgcctggaagaggcgctgcgcctgcgagcggggggcatcgcccagccgatcctcctgctggaaggcttttttgctgcggaagacctggcggtgatcgccgcccagcgcctgcatacggcggtgcatagccccgaacagctggcggcgctggagcaagccgatctccccgagccggtgaccgtgtggatgaagctggataccggcatgcatcgcttaggggtgcgcccggaggaagccgaggcgttttatcagcgtctgagccagtgtaaaaacgtccgccagccggtgaacgtggtgagccacttcgcgcgcgccgatgagccgacctgcggcgccaccgaacgtcagctggacatcttcaccacctttaccgaaggcaagccgggcttgcgctctatcgccgcctcgggcggcattctgctgtggccgcaatcgcattacgactgggtgcgccccggaattatcctgtatggcgtgtcgccgctggacgatcgctccaccgggaaagatttcggctgccagccggtgatgaccctgacgtccagcctgattgcggtgcgcgagcataaagcaggggagcccgtcggctacggcggcacctggatcagcgaacgcgatacccgtctcggcgtggtggcgatgggctatggcgacggttatccgcgcgcggcaccgtcgggcacgccggtgctggtcaatggccgggaagtgccgattgtcggccgggtggcgatggatatgatctgcgttgacctcggaccgcaggcccaggataaggccggcgacgcggtagtgctgtggggagaggggctcccggtagagcgcatcgccgagataacgaaagtgagtgcttacgaacttattacgcgactgacctcccgcgtcgccatgaaatacttcgactaagcctctggcgtaccggatagcacagaggctgatccggtacgcaccaggcctgcggcgctcaaaaaagcggtttataccgctgcgcggtcactttcccctcaacatcctctcgacctgccgtcatatccggtttattgtgtaagaacctgccccatgtaaacctggagatacatcgcgtgtttcaaaaagttgacgcctacgccggcgaccctattctttctctgatggaacgcttcaaagaagacccgcgaagcgacaaagtcaacctgagtatcgggctgtactacaacgatgacggcattatcccgcagctgcaggcggtggcggaagcggaagcacgcctgaacgccgagccgcatggcgcctcgctgtatctgccaatggaagggttgagcggctaccgtcaggcgattgcgccgctgctgtttggcgcagagcataccgcgcttaagcaaaatcgcattgcctctattcagacggtcggcggttcgggcgcgctgaaggtcggggccgacttcctcaaacgttactttcctgagtctcatgtctgggtcagcgatccgacctgggaaaaccacatcgccatttttgaaggggctggcttcgacgtaagtacttacccctggtttgataaagccaccaacggcgtgcgctttgaggacctgctggcgacgctgcaaacgctgccggcccgcgatattgtgctgctgcacccttgctgccacaacccgaccggcgccgacctgacgccagcccagtgggaccgcgtggttgaggtattgaaagcgcgtcagttgatccccttcctcgacatcgcctaccagggctttggcggggggctggaagaggatgcctacgctattcgcgccatcgccagcgccgggatgccgatgctggtcagcaactcgttctccaaaattttctcgctgtacggggagcgcgtcggcggtctgtccgtggtctgtgaagacagcgaaaccgcgggccgcgtgctggggcagctgaaggccaccgtgcgccgcaactactccagcccgccgagctttggcgcgcaggtggtggcgacggtgctgaacgatgccgggctgaaagccacgtggcaggcggaagtggacgccatgcgcgcgcacatcctgaccatgcgccaggcgctggtcgacgcgctgcagcaggttgcccctggcagcaaagtggattacctgctcaagcagcgcgggatgttcagctataccggatttagcgcggcgcaggtggatcgtctgcgcgatgagtttggcgtctacctgattgccagcggacgcatgtgcgtggcggggttaaactcacgtaatgttcagcaggtagcgaaagcttttgccgcggtaatgtaagccgctctccagcaggttgtctctgccggtcaacgggcaggggcaacccctcggatgtgatcatcctctttttctatgacatctgcgcgaaaaaggcttttcatccatgccgccggcgggtaaggtcgggacgttgataagcatgcacattattgaaaacaataatgattgatagatttagggataaatatgcgcaaacttactctcgcccttgcggcggcttctctcctgttcacgctgaacagcgccgttgtggcgcgcgcctccacgccgcagccgctgtgggtcggcaccaacgtggcccagctggccgagcaggcgccgatccactgggtttcggtggcgcaaattgagaacagcctgctggggcggccgccgatggccgtcggctttgatatcgatgacaccgtccttttctccagtccgggtttctggcgcgggcaaaaaaccttctctcccggcagcgaggattacctgaaaaacccgcagttctgggaaaaaatgaacaatggctgggatgaattcagcatgccgaaagaggtggcgcgccaactgattgcgatgcatgtgaagcgcggggacagcatctggttcgtcaccggccgcagccagaccaaaaccgaaaccgtttctaaaaccctgcaggatgattttctcatcccggccgccaatatgaatccggtgattttcgctggcgataagcctggccagaacaccaagacccagtggctgcaggcgaagcagataaaggttttctacggcgattcggataacgatatcaccgccgcccgcgaagcgggcgcccgtggcatccgcgtgctgcgggccgccaactcctcctataagccgttgccgatggctggcgcgctgggcgaggaagtaatcgtcaattccgaatactgatgaccgcctgaacgcgataaacggcagcgacggcgctgccgtttttttatgcaaaatcaggggtggaaggttttaccttttcacgtattgctgcacacttagaaggattcattcgcaaaaggagtcaatgatgtggtatcagcaaaccctgacgcttgggccaaaatcccgcggttttcatctggtcaccgacgaaatccttggccagatccgcgggctgtccggggtgaaggttggcctgctgcacctcctgctccagcatacttccgcttccctgacgctcaacgaaaactgcgatcccaccgtccgctatgacatggagcagtattttctcaacgccgtaccggacaatgcgccgtatgaacatgactatgaaggccctgacgatatgccgtcgcacatcaaatcatcgatgcttggcgtgtcgctaatgctgccggtcgaggacgggcgcgtcaggctgggaacctggcagggcatctggctgggggagcatcggatacacggcggttcgcggcgcatcgttgcgacgctcatgggggaataaaagatgacaatttcggagttattacagtactgcatggcgaaaccgggagcagagcagagcgtccacagcgactggaaagccacgcagattaaggtctcagacgtgctgtttgccatggtgaaggaggttgaggaccagcggccggcggtcgcgctgaaggcgagtccggagctggctgagctgctgcgtcagcagcatcgcgatgtccggcccagccagcatctcaataaagcgcactggagcaccgtctatctggatggctcgctgccggattcgcaaatctactacctggtcgatgcgtcttatcagcaggcggtgaaaatgctgccggagccggtccggcagcagcttacccgctaattatttcagcatgggcttgaggaagcgcgcggtgtgcgaggcttcgcactcggcgacggtttccggcgtaccggagaccaggatttcgccgccgccgctgccgccttccgggccgagatcgacaatccagtcggcagttttaatcacatcgaggttgtgctcaatcaccacgatggtattgccctgatcgcgcagctggtgcagcacttccagcaactgctggatatcggcgaagtgcagaccggtggtcggctcatcgaggatatacagcgtctggccggtaccgcgcttggacagctcgcgcgccagcttcacgcgctgcgcctcgccgccggacagggtcgtcgccgactggccaaggcggatataggtcaggccgacgtccatcagggtttgcagcttacgcgccagcgccggtacggcatcaaagaattcacgcgcctcttcaatggtcatatccagcacttcgtggatggtcttacccttgtacttaatctccagcgtttcgcggttatagcgtttgcctttgcactggtcgcacggcacgtagatatccggcaggaagtgcatctcaaccttaatgacgccgtcaccctggcaggcttcgcagcgcccaccgcgaacgttaaagctaaagcgccccggcgtatagccgcgtgagcgagactccggtacgccggcgaacagctcgcgcaccggggtaaacaccccggtataggttgccgggttggagcgcggcgtccggccgatcgggctctggtcgatatcgatcactttatcgaaatgttccagcccctggatatcgcgatacggcgctggttcggcgatggtcgcgccgttgagctggcgctgggcaatcgggaacagggtatcgttgatcagcgtggatttacccgagccggagacgccggtgatgcaggtaaacaggcccactggcagggtcagcgttacatccttcaggttgttgccgcgcgcgccggtcagcttgaggactttttccgggttggcgggcacgcgctgtttcggcacttcaattttgcgtttaccgctcatgaactggccggtcagggattccggtaccgccataatggcctccagcggcccttccgctactacctggccgccgtgaacgccagcgccgggaccgatatcgatcacatggtcggcggcgcgaatggcgtcttcgtcgtgctcaacgacgatcaccgtgttgcctaaattacgcaggtggatcagggtgccgagcaggcgttcgttatcgcgctggtgcaggccgatagagggttcatccagcacgtacatcacgccaaccagcccggcgccaatctggcttgccagacggatacgctgggcttcgccgccggagagcgtttccgccgagcgggagagcgtcaggtagttgaggccgacgttgacgaggaatttcagacgatcgccaatctctttcagcactttttcggcgattttcgcccgctggccggagagcttcagattgttgaagaaatccatcgcatggccgatgctcatatcggagatggtcggcagcggggtgttttccacaaacacgtggcgcgcctcgcgacgcagacgcgtgccgtcgcagctggcgcacggacggttgctgatgaacttcgccagctcttcgcgcaccgcgctggattccgtctctttgtaacggcgctccatgttatgcagcacgccttcgaacggatggcggcgcaccgaggtatccccgcggtcattcatgtatttgaattcaatactttctttacctgaaccgtacagcaccactttctgcacgttggcgctgagggtgccccatggcgcttcgacgtcgaatttatagtgctccgccagcgacttcaacatctggaagtagtagaagttacgccgatcccagccgcggatggcgccgcccgccagcgacagctcgggattttgcaccacgcgatcgggatcgaaatattgctgcacgccgaggccgtcgcaggtcgggcaggcgcccgccgggttgttaaaggagaacagacgcggctccagctcgcgcatgctgtagccgcagatcgggcaggcgaagttggcggaaaacagcagttcttccgctttctcatcatccatattagccacaatggcggtcccgccggagagctccagcgcggtttcaaacgactcggccaggcgctgcgccagatcgtcgcgcaccttgaagcggtcgatgactacctcaatggtgtgcttcttctgcagctccagcttcggcggatccgacagatcgcagacctcgccgtcgatccgcgcgcggatgtagccctgactggcgaggttttccagggttttagtgtgctcgcctttgcgctctttaataatgggcgccagcagcatcaggcgcaggccttccggctgggcgaggacattatcgaccatctgactgacggtttgcgccgccagcggcacgtcgtgatccggacagcgcggttcgccgacgcgggcgtacagcagacgcagatagtcgtgaatttcggtaatagtacccaccgtcgagcgggggttgtgagaggttgatttctgttcgatggaaatcgccggcgacagcccttcgatatggtcgacgtccggcttctccatcagcgacaggaactgtcgcgcataggcggagagcgattcgacgtagcgacgctggccttcggcatacagggtgtcgaaagcgagtgaagatttgccagacccggaaagcccggtgacgacaatgagtttgtcgcgcgggataacgaggttgatgtttttgagattatgggtgcgggcgccccgaacttcgatcttatccattcacctttcccggtaggtagatacacggattgcctggtttgcttgaaggacaaacggcagaaacggctaattatgacacaatttaacctgaatgaatatacagtatcggaatgcaaattcgggtcgagtgtgcaacaatgccgtagccgggtactatctctggaatcagcctcgcagctattaaaatgctacgtggaaatggtacactcgcgcgtttacactattaagaaacgtattcaggagacacgaacatggccagcagaggcgtaaacaaggtgattctcgtcggtaatctggggcaggacccggaagtacgctacatgccaagtggcggcgctgtcgccaacttcacgctggcaacttccgaatcctggcgtgacaagcagaccggcgaaatgaaagagcagaccgagtggcaccgcgttgtgctgttcggcaaactggcggaagtcgctggtgagtatctgcgtaaaggctctcaggtgtacattgaaggccagctgcgtacccgcaagtggaccgatcaatccggtcaggacaaatacaccaccgaagtggtggtgaacgtgggcggcaccatgcagatgctgggcggccgtcagggcggcggcgcaccggcaggcggcggccagcagcagggcggttggggtcagccgcagcagccgcagggcggcaaccagttcagcggcggcgcgcagtcccgtccgcagcagcaggccccggcagcgccttccaacgaaccgccgatggacttcgacgacgacatcccgttctaaggcttgccttaggcgcactgtctgcgcagtcgaaaacagaaagccccggtttcgccggggctttttctttgttattcctgcaccgtcatttcaggatggaatttgacctacggtaacgagcgattcagatgacgggcacctgagcggtggcggctgtcgccacgctgggctgcggtttggctggctgcgccaccggctcctgccgcggtacggccgtcgctttctgtttgcgggccatgtcatcgacgatcagccgataggcgatgtaatacttatagatattgctgacgtaggttaccgtctcggcgccaattttttctgccgccatattttcgacgttaccgaaccagacgttcgggtcaaatcctcgctgtttagtcatggtgcgcaggcgggcgatacgcgccggacccgcgttataggaggcaaaggtaaacagcgctttatcgagccgggtcatgggctcatcggcatagtaccgatccatcatccagcgcatgtatttcacgccggcatggatattgggatccagctgtttaatatcgcccaccttcagctcttttccagtgctgggcatcacctgcataacgccgatggcgccgacgtggctccgtaccgactgattcagccgcgactcctggtatccctgggccgccatcagcagccagtcgacgtcgtaacgatcgccgtacttgcggaagacatctaccatcgcgaggaatttgcgtcgttccttactcgccgcggcatttttgacatatttagcatttttcaggtaacgcagcaggagagtattgcccagcgtggtgccctgacgattctttttgacgaagttgttcagtaccgtcagcagctgcgggctgtctttgcgtaccgcccaggcaatgtcgccgccgtcgcgcagcaccacgttgtcatggacctgaatttttggaaacacctgtttccagaacaacgccttatgctgatcgacgacgatcagcggaatcagcccggcgttgagcatttccagcagatcttcatcctccagcgcttccggcgccgcctccagtatcaccggtgggcgcgattcaccggcaaatcgggcgttcagcgcttgcaggctgtcgtaatagctggaggagcggcgaacaaagacggtttgaccagagagttgctccagactgtcgaccttcggtgaagccgggccggagatcagtaattctttcacgttgctgtagagcggctgggcgaaatcgacctgtgcttcccgcgagggcgtgatagtcagattggcagccgcaatatcgcctttaccttcattaagcgcgataaagagattgtcccgactgaccggcacaaaaacgatatgcagcttcaggtggcgctgtttgagctttttatccttcgctagctgtttattcagatcgttttccagcgcgataaaaatgtcgtgcgtcgccccgcgctgggtgcctttatcaataaaaaagaaggtcttgctgtaggtggttaatacccgaatggtacgacggtcgatcatgccaggcaaatcgcctctccatggccgtagcatatcgtcgatatgaatcgatagcgtgttgtcttcggctgctgccggcggcgctttttccgcctctactgccggcagcagaggagcgaataacagtgtcgcgaggcaggtgagccaggcgataaacagacgtgatagcgagtaggcgttcatggaggaatactccgcaggggatgtgattattttagcagaacggccgccgttagccgggcacgacaagggcgtaaaaaacataacaatgccgacaaatagttttctcccattttatcgcttactattaatatgtttttatctttaatttaactatggagataatatggcgaaaatgtgtgtttttaatgataaatagaaaataatgatgatgtttttattttatttctccccatctgttttgttgtaaccttttgattgttggtgtttattttgtttttcttcgagattgattattatcatcttgataatgaatctcatttttattaccgtaacacggcacattactctaataacacgctgtctggattacgctatcaaagaatagcgcgcagcgctttttctctaatgatgaaacagggcacttaattttattatgcctcatgctgttttcttattcccatgactatcgggaaggggctgacctacgccaaaatctggcgaggcgcagaggcgagtattttatcccattgttttttcaattggggaaggcgttatgcccgacagcaacagaaaacagggcatattctatgaaatacacgtctcacttcccgctggggatcgtcattcctctgctcgcctgtagcgtgccgctgcaggcggcagagaacatgaccgaacaatcgacgcctgacgagagcgccgccactgccgaaaatcacgaggagacgatggtcataaccgccgccaggcagaacctgcaggcgccgggcgtgtcgaccatcaccgcagaagagatccgcaaacatccccccgcccgcgatgtgtcggagttaattcgtacgcagcccggggtaaacctgaccggcaactctaccagcgggcagcgcggcaacaaccggcaaattgatatccgtggcatggggcccgagaatacgttggtgctggtcgatggtaaaccggtgaccagccgtaactcggtgcggtatggctggcgcggcgatcgtgactcccgcggcgataccagttgggtgccagcggagatgatcgatcatatcgatgtgatccgcggcccggcggcggcgcgctatggtaatggcgcgatgggtggggtcgtcaacatcgtgaccaaaccgaccacaccagaatggcacgggtcgtggaatacctatatgaacgctccgcagcaccgtaaagaaggggcgacgaaacgtactaactttagcctcaatggtccgctgtcggacagtgtcagcttcaatctctggggtaatctgagtaaaacccaggccgatgcgcaggatattaacgccgggcatgaagcggaacgtaccggttcctacgccggttcttatcccgccggacgtgaaggggtggtgaacaaagatattcacagtaagctgcgctgggagtttgccccgatgcaggccctggagtttgaggccggttacagccgccaaggtaatctctatgccggcgacacacaaaacaccaataccagtacgctggtgaagagtatgtacgggaaagagaccaaccgtctctaccggcaaacttacggcgtaacatggaccggcggctgggataatggcgtgaccagcaacagctatgcccagtacgaacacacccgtaactcgcgaatggatgaagggctggcgggcggtacggaagggatcttctccagtagcgagttttcagatatcgatctggccgatgtcctgctacatagtgaagtgaatattccgtttacgctgggggtcgatcagaatctgacgctggggacagaatggaatcagcagcggatgaaagatggcgtatcgacaacccaggcgctctcttacggcactatcgatggcgtatcggctaccggtcgtagcccgtactccagcgccgagatcttctcgctgtttaccgaagataatatggcgctaacggacagcaccatgctgacacccgctctgcgcttcgatcaccacagcatcgtcggcaataactggagccccgcactgaacctgtctcaggagctgacggacgactggacgctgaagctgggcattgcccgcgcttacaaggcgcctaacctctaccagttgaacccgaactatattctctacagcaacggtcaaggctgttacgccagtagttccgcctgctatctgatggggaatagcgatctgaaagcggagaccagcgttaataaagagattggtcttgagtacaagcatgatggctatcaggcggggatcacctggttccgtaacgactatcacaataagattgagtcagggtatgcggcggtgggtaccgccagcaacggcaccaccaatatctatcagtgggaaaacgtaccaaaggcgttagtggaaggcctggaaggaacgctgaatctgccggtgggggaggcggttaactggagcaataacctgacctggatgctgcagagcaagaataagacgaccggcgaccggctgtcagtgatcccgcagtttaccctgaactcgaccctaagctggcaggttcgtgaagatctctccctgcagagcacctttacctggtatggccgacagaaaccaaaacgcttcaattataagggcgaggcggtcagcggcagcgaactaaacgaagtcagcccatacagcattgtcggcctcagtgcgacctgggatgtgaacaaaaatctgagcttcaccagcgggatagataacctgtttgatatccgccactaccgggcagggaatgcgcaaacgaccggcaacgcgacgacgggagcttatctgtatggcgcgggtgccgagacctataacgaatcggggcggaccttctttatgagcgttaatactcatttctgatgatcctgatgaggagtaaaccgggtgcaacgcgacccggtttttttatttcagatgagagcggaggaggcggttataaatcgtgacaaaatcttcacgccctctacattattagctcaacatatccttttatactgatttccgtcgcgcaaggtcgttgatcccgaccgggctcgataatagcatcctgctatttcccttctgtaatatcccctgtcccccttccattcccaaccgcagcgatgcggaggagggggacctccttatttttgccgcgtgatctgatagcgatactgagtgggcgtgagcgcatgatattttttgaaggtacgattaaacgcactgagatcgtcataaccgaccatcatacaaatatcgacgattcggtaaccaggcgtcgtcagcaataaacggcgacacagcgacatgcgctgctggcggatatattccattggcgaacgatcaaaataatgacggaagagccgaaacaaatgccagggggaataaccagagatatcgctcagatcgtcgacggtcagtttcttatccagattattatcgatccacaagagcaggtcgcttaataccgattgctggagcgttttgctacgcataattgcggccaatcccataacgcagggctcctcagtgaggagccctggggtttattgaacagtgagtgtgccgtggcgaacctgataatttttttgattatcagggccaatatagtcgctggcgggttttgccagctgcagatgaccaaaggcggttgtttgctctgcatgataattttcgccgtcattcacgtcgccgcgcccgttataacgggcaatggccgggaagggatacaccggacgagtcgcgataaccgctggagcggcgtcagcgtaaggctgactgactttctgcacgccgtgaaactgcgtttgcgcatctggtttttctgtcatcggcggcaggtcggcagcggctgttgcccgtttgccggccatgatctcctgcggcgcgatgccttcctcggtccagcgcatcagcggggtaaggagatcaatttgatcgtaaccttcgccattaccgcaatgggctaccccaggcagcaggaataaccgcaggaaggtatccgttgcggcatggcccatctctgcttctacgccgcgataataggcgatagaaaaggccgggctgacggagtcatcggccagaccgtgccagaggataagcttgccgccgcgctgttgataggcatgaagattggtatttgccgcgttatagagcggcgccagttgggcgacggcgtcaaaattctgctggttaagcgggaaatcccgcatcgattggatcttctgtttttctcctggcaggagcacggattgcagagccggtagtaccatcatttccgacattgagtggccggtcggcgtctcgggcaccggccagcgtagctcggaacccagcggcagaccgcccgcgacgaactgggcgccgtggctgtcgtaagcgccgcggtagagctttttcaccacctcgatctcttcctgcgtcaggcaggtagaacggtcccgagcatcggcaggacagcgggggagccatgactcagagaactgacaggcatacggattttgcaggacaccatcctgcacgccggaaagcgtcgggcagtgagccagcacggcctggtgaatcagaggaaggcgatttttcagcaggatagcggtaccgtccgggcgctgattggcggccacattccagccgtggaagaaggagttctgaaactggaaaaaggccgctggcgcgccagcgctgataccgtcaaaatcctgcggaaagcgctgcgcttccatcaatgcttcgcgaccgccgtctgagcagcccataaagtaggcatactttggcggctggcggtaaagcgtctgcatcaccgctttggccagcacggcggtcaggtggttggcgcgccaggcaaaatcgatgcgcttttgcggatcttcggcccatgacgcatccatcatactgccatggtgccccatatcggttgctgccaccacaaactcgccgttcattgccggcaggcagccgctggcattcgacagattcaggttaatactcccgcacagtccgccacagccgacctgcaaaaaacgttgactccagcgttgggtcggcagggcaatctgcacgccaatctcaggggcgatagtggcgctcaccttgcaccagcttccctgcgcggaggtctgcatttcagtgtggttgatagtgacctttgcgccaacggccgcgctgaagtcggtagtgcttagcgcatcgcatgtcagcgcgggaagaacgatcggcagactggcgacagcctgcgtgggtgaagcgaacgataacccgaagagggcgcagaggatgatgggcaagattgtcttgagtaagcgtgtcatacgcagttccctgtggctgatgatgggaggcggcaggatggcgaaacctatgcctcaccttccctggcgaggcgccactgcttggctattgtagataacgatagactttccttgatgccttgataaggcgaccctactgtattctgctattttgaggaaaatatggagatgtttgccaacggcgtctggcggtgaattcggggtagaatgttgtgatatcagttgcataatttattcaatttctcttcattaaatctgctgggttgcaggttatttttctccctgttcctggtgatcccagagagcatcattcctaacgagatccttccccctttccattaataagaaagggggctttttattaataaaacgttcaggcaaatctaaatatagtactggtgttggccattagaacaatgcgcttcagaaaaagttccatcattaaatatatttttaaagatgctttaatatccattttttctccattttgtcgccataattgcatgtaattctgcgcctcgctcaggttattttctgtcgcatattttagagatgcatcctgaacaaataagctcaacgccagcagaacactgctattgctcattatctcgtagacgacacattcatgttaaaaaagactcatatcatcagcggattattgatcgcccctttaacgttatatgccgcaacatcatatcaagttgatgatatccgttttgaagggctacagcgcgtgaccgtcggggcggcgctattaagtatgccattgcacgcgggagatgcggtgacgccagaagatgtcagcgaggcagtgcgcgcgctgtatgcgagcggcaatttcgaaaatgtgcagatcctgcgcgatgggaaaacgctggtggtgcaggttaaggaacggcccactattgccagcgtcagtttttccgggaataaggcagtgaaggatgatgcgctaaaggaaaatctcaccgcgtccggtatttctgcaggtagtgcactggatcgaaattcgcttagcgaaatagaaaaggggttgcaggatttctattacagcgcggggaaatacagtgcgcaggttcacgcggtggtgaccccgttaccgcgtaatcgcgttgacttaacgttcgtttttcaggaaggcatctcggcgaaaatcgcacaaataaacattatcggtaatcaggcgtttcgggaagagacgctcctggaccagcttcagctacgtgataatgtgccgtggtggaacgtggtagccgataaaaaataccagaagcagaagctggaagccgatctggaaacgctgcgcagtttttatctcgatcgcggctatgcgcgctttgctatcgagtccacgcaggtcagtatgacgccagataaaaaatccctgtatatcactatcgccctcaatgaaggcgaacgttatcgggtcgaccgaactcaggtgatgggcgatctggctcagcatgggccggagatcgaggcgcttgcccagccgctggcgggggcatggtatagcggggcgcaagtcaccacggttgaaaatgagatcaaaaagcactttggtaagtatggttatgcctggccgcaggtgacgtccacgccggaaatcgatgatgcgcatcaccgcgtggtgctgcatattcaggtcaacgcgggccgccgctactcggtacgccagatccgcttttccggtaacgacacctcccgggacgcggtgctgcgtcgtgaaatgcgccaaatggaaggggcgtggctcaacaacgaaaaagtcgatcaagggaaggtacgtcttgatcgaacgggtttttttgagaacgttgaacagcagatcgttccggtcaatggaacggcggatcaggtcgatgtggtctacaaggtgaaggagcgcaacaccggctcattcaatgtgggcctgggatttggtacggacagcggcgtgagctatcagcttggcgtgacgcaggataactggctgggaacgggtaatagcgttagcttcaatgggacgcgcaacagctaccagtcttatcttgaactgggggcgacgaacccgtggtttaccgtagatggcatcagcctgggcggaaagattttttataacagctatgatgcttctgatgcggatgccgggagctataaccagcagagctatggtttaggtagtacgctagggtttcccattagcgaaaataactccctgaacctgggactggattatgtccataatcgcctgaccaatatggatccggagctgacgacctggcgctacctcagctctcggggaatcgagcccagcgtggtgacgaaagatggcgacagcggcgcaaaatatagcgccaacgattattttgtgagtcttggatggggctacaacgatctcgatcgcggcttcttcccgcgtgcgggaaacaagagcagcctgagcggtaaagtgacgctccccggttcggataatagctactacaaactctcttttgacaccgcccagtatctgccgctgagcgagaacaagcgctgggtctggatggaacgcctgcgcgcaggctatgccggcgggttagacggcaaaagtgtgccgttctacgataacttttacgcaggcggttcgtcgtcagtgcgcggattttcttctaacactattgggcctaaagcggcctattaccgctgtaacggtagcgaaagcagctatagcgcctgcccgctggacgcctcgtctgatgcggtcggcgggaatgccatggcggtgctgaacagcgaatttatcattccaaccccctttgtgaatgataagtacgccgatagtctgcgaacctcgctgtttgttgacgcggggacggtctggagtacatcctggcacaacaccgcgcagacgctggcggcagggatccctgactacggcgatccgagtcatattcgtctctccgcggggattgccgtgcagtggatgtctcccctcggtccactggtcttctcctgggcagagccgtttaaaaagtacgatggtgataaagcagaacagtttcagtttaatatcggcaaaacctggtagggctccaacggggcctgatagaccggcgtggctatattctgtggactgtcctccgacatagcgattgagcagaatatactcaaccgctatgtcgatattatcgctaaggaatgcgatctggcgggacacccgcgacatttacccgagcgcggtctgcgggcctcgcggacctggtgacgtacgacgaggtaaccacgcaataaatagctgcctgctatggtcctctcttcttgccaaaccgcgggtaatactcagtgctgcatcatctaataccaatggctgaggcctcatccagagggactaagacgtattgtcaattaagtttatattatcttattttttattgtattttcttttttaaggttaatttggctgtttttcatcaggcctaaccataaatttagagagggagatgaaacgttactaataatggagtatgttgttaggaattgtcttaaatcacataattgtcaggggtgcttgcgatttataacaatgaatgctatcactatatattgtaataatttgtagcatctttataaggaaggaatatgaaatggactattcttaataccctgatctgcccgcaatctggtatcgccttctcggctatatccagtctgcgtttcttgaaatttatcatgtggtacgaggctgatgtaatcctgttgcccggtgagtcgataagactctattcctcgagagttttaattaatgaccagtatcattcattaaaaatctataatattacggtgtacgacgaggcgcagtgggaaaaattacgtgagcgaccatcgtgcccttaccatgccggtggcgagcggtctgactcctgtttttaccagtccttttgcacgattaagcgttgcccgaataatattccccgcagtgaaccctggcgttagccagtccacgccgccggtcagacaccggcggcgtgacctcatttcgccagcagggcggccagtcgaggctggacgcttgcgcagccggccagcacgaggttgcctcgccgcaggcccgcattggcgagaaacgcattgcacgttccgcccgcctcctcaatcaatagcatgcctgccagcgcatcccagctgttcatatgcgcttcataataggcgtggagctgaccggcggcgacatgcgccagcatcagggcgcccgcgccaaaacggcgatactccagaccggcgtcgagcagcgtgtcgatggcccgggcgtagtcgctggccggggcccggctggagcgccccatgccgatcaccaccgcatcgggctccggctcgcgtagcgtcaggcgccgaccgttgagatacgcgccttcgccgcgggcggcgaagaaaaattcatcgcgatcgggggcgtaaatgatgccgagcgacagctcgccctggcacactcgcgccagtgagatgcaccagtaatccatgccgaggataaagttggtggtgccatcgacaggatccagcacccagacggtctggtcgtcgccttcaaaaccgctctcctcgccgaggaaaccctcctcgggaaagtgggcctgcagccagcctttaatctcttgttctaccgcgagatccgcctgcgacacaaagtcctggcgcgcttttttatcgacctgtaatcccgcatcgcgcagcgcctgggcgtgggcgcctgcctggcgaatcaaggcgcataatgactctcgttgtgcttccgtcatagtcctgctctcagataacaaagggcgacgtgcgccggtgaattaaggttacctccacccaggtggtgcgtgaaggttgcgaagggtcggcggcgcgctccagaagccgggcgagcgcctggcgggcgatcgccgccacatcctgatgtagcgtggtgagctgatagctatattgcgcggtcgtcggcgtgttatcaaaaccaatcagctgaaaatccgccggagcctctctgccgcgctggcgcattccatcgagaaagccacatgcaagctgggcgttggcgcagaagatcccctccagcgcctcgtcggcgagcgccgcagcctgtaacccgcccgcgtaaccttcttgctgacaggcgaggatcgccaggtggcgttcgacgtccactccgcgcgtttgcagcgcccggccgaacgcttccccgcgcatgcggccggcccaggtggaaggatggtggttgagccagccaaagcgctgacagccgctgcgcagcagttggtcggcggccagttcggcgccggcggcgttgtcagaacaaacgtaatccacgccggggattgtcggctgacgattaatgcccacgaccggaatatgctgctggacgcactcgttcaccagcgcctccggcggctggccggaggtgacgataacgccggagacgcgaaactgagcgaaacggcgcaaggtctgcgccagatcctgctcgctgtggatctcgctcaccagcgcctgaaagccctggcgctggatctcgttaagcagcgcatcaagcagggtactgcgaaaaggatcgctgatgcgcgagacgatcacgccgattaagtggctgcgctggcggttcagcccctgggcgaggaagttaacctgataccccagctcttcggcggcgcgcagtacccgcgcccgggcgtcgggagagatgctgccgttgttgctcaacgcccgggacaccactgcccgggagacgcccgctcgccgggcaacatcctgggcggtgacgctgggtttgcgtgggttcataggaggtacgtctcgtcagtgggcgtgggacgcggcagcgttaaggtgagtccatcccgggaaacgaataagcccggccacggctgacaggcctgctttagcgccgacagggaagcatcctcgcagtgatagagccccagcgccgggagctgcagcgttctgaacagcatcaggcaggaggggaaatcgccatgcgaggcgtcatcgtccagggctgctaccgaggcgcactcctgaaacgccagcccggcgccggccatcagggctatcgagtcggcggtcggtcggccatcgccgctgtaaaacagcgtctgcccggcaatggtgatgcggatggcgcgattactcagctcatgctgggtgggggcagtgcggatctgccagtcctgccacgtccaggcttcgcggcattcctgccagtcgatggtgaaaccaaggtccgcctgcggccagttcgccagcgcggccagttgcatgagcaccggctgctgcgccggctggcagtagataatgactggcttctgacgggaataacttttccagtggttcagtagcgccgtcaggccggtgcagtggtccgggtgaacgtgggtgaagtagatcgcgtcgatatcgttgacctcgccgccgcgctgccagagcgcgcggggaacggtggggccgcagtcgattaaccactgtttgttgtccgcatcgatcacccgcagcgcggaggtattttgcgtgcaggaaaaggcgctcccgcagccaagcacatctattttcatttaccctcgccaaaattttttgccgcttaattaaattgtcataaatacccgacaaagtaggctcatatcatgtcgagtcaacgttgcattttttttacagtcaaatgaacacgtgttcaccttgctaaaaaaaatgccgcagcagcgctttcaggtagcgaatatgagttatttacagatctccggccttaaaattagttatggcgataaggtggttttacataatatcgatctggcggtagagcagggagagatgattgctctactgggcccgtcgggatgcggaaaaaccacgctgctgaacgccctctgcggctttattccggtgcaaagcggcgaggtggctattgccagccgaacgatcactcatcttgcgccggagcagcgcaatatcaccatggtatttcaaagctacgccctgtggccgcacctgacggtagcgcgcaatatcggctatggcctgaagctgcgcaaatggcgcggggcggatatcgcgcggcgggtggcggagctgctgcgaatagtcaatctcgaagggcttggcgaggtgaaagtgaccgaactgtcgggcggccagcggcagcgggtggcgctggcgagagccctggccatagagccccaggtgctggtgttggatgagccgttatctaatctggatgccaaagtgcgcctgaatgtgcgccatgaaattaaatctctgcaaaagagactggggttcacgtcattaattgtcacccacgatcagcaggaagccttagtgatggcggaccgcattgcggtattaaatcaggggcgtattgaacaaaccggcacgccggaagaaatatatcaacgccccgcgacgcccttcgtcgctgattttatgggggccgataataaaataatttccggtgaattatccgctgccgcaatatccggtttatctgccgctcagcagggtgacaacgttatttattttcgcagcgccgatgccgcgctcgctgaattaacgcagcctgcgccgcaggaggggctggctctggaaggcgtggtggagcaaagcgcgtttctgggcaatctgtatcgtcacagcgtgcgctgccatgaccgcctgctgctggcggatgccgcgcagtgctggccgacaaaaagccgcgttcggctccatgtgccaacgccggccctgcatatttttcctttaccactatcacagtgatatcagcgtgttcattctggggacaatccatgttgactaagacgaaagcagcgatcgtaacgaccctcttcctgagccttggcgcacaggccgacaccattctcaacgtcgccaccgcgggcgatcagaatatggtggattatgtaaaaacctggctggggccaaaatttgaagccgctcatcccggcgtcaaggtgcgggtgatcggtaccggccccggcgacgccgggtcgaataaaattagcgagaagctaacggcccagcaggagagcggcgcgcagcagtgggatatcgacgtcgcggtagtgcaccagaaggcgggcggtgagcaggtggcaaagggattgctgcaaaaataccgtcaggatattcagaccggcggcatggtgagttcgccgagcgccacccaggcgctgggcgttaacgttgacggatacgtgatgccgatgttcttaagccagaccgctatcgcctggaacagcgatctggtcactaccccgccggcgtcgtatgacgagctggtggcctggacgcagaaacacccgcaggcttttggctataacggcatcaagaatggcatgtccggcgtcagctttgtggtgggctggatctacgcctacgggaccgacgcccagcgtctctccgccgggccctatgataaaagcgtcgaaaaaagctggcagcaggcctatgagaagctaaaggcgttcaataaaaacgtaactttcaccccgggcaacgccgggacgctcgatatgctgagccggggggaaatcgccatgggcccggtgtgggtcgatatgttctatagctggaaagatcagggcaagctgccgccgtcgatcaagcttgctttactggcgccgggcatgcctggccagccgatgtattacgtcatcccggcgaaggcggcgaatccgcagctggcgcgcgactttatcgcgctggccaccagcccggaagtgcaggcgcaggggatcgtcaagcagttcaactggtatccgggcatcgacgccgggcaggtgaagccgaagctggatacggcgacctggcaaaagctgtttgccgaaatctcgccggaagcgctggcgaagtatggcaaaagcttcccgatcgccccctactttgacgatatcaaagagggttacgaaagccaggtggctaattaaacctttttccagcccgggccgccgtcccgggcgcttgcttgtgctgacgccaggtttattatgtccagttcattaaaatatctgctgctggttgccccggcggcgctgatgatcgcgatcctgtttttgtatccgctggggttttcgctggtctcggcgtttaccgcgccgggacagccgttcaccctcgatcacttccgcaaggtctatgcgctctacgccagcgatgtgctcttttcgctgcttattgtgctgatctcggtggcgctgttagcgctgctcgccattaccctgtcggcagtgattgcgctgtcaccctgccgacccgttgtgcgtttgctgggttttttgtatcgcctgccgctgtttattccttttatcgttgttgcccagatgatgcgcacttttctcgccaaaaatggcctgatgaacaatgcgctggtggcggccgacctggtcacgccgctggagacgctctcctggctgggatggaaagggatagtgatcacctttgtctggaagcaactggcctttgccacgctgctgatctgcggggcgatggcggcgctggagtcgtcgcagatccttgctgcacgtaatcttggcgcctcccggccgcggatcctgttcgatatcatgctgccgcaggtcctgccgactatcggcgtggcgctggtgctgtcgacggtgaccatgatgtcggtgctgtcggtaccgttgatgatcggcgtgggaaccccgacgatgctaaccgtggatatggcgtttcgcgtcaattcctatggtgattacgcggtggcgaatgcgcttggcgtggtgtcgctggcgatctgcggcgcgctgtcgtggttttacctgcgccacagcctgcagcaaaaaggcggtgaatcatgaaagcgctggccctcgtatcaacctcggcatggtgggtgaaagggcgccgtaaagtgcgcgccagtccggtgctgcagaccctgctgctgctgtttatgctgctggcgatgtttggtccgctgctgaacctgttgatctggaccgtagcggaaagctggtattttccccattcgctgcccagccggtgggggctgaagtactggtatcaggttttcaatccatacagcgatgtctccagctcgctgttaaccagcgtgctgatcgctctgttatcggtgggggtctgtttgctgatttccgtacccgccggctatgcgctttcccggcggaaaatgccattacggatgctgttcatgctgctatttcttatcccgcaggcctttcctaacctgacggtatacatgaatgttgcccgattgttttatcagtggggattgaacggcagtatcgcaggggtggtgctggtgcatagcgtccacggcctgatgtattcggtgtggatctgtgtagccgcgttttcagccatcgacccgctgctggcgcgggcgtcgcgtaaccttggcgccgggccagtgtataccttctggcacattgtgctgccgcaggcggcgccggggatcgttgccgccagcatctttgtttttctggagtcgctggatgagtttaccggcactttcttcgtcggggcgccggatatcaccacgctgccgctgctgctctataacgccagcatgtcgggtaactatcaggtctcgtcgattaccgcgctgattttgctggccccatcgctgctctttatggtggtgatccataaatttatgcgtccggagatgatggcgaaattagggaaataagggctgcagaaaacgaaaaagcttcccgtcgggaagctttttaacctcaggtcatcatcattggccattctggcggtgtctgactcatgacttcaatcatcacatctttgatattgccccagattttggcaatatcgagcagggtgataccgagcaaaccggtggcgaaccagcaggcggcggccaggccgaggcagctgcagatcaccgccagaccggcgtaatcgcttttgcgaagctgaatattcagtgagctggcgagaaacatcagtaccgcgctcaccaggggccagcgcaataatacgacactggtagtaatggaagccattaacctatcctcaaagaaagtcgggagccatggacgacctggcgcgactgacgatggcatagcgctctggtctcaactggcgtactagagagtgatgaaacgccatttctgtttcatcaacttgtgtgaactatatcacacttggcgctttattcaccagtcaaaaaatgagcttttgctgcgtttaataactatgaagtttgtgtggatattggtgagcaatcccgggaagcatattttcattcactgcctaatgattattattctgcgggttttattacctgttcttgtttattacacggagaaaccgagtcagatgcgcgtctattcttaatcttgccggaatatcttccgaatacctgataaataagtattattcatcaccatcagaggtaaaactgacgctcgtgagggctgtcggatgtcagctgatgtctatcgcaatcgcgattgctaacgtgttcgggctaccttaattaaggcatatcgcatggatgtaagcgtaaatgggtgacagtgcgccgcataaggcgctaagactcatcggaacaggtttggttattttattgccagtggtgctggcattgtggtttgcccagctgcgggctaaagccgaaaccattgatcaattacactcattttcgcagctggcgctgcaaaaaacggaaatggtcatccgggaagcggatcaggctcgggctaaagccagccagtatcgcggtgagttgtgttcagcggatcaccagcgttatttactgcatattgtgcgcggcctgctgtatgtggaagatctgatctacgctaacggccagcgctttatctgttcaacgtccgttcatcagcaaaccggctggcggatgccggcggctaattacaccaaaaagccggatgtcgcgatttactattaccgggacacgccgttttatccgggctttgccatgaattatatgcagaaggggccctatgttgtggtggttaatcccttctcgtacagctcggtgatcgccagcgaccgcgatttagcctatggcgttttcgataccaaaaccaacctctttttctcggtaagtaacaatgtcgagcccgcggaactccatgcgttaattcgcgaaggcgataccttttttaatcagaatggccgggtgtatacgatcgcccgctccgctattcgccccatcgccgtcattatgtccacctcgcgggccagctactatcacaacttttgtgaccaggccagtctgacgctgccgctggggataatttgcagtattttactggtgctggtgtggtcgcgcacccgccgacagtatcactcgccgcgcaatatgctgcagcgggctctgagctgccgccagctgcgcctgcactaccagccgattatcgatattaaaaataaccgctgcgttggggcggaagcgctgctgcgctggcctgggtttgacggtccggtgatgaacccggcggagtttattccgctggcggaaaatgaaggcatgattgcccaggtcacggactacgtggtggatgaactgttttatgaaatgggtgagtttctggccagccatccacagttgtatatagccatcaatctctctgcgtcggatttccattcggcgcggctgatttcacagatcagtgagaaagcgcacagctatgcggtctgtatcggacaaatcaaaatcgaagtgaccgagcgcgggtttatcgacgtaccgaagaccacgccggtgatccaggcgttccgcgaagcaggctatgaaattgccatcgacgatttcggcaccggctactcgaatctgcataatctgcacgcgctgaacgtcgatatccttaaaatcgataaaaccttcgtcgatacgctcaccaccaacaacaccagccacctgattgctgagcatatcatcgagatggcgcgcgggttgcggttaaagacgattgcagaaggcgtggagacgccggagcaggtaagctggctctacaagcgcggcgtacagtattgccagggctggctgtttgcgaaagcgatgccggcgcgggagtttatgcagtggttagccaatgctcccgcgcccgcgaacgtgcctcagccgccgcgtcacgcggagatctgatggcgatagtcgctgggagtgcggtcaaactcgcggcggaacacccgtgagaaggtttgctgcgagacgtagcccagatccatggcgatatcaaagatcggccgctgggtggttcgcaacgcttccgccgccagcagcaggcggcgctggcgaatatagtcccccagcgtctgatgcatcacggtacggaacatccgctgcaggtaccacttcgagtatcctgactttctggcgactatatcaatgttaagtggttgatcgatatgttcatcaatccattcaatcaaagtttgaataatatcctgatgggacataaagcggcctctctcaattctcgattcgtcgttttgtctgcaggcgagtataattcctcaagttaacttgaggtaaagcgctttatggaaaagaaatcaccccgcatcaaaatgctgttgacgcctggagaagtggcaaaacgaaccggcgtggcggtctcggccctccatttttatgagagtaaaggattgatccacagtcagcggaatgccggcaatcagcggcgctaccggcgtgacgttctgcgcgcggtggcgattatcaaaattgcgcaacgtattggcatcccgctggccactatcggcgacgcgtttggcgtgctgccggaagggcacaatctcagcgcaaaagagtggaagatgctgtcatcgcagtggcgtgaggagctggatcggcgcattcataccctgacggcgctacgcgaccagctcgacggctgtatcggctgcggctgtttatcgcgacgcgactgcccgctgcgcaacccgggcgataaactgggggaagagggaaccggcgcccggctgctggaagacgagtgataaaactaaagcgccacaactgggcgctttagttgttttccggtcttggtctttcgcattatctcgctggttcgcgagagggtttcccccgacgtcgacgtccctcagtattgcgcaatctgttgatggaggttccggtttgcgtcgacactttaactatggcatctgccgtcgctttttcctcactattttgctgaaattttcccggcaatgagcgcctgtttctatagttaatttgaacaaactacgggagaggctcatgctgacggtacatcatcttaatcaatcacgatcgcaacgcgtactgtgggcactggaagagctgcagctgccttatcagatagtccgctatcagcgggagaaaacgatgctggcgccggcggcgctgaaaaaaatccatccgttgggcaaatcaccggtactggaagataacggctatgtgctggcggagtccggggcgatcctcgagtatttgcaggaaacctgggacagcggcgggttgttgaagccgcagggaattgacgacaaactgcagtaccgcttctggctgcactatgccgaaggctcgctgatgccgctgctgttaatgaagctggtgttcgccagccttggcaaaccccctgtgccctttggcgttcgctcgctgggttcgctgctgggcaaggggatacagaaaacgtggctcgatccgcagctggccacccatgcgcggttcattgacgaccatcttgccgcgcggccatggttcgctggcgagcggctgagcatggccgatatccagatgagcttcccggtgatggcattgttggcgcgcggcggcatgcatgaccttgtccatatcgaggcctggcgtcagcgagtggaacagcgaccggcctggcaacgcgccatcgagcgcggcggccccttcaccttacccggcgcctgagatatcagcggatccgatgacgtcgataaatgaaagcaactcactaaaaaattgttagcggattgcgcatagacgataacgtttgcgcatcggctggtcattttctgttcgtcataagcgaaatttagcgaaatacgataaacatcggttgaaaagggttatctaaaggccggataatcgtttgcctttctgtttcgctcccccttttttctgctgtccgggggaggcgataaggttgaccaccgtagtgtatgcgcggagttaaacgtttgcttttttgcggcccccctggcgctgcgattcggtacatggagatcgcgtttaactggcagtggacggtccaccacgcatatcaacgaacgataaaaattttcaggggaagttttctatgtctacgccttcagcgcgtaccggcggttcattggacgcctggtttaaaatttcggcgcgcggcagcaccgtgcgtcaggagattgttgcaggtcttactacctttctggcgatggtgtactccgtcatcgtggtgccgggcatgctcggtaaagcgggcttcccgccggccgcggtgtttgtctcgacctgtctggtagcgggcgttggctcgctggcgatgggattatgggcgaatctgccgatggcgatcggttgcgctatctcgttgaccgccttcaccgccttcagcctggtgctggggcagcagatcagtattccggtagccctcggcgcagtattcctgatgggggtcctgtttacggtgatctcggcaaccggcatccgcagctggatcttgcgtaacctgccgcagggcgtggcgcacggtaccgggatcggcattggcctgttcctgctgctgatcgccgccaacggcgttggtctggtgatcaaaaacccgctggacggtttgccggtggcgttgggcaactttgacagtttcccggtggtgatgtcgctgattggcctcgcggtgatcattggtctggaaaaaatgaaggtgccgggcggcattctgctgaccattatcggcgtgtcgattgtcggcctgattttcgatcccaacgtccatttctccggcattttcgctatgccatccctgagcgatggccagggtaattccctgatcggcagcctggatatcgtcggcgcgctcaacccggtcgtgctgccaagcgtgctggcgctggtgatgacggcggtctttgacgccaccggtaccatccgcgcggtggctggccaggcgaacctgctggataaggacggacagatcatcaacggcggtaaagcgctgaccaccgactccctgagcagcgtcttctccggtttagtcggggcggcgccggcggcggtttatatcgaatcggcggcgggtaccgcggccggtggtaaaaccggtctgaccgcggtgacggtcggtgtcctgttcctgctgatcctgttcctctccccgctctcttatctggtgccggcctacgcgaccgcgccggcgctgatgtacgttggcctgctgatgctgagcaacgtggcgaaaatcgatttcaatgactttgttgacgcgatggctggcctgatcaccgcggtgtttatcgtgctgacctgtaacatcgtgacgggcatcatgatcggtttcgcgaccctggttattggccgtctggtctccggcgagtggcgcaaactgaacctcggcacggtgattatcgctgtggcgctggtggtgttctacgccggcggctgggcgatttaaacccttcgtgctcctcacgggcggctcaggccgcccgttttatttttaagccacatcctgtttccatttgcgttaatctgggtagcgtatgattcacaggcacgacgccttacaggtataaaagaaaacgcagcaaacagggaacacatggaaatattctttaccatcctcatcatgacccttgtggtctcactctccggggtagtgacgcgcgtactgccctttcaggttccacttccactgatgcaaatcgccattggcgcgcttctggcgtggccgacctttggtttgcacgttgaatttgatccagagctgtttctggtactgtttatcccgccgctgctattcgccgacggctggaaaacgccaacccgcgaatttattgaacacgggcgcgagatcctcggcctggcgctagcgctggtggtcgtgacggtggtcggcatcggctttctgatctactggattgtgccgggcattccgctgatccctgcgttcgcgctggcggccgtgctgtcgccgaccgacgccgtggcgctttcgggcatcgttggggaagggcggataccgaagaaaatcatgggcattctgcagggggaggcgctaatgaacgacgcctccggcctggtctcgctcaagtttgccgtcgcggtggcgatgggcaccatggtctttaccgttggcggcgccaccgtagaatttctgaaggtggcgattggcggcgtgctggccgggtttgtggtgagctggtcgtatggccgctcgatgcgcttcctcagccgctggggcggggatgaacccgccacgcagattgtcctgctgttcctgctgccgtttgcctcctatctgattgccgaacatatcggtgtctccggcatcctggcggcggtagcggcggggatgaccatcacccgttccggcgtgatgcgcaccgcgcccttggccatgcgcctgcgcgccaacagcacctgggcaatgttggagtttgtcttcaacggcatggtcttcctgttgttgggcctgcagctgccggatatcctctccagttcgctggtagcggcggaggccgaccccaacgttgagacctggatgctgtttaccgacattatcctgatctatgccgcgctgatgctggtgcgttttggctggctgtggtcgatgcgtaagctcagtcagcgcttcctgaagaagaagccgatggagtttggctcctggaccacgcgcgagctgctgatctcctccgttgccggggtgcgcggggcgattaccctcgccggtgtgctctccattcctctgctgctgccggacgggaatgtctttccggcgcgctatgagctgattttcctcgccgccggggtgatcctgttctcgctgttcgtcggggtgattgcgctgccgatcctgctacgtcacattgaatcgagcgataatgtgcagcagcggaaagaggagcgtctggcgcgcgcggcaacggctgacgtggcgattgtggcgatccagaagatggaagagcgtctggcggcggataccaaagagaatatcgatacccagctgctgaccgaagtcagttcgcgggtgatcggtaacctgcgccggcgcgccgatgggcgtaacgacgtggaaacctctatgctcgaagagagtctggaacgccgcttccgcctggcggcgctgcgctctgagcgcggcgagctgtatcatctgcgcgccacccggcagatcagtaacgagacgctacagaagctgctccacgatctcgacctgctggaagcgctgttaatcgaagatcaataacctgtaatccggatagcgcgacgcttattcggactactggcgagactgcagtaaatgtgtagccccggtaagcgttagcgcgaccgggggaaacccgggcagcggcgcaagcgcctgacccgggctaccccttcccttgcggaacgcgttgtcaccagggaattattccagccagaacgctttgctgcacgccagccaggcctcagcgctgcgcgacatatatacgccttcccgccaaatcatccccagctcccagcgcagctcgctttgcaacgggatccagcaaaaattctgccggtcgagacgctggcaaatcggttccggcaggatcgctacgccaatgcccgcctgcaccatggcggcgagaaaatcccactggccgctgcgcaccgcgatacgtggcttcacgtcatgctcggcaaacagccgcatcagctgctggctaagggcaaattcctcgttgtagataaccagcggatgcgacgccagctcggccggcgagagcgaggttttaccttcccactccgcggtccttggcgtcaggacgcacagcgggtgattgaacaacggcagaatggtgaggctgctatcctcctcgacaggcagggcggtcatcgccatatcaagttcgccattgctgaccgcctgctggaccgtcaggccgccaaactcggcgatcttcagctcgacgcccggatagcgctggcggaagcgactgatcggctcggccatcagcatcccgaccatcggcggaatgccaagccgcagcacccctttatgcaggtggttgatatcgctcagctctgactccagctggctgaactcgcccaagatcgcctggccgcgttcaaaaacgacgcgcccggtatcggtgagcagtagtttgcggccgtcgcggatcaatagcgtgcagttcagctcatcttcgagattcttgagcatcttgctgatggtgggctgtgtgacaaacagcttttccgccgcgcgagtaaaactctgctgacgaaccacttcaacgaaatagcgcagcgttcggatatccataattattccctgagactatacctgcgatgattttaattcatttctgtccgcttcggcggctctctatactgctcgcctgacttctttttttcaggactatcgcacatggccttcgcgccagctcgcgttgcccccgccgtggcgcaacgacttcagatcccggtacaggtacttctctacgtcgggttattcatcttcgcacaatatctggtgaacaggtggcaggtaccgctgccggctaacctggtcggcatggtgatgctcctgctgctgatcgtctgccgggtgataccggtaagctgggtgcgcgccggcgcccgctggctgctggcggagatgctgctgtttttcgtcccggcagtggtcgcggtggtgaactacgcccagctgttgatggtcgatggttggcggatttttctggtgattgccttaagcacgctgatggtgctaggcgccaccgcctgggtcgttgacaaggtctatcgttacgaagtgggcaggttaaaaaaatgagcgatgccgtactgagtatcctgtgcctggtggcgacgctggtcctctattacgccaacaaaaaactgtatcgccgttttcataaactccctctgatgccgctggtgttcacgccgatcctgctggtgctgattctggtggtaggccacatctcttatcagagctatatgggagagacccactggctgctgtggctgctgggcccggcgaccatcgcctttgccgttccggtgtatgaaaatgtcgcggtgattaaacgccactggatgtcgctcagcgccggggtggtgacggcggtagtggtggctgtcaccagttccgtatggctggcgcgcgggtttatgttgtctgatgaaattcagcgtagcctggcggtgcgctcggtgaccacgccctttgcgctggcggcggcgaaaccgctcggcggacaacccgatctggtggcgctgtttgtggtgatcaccggcgtgtttggcatggcggtgggagatatgctgttcttacgtcttgctatccgggaggggatggcgaaaggagccgggttcggcgcggcttcccatggtgcgggaacggcgcgctcgtatgagctgggccagcaggagggcgtggtggccagcctggtgatgatgctgtcaggcgtagtagtggtgctggctgcgccggtcgtccgctggctgctgttttaacattatcgccagagtgaatgttaataaatattgaggagaggaatagctatcggctattccctgtttttgttattgatgcatttaacggttcatcataaaagattaagccaattcttatatcagcactgactttgtaactaaatgtttctctgcatgcccgtatttaattatggggtaaatattatataaatatccaattatctttgcgaattttataactttataactgtttgatttttatggttttgaatatgaccacgcatgcgttgcgatgttatatcgcaaaaaatcaatttttacattaataattgagttcttacctcatgctagttattatttttacgcgagcttgtattattgaatggattcaaatgctggtcgtttatttatgaataatattaattgtcataaaccatatgtcatgtaaatacatgcatgacgccgcgctgcttgaatttcattctctaatatcgctgcataaaacaattgacggactgattgtcgtttataatggatatgggaataaatatgaagatgagtaaaaaatttctggcgggtgccctgattttctctgcctgcagcgcgctgtctaccgttgcgcaggctgataacaccattacctttaatggtattgtttccgataccacctgtacggcgaccattgatggcggtgtaacggctattgatatgggcaccacctcagtggcggatctgaaagcgtataccttcggcgctgccaagaacttctcctttagcttagctgattgcccgaccgcggaagaaggtggcaacagtatcgcccgcgtcacttttggcggtgtttccgataccgcgaacagcgattattttaaaaaccaggcaactgatgagccggcaaccggcgtcgctgtggcccttttcgacgaagcgggcaatgtgatgaagaataacgaagagggttctgatgttgatatctcttcgggtgcagcaaccattccgttcaccgttaaaatggtgaaatcgggtgatgccgatccgacgaaaggtaccgttcagacaaccgtgacttataacgtgacctatcattaattcggcttcttgttgaatggagaaaggggaatcgcctgctattccccttaaattaaacatatgagatatcctttttttgcgatcggtttattgctgtcttcttccttcgcgcaggccagcgtggtcgttggcggtacgcgtctggtttttgatggtacgaaaaataacgctgtaataacggttgagaataaagatcagaacagcaatatcgttcagtcctggctctcggtggttgatgcagcctcacccgccaaagacgcatttattattacgccgccgctgtttcgtctcaaagccggggagaaaggatttgtccgcgtagttcgatcaggaaagaaattacccgacgatcgcgagtcgatgttttggctcaatattaaagggatcccggcaacagaatatgtacctgataaaaatgtcgtacagtttgcgattaattcgaaaataaaattgatttatcgacccgctgcgttaaaaggtaatacaccggaagcgtacgctgaaaaattacagtgggggaaagaggggacgtcggtgacggtaaaaaataactcaccgctgtatatgaatttctcacaggttagccttaacggtaaaaatatttctggcgcatggtttgctgccccgttttccactttaaaaatacccgtgaagagtagcctgtcggcgacaggaaaaaaagagatcacatggagcgtgattaatgattatggtatgtcagggaagaaatataccgctatcattcagtagcgttgagctgctattttcaactaaaagtatctgcgtcgctattattctgtgcctaagtactctaccctctcgcgcggaggccggcgaatatttcaacccaaatttactcgaagtcgctgagagtcctgcggcttcggttgatctatcctatttttcgcaagatggcataccgccgggcacctatcacctggatgtttacatcaacgataagtacgtcagttcagactcgctgacttttcaggaaattagccatgacgcaggcgcgactgcttctccctgcctgtccgcggagtatctgaattcatggttgattaataccaccgcctatccgcagttgttcgaggcaggggaaacctgcgcccggctgtcggcgatccccgggatgacgttctcggtatctcttgcccagcagcgcattgattttaccgtgccgcaggccgccatgctgaatcgccccagagactatattcccgagagccagtggcaacaggggatcaatgccggtcttctcaactatagcgtcaccgggcagcgtaatgcgccgcggcataacggcgccactatcgacagtcagttcgtcagcctgcagccagggctgaatctgggaccatggcgcctgcgcaactacagcacctatagccacagcgataacaacagccgctgggagtcggtttactcctatcttgcccgcgatattcacaccctacgcagccagctggtggtcggtaatacgtatacctcttccggcattttcgacagtttgagttttaccggtctgcagctcagttcggacaaagagatgctgccggatagcctgcatggctttgcgccgacgattcgagggatcgcgcgcaccaccgcggaggtctcggtttatcagaatggttacagcatttataaaaccaccgtcgctcccggcgcctttgaaattaacgatctgtacgccaccggcagcgccggcgacctgtacgtcaacattaaagagtctgacggcagcgagcaaaactttgtggtgcctttcgcgtcgctggcgatcctgcaacgtgagggccagctggactatgcgctgagcagcggcaggacgcgatcgggtagctccgacgataaagaatataactttattcagtcttccctggcctatggcgccaccagcaacatcactttttatactggtttccagcaggcggaagataaatacaccaacctgttgttaggcgctggctttaacctcggtactatcggtgcgctgtcgtttgatggctctcagtcgtgggccgacgtgaaaaccagcgatacggccttgtcaaccagtacagagcaagggcaatcgtatcgcgtccgcttcagtaaaagctttctgcagacgggcaccagcttttccgtggccggttatcgctactccacctcgggatattattcgtttcaggactttgtcgataactcttccacacagcgcgactgctgtacgcagagcggcagaacgaaaggccggtttgacgcatcgttgtcgcagacgctgtttggctatggttcgctctcgctttcgttggtcaatgagacctactgggacagttcgcgtatggaatcggtgggcgtgggctatagcgggtcgattggcaaggcctcctactttattaactattcctataaccgcaatgtgcaaagcaccgatgacagcagcaataaccggccggccagcgatacggtcgtctccctgacgttaagtattccgcttggcgagacgctctcggcaaattacaccatgaaccatggtcggcataacgataccacgcacagcgtggggctcaacggctcggcgtttgaggatcgttccctgaactggagcgtactggaagggtacaacacgcaggataaaagcacctccggcaacctcagcgtcaactaccagggctcgaaaggggatgtggctggcggctatggctacgaccgctacagcaatcactacaactattcgctgcgcgggggcatggtcgcccatacgggcggactcacgctatcacgctttcttggcgagagttctgcgctggtcgaaacgcctggcgtcagcgatgtgacagtgcgcggtcagacaaacgtgacgacggatgccgccggatatgcggtggtgccttacgtccgtccgtaccatcgtaacagcctggcgctggatgaacaggaaatacctggcgctgaagtggataacgtcgccagaacggtggttccgacgcgcaatgcgatcgtcaaagtgaagtacgacacgcgaattggctataaggcgatgctcaccctgcgtacccgcaatggcgtggtgcctttcggcgcgctggtgaccctcgataatgatcacggtagcgcgtcgcgcagcaatatcgttggcgatgaggggcaggtgtatctaacggggctgcagaaaaaaggccagctgttagcgcgctggggggagaaaagcagtgagcagtgcaccgttcattatgacttctccggcatggcccttggcgacgatattctgttctatcaggccgaatgtcggtaatggatgcaggttttcaacatggaagaggggctgatatgaatatgcgagacggcagcacaaggggcctcctggtggccattttgctgctctcccttccggcgctggcttatgagggcagcagcacggtcaattttaacgtcacgggcaccatcgaagcgccttcctgtgaggtggccgtggagccgtcgaacagtatcgatttaggcaccgtctcctcgcagacgttctccggacatgccggggcgagcggcgccagcgtgccggttaagctggtcttttccagctgttccgccgatgcgtcggcggtgaccatcgcgtttagcggcaccagcttcgatagcacccacgcttcaatctataaaaacttccagactggcagcaacggtgccagcggcgtcggtttgcagctgcagagcatggccgaccagcagccccttggccccggcgaccagtatctctatacctttggggacgatgcggatatccatacctttaatatggtggcacgtatgttttcgccttatggccaggtaaggtccgggatggtcgggtttaccgccacgttcgatgtggcttacaaataacgtttcgacagggatgggtatgaaaaaactgatcttattgctcatattggcactgtgtcccgtctatagctgggcggcctgcacgggaaccaactatggcgatgtctcgatgaccaacctgccggaaaagatcctggtcaatgccgggagctataccgcagggacggtactgtatgactcggggaagattacgcgctcgcaaacggaattgcttaactgtgaggggagcacctacgcggtttttgcctggtcctcgaacaatgccggggcactgataggggataatatctatgccacctcggtgcaggggatcggtatccgcgtcaaggtgtggctcaatatcagcggtgaatatggcgatgacaccgatgatttcagccccgactcgcaggtgcattatattggtgatgtgaattattacctcggaaagccgacaggtcttttcgactctttcgcgtcgactcattataccccggcgtatcagctgcagctggtggccaccggcggcgccatcgccagcaagagtcaattatcgttcagcgacccggtggccacggtatcggccaaggataaaaaggggaccatcgctatttcacaactgcacatcagcggcacaaccagcatccagctaatcccgatggggtgtattgtcggtagcaataatctcagtttttccatgggcagcatcaatgccagtgagtttaataccgcgacgaaggtgggtagcgcgcggcagtctctgagcctctcctgcgagccgggaactaacgtttcgatgcgtgtggcggctgcttctgcaagcggggataaccctgacaatacggtgatggccctcacggcggaacagaatgccgccactggcgtgggagtgcagttaaatttgaatggcaaagcactgccgttaaataccgatatcagcctctatacttcgagccgcacgacggtgaccaacagcggcgcggacgccagctacagctatttcaccaatcccgacagccccggaggcgcagcggccatgcagacgctcgctttatccactaactattacaggacggggagcgcggtgaccgcggggacagccaacgccaccggggtgatcacctttacttataactgaggggagaatcccttccccgaacgatgccggggaagggagaggacgattaatgcgcctggccgcgttcgataccgatcccggtttgtgaacggataaactgggcgcggaactgctcgcgctcgcgcatcccttccggtgagttatcggtggcggagaagacccagatgccaatgaacgcgatggcaatggagaacagcgccggatattcatacgggaacagcgctttctcatggccgaggatctgcacccaaatggtggggccgaggatcatcagaatgaccgcagtcagcaggcccagccagccgccgaccatcgcgccgcgggtggtcagcttcgaccagtacatcgacagcagaataatcgggaagttacagctggcggcgatggagaaggccaggccgaccatgaaagcaatattctgattttcaaacagaatacccagcagaatggccaccaccccaaggatcagcacggtgatcttggagaccttcagctcctgacgctcggtcgcgcccttgcggaagacgttggcgtacaggtcgtgcgacaccgctgacgcgccggcgagggtcaggcccgccaccaccgccaggatagtggcgaaggctaccgcagagataaacccgaggaacaggttgccgccaaccgcatccgccaggtgcaccgccgccatgttattgccgccgataagctgtccggccgcgtctttaaacgccgggttcgcgccgaccagcatgatggcgccgaagccgatgataaaggtcaggatatagaaatagcccataaaaccggtggcgtagaagacgcttttacgcgcttctttggcgtcgctcacggtaaagaagcgcatcagaatatgcggcaggccagcggtaccgaacatcagacccagacccagagagagcgccgatatcggatctttcaccagtccgccgggactcataatcgccgcccctttcgggtggacggccatcgcctcggtaaacaggttattgaagctgaagccgacgtgcttcatgaccataaaggccataaagctggcgccgcacagcaacagaaccgctttaataatctgcacccaggtagtcgccagcatgccgccgaacaggacatagagcaccatcagcacgccaaccagcactacggcgacatggtaattaaggccgaacagcagctggatcagcttgccggcgcccaccatctgggcaatcagatacagggccaccaccaccagcgaaccgcaggcggagagggtgcggatcggcccctgcttcaggcggtaagaggcgacgtcggcaaaagtgtagcggccaagattgcgcagacgttcagcaattagaaacaggataatcggccagccgacgagaaagcccagcgagtagatcagcccatcgtagccggaggtatacaccagcgcggagataccgaggaacgacgccgctgacataaagtcgccggcaatcgccagcccgttctggaagccggtaatattgccgccggcggtgtagtaatcgctgcgcgaacgcacccgttttgaggcccagtaggtgatgtacagcgtcagggcgacgaaaatcaggaacatgacaatcgcctgccagttggtcggctggcgctgtaccgcgccggtaatagcgtctgcggcgtgggcgccgaggggcagcagcgtggcggcgagcgccgtcaggactctcttgatcatgcttttacctcgttgagaacgcttttggtcaaacggtcgaattcaccgttagctcgccagacataaataccggtcaggataaacgaaatgacgatcacgccaatgccgagcgggatcccgcgggtgacgctggttccggcgtgcagcggggtgccgagccagccgggtgcaaaggcgataagcaaaataaagcccacgtagatcactaacataatcactgacagaatggcggcaaaccgttgccgtgatgcaactaactccctgaaatgcgcactattttctatccgctgacaaagttgttcattcatcttagcgtctccagaggtctccctttcgtcatccactcggcggacgctggcgacagcaacccctccggcgacggagccgggacaggtgttgctgacggcgttcctgcgagtgaaatcctgggggagggacttatttttatcctctccccggaaggggagagggtgtagggaatcggtctttacttacgatggcatggtaatggcctgcttctcttcgagcagtttttccacgacgccaggatcggcgagggtcgaggtatcgccgaggttgctggtgtcgcctgcggcaatcttacgcagaatgcggcgcatgattttgcccgagcgggttttcggcagcgaatcggtccagtgcagcacatccggcgtcgccagcggaccgatctctttgcgtacccagttacgcacttcggcatacaactccggcgtcggttcttcgccgtgattgagcgtcacgtaggcatagatggcctggcctttgatgttatgcgggatccccaccaccgccgcttcggcgatttttgggtgcgacaccagcgccgattcgatctcggcggtccccagacggtgtccggagacgttcaggacgtcatccacccggccggtgatccagtaatagccatcttcatcacgacgcgcgccgtcgccgctaaagtacatatttttgaaggtggagaagtaggtttgctcaaagcgctcatggtcgccgaacagggtacgcgcctggccgggccaggagtcggcgatggcgaggttgccctcggtggcgccatccagcggcaggccttcgttatccaccagcaccggctggacgccgaagaacggacgcgtcgcggagccggccttcagctcaatcgcgcccggcagcggagtgatcataaagccgccggtttcggtctgccaccaggtgtccatcaccgggcacttctcgttaccgatcttcttccagtaccactcccaggcttccgggttaatcggttcgccgaccgagccaagaatgcgcagcgaggagcggtctgtgccttcgatagctttgtcgccttccgccatcagggcgcgaatagccgtcggggcggtatagagaatgctgaccttatgcttatcgacgacctggcacatgcgcgccggcgtaggccagttcggcaccccttcgaacatcagggtggtggcgccgcaggccagtgggccgtacagcagatagctatggccggtgacccagcccacgtcggcggtgcaccaataaatatcgcccggatggtagtcgaaaacgtatttaaaggtggtggccgcatagaccagatagccgccggtggtgtgcagcacccctttcggtttaccggtggagccggaggtatagaggatgaacagcggatcttcggcgttcatttcgacgggccggtgttcggcgctggcgttcgcaatcaggtcgctccaccacagatcgcggccttcctgccagtcgatattgccgccggtgcgtttcaggaccaccccgtgctcaatgcttttcacgttcgggtttttcagcgcgtcatcgacgtttttcttcagcgggatggcgcgaccggcgcgcagcccttcgtcagccgtgatcaccaggcgtgagctggagtcgataatgcgtccggccaccgcctccggcgagaagccgccgaaaatgaccgagtggattgccccgatgcgggcgcaggccagcatcgccaccgcggcttccggcaccatcggcatatagatagcgaccacgtcgccttttttaatcccgaggtcgagcagcacattggcgaaacggcacacgtcggcatgcagttcacggtaggtgatgtgcttgctttggctggcgtcgtcgccttcccagatgatggcggtttgatcgccgcgttcggcgaggtggcggtcgagacagttagcggcgaggttcagggtaccatcttcataccatttgatggaaatattacccggtgcgaaggaggtgttctttacacgggtatagggccgcatccagtcaaggatcttgccctgctcgccccaaaatgtatcagggtcggttatggattgttggtactgcgccttgtactgatccgggttaatcaggcaacgttccgcaatattagcgggaatagggtgtttgtgaatttggctcatggctttttttctcctttgaacttgttaaatatatgtcaaacaaacgttaagagtaggggttttgacagctttgtttgttaattggggggcagatcacgcaatgattaaactgggtgaaatttcatcaaatgaaactttgaagcgaaataattacgcaaatgaatttatagaaacggaagctgtgaaattttttttattacaaatacttatgcaatataactgggggaaattcgctgctttatgcataaaagcagaggaaagccctgttcttaaaggcttgcgcagcatgccgtgcaaatgatactgatattgcgcgttaaataaccccacaaagcaacgcaacacaattcataccccctgcagtgggtaccatgacgaaaaggaatggtgcctttcattgaggaagtcagtagtgaagaaaacaaaaaaagtcagtctggcctggcaaattttgctagccctggtgctgggtatccttctgggcagttatctgcattaccacgctgaaagtcgcgattggttaattagcaatttgctgacgccggcgggcgatatctttatccatctgattaaaatgatcgtggtcccgattgtcatttcgaccctggtggtcgggattgccggcgtgggtgacgccaaacagttagggcggatcggtgccaaaaccattatctatttcgaagtgatcaccacggtggcgattgtgctgggtatcaccctggccaacgtcttccagccggggacgggcattgatatgtcgcagctggcggcagttgatatttcgaaatatcagaacaccaccgccgaagtgcagagccatgcgcacggcctgatgggcaccatcctgtcgctggtgccgaccaatatcgtggcatcgatggcgaaaggcgatatgctgccgattatcttcttctcggtgctgtttggcctggggctctcctcgctgccggcgacccaccgtgagccgctggtgacggtcttccgctctatctccgagaccatgtttaaagtcacccatatggtgatgcgctatgcgccggtcggggtattcgccctgatttcggtaaccgtcgccaccttcggtttcgcctcgctgtggccgctggccaagctagtgttgctggtttactttgcgatcctgttcttcgcgctggtggtgctggggattgtcgcgcgcctgtgtggtctgagcatctggatcctgatccgcatcctgaaagatgagctgattctggcttattctaccgccagttcggagagcgtactgccgcgcattattgagaagatggaagcctacggcgcgccggcgtcgatcaccagctttgtggtgccgaccggttactccttcaacctcgatggttcaacgctgtatcagagcatcgcggcgatctttatcgcccagctgtacggtattgacctctctatctggcaggagattaccctggtgctgaccctgatggtgacctcgaaagggatcgccggcgtgccgggcgtctccttcgtggtgctgctggccaccctgggtagcgtcgggatcccgctggaagggcttgcctttattgccggcgtcgaccgtatcctcgatatggcgcgtaccgcgctgaacgtggtgggtaatgcgctggcggtgctggttatcgccaagtgggagcataagttcgatcgcaaaaaagcgctggcctatgaacgcgaagtgctgggcaagtttgataaaaccgcccaataaaacacaaagcccggcgcgatagcgccgggctttttcttatcctttactaatccggtcaaactcttcgcagccggtatcaaacccctccaggcaactgacgttgagccagtgcagcgccttctgcttattcggttcgataaagcctttctctccctgctggaacatcatcccggcccagtattcggcatagccggtgcgggaaagtgatgaactgcctttaaagtattcacttgctttcacatcatcctccgggccgtgtacgccgctggcgtagatcagccccagcagcatctgggcatctaccgccgcatcgctttcgctatcccgggcagcatcctgcagcagcgtgatggcgtgcgctacgtcggtggcgccagcctgacggttgaccagcacccgcgcgaggacgatctctccggatttactgccggcctcgacggctttttccgccagctggcgggcctgcggatagtccgcctgttgggggttacggattttgagctgcgccagcagcgccaacgcatcgccatcgccctgggcggccgccttctgcgcccagtattcggctttttgataatcgccggagctgacccaggtatcggcaaggtaatattgcgcgcgtcgatcgccggcttcggcctgctgttgatactgactgccaggttcggtggcgaccgctgcgccgctggtgaaaaccagtagaaataaaaagaggtatttcatttgtatttattatcagtaaggaacatagcgcgcagtataaagggaggcgaaaaagaagaaaatggcgggtatcggtaggtaaggccgatttgcgctacctgaccgtaggcccgcgcaagcgcagcgccgccgggcgacagactgcggacacggagccgcttgtgtgccgggtggcggctgcgcctgacccggcctacgcatcgcgcgagccgggtcagaccgccgaaccttaacccatcgcgctttcgcgcaggcgggatttcagcttgttgtactcgtcgatcacgtactgttccgcggcgcgctgatcggcaatccgctcaacgttgaccgcgcagtacttgtactccggcgttttggttatcggactcaggttctctgagaccagctcgttacaggcgccgatccaccactggtaggtcatgtacaccgcgcctttattcggccgatcgctgacctgcgcgcgggtgatgatgcgccccttacgcgaattgacccataccagctcttcatcttcgatgcctagccgttcggcgtcggcggtgttgatttgcgcatagcctggttcatccgccagcgccgccagcgccgcgcagttaccggtcattgaacggcacgagtagtggccgacctcgcgcaccgtcgacaataccatcgggtactcgtcggtaagcttatcgatcggcgcgacccagtcgcaggtgaagaactgcgccagtccgttcggggtatcgaacttctctttaaacagatacgacgttccctgatcggcgtcggactcatcgcggcacggccacatgacatagccgagctcacccattttctcgtaggtggcgccgtagaagtccgggcacagatgccgcaactcgtcccagatctcctgggtgttattgtaatgcatcggatagcccatccgggtggcgatttcgctgatgatctgccagtcggttttcaggtcccacttcggctccaccgctttaaagaagcgctggaagccgcggtccgctgcggtatacacgccttcgtgctcgccccacgaggtggacggcaggatgacgtcggccgcggaggcggttttggtcatgaaaatgtcctggacgataaccagttccagatcgtcgaacgctttgcggaccgccgagagttcggcgtcggtctgcagcggatcctcacccataatgtacgccgcccgcacttcaccgtgcgccgcgcggtgcggcaattcgctgatgcgatagccggtatgcgcaggcaggctttccacgccccaggctttggcgaatttctcgcggttctccgggaacttgacgtactgatagcccggataggtatccggtagcgcacccatatcgcaggcgccctgaacgttgttctggccgcgtaccgggttgacgccgacgctcggcttgccgaggttgccggtgaggatcgcgaggctggtcagcgaccgcaccgtctccacgccctggtagaactgggtgacgcccatgccccacaggatggcggcggatttggcgctggcatacatccgggcgcaggcgcggatctcctgggcgctgaccccggtgatctcctccaccgactccggcgtatagccttcaacgattttgcgatactcctcgaagccttcggaacggctggcgacgaaggatttatcgtacagatcctcttcaataatcacgtggccaatggcgttgagcagcgcgatgttcgagccgttcttcagcgcaatgtgcatatcggcgatgcgcgcggtttcaattttgcgcgggtcgcagacgataattttcgccccgttgcgtttagcgttaatgacgtgattcgccacgatagggtgggaatccgccgggttgtaaccgaagataaacaccagatcggtgttatcaatctccgtgatggcattactcatggcgccgttaccgaccgactggtgcagacctgcaaccgaagggccgtgtcagacgcgagcgcagcagtcgacgttattggtaccaataacggcgcgcgcgaatttttgcatcacatagttggtttcattaccggtgccgcgggaggagccggtggtttggatcgcatccgggccatatttggctttaatggcgctgaggcgggtggcgacgtaatccagcgcctcgtcccaggagacggcttccagcttgccgccgcgttgacggcggatcatgggggttttcaggcgcggcgttaggatctgggtatcgttaatgaagtcccagccataatagcccttcaggcacagggttccctggttggttttcccctgcgccgcttcagcccgaacgattttgccgttatcgaccaccaggttgattttgcaacctgatgcgcaatacgggcaaaccgtgacgacttttttcatcggtcttgctccagttattcaatgggcgcgtttgcgctatcgcgccgtcactatgcatcttctatgccatattttcattgtgggtattccttgatgatacgcgggttttttgggcggaatgctgacgaaaaacagcctgtcgacagatttgacgtgtcgataccctggagatgtgacggcgcttgaaaaaatgtcaccgggagaggaatttgtcggcgcaggcttgcagaatcgatcagactgacactaattcccggcgggcagaggcaaaaatgaaaccagtcattttagtggtggatgatgacagggcgatgggcgagctgctcagcgatgtgctcggcgcgcacgcgtttgaagtgcttgtcagccagaccggcaacgacgcgctgacgacggtggcgcagcgggcggatatcgcgctggtcttactggatatgatcctgccggatacccatggcctgcaggtgctccagcagctgcagcgcacgcggcctgagctgccggtggtgatgctctccggtctgggcagtgagtctgatgtggtggtgggcctggagatgggcgccgatgattacatcgccaaaccgttcagctcgcgggtggtggtcgcccgggtgaaagcggtactgcgacgcagcggggcgctggccggcgaggcgtcgggcgccggtgctggcctgacgtttaacggctggcggctggataccacgcgctgtgaactgtataacccgcagcagcaggcgatcccgctgacccagggagaatatggcctgctgctggcgctggcgcagaacgcgcgccgggtattgaatcgcgaacagctgctggcgctgacccataacgaaagcaccgaggtattcgaccggaccatcgatgtgctgatcatgcgcctgcggcgcaaaattgagctcaacccgcatcagccgacgttgattaaaaccctgcgcggtctgggctatgtcttttccgccgacgtgacccacagcgagaaggcggcgtagggcgggtttgctgccaacccgctgttgactttatttggcgcagggagtttactttttttattaaagtgacactctgggttaatctatggcaacaaaattaaactggctgctgcaaaacagcgctcccggagatgtgatccttcagtcctggttaagccagcatgccatctctccctctctggcctttaaatacgcgcaaagtggctggttaaaaaaaagaggcaacggcgtatatgcgcgtgcgggacgtgagccggagtggaacgatgcattagcatgtttgcaaaatcagcttgccgctccggtgtatgttgcggggctcagtagcttagtctggcagggccgttcacactatctacagctaaaacaaaaccagtgctggcttagtgtggaaaataaagcgctgctgccgaaatggttcagggaattcccgggtgtggagtggatagtcatatcggggaaaaaactgccggtgctggatgatagataccgtgtaacgcttgatataaaagggaaaaaactcatcggcagtgcgccagaactggctgcttacgagttgctgagcgcggtgccggggaccctctcatttaaccacgctgcagagcttttccaggggctggttaatcttaatcctcgtaaagtagagtatcttctttccgtcagccagtccgtgcaggccaagcgtttgtatctcttcttcgccagtttttacgagcatggctggctcaaacgaatcgatagccaaaaaatcgatctgggagcgggcaagcggcaaatcgtggaaaatggaaagttcaatgctcaataccaaatcacagtgcctgaacgctttcaaaaggaataaaaaatatggatatacaggcgccttattatcggcaggttgctctgctaatgcaggttttaccctatgttgctgtcgaacgggaatttgcgctgaaaggtggcactgccatcaatctctttatccgcgatttccctcgattatcggtggatatcgacctcgcctgggtgcccctggaaagcagagccatcgctttacctcatatacgggatgcgcttgcacgtattgccgccaatctgcaacaacaggcaggtatgagcgctgtattacaagctaatcgttcagatgagatgcgtgtcattgttactaccgatagcgcgcaaataaagatagaggtttcaccggtcgcccggggaacattatatccaccacaggagcgagaagtggtgggggcggtagaggacgtttttggctatgccagccttccagtggtttcgttgcctgacctctacggtggaaaattatgcgcggcgctggatcgccagcatcccagagatttttatgacgtgaaattacttcttgatgcgcaggagcttgaccgtcccattttcaatgggtttatcgcgtatttactgagccataatcggcctctggttgaagtgctgagtcctcgctggaaagatattgctgaacctttttaccgtgaattcagcgggatgacatttgagacgatagccctggaggaactgacagcagtccccaacaggatgattgctgcgttaaaatcctgtttcacacaacaggatgtcgattttttactgtcatttaaacgaggcgaaccagactggcgtttagcgccggaaatgcgtattcaggatttgcctgccgtgcagtggaaattgcgcaatattcatcagatgccagcgataaaacgcgctgagtcattagataaactggaaaaggtgctggccgagtggcgcagttagttacctggcccgcccttgttgaactcagcgtaaaacaggcgtgatttgaataaaccgtatcccttttctcgccatgacacgccgttctcctgtggcatcgccctgatagcgggatctactcgatctaaacattctgcaactgaataaacgcctgcagctcagggagcgttttggcgccgtcgatcgcgttggcggcctgcaggccggcgcagaaggcgtcccccgcgccgacgctgccgataatctcctccggcggcagccgccatgacggtacccagcgcccggcttcggtacgggagacgccccatgccccctccggacaatggatcactacccgctggcgtacgccggcgtcaagcaatgcgctggcggcgcgggcgatattggcgacgtgcggctcgccgttgggtagacgaatctccagcccgctaaactcgctggcttccagttcattgatggtcaggtagtcaagatgcttcagcgccggcaggaccagcggccggtagcgcgggtcgcccttgcgcgacaccagatcgagggacacctcatagcctcgctcgcgcatctgcgccagcagtcgcgcgctgcgggtgccgtacacttcatcggggcgatcgaggctttcgagcagcagcagatagccgagatggaaaattttcagcggcgcatccagcggctcaaaagccgggagatcaagcaggcggttggcgccgggagagtgaaagaaagtgcgctggccttcggcgtcggtcatcacctgggtcatcgaggtgggggaggagctggtgcgctgtacgagctggcgattgatatggtactgatcgagcatggcggtgatgtagtcgccatcgttatcctcgccaatcaggccgaccgcctgcagcggcagcccggcgtgcattttggccagggtcagcaggacattcagcggcgcgccgccggtggcgcgttcgctatggacaatttccaccagccagccgcgctccggccactgcccgatctggtggacatgatcgaccagcatgttgcctgcggcaataatgcctttccgttccatgatcgctactccgcgccgtcatattcgttaagcgtagcgcacaatcggcggaacgattgtgcgccgggttgcgcttatttcacggtccagcctttgtaagagctgacgttatttttgtcgatcatcgtcaccgggatcagtaccggcgcggtcggcgcaggtttgccctgcaggatgtcgtagccaatctccactgccttcgctgccatcacctgtgggtcctgcgctggggtggcgacgaacagcgagttcttacgcttcagcgcctcttcgccgtccgggctgccgtcgacgccgacgatgaagaactcgctgcgctgcgcctgtttcgctgccagatcggcaccaatcgccgtcggatcgttgatcgcgaacacgccgtcaatcttcggattggccgccagcagggaggtcatcacctccaggccgccttcccggctgcctttggcgttctggttggcggagaggattttaatgtccgggtgttttttgaactccgtttcgcagccttcgacgcggttttgtacggcggagaccggcggcccgttgatgatcaccacgttgcctttgttgttcaggcggtcgctaatgtatttacaggccagctcgcccgcctgggtgttatcggaggtgatggtggcgtcggccccttcggcggcgacgtcaaccgccaccaccacgatcccggcctctttggcccgcttcaccgccgggccaatgcctttcgaatctgcggcgttgaggatgatcatatcgactttggcggcgataaagttatcgatctgcgccacctgctggcccagatcgtagccgctggagaccagcgtcactttgacgttatcccccgccagcttgcgggcctccagctccgcccctttggtgatctgtacaaagaacgggttggcaaggtcgcccaccgtcacgccaatcgctttcagctctttggccgacgcaaaaggggaggcggccagcagcgcgccagcacacagcgcggtgactatcggttttaaacgcattcgcttttcctcgcaggtaagatgttgttgttatgcactttgatgatgtcgggtacggtatttgtcgatcagcaccgcaatgatgatcaccgcccctttgatcaccagttgccagaagtaggagacccccatcagggtcatgccgttattgagggtggcgataattagcgcccccaccagcgtaccggtgatggtgccgataccgccgacgaagctggtgccgccgagaatgaccgcggcgatggcgtccagctcgtagccgacgccgaggttgccgttggcgctgtacagccgcgaagcgctcatcaccccgccaaggccggagagcaggccgctcatgccatagacaaacagcagcaccagccagactttgatgccggtcagccgcgccgcctgcatgttgccgcccaccgcgtagatatgcaccccaagggtggtgcggcgcaggataaaccagcacaccgcgatcaccgccagggcgatgactaccagccacggcaccgggccgaggtagtcattgccgatccactcgaagctgatatcggagttgatcaccgtggtgccgtcggccagcagataggcggcgccgcgcagcgccgtgtaggtgccgagggtgacgataaacggcggtagcccggcgaaggcgaccagcgcgccgttgaacaggccgagcagcaggccgagcatcagcgccgccggaatcgacagcaacgcaaactccgggatcagcgacaccaccatcgcggccactgcggtggtgccaaggatggagccgacggaaaggtcaatgccgccggtgaggatgatgaaggtcattcccgccgccagcacaatgttgatcgaggcctggcgggtgatattcagcagattgctttccgtgaaaaagttgggggcgataaagccgaaaacggcgacgatcaggatgaggatcggcagaatgccgacggtctgcatcaggtcgcccatcaacatttttttcgccgaagcggatttcgcgaccggcgcggaggtctctttcggtatgctcatagttgccctgccttaaggtgagaatcggtcacgccggtggccagcgtcatgatactttcctggctaatatcaccggcctgtagctcgccggcgataacgccctcgcgcatcacatagacccggtcgctcatgcccaccacttcgggcagctcgctggagatcatcagaatggcgacgccctggcgcgccatgtcgttcatgatgcggtaaatttcgcttttcgcgccgacgtcgacgccgcgggtgggttcatcgaggattagaatgcgcgggccaatcgccacccagcgcgaaattaacagcttctgctggttgccgccggacagtccgccggcgcgcacctgggcgtgcggcacgcggatgttaagcaactggatggcgtcatcggagatggtttgcgccttccggcggttgagcatcccccaggtcgcgtcgcgctccagcgtcgccatggtgatgttttcctgggctgccagttcgagaaacaacccctgttctttgcggttttcggtcagaaagccgatcccgaggtcgatggcttcccgcggcgagtggatcaccaccggctcgccgtcgatctcaatcaccccggcggtggctttgcgcaccccgaagatcagctgcgccagttcggaacgcccggcgccgaccagcccggcgaggccgacgatttcgccggcatgcaccaccaggctgctgggcttaatcttgccgccatcggtcagatcctcgacccgcaggcgcggctggccgcagggaatgtcccgttctttattgaacagatcgctgagcgggcggccgaccatcatgcgcaccagctccggtgcgttgagcttgtcgcgcaccaggctgccgacatactgcccatcgcgcaggacgctgacccggtcggagagctcatacacttccgccatgcggtggctgatatagatgatcgccatcccctcatcgcgcaggcgcaggatgagctcgaacaggcgctgggtttcccgcgacgagagggcggcggtgggttcatccatcaccagaatgcggctttgacggtgcagggcgcgggcgatctccacctgctgctgttcggcgatggtcagggtcatcacccggtcgctggctttgaactgggcgccgagacggtcgatcaccgcctgcgcctggctgagcatggctttgcgctgcaccagaccaccgcgcgccagctcgctgccgaggaaaatgttttccgcgacggtcaggttcggcgccagctgcatctcctggtagatcaacgtgatcccggcggccagcgcgtccttggggccgcggatcgtttgcggttttccgtcgatcaggatctcgccgctggtggcgctataggcgccggcgaggatcttcatcagcgtgctttttccggcgccgttctcccccatcagggcatggatctcgccgggccagaccgtcaggtcgacgcccttcagcgcgtagaatttgccaaaagctttggcgatatggcgcatttccagtaccggggtggcggtcatcgcggcgctcctgtctgtaagaacaatagctgcagtccaccaccggaaaataaatgcagaatgtcagaatccattcatatttgtcatagtgataaatagttaaccgcgatcacagttacgcggcgtcattttctgcaccgtcacgcttatctgccgaccgatccttcaccggagttgttatgaccgctcgccgacacccgtttttcaccagcgcccgtggccgcctgctctcctttaatctgctgatgggcgtggtcaccctgttggtcagcggcgtggcggtgttcggctttcaccacgccagccagctgcaggagcaggtgcagcgccagactctcaacgacatgcgcggcagtatggatctggcgcgggacacggcgaatgtcgccacggcggcggtgcgcctgtcgcaggtggtgggggcgctggagtacaaaagcgaagcggaacggctgctggcgacgcagcaggcgctgaagcactcgctggcccagctggcggcggccccgctggcgcagcaggagcaggcgcgggtggccaatattattcgccgcagcaacgcgctgcagcagagcgtggcggagatgctggagcgtggccagcggcgccatctgcagcgcaatgcgctgctgagttcgctttaccagaatcagagtaacctgcgccatctcgccgatcttaacgatcgcggctgggataaggcgatcgatccgcgccggctggccgagatggaccggctgatcgtggctgcgatccataccgtcacgccgcggtcgatcgtcctgcaactcgaccagctgcgcggtgccctgccgacacgcagcgccgatcccgcgctggcgtttgtcctccctgatgtgacccgcgagctggcgacgctggccccgctgtcggcccagctggaggagagcgacctgacgatcagctggtacatgtatcacatcaaagcgctggtcgcgttgcttaacgaagatatcaatcagtacgtgacccgggtggcggaagcctcagagcagcgggcggcgcagagccatcgggagctgcgctccatcagtatgtttattctgctttccgcgctgctggcgctggcgatcaccggctgcgccgggtggtacatctaccgtaatctcggctcgaacctgaccgccatctcgcgggcgatgtcgcggctggctcagggagagccgaacgtctcggtgccggccctgcagcggcgcgacgagctgggggagctggcgcgggcctttaacgttttcgcccgcaatatggcgtcgctggagcacaccacccggctgctgaaagagaagaccaaccagatggagatcgatcggattaagcgccaggagctggaggaggcgctgctgcatagtcagaagatgaaggccgtcggccagctgaccggaggtctggcgcatgactttaacaacctgctggcggtgattatcggcagccttgagctggtggagccggatgcgcgcgatgcgccgcgcctctccagggcgctgaaggcggcggagcgtggggcgcttctgacccagcggctgctggccttttcgcgcaagcaggcgctgcatccccaggcggtggcgatggcgccgctactggagaacctcagcgagctgatgcgtcactccctgccggcgaccttaagcctggagattgaggcgcagtcgccggcgtggccggcatggatagacgttggccagctggaaaacgccctgatcaatctggtgatgaacgcccgcgacgccatggcggggcgcgacggggtcatcaaaatacgcacctggaatcagcgggtcacccgcagcagcggccagcggcaggatatggtggccctggaggtgatcgatcatggcagcgggatgtcgcaggcggtgaaagcccgggtgtttgaacctttcttcaccaccaaagccaccggcagcggcagcggcctggggctgtcgatggtgtatggctttgtgcgccagtctggcggccgggtggcgctggagagcgcgccggggcaggggacgacggtgcggctgcagctgccgcgagcgttgaccgaggttgagaaggaggtggcgccagcggtggacgagccgtccccggcgggcgagcggctggcgctggtgctggaagatgaagaggatgtccgccagacgctatgtgaacagctgcatcagctgggctggctgacgctggaaaccgccagcggtgaagaggcgctgcagctgctggaggcctcgccggatattgccctgctgattagcgatctgatgctgcccggggccctgagcggcgccgatgtgatccataccgcccgacgccgctttccggcgctgccggtgctactgatcagcggccaggatttgcgtccagcgcagaacccggccctgccggaggttgagtggctgcgtaagccgtttacccgagcccagctggcgcaggcgctgagcgcggcgtacgcgaggatttgagattcctccgctacccgggtttcatgcggatgattaaggtagcggcaggactctgatgagattggccccgatgaaacgttacgcaaccgcactgctcttttgcactctgtcgctgaccagcctggccgctcgcgccgatattatcgatgacgcgatcggcaatattcagcaagccattaacgacgcctataacccgggcagcagtcgctccgatgacgacgacagatacgatgacgatggccggtatgatgacgggcgctatcaggggagccgtcagcagagccgtgacagtcagcgccagtatgacgagcggcaacgccagctggacgagcgccgccgccagctggatgaacgccagcgtcagctcgaccgcgatcgtcgtcagttagaaagcgaccagcgtcgtctggatgatagctactgatcgccccccgcaggccagcgcttaatccagcgctatttccatcccgtcatagcccgcttcgaaacctgtcggcagcgggttatccatcatccagatgtcaaactggtggctgatatgggtgaggatcacccgcggacagccaatgatctggttaaggctgcggacggtgtttagatcgttatggttacgcggggtctgcgcgcgcggctcatgactgcagtcgatgatcatcgcctgcgggcggttattgagcaaaaacttcagcgacttgtccggcagcccggcggtatccgagagccaggccagccggctgtgggccgactccagcagataaccaaaggtcagcttcgagtgattaaggggtaggggcgtcacccgcagcccctgcaggttaaacatcacaaacggcgtgacggtatggctaaagtcaagcagaccggggtgtttgagcagatcgtcgcagccggcgtcatccggcgggccatagaccggaatcgacgcgccgactccccagcgcagcggaaacagcccatgcacatgatccagatggtagtgggtcagcagcacctgttgaaagctgccggcgggatgatgctccatcagatccggtcgtccggcatcaagcagcgtcacggcgctgttgaacgtgaccactccgctacaggggcggcgtcggtggctctcctcgcggcgggcgcggcggcaggccgcgcagtcgcagccgaagaccggcaccagctgagcgccgccggtgccggttaagcggagggtcaggctcatcgtgtcaccttttgtttataccagttgatccgcttcgcgcgccgcgtggctgcgcagcaggcggaaaaattcatcgaccgattgtcggagactgccgtcgttattcaatgtcaggcagttgtccggcttatagcgcgcggcgcgttccagacgctgggcgatttccagcgcgttttcccggccgcgctgctccagccgctggcgcagcaccggcggcgagacggcgagacagatcggcaccagcacctcgccgtaacgttcccgggccagcgccaggtgggcgcgggagccgttggccaccacgtcaaagccggcgtgcagccagaggtcgatctccacgccaatgccatagtaagtattgttggcgtgccagctgagagcaaaaagatgctgctcggcgcgggtaaaaaactcatgttcgctgagggcgatatgattctcgctgcccgcgttaaacgggcgggttatgtaacgatgggccaccagcagctgcgggtgctcgcgctggcgcagcgccgccagcaggctatctttaccggagccggaggggcccaccagccaaatcagttttcctggcattaaaagaccctctttccctggcgccagacatggtcgatctggatatgttcgccgcgacggtgcgccagcaccaggtcggcgcgtttcccctcggcgatgacgccgcgatcgtcaaggcccagcgtctgcgccggatgctgactgaccagacggatcgcctgtggcagggtgaaggcattgtcctcggcgtcggcgatgcggaaagcggcatccagcaggctggcggggtaatagtcagatgagaggatgtccagcaaaccgtggctcgccagctggtgggcggcgacgttgccggagtgggaaccgccgcgcacgatattcggcgcccccatcaggacgtgcatcccgtgctgacgtgaagcctgcgccgcggccagggtggtgggaaactcggcgatgacgctacccagctggtgggattcagccacatgcgcctcggtggcgtcgtcgtggctggcgagggcgatacggcgggcgcggcacatggcggcgatggtctggcgattgggctgcgaccaggtggcggccagagccatctgctcggcttcaaaacggtccatttcgtcatgcgtcagatgatattttccctgatagtaatcgcggtacttgctgcgatcggcgtactgacgctggccgggcgagtggtccatcagagagaccatgctcaccgactcgcggtcgatcagcttttcaaacagcggcagcgtggtgtgatgcggcagctcgcagcgcaggtgcagacggtgctctgcgcggttaagaccgcgcttttgcgtctcttccaccgcattgaccatcttctccagattctcaagacgatcaccgccatcgcgcacgtcgccaatcgccacggcgtccagcacggtggtgatgccgctggcgaccatcatggcgtcgtggctgctcatcgccgagtgggccggccagtctaccttcggccgcggggtaaagaacttgtcgaggttatcggtatgcagctcgataaggcccggcagcagccagccgccttccccatccagcgcctgcggcagccggctctggctttcggcgaaggcgaggatgcgaccgtcctggacttccagcgaaccgtggaccacctcgtcgtcgagaaccagttttacgttattgataatcatgctgtcattcccatagagtgcagtcggtcggcgacctgacggcgtaccccttcgtcatggaaaatccccacgatggccgcgccgcgcgctttggcatcgtggatcaggttgaccacggcagcactgtttttgtcatccagtgaggcggtgggttcatcaaggagcaggatcggatagtcgaccgcaaaaccgcgggcgatgttgacccgctgctgctcgccgccggaaaaggtggacggcgcaaggtgccacaggcgttccggaacgttgaggcgggtcaggagctgggcggctttcgcggcgctcgcttcgcgcggcgtcccaagatcgagcagcggctgcatcaccacctccagcgccgaaatgcgcgggatcacccgtagaaactggctgacccagccgatggtggttttgcgcacttccagcaccttgcgtggggtggcggtgaccaggtccacccattcgtcgccgtggcggatatggatatggccgctgtccggcagataattggcgtacagcgaacgcagcagggtcgatttgccgctgccggagtgaccgtggagcaccacgcactccccggcgttaacggtcagcgaggcgtcggccagcaccggcagacgcacgccgtgctgctggtgcagaacaaaggttttatggacgttttcaacgcggatcatgttagctctcacgaggttgggttgccgggtggcgcttcgcttacccggcctacgaataacgcacctgtgggccgggtaaggcgcagccgccacccggcaaaacagcattaattctgcaacaccgacgacaccagcagctgggtgtaaggatggtgcggatcgtcgagcacccggtcggttaagccactctccaccacctggccctgcttcatcaccagcagacggttcgccagcaggcgagcgacgccgagatcgtgggtaacaatcaccaccgccagattcagctccaccgccaggccgcgcagcaggtctagcagccgcgcctgcacggacacatccagcccgccggtgggttcctccataaacaccagcttcggctgggtgaccagattgcgggcgatctgcagacgctgctgcatgccgccggagaaggtggtgggcaggtcgtcgatgcgcgagggcgggatctccacctcctgcagccacttttcggcggtggcgcgaatgttgccgtagtggcgggcgccggtggccattagccgttcgccgatgttgcccccggcagggacctggcgaggcagaccgtccatcgggtgctgatgcactacgccccattcggtgcgcaacaggcgtcggcgttcggcttcgctcatggcgtacagcgagcgctgctggtacagcacctcgccctgctgcggcgtcaggcgggcggagattgccttcagcagggtggttttaccggagccggactcgccgacgatgccgagcacttctcccggccacagctcgaaggagacattgcgaaaacctttatccggggcgtagagatgagtcaggttattcacagcaagtaatggctggttcattttttctgcccctcgctctgctggcggcaatagtcggtatcggagcagacaaacatccgctggccgctgtcatccagtaccacttcgtcgaggtagctgtggcgcgagccgcagatggcgcagggctcatcccactcctgcacggtaaagggatggtcgtcgaaatcgagactctccaccggggtatagggcggcacggcgtagatccgcttttcgcgcccggcgccgaacagctgcagcgccggcatcatgtgcattttcgggttatcgaatttcgggatcggcgaagggtccatcacgtagcggccattgaccttcaccggataggcgtaggtggtggcgatatggccgaagcgggcgatatcttcatatagtttcacctgcatgacgccgtactcttccagggcgtgcatggtgcgggtttcggtttcacgcggctcgataaagcgcaatggctccgggatcggcacctggtagatcaggatctgatcctccaccagcggcgtctccgggatccggtggcgggtctggatcagggtggcgtcttcggtacgctcggtggtggcgacgccggtgacgcgcttaaagaactgacgaatcgacaccgcgttggtggtgtcatccgcgccctggtcaatcaccttcagcacgtcgttctcaccgatgacgctggcggtcagctggatgccgccggtgccccagccgtagggcattggcatttcgcgcccgccgaacggcacctggtagccgggaattgctaccgctttgagaatagcccggcggatcatgcgcttggtttgctcgtcgaggtaagcaaagttatagccagtcagtgggttagccacgttcgttctcccgttgcaggcgtttcagcagcgccagttcggcctggaaatcgacatagtgcggtagcttcagatgcgagacgaagccggccgcttcgacgttatcggcgtgagccagcacaaactcttcatcctgcgccgggccggcaatctcttcgtcatagtccggcgcctgcagcgcacggtcgaccagcgccatggccatcgctttgcgctcgctcatgccgaaggtcaggccgtagccgcgggtgaagtgcggcggctcctcctgcggggcgacgaagccattaaccatctcgcactcggtcagcagcagctcgccaatattgacgctaaagcccagctcttccgggacgatttccacctgcacgtagccgctgcggatctcgccggcaaacggatggttgcggccatagccgcgctgggtcgaataggccagcgccagcaggtagccttcatcgccgcgcatcagctgctgcaggcgcgaggaacgcgagcaggggtagcccggcggggtgcgggtgatatcgtcgggcggcgtgccgcgatcttcctcggtcttcgccagcccctgctgcgtgagcaggctaaagacgtgcggcgtcggctctgcttcgccatcggcttgctgcacagacggcgcttcgccattggccagcagggtaaaatcgagcaggcggtgggtgtagtcgtaagtggggcccagcagctggccgccggggatatctttatacactgcggagatgcggcgttcgaggcgcatctccgcggtattaatcggttcgctgaccgccagccgcggcagggtggtgcggtaggcgcgcagcagaaatattgcttcgacgttatcgccgctggcctgcttcagcgccagcgccgccagttcgcggtcggcgatgccgccctcggtcatcacccggtccaccgccaggctgagctggtcgcctatctgttcgacgctcagttcgggaagccgtccatcgccccgtcgtttctgttcctgtaaggcgtgagcggcgcggatcgccttctcgccgcccttgacggcaacgtacatttagcacacctccacgtgggtggtgcgcgggatcgccagcaggcgctcgccgcaggtgaggatcaggtcgatgcccagcgggaacggatgcgggcgttcggttaattcgtcgatgatgcagtccggcagctgcggcgcgatcattcgctcttcggcaatgcctgccccggtcaggcgcagcatgcgtccgccgctgaggctggcaagctgaacgatcagtgtgacgccggtttccggcgcggtgacggtgccagcggaaaggacgttgagctgctcggcgctgataccgtcattggcgacggcaaagaccgcctgctgcggctggtccaccagcggcgcgccggtatgaaagcgcagattctgtcccaccagatcgttacgcagagcgctggcgagccagaccggtgtttcatgatcggcaagggtcaacagcaggctggtggaggccacgttcaatggctgccagccgtgctgaagctgctgcagggagacaatcacccccggctcgctcatcgctttcagcaggcgacgaaaactgtgttgggcatcctgcacagccagggtaaaagcgggttgtaaggtcatacgttatctccgcgaaccagggtaaagaagtcgacccggctggcgttgacttcggcgcgtcgggcttcaatgcgcgcgctgcgtagcgcttccagcggggttatcagagtttccattaaggtgtgaaaatggcggggcgactgcagcagggcgtcgatcgccgcgcagcgttcagcgtgcgggcggtcgcggcctaagatccagctgtaaccgagggtaccgtcagccaggcgtaccgctgcgcgggtaagggtggcgtcgccggcaaagaagcggtcgccgataccgcccatgcgggcctggagctgtaccagcccggtttccggggtgcgaatcaattcatattccggcgccagctgcagggactgcatgcgcgccagaaggtcctgcggttcactgtgggccagcacggacatccagcgctggcgggtggcggtatcgaagtgcattcagtgctccatggtaaattcaatcatgtcggcgcgggtcaggctgacggagtactccgccgtgagcgactcgccctcgcggctattgagcgtgcggacgcagagcagcggcgccatattggggatttccagcagcttgctctcttttgcctgcgcgcggcgggcgctaattttggtgcgtacgcgggtcagttcgacgtcgagccgatcgcgtagcagatcgtgcagcgagccgtggctgaaggtctgtagcaccggccagaagcgcaggtcagcgaagtagtggtcgatcaggcacagggcgacgccattgacccggcgcagggtacgcaggtggatcacgttctcgccctcattgatgccaaaggcctcggcgacatgggcgctggcggggcgcagcaccgacagcagcttttcgctggtgggatcgctgccttgttccagcaggttttggctgaagcgcgcctgggcgttaagcgggtagtcgatggggcgcatcagcaccagcacacccacgccctgacggcgctgaacccagccgcgctcaaccagctggtcgatagcccggcgcagggtgtggcggttaacgtcgaagcgcgtcgccagctgctgctcggcgggcagatagtcgccgcagcgatagtggtggcgcagctcctgctcaagtcgggcggcgatttcctgatagcgcgtggggtaactggtcggatgtctggacaggtgcatggtcatcaagcctcacacagcataggcgaggagcttcctcgcgttgtgggccgatcctgaccggtttatgttgcatttcggttaagtgacgatgaccaaaggatgaagagttgatgccaggcggatgacagggcggccgggccgccctgggggcgtcagccttgtttgaccacgttgatcatccaggggacgccaaagcggtcgacgactttgccgaagccgtgggcccagaaggtttcctgccaggccatctcaatgcgcccgccgacagccagcgcgtcgaaccagcgctggccttcagcgacatcgctgggatcgaggacgagggtgaagccggcgtaatgcacatcgggcccgaaggcgctgtcgctcagcatcagctggccattattgatgcgcaggctggcgtgggcgatagcatcatccgccatcttctggccagacgggcagccgtctgacgcttcctgcgccgggggcggcatttcgccaaaggtcattttaaacatcagctctgcgcccagcgtctgctggtagaaggcgatcgcctcggcgcagttgcccgcaaaggcaaggtagggacttaaggacatggtgaatacctcagtgaccgtaacccgtaaagcgtagtcgcccggcaggcgattgagccagacggcagggcgaaaaggggcgctgaaatatgacggcaggcgacagcgtaaatagcggttgccggcgagggaaataacaggatgcgccgggggacaaacggccaccaggatatcgggagcggcgacggttatgtgaaaaaataatcgtgccgcctacccgaaattaaatcagttctttttcacaaattccgatttgagcttcatcggaccaaaaccgtcaattttgcagtcaatattgtgatcgccttcgaccagacggatatttttcactttggtgccgattttcagcatcgaagagctgcctttaaccttcagatctttcacgacggtaacgctgtcgccatcggccagtaaattgccattggcatctttaacgatcagaatgtcgctctcttccgtcgcctcggcagggttccactcatgggcacattccgggcagatgtacatgccgctatcttcataagtgtaagtcgaatcgcattttgggcagtgtggcagttgcatgacgctcctcatgatgtcgtcgaaaaacaggacgttggtcctttaaacagcggctgagagccgaaagtgggtatgattatagcgcaatcacccacttttgtcgggtgtttttttgctaaaaagtagccgtggtattattccgggaaaaagcgaataaacgctgaaattaaccgcccgaagtggagcaaaatcgaagaaataatttccgcgcgatcggcaggaaatgaacttatttattttccgacactctgtaatgaggcggtaaatttctgtgaagttgatcgcagatataaacactgttagggtaaaaaaggggagcaggtcaatttcatcaagcatcacgatgagccgctccatttattcaccagtagccagagcaggcgtcaacaggttcggttgtacattctgtcagcagacagtgcaggcaaacctgctacgcttgaaatgaggagcacagcaattcaccgctcctgacgcacgatgcgaatggccttgccattcggcgaagaggcgtgcactcaaggcggagtagcagaggaaaaatatgcttaaaaggaaaaaaataaagcccatcacccttaaggatgtgaccatcatcgatgatggtaaactgaaaaaggcgatcaccgcggcctccctgggcaacgcgatggagtggttcgatttcggcgtctacggctttgtggcctacgccttaggtaaagtcttcttccccgatgccaacccaagcgtgcagatgattgccgcgctgggtaccttctccgtaccatttttaattcgtccgttaggcggcctgttcttcgggatgctgggcgataaatatggtcggcaaaaaattctcgcgataactatcgtgatcatgtcgataagtactttctgtatcggccttattccgtcgtatgccacgataggtatctgggcaccgatcctgctgctgctgtgtaaaatggcgcaaggcttctcggttggcggtgaatataccggggcgtcgatcttcgtcgcggaatactctcctgaccgcaagcgcggctttatgggcagctggctggactttggctccatcgccgggtttgtgatgggggccggcgtggtggttctcatctccagcgtggtgggtgaacagaactttctcgactggggttggcgtatcccgttcttcctggcgctaccgttaggtatcattggtctctacctgcgccatgcgctggaagagacgccagcgttccagcagcatgttgacaccatggagcagggcgaccgtgaaggactgcaggacgggccgaaggtctcttttaaagagattgccaccaagcactggcgtagcctgctgacctgtatcggtctggtgatttccaccaacgtgacttactacatgctgctgacctacatgccgagctatctgtcgcataacctgcactactcggaagatcatggagtgctgatcatcatcgctatcatggtcgggatgctgtttgtacagccggttatcggtatgctcagcgaccgtttcggccgtcgcccgtttatcctgattggtagcgtggcgctgtttgccctgtcgatcccggccttcattatgatcaacagcaacgtgactagcctgatcttcgccggcctgctgctgctggcggtggtgctgaactgctttatcggggtgatggcctcctcgctgccggcgatgttcccgacgcacatccgcttcagcgccctggccagcgcctttaacatctcggtgctgattgccggtctgacgccaaccctggcggcgtggctggtggagaccacccaaaacctgatgatgccggcgtactacctgatggttatcgcggtggtgggtatggcgacgggcctgtcgatgaaagagacggctaaccgtccgctgaaaggggcgaccccggcggcgtcggatatccaggaagcgaaagaaatccttggcgagcactacgataacatcgagcaaaaaatcgaagatatcgatcaggagatcgccgatctgcaggcaaaacggtcgcgtctggtgcagcagcatccgcgtatcaacgactaaccgttttcactgttaatcatgccgccaggggaaaccccggcggcattttttatgccttcggcaaggccaggccgtgacgccgctgctggctgagtttacggtactgctgcggcggcatgcccacgtagcgggtaaaagtgctgtagaagcgactgctggagcgaaaaccggcggtaagggcaatatccaggatggtcttgtcggtatcgctcagcagcgcccgcacatgattgatacgcatggcggtaatgtactgcttcatggtctgctgcatcacccgctgaaagacccccatcgcgtagttcgggttgagcttcacgtgctcggcaacggcattgacggtcagcgcctggtcgtagtgggcagcgataaactccagcatctggctgacataaaactgcgcgtggcgcgagacgctgttcttgtgggtgcgtgaggttttattgaccagaatcggctgccagccggcgaggctcagccgcttcagcatcagggcgatttcatcgatcgccagctggcgtatctgttcattctcgtggctcagttcctgctgccagcggcgcacttcgaaggcgctcaactgctgcgcggcgagggatttaatcaccatcccatgggtgacgtggttgataagctcccggtccagcggccatgagagaaacagatgcatcggcaggttgaatatcgccatctgctggcaatcgccggggcgggtcagctgatgcggcgtacaggcccagaacagagtgatatagcctttctcaatgcgcaccacttcgttattaatcaaatactccacgtcgccatcgaacggcacgttgacctccacctggccgtgccagtggctggtgggcatggcgtgcggcgggcgcagttcgatatccatacgctgatactcggagtagagcgccagcgggctgcggctctgcttttcgtcgctgctgcacataaagggatcggggggcagagaggtgaagcggtgttccatcgttagcgtattcctgaattgtcagagtggctgcatttttcgccagaactgacgacagcttagcggaagaatcggcccattttctctcctttttgctcaatctgttcccgaaatctcagattttgtggcgcttaatggccgatctgagctttcgggaatgctccggcgggaacagggcagcgcagcggggagcggcgtgccactctgcaagtgttcaatgacctgatggagagtgcgtgatgtctgccccaaaaattacttttatcggcgccggttcgacggtgttcgtcaaaaatattctcggtgatgttttccagcgcccggcgctgaaatcggcgcatatcgcgctgatggatatcgatgaaacccgactggaagagtcgcatatcgtggtgcgcaagctgatggattccgtgggcgcgaacggcgaaatcagttgccaccgcgaccggaaaaccgccctgcagggcgccgattttgtcgtcgttgccttccagattggcggctatgagccctgtaccgtcaccgattttgcagtctgcaagcgccacggcctggagcagaccattgccgatacgctggggccgggaggcattatgcgcgcgctgcgcaccatcccgcacctgtgggctatctgcgacgacatgagcgaggtctgcccggacgccaccatgcttaactacgtcaacccgatggcgatgaacacctgggcgatgtacgcccgctacccgcatatcaagcaggtgggtctgtgccactcggtgcaaggcacagcggaagagctggcgcgcgacctcgatctcgatccggcggatttacgctaccgctgcgccgggattaaccatatggcgttctatctgtcgctggagaaaaagctcgcggacggcagctacgtcagtatctaccccgacctgctacaggcctacgccgacgggcgggcgccgaagccgaacctgcacggcaatccgcgctgcgaaaacatcgtccgctatgaaatgttcaaaaagctgggctactttgtcaccgaatcgtcggaacatttcgccgaatacacgccatggtttatcaagccgggccgcgatgaccttctcgctcgctataaagtgccgctggatgaataccctaaacgctgcgtcgagcaactggccaactggcatcaggagctggagagctataagcgcggggagcgcattgaggtgaaaccctcccgcgaatatgccagcaccatcatgaacgccatctggaccggcgagccaagcgtggtgtacggcaacgtgcgcaacgataatctcatcgacaacctgcctcagggctgctgtgtggaagtggcctgcctggtggacgccaacggcatccagccgaccaaagtgggcgcactgccggcgcatctggcggcgctcatgcagaccaatatcaacgtgcagacgctgctcacgcaggcgatcctcaccgaaaatcgcgattacgtctattacgccacgatgatggatccgcacaccgccgcggtgttggggatcgaagagatctacgcgctggtggacgatctgatcgccagccacggcgactggctgccggcctggctgcaccgttaatcctcttatgccgccgggggcaacgaacccggcggtgcctgtcacgctctatcaaacgctgaaggaggcgctggcgacagcgacctggaccctatgagtatttcaatgacaacaaagctcagctacggatttggtgcctttggtaaagatttcgctatcggtatcgtctacatgtacctgatgtattactacaccgatattgttggcttatcggtcggggtggtcggcaccttgttcctggtggcaaggatcctcgatgcgatagccgatccgattatgggatggatcgttaactgtacgcgatcgcgatgggggaagttcaaaccgtggatcctgatcggcacgataaccaactcggtggtgctgtatatgctgttcagcgcccaccacttcagcggcggggcgctgctggcgtgggtgtggctaacctacctgctgtggggcttcacctacaccatcatggatgtgccgttctggtcgttggtgccgaccattaccctcgataaacgcgaacgcgagcagctggtgccttacccgcgctttttcgccagtctggcgggatttgtcacggccggcgtcacgctgccgttcgtcaacgccgtcggcggcgccgatcgcggtttcggttttcagatgttcactctggtgctgatcgccttcttcgtcgtttccaccctcgtcaccctgcgcaacgtgcatgaggtttactcctccgacagtggtgtgagcgaagactccagccacctctcactgcgccagatggtggcgctgatctataaaaacgatcagctggcctgcctgttaggcatggcgctggcctataacacggcggcgaacattatcgctggctttgcgatttactactttacctacgtgattggcagcgcggagatgttcccgtattacatgtcctacgccggggcggcgaatttgctgacgctgatcctgttcccacgactggtaaaagggctgtcgcggcgcattctgtgggcgggtgcttcgatcatgcccgtgctgggctgcggcgtgctgttgctgatggcgctgggcggcgtttacaacatcgcgctgatttcgctggccggggtgctgttgaatatcggcaccgcgctgttctgggtgctgcaggttattatggtggccgataccgtcgactatggcgaatatacgatgaatatccgctgcgaaagcatcgcctattccgttcaaacgctggtagtcaaagccggttcggcgtttgcggcctggtttatcgccatcgtgctgggtatcatcggttacgtgccgaatgttgtgcagtcgtcccacacgctgctggggatgcaggcgattatgattgcgctgccgacgctcttttttgctctgacgctgtttctctatttccgttattacaaactgaatggcgatatgctgcgacggattcagattcacctgctggataaatatcgccgggtaccggaaaatgacgtcgagccggaacggccgattgtggtacccaatcaggtgtaaaaagcgtgcgaaaaccgctgacgaaagaggggagggatgctctctttttgagcaaaaaacagtgtcttaaaaagacagaaagagaaaactgtagttctctattttatctcaattatttctctttttgagcgttctggactgtttgtttctccgattgttctcaaataaaactcagaattgtctctttttcgtgctcttgcgctgctttttaactcttgctactctttttgggtcttacatttttctcttatttgtctcagtgatggagcaatgcaatgcgcatttttatcgatgatggttcaaccaatatcaaaatgctgtgggagcaagatggcgaaactttcacccatatcagccccaacagttttaaacgcggctggtctgccaccttcggttcggggaagccttttaactacacggtggatgatgaaaagtactcattcgacctgatcactcccgatgcgctcccaaccaataacattgactggcaatatagcccgttgaactccatcgctgtccatcatgcgctgctgaccagcggtcttgagccacaggatgttgaaattgtggtcaccctgccgctgaccgaattttatgatgaagatgcgcaatatcgcctcgacaatattgagcgcaagaaaaagagcctgctgcgcgaagttaaactgaataaaggcgtggtgttcaatatcactaaagttaccgtgcgcccggaatcgattccggcgggcattagcctgtgtgatgagctgaaaccgtcgcattcggtgctgattatcgaccttggcggcaccacgctggatatttcaatggtcgccgggcagatgacctcggtttcgcgcatttacggcgacccgaagctgggcgtatcgctggtgaccgacgccgttaagctggcgctggcccgggcgaataccgacacctccagctataacgtcgaccagataatcatcaaccgccacgacgaagaatacctgaccgacaacatcaacgatccggatgcggtttctgaggtgaagaaggtgatcaataacagtatcgaacgtctgaccacgcgtgtcctgacggccatcgatagctttaaaggctattcgcacgcgatcgtcattggcggcggcgcgccgctggttgccgacgccattcgtgaacggatgggtctgcgcgaggatcgtttcgtggtggctgaagagccgcagtttgccctggtgcgtggtctgaaaattattggttaaggagcgtctatgactctggatcgcagaaaagtgctgatttacctgcgcccggatatcagcgccagcgagcgcttcgcggacgcaaaaattgaggcccatcaccgtggcgaccgcggcgatatgtcgcgtaccgcgctgctggcggggctggcgttaggggaagtcgatagccgcttgccgtcgatgctggcggcgctgctggcggaagatactaaaccggaaacgctgcgtaagatgctggcctcgttccttgagatccagccggcctctcccgccccggcagccgcggcagcagccgccccggctaaggcgccggagccgcccgcgccggtgagcgagagcgtctccgcgcgtaatctcgccggttcgttaccggattaagcgctattcccggtttgcgcgacccgggaaactccccggcttgcgctgcgcttagtttgtaggccgggtaaggcgtagccgccacccggcatacaggcggccccctggctggggccatgcccggcggcgctacgcttgcgcgggcctacggatccagtgcaatggtgggcccagtgccatttgtaggccgggtaaggcgtagccgccacccggcgcgaagacggaacgccacgacccgggatggcacccctatccgtgggcgaggaagcgcgccaggcgctgctgcagcaggcgattttcgcgggtcagccgcgcgttctcatccagcagggtcagcgccaccgcaattcccggccagtccagctccagctcgttacgcaggcgtaccgcgcgatgcacgatcgttaccgcgctgtcgtcgaacagccaggtgtccgcctgcggctggtgtggctcaatcatccctaagccgacgatctccgtcagctcctcttccgacaccccggtacgcaggcacaattcggtaatggtaaacgtcactgttactgtagccatcagactttcccccatgtcttacgcggatcgaagctggcttcggcggcggccaattgttgccagagctcacgcgctttttcatctggttttggcggcatcactattttaataacggcgaacaaatcgccggtgtgggttttgctcacgagtcctttccctttgatacgcagtcgctgccctgcctgactgcccggcggcaccgtcagcagaatgctctctttcagggtgggcaccgtcactttcgcgcccagcgcggcctcccatggcgccagcggcaggacgatctccaggttatgaccgacaatatcgaatagcggatgcggggcgatgtggataaccagccacagatcgccgttcgggccgccattctcccccggcgtcccctggcctttcaggcggatacgctgaccatcgactaccccggcggggatcttcacattcagcgttttcggcgtttcgctttcgatcatgccaaacacgttgtacaccggcaggttatagctgatggtgcgcgtctgctcggccagcgtctcttcaaggaacaccgccacttcgatctccagatcgtggccgcgcgccgcgtgttgacgacgacgctgatgcgtctgctggccaaacatggaggagaagatgtcgtcgaaatcttgctgactgtagctctgctcgtgggtctgtcgctggcgaccgaagccgggatcgttgcgatgctgccagagctgatcgtattcggcgcgccgttgctcatctttcaggacttcccaggcttcggcgagatccttaaatttggcttcggcatcgttttctttactgacgtcggggtgatatttgcgcgccaggcggcggtaggcggtcttgatggttttcagatcgtcggttggttgcaccccgagaatggcataataatccttcaattccatgatcttatctcatctatgctcagtgcggtggttacatattccctggaacaggcgtcagtataaagcgtagggcaaatgcgccctgacggggaagaaaagtggcggaaacttgacgccgtcggggtcgacggcgccgtggataagattagtctttcgcctgcggccgtgggcggcggcgccatccggtgaatagcaccagcagcgcgccgacggcgccagccaggcgcgcggtgccctcgccggcgctgggaaacagctggcgaatggtagggtcgctgaccagcgttgacccggcaatccagccgatgagcatcccgcccagcagcaccaccgcgggaaagcgggtgagcaggaccagcaccagcttgctgccggcgacaataaccggaatgctgatcgccacgccgagggcgaccagcgcaatgtgccctttccccgcagcagctaccgccagtacgttatccagcgacataatcacatcggcaacggtgatggtgatcgcggtgcgccacaggctgccagagctgctaacctcgctctcttcttcctcattcctgaccagcttgatgccaatccacagcaggagcagcgcgccgactattttcagccacggcagcgacaggagatacaaagcgatcgccagcagcagaacgcgcgccaggatggcgcccacggtaccgatgatgatcgctttggtgcgtttctgcggcggcagtttgcggcaggccatggcgatcaccacggcattgtcgccacccagcagtaagtcgatggcgacaatctgcagcataatcactgccatgtcccattgttgaagaaatgcatacatatcgagagaaaccacctgaaaaaagagcaagaaaaaccgctgcgcagggtactccgcctgggccgcgttgaccactggcgcagacctgcgctatcgcgcgggaaagagagagcctgaaaaataaagttacgaatcaaggcgccgttgggcaaggcttcggcgaaaaagggtgatattttgtcacccagactcacctgccgttcacttatcgcaaggatccccactatgtctggccacaagaaatacctctctgtcgccctgctgagcgctgtcttactgccggcgatggcctctgccgctgacgcgccggcgactttcaccccggaacaggaggcgaaaatcggcaaaatcgccgccgactatctggtcgcccacccggaagtcctgctgcaggcgagccagaaactgcagcaaattcaggctgagcagcaggccagcgcggccactcaggcggtgctgaagaacgccgccgtgttgacccaggataaaaataccccgacctacggcccggccaatggcaaagtcacggtgatcgaattcttcgactaccagtgcgtctactgcagccgtctggcgccggtgatggagcaggtgattaaagcgcacccgcagacccgcttcgccttcaaagagtggccgattttcggcggccgctgggaaagctcgctggaggcggcaaaaaccggcctgcagatctatcaacagaaaggggcggatgcctatctggcctaccataacgggatttacgctaccggccataacgaaggcaagctgacgacggcggatatccagcagcaggcgaaaaaagccggctttgatgcgaagaaggccgccgacgtcgaaccggtgctgcagagcattaacgatctggcgcaggagattggtctgagcggcacgccgggcgtgatcgtgatgccgaccaccggcgccacggaagccagcatcaccgtcttcccggggctggcagacaaagcctcgctggaagccgccatcaaaaaagccggcggctaatccccggcgtattacctgtccaggccgccgacggcggccttgctctcatgcgtcatcgctctcttcctgcggcggcggtaacgcgtggctttttaaatcaataatctgcccgatttgatcgtggtaaacggtgagcaaattatagcggctcatctccgagataatctgcggcgcgacgttaaagctgctcgccagctcatcgtcgcgcagagcgagcaccgcggtatgacgccgggtacgggcgcggcgccggttgtagtgataccagaggatcaacagccagccgttcagcgcggcaatcagcagatacaccagcgccgtattcagggagtccatcagcgattcccagcgcggagagggcggcgcgatgaactgcatcagcaaattggcgtacagaaagaacagaaaaccgagccaggccagcagcgttaagccggcgtcgaccagccggggtagcacccgatgttcggttaagatgagcgtattttcattcatcacaggcttccttttccccggtccggactcacccagcgcgcgcgggaacgttgacgtttcaccatcactttcggaaaagcgaccagcgtggtcagcaggccgatcatccagtagaccatcgggaaccagatcacccagaacagcgatttggcgacctttttctcatagcgccgctcgatatacaggctggcgacgaactgcagcaggcacatcaggccgagcagcatgccggtgaattccggtggaaacaggctatgcaccgccagattgtcaggcagcggcatcaggcggctgaggataaacagcagaatggtgatcgcgtaggcaaaggcccacagcgtggagcaggcatactccagaaacagcggccacatccggtgatgctgccagtgaaacaggcggcgcagattgaccagaaagacttcggcgccgccctgggcccagcgcagacgctgcttccataaccctttgagggtctccggcatcaggatccagcacagcgctcgcggctcgaaaaagatgtcccagtggcggagctgaagcttccagctgatatcaatatcttcagtgatcatatccgggctccagtagccgacgtccgccagcgcctggcgccggaaggcggcgattacgccggagacggtaaagacccggccatagatccgctgcgtccgtttgataagcccaatgatcgacgagaactccccaacctgaatgcggccgatcagcgtggatcgggtgcggatccgcggattgccggtgaccgccccgacgtgcggataatggatcaacggcgcgaccagccaggccgcggtatcccggtccagcagggcgtcgccatcgatgcagaccagcagatcgccgcgggcggcggcggcgcccgctttgagcgccaccgcttttccctgattggcggccagatggatcacccgcagcctcggctcctcctgcgccagctgctggagcacctgggcggtgttgtccgaagagccgtcgttaatcgcgatcacttcaagattggcgtaacgctgggccagcgctgcgctgatggtttcccgggcgtttttctcctcgttaaagcaggggatcaggatcgagatcagtggattgcccggcagcgtcggcggcggggtatcctccccccacggccagtgacgttccagctgaaaccagaagtagagacccccggtgatccacaacactgacataaacagcggccagaaaaagacaaagtcgaggataagctcgccggtaaataccgctgcgacacctaacggcagcccgaatacgaggcataaaatgcacaatgcgataatgcgatcagtcatggtcagggtaccaccaggaagaaaattgcggcctgatacgagagatatcaggctggttgttaataaaatcgtcagggtagtagccgtagtttttgacgccgttcagccgcagcaaacgcatccagtccgccagctgctggtcgggaatggcgttttgctggcgtcgattccagtctctggcctgcagttcaaagatggttttcttcagcgcgcccgggtggcgggcgacggcctgcaccagccgcgtcagccaggcctggctggcgtcgatcggcacggactccatcagcggcatcgccatggggaccgtccagtcataggcggcaaggaagtcatccagattctgcgcaaaccaggcttcgctttgcggctccaggatcggcagggcgaagagattacgcgccgttttcacctgcgggccgcggatggcctgcactgcctggcgtagatccagagtgaagcgggtcagggtttggcttttgaaacgcatccatgcctggcgctcttgcggacgttggggcaccggggcggcatcgtgcgccatacccgtctgccgccaggcggcgaccgcctccgggctcacgtcttcaaaatcggtcaacacggcgtcgtcgtgaaacagaatcccgctgaagctggcgtgtcgggccagatcttcgtagatgtcggtgatctgctggcgaacccggggatcccagggcgacagacggacgtacggctggcgggcaagtaacgccttcccggtttgcggatcccagcgctgaacgcgcggcagatctgaggcaagatcgaaggccagcaccggcatccaggcataaaccttcacattgccgcgggtctgcaactgccaggagacgaagttaaacaggtcggcgcgcatcggcagccagcggttggggaaatagagcgacttgaccgtgccgtcgccctgcgggtcggagaaggcctgcagaaagacgtggctgattttcatgtcatagacgcgctgcaccagcttatcgatattctttgcctgctggacgggattggggtcatagacatagtccagatccacatgcatcacccgaacaggatcggcttcctgaatctgggtcacggcgctggcaaaggccttgagcgacgggttaccggcgatcagcaggcgtggaatattgtccagatccttcacgttgcccaggccgtcgttcagcgtaaacgccagctgatacccttgctgtttggcgatagtcagggtgctgccgctggcggcgccgtagggccacacccaggcgcgcggcgttttcccggcaacctcatggattttcgccgtcactttctgcacgtcatctgtcattcgccgggtaaactgcgcgtcgctttcatagcggccggtggttttatcccagccgcggttggcggcggcaggctcgcggctgccctgcggattggccggcagaccgtagtgcgaggcccaggtgtgagcgccgatctccaccagcggcgagcggctgagctcgcgcaccatctcccaggtagcgaagcgctcgcgcggcgtcatcaggccgccaaaattaacgggctgaccagcgggagtgtccacccagctgcccaccggcgcccacagcgccgggacgttccaggctttaagcagcggccatacgcgggtgtaaaagctgctgtaaccatcgtcaaaactgaggagaaaagccttgggcggcagcgactttaagccataatgcgcatcgagaatgtcctgaacgctaatcgcatggtagccgttatgcagcagccaggcgatctgctcattgagtgcgctggtgcgcaccgaaagataacgctggtcggcggcatcgtcttcgacgtcatggtaggccagcaccagaaagcgatccgccggccagggttgattggcctccagttgggggcgctgctgcggggcgaggaaggggacttcctcagcacgcacgctgaagataaggcacagccagatgagaagcatcaggccgttgcgcagggtcgtgttcagcatggtcatccttaaaaccgtatatttgcatcaagagtgatggcgaggttgttttcacgtttgccgtcgtaggggcgcttatcccagttcagcatcaccccggtgtcgacgacgttgttccagcgcaggcgctgcccgtaacccagcaccgtgatcgccccggcggcgtgatttttttgccagtagctgccgccgccggcgagtaactgctggctccagacggtgtcatagcgctggtaaagcgtgtgatcgacggccagcgccgcggtggcggcgaggtcccgtgccggactgtagtaggcggtgtcggtgcggctattggcgctggccgacagaccgggctgcaaatccagcgttaaccatggggtttgccagaggcgttctttaccggagagggtgtactcatggcggcggttgcgatcggtaaaccggctggcggccgcgctgacgcggtactcccggcgttcgtttggagaccagcgcagccagccttcgccgcggttggcgctgacgccgttgcgtaacgcgcgcagcggcgtctgctgcgaaatccgctccagttcgccgcccagctgccagcgatcgctaacgtcatgggcggcggaaaggcggacgccgggcttgttctcgccgtgaaaattgacgctggagagctcaagctcgccccagtagtcgcgcggacgccattcaataccggcaaacagctggcgacggctgcctttcccctcttcaaaattgccttcagcgaagcggtgcccgccgaacaaccgccagctgtcggctagcggcgggctgtagatcgccgtctcaaaactgaggtcgtgcgtgccgctcaccgggttgtcggaatgcagccctttgccaacgctcaggcgcagctcggagagatgatggatctcgcgcgctctggccaggcgctgggtgttcagatcccgtggcgagcgggcgacgacgtcgtcagtcagcagatccatttgccgccactcctgcagatcgagggcgacccaggcctgctggcgctccagctgcaggctggtgggttccagagattccgccgcttttagctggcgttcggctgcccgtggcaatcctctctcctgcagaagggcggcatagtctatctgcaggccctggtttccaggggccgtcgccgccaggcgctgcattcgggcttcggcctgcggcaggtcgttggtagccgctaaatagtgcacgttaagcgactgtgcggtgagccagtcgtcgttcggctgcggcgttggcgagccgtagagacgacggatgtagggcgcattcctggtgaggcgggcgacataccgttgcgcctccgggtactgaccggtgtccagcagagcgtagaaaagctcgtgttcctcattctgttggcttgtcagccacgaaggatgctggtggataagcgtcagcgcaggctcaatttgcttaagggcgataaaagaggagatgacccagccgatggcccagtcgggaacggtctgctgctgggcgatcaggctttggtattcgcggatgacctgcgcgtactcggcgctggcgtacagtgcgcccagacgatcaatacgcgcccggatgatgtcgggcgcagcctgtgggtcggggtgccaggcggcgatcatcgcgtcatactgcgtgagcgccgtgcgggccagcgcgtaacgcgccttttcttcgcgggaaggggtatcggcaaggcgcaccagttcggcggcggcgttcagctgcaagttacgcttttccgcaggcgtcagttcgacgctattcgccaggccgagagcaggggaatcaatccggttgcgggtcagggtcgccatcaggctggccagcgcggttttgttttgcggttcacgatcgaggatctgcgtgtccaccaacagctggtcccagcttttgcccagccgcaggtagacataggagagcgtctgcaggtgcgcaacgctcgcctgctccgccaccaggcgacgcgcttcgctgagcgcctcgccgtccttgcgggcatcggcgagcgttttgatatagccgatacgatagtcgtcgctgccaggggcctggctgagcgcctgctgccagagggtgagcgaggtttgccactgcttctggttgcgcagggcctgcgccgcggcggcggtgccccgtgcgggaagcggcatatagacctggtagcgtcgccagactttcaccacttcatcgtcctgaccggcccagagggccacctgcagccagtccgccacctgagaaggggttaaggcatgccgcagctggtactgctgaaggtaactgagaaagggggcgtactgaccttggcgcgcttgcaagatttgctggtcatagagtgaatccgctccctgaaccagcgccgggaagagcaaaagcaagccgattgatagcgagagtttcgtgttgcgattaaacaataacgtatttgaataaggtgatctttccatttctatttgccatatgttcatcaagaatccattgcacaacacgaccgtcctttgacggtgagttaaaggatgaggatggtcccatttagctgactggcactgcaggtgaatgacctattgcaaactaataaacatatctcctgttgataaatgaatgggtaatttatacccgatacggcaaccgataaatatggataaattatggtctgcgttttaagataattctgtaaaatcgacttcattcgaacgggagtgttcaagttgatttctttaacctactgatataaataaaaaagaaagtcaggtggaattttgtttcaaaatggcggtgtgacttatatttagttggggttagagttttttaggcaatatttaagatgatttctgacaaaaattctcaatagcaaaaaaagcatcttttctgtggattttttttatttataatcaatctgtttatttcctgtcagaacgcaaggagggttttcacagccagattcagatgccgcgctaatgataaatcacaggtctcgttattttcaccgccatgcgaagcgttccatagggggagggaaaacgtctggttgacgagaatttgttgattaaatgttaaagggacgatttgtggcaactttaatgatattggttacccaagattactatctttttcaaggtgttaagaatttttttcctgatatcattcagttagattctagcggaaaagcgattttagataatgaggttgatgaagtctctctgctggttgatagccgctcgccgctttgccattacgattatctcgtgctggcagcggcgaaatccagaaagcgaatatgttgtatcgtcctcgatatgcgtcatcgggaagagcatttactgagcctgaaatcgtttttaaacatgtcattatcacccgcggatatggcgacattatttggcctttttctggagatgaatagcaagcgtctgaccaaagagtggtttgacgatctgcgcttaagtttgtctgaacagttaatgttacgtttactcatggcggggatgaccatggaggaggtggccgtcaatctcaatacgtcactaaaaagcctttaccgcaagcgtactgcgctttatgagcggttggggttagataattttaatgaagcttgcttatttatctttcgaaataagctgctggagcagaccgaacgttcgttatgaagcttcgctgtacagagaatggatgttatcgcaaggtatttgttgacgaaaatctaataaattaaatagatattgataggtacaaccgtcgatacccggcggtatcgatgatggcattaggcatataattccggagctctttggaagtatttaccgccaatgcggtttgctatgcacagcgattattataatgaatatattccttgcgccgcacaggaatagttttgtcataaattaacactaccatggtattccgactcacgcgtcggaataccatgagatatcgtgaaagcatcagaggagcgaggtggatgagaataagggacagtattgctgagcggttagaggcatgcgggctctaccgtcgggcggcatccagatggattgaggtgatgcagcgttgtctggacgatgaggaccgagagtggatccgtcaccatcgcaatcagtgtctgaaaaaggcgcaacgtccgccggcgccgaaagaggagtttgccgacctccaccaggcggcgaaagagacgcaatatcgtatgggcattgcgaagccctatggcgaagcattcaggctgcccggcaaagggaaaacggccgccgagtaatgcctttcttcacgacgtttgcctgacggcttcgccttatccggcctgcgggtcctccacaggttcaaacagcgtaggcccgcgcaagcgcagcgccgccgggcgatacacatcagataccgtactcgcggttgtgccggatggcggcataaatgccttatccggcctacgggtcccccacaggttcaaacagcgtaggcccgcgcaagcgcagcgccgccgggcgatacacatcagacaccgtacccgcggttatgccggatggcggcataaatgccttatccggcctacgagtcctctgctgattcaaacagcgccggcccgcgcaagcgcagcgccgccgggcgatacacatcagacaccgtacccgcggttgtggcggatggcggcataaatgccttatccggcctacgggtcctccagaggttcaaacagcgtaggcccgcgcaagcgcagcgccgccgggcgatacacatcagataccgtacccgcggttgtgccggatggcggcataaatgccttatccggcctacgagtcctctgctgatacaaacagcgcaggcccgtgcaagcgcagcgccgccgggcgatacacatcagacaccgtacccgcggttgtgccggatggcggcataaatgccttatccggcctacgagtcctctgctgattcaaacagcgtaggcccgcgcaagcgcagcgccgccaggcagggggtgatagaacggagttcgatgaagagtccggatgtagaaaagcaaaaacccgccttttgggcgggttctttaaatagtggtgcccggactcggactaacgccgcaggcgttgaacagcgcgcttgccgcgctggccccgaaggggtgagccgctgtgcggcgaataatcgaacggagttcgatgaagagtccggatgcagaaaagcaaaaacccgccttttgggcgggttctttaaatagtggtgcccggactcggaatcgaaccaaggacacggggattttcaatcccctgctctaccgactgagctatccgggcaacggggcgcattaaaccgtaatccgcccaccccgtcaaccaaatttcttaaattacttatcgattgcttatctttgcggcaattctgcgttcaaaggcgcgttttggcttaacttcactgcatgccgttatcgccctcgcgggttttccagccgctggtaatggcgataacgtggcgtagtccggagatgagataatcgccaatgacctcctcgtcctcacgcggcgagctcagggtaatttccgcatccacgccgtggcgataggcgccatgatggctgaaaatggtgccgatataacacttcccgttcagccagaccggaatataggccaccgtctcatagatatagttaacggcgacgccgctgtagtagttatccgcctcgtcagcggaggtgcccggcgggatggggcagatcggcgcgtcgttgtcgctggcgggtctgtctttcagcaggctgccctgcattacctccagcgagcgcagcaggtcagctttatcgccgtcgctcaggctgggggtcagcggctggtctttctccggggagcggatgctgttcagcgtatagcgatagcgaaccgtcaccgcgggcgtctggctggtggtgctgaacgggcgtagcaggtagaggttatcttcgccaaactggccgttgtaccacagggcatacacctggccgttgattttgacccagtggttccactggttagccccgcggccattaatggaaaagagggcgccgggcaccccggcatcgaaatcatcaccattatcactgtcgctgccgttgacggcggcaaaatcatcatcacctcgcttgagcaccccggtgtagctgaagagcccggtgccgcccacgtagctgtcgatgatcagttcgcgtttgccgtcgccgtcgaggtcgataagggtaaagctgactttgccgttttctgaatccgcgctaatcgaggagcgcagaaacgcctgccactcatcatcgctgatatccggggacggtttactggtcgtgatcagcgtatcgtcggcgtaagtgagcgtgaagtcggtaatatggccggttaacggaaactgctcggcgaccttattcagagacaattctggatcgcttttttgcgctttcaacactgcgttatacaacgtgcgcagagccaggttatccgcctctttctgctgcctggggatcacctggctgacaaaggtcggcagcatccaggtgccacccggggtgatttcccgacacataccggtgctgtacttcaggctgggggtaaaggttttaccatcccaaacgcgcgtctcgccggtgacgcagtcggccatgccccgttctttgtgcaaaaagacgatagcgccgtcggcgtagctggaggcctcggtagtgagcagccgcggtttgctcaactgggcgttatcgaccagccacagggcataaccgtcgttatagggcgctcgccagcagagcgcctgcgccagagaatgggttttatccagcgcggtcagcgtgatctggcgatctgccgccggaatggcctgattctgccagtcgtcgcagcgctggttcagcagcggcgtcaggatgggcagcagtttctggcgctgaagcatactcaacggcactggctgcgcgttatggagaaccggggcggcgataatttccggggcgggagtggctggcaaaatggcatcgtcgccggcatcgcctttatccagcagcgcatcggcggtgccggtgcgtcgctgaaacgcatccattttacccagcacctcgcggctgccggcgctggaaagcggcaggtgctggccgttaagggtgaattcgattttgcgctgattcgttaacgcctgtagcagggcggtggtctgatcgctgtcgaggcgaaagtggctctcgtcgagagcgtccagcgcgccaaaatcccggtcgtcgatcagcaggctggcggtggagtcggcggggatatcgtgctcgatttgcgcaaaggttaccgtggcggtgaggtgctgttcgctgcccgcgttgcgggtcaacagcacgctgacctcacccatgcggacgccgtaacccgccgcccggcaggcgccggtattatcgcaggcgagctcccagtctttttgtgcaaaggaaaaaccttgcaggggagccgccagcaggggcgtagagcagaggcccagccaggcagcccagaagaacgcgcgcatatcaatccctgtcagcaatcagtgagggggaaattataggcgcgacgtggcggttaggatatcagaatcaggtcaaggcgccgcccatacggcactgggcgaagcgtagaatatcttcagccagccgccgggcggtatccacatccgtctggctacgtttgaccagcagacggctcagacagccctcgacaatcagctccatctgcttggcgaccatttccgggtcatccacctccagctgagtcagcagctcgtgagtgtaggccagcgaagcctgcttctgctgttccgccagctggtgaatggggtgctgaggatccgggtagaaggtgcaggcggcgataaacaggcagcccgggtaccgctggttgcttacgcaggtggtgagtgcggcatagcgtgccagcagcttttgctctgcgcttaaggtctcgtccagcaggagctgacgacgccaggcatccacctgctggctcagatagcgaagcgcgtcgtacagcagcgcttcgcggtcaggccagaagcgtttcaggtcgctcgtcgggcaggacacgcgctcagcgaccatctccagcgacgtgttggcgataccttcaatttcaagaatcttaatggcttctgccaggacgtcttcacgtagcacggtgttctcctccatctttcctcctaaagtgtcgctcacgcttgccaatcgcgcaaatgggcgctgaatgccgcggcatccataaagccggtgactcgccgctcaggctgttcctgaccctcagcgttgaagaacaggatcgtcggcagacccagcacctgcaggtgtttcagcagcgcgacgtcttgcgggctgttcttcgtcacatcaacctgtaataacacggtgcctttcagcgcctgctgcacgtcaggtgaactaaaggtgtatttttcaaactctttgcaggccacgcaccagtcggcgtaaagatcgagcatcaccggttgacctttcgcctgcgccagcgcctggtcaagctcggccaccgagctgacgcgggtgaaagccaggtgcgcctgctgctcaaccgccggggcgccaaacgcccagtcctgcagaggccgcgcgctgaccagcgcggcggcaagcagaatgatctgtaccagccgcatccacggccgggtagcgcccagagaggtgataaacgcccagctgaagaaggcgacaccgagcattgaccacagccgtaacccccactggtcgccgagtatgcgttccagcaggaagacgggcagggcaaggatcacaaacccgaaggcggttttcacatggctcatccacgggccgcttttcggcaacaggcgattgccaaacacggtcacaaggatcaacggcagacccatgcccagcgcgtaaaggtacagcgtgccgccgcccagccacagattaccgctctgggcgatatacaacagaatggcgcttagcggcgcggtggtgcagggggagcagatcagcccggcaatagcccccatcgcaaagaccccgccgggcgagccgccctggcgcttattgctgagcagcgtcagccgggtctgcagcgacgacggcagctgcagcgtgaacaggccgaacatggagagcgccagcagtataaacaccgccgacaggccgaccaggacatacgggtgctgcagggccgcctggaactgcagcccggcggcggctaccaccagccccagcgcggtataggtcagggccatcccctggacgtaaataaaggccagcagcagggcgcgcgcggtggaaagccgctgttttccgcccagcacgatgcccgaaatcagcgggtacatcggcagcacgcagggggtgaaggcgataccaatacctatcagcagcgcccacagcgccgtaaagggcaggcgggcaggcgtgtctgcaggcggcactgcggcaggcgcaggtgatgtggcgagctccggggccggtcgcggctcaaccggcagcggcgggttgaacgccgggcggctgctcgtcgacggcatgggctcgatggcggttgcctggccgtcgtttgaggccgcctgcacggcgctcagcgggatcactttagtctccggcggataacagaatccggcatcggcgcagccctgccaggtgacggtgagagtagcctctttgtccgcctccttcaccgtcaccggcacggtcaggcgttggcgaaagatctcgcttttgccgtaaaactcatcttcatgccactctcccgccggcagcgccggttcgtcgatcgtcgccccggcggcgctgaaggtaaactgttgacgataaagataataaccatccttgatttgccagctcaggttgacgtcatgctgttgctgctgaaagtcaaaggcgaaagcttgatcagcaggcacgaagttcgagcgccccggcgcgtcgaataacccggcggtggctgatgtgctgcacagcagcaggatcagcgtaatgatgcggtaagccatgagaggtaatcgttgtctccatgcgtgacgggtagaaccagcagttctggggtttgatacgggtggtgtgacttcaggcagtccagcagcgcctgctgatgggcaaggtcagttttgagtagcatctgcacttcatactcctgctcgagtttcccttcccagtaatacagagaggtagcccccggcagcagcgtggcgcaggctgccaccttttccgccagcgcttttgccgccagatcctgggcggtcgcttcgtccggcgcggtacagagcacaacaacagcatcaggcgtagtcatcatgaacctcgtatcagcgaaaagaggcactataacacgcaagatgcggggatattagcgtaacgagcggggaaagtgagggcaacggaaggcgggcccgtagtgggcccgccgccagcggtatttacagcataatcccgccaaagataaagccgaggatcacgcacagcgtgatagcgataacgccggggatcaggaaggcgtggttaaagacatatttaccaatgcgggttgagccggtgtcgtccatctctaccgccgccagcagggttgggtaggtcggcagaacgaacagcgccgagaccgcggcaaacgaggcgatagccgtcagcgggctgacgcccagcagcagcgcggcaggcatcaacgccttggtggtggctgcctgcgagtagagcagcgtggcggcgaaaaacagtaccaccgccagcagccatgggtaattatgcagcagatcgccggccacggcctggatgtcgctgatatgcgctttaacgaaggtatctcccagccaggcgacgccgaggacgcagacgcaggcgctcatcccggacttaaaggtgctggcgttgagcacttcgccggtgtcgattttacaggtgatgctaatcagggtggcgatggtcagcataaataccacgatcgcctcgttacgcggcagcaccgggttcttaatcaggccgacggtatcgctgatggccgtggcgtagaacattaccgccacgatgccgatcaaaaacagcagaacggaacgtttggcgtgcggctgcagctcaaatacctggctgccgcgcagtctgacttcccccttggccagccgctcctggtaaaccggatcgtctttcagttcgcagccgaggaagttgcagacgatagcggtgagcatcaccgccagcagcgtgaccggaatacagatggccagcagcgtcaggtagctaacgcccagcggctcaaggatcccggcaaagaacaccaccgccgcggagataggcgaggcggtgatcgctatctgagaggccacgaccgcaatcgacaggggacgagaggggcgaatgccttgctctttggcaacttcggtgatcaccggcagcgtggagaaggcggtatggccggtgccagcgagcacggtcataaaccaggtcaccagcggggcaaggaaggtaatgtacttcgggtggcggcgcagcatccgttcggcgaggctaaccaggtaatccatcccgccggcgacctgcatggcggcgatagcggcaatcaccgccataatgatttcaataacgtcgaaggggatcgcacccggtttaatttgaaaaataagcgtcaggacaaggacgccaaggccaccggcaaagccgataccgatgccgccgagccgggcgccgagataaatcgccagcaggacaataaccagttctgcaccaaacatatatgccttccttgttttttaacaagttgatattgaattgttgtattttagtaaaaccaaaaagcaaaaaaggcatgtcatcgctgacatgcctttgaatgactaacctgaaagattactgttcgctttcatcggtataacgctttgctttataagcgggatgcatcaggttttgcgcagagaaaatatcatccaactccgccgccgtcagcagtccgcgctccagcaccacttcccgtacgctcttgccggtttcggcacagatcttgccgacgatatcgccattgtggtggccgataaacgggttgaggtaggtgacgatgccgatggagttgtagacgtagccttcacataccgctttattggcggtgatgccgttaacgcatttctccagcaggttgtagcaggcgttggtcaggatatgaatcgactcgaacatcgcctggccgattaccggctccatcacgttcaactgcagctgaccggcttcggaggccatggtcacagtggtatcgttgccgataactttgaagcagacctggttgaccacctccggcaccaccgggttaaccttcgccggcatgattgaagagccagcctgcagctcaggcaggttgatttcgttgaggcccgcgcgcggaccggaagagagcaggcgcaggtcgttacagatcttggacagtttcaccgccaggcgtttcagcgagctgtgaaccataacgtacgccccgcagtccgaagtggcttcaatcagatcttccgccgggacgaccggtaagttgcttacttcagccagcttctgcaccgccagctgttgatagccgtccggggtgttgaggcgagtaccaatggcggtggcgccgaggttcacctccagcagcagctccgcagtgcgcagaatgcttttggtctcttcattaagcagcacattgaaggcatggaactcctggccgagggtcatcggcaccgcgtcctgcagctgggtgcggcccattttgaggatgtcctggaactccacggctttcgcctggaagccttcgcccagctgtttaatcgcatcaattaacttaaggatggaggcatacaccgcaatgcggaacccggtggggtaagcatcgttggtggactggcatttgttgacgtgatcgtttgggttcaggtactggtattcgcctttctggtggcccatcagctcaaggccaatgttcgccaggacttcgttggtgttcatgtttacggaggtaccggccccgccctggaagacatcgaccgggaactggtccatgcatttgccgttattcaggacttcgtcacaggcggcgataatcgcatttgccgcgcttttgggaatggtctgcagctccttgttcgccagcgcggcggctttcttaaccatgaccatgccgcgcacgaattctggtatgtcgctgattttgctgttgctaatgtagaagttttcaatcgctcgcagagtatgaacgccgtagtaagcgtccgcgggaacttccctggtgcccaacagatcttcttcgatacgaatgttgtttaacatgtgaaccttcttttcaagctgccaatgaattcaccaaacacacagaatatccagtattcagtatattttctggccgacgattatttccttaaccggcccggtgcccaagatcatatgctgatgatagcgaatatcagtaagcttgatcacttattacattgcgggtatgagaagatttattaatctgtgaaatgggtcaccgctttcttattcctgagaaaaataagcctttccgctgattgaaaagccgctcagcatccccatgttagtgggatgcgatcagcaaattgatgattacgggcgctgaacgcagcgcccgttgatgaaggagacgccggtgcgttggattccgtttattgccttttttctttacgtttacattgagatatcgatctttatccaggttgcgcacgtgctgggcgtctttatgaccctgatcctggtgatctttagctcggtggtagggatgtcgctggtgcgtaaccagggcttcaaaaacttcctgctgatgcagcagaagatggccgcgggcgagagcccggcggcggagatgatcaagagcgtatcgctgattatcgctggtctgctgctgttgctcccggggttctttaccgacttcctcggcctgctgctattgctgccgccggtgcaaaagcatttgacgatgaagctgatgccgcacctgcgcttcagccggatgccgggcggcggctttagcgccggaactggcggcggagagaccttcgaaggggaattccagcgcaaagatgagcagcgcgaccgtctggaccataaggacgatcgccgcgattaacatcccccggcccggtcagcagatgcgaccgggccgctttctttgcaggcctacacgcttcccgtcgccagcttgcgcctgggtaaaaacagccacagccccgccagcatcaccagcgcgtacaggcttttccagccgaccatcgccagcagcagcagacagagaatgctgcccaccactgccaatagccgatagcgaccgcgaagcaaacgacaacccgccagcatgcacagcagatagatcatgatgaaaatgccattggcgtaaacgatcagcgcgtccagattgatatcgagcagatagatgccaagggtgctaactacgcaggatcccagcacggcgttgagggcgttgcgcgggatctgccgtggcgacagccttgcgaggtagctgtgtggcttatgctgcgcttgcgaccagaccaggcgggcgaagctttgaatatagatgttgaggctggcgaaacaggcgagatagccgatgacgcaggctacccacagcgcttcgacgccgaacagacggaccacgatattcggtaatgacgccgccgccgccatctcctcgccaaaggcgtggaagtgcagcaccagcacggtgcaggcccagtagaccgagccggcaagcagcaggcctatcatcagcgccctggggaaatcacgctcgggatgtttaaactccgaggcgagatgcgcgaaggcttccagaccgacaaagcaccagaacatcaccgacagcgccaaaaagagctgcccgcggtcaatctccgccggggccgggaaggggatctgcgccgggcttatcccgccgcgccaccagactacgacgatcagcgccacaatcagtacggcaaccaacgtctgcaggttggcgctggagctggcgccacgcgaaccgacccaccagacgatggccagggtgcccagctccgccagcagcagctgcgcatcatgccagccgaacagcgcctggccaaaaccggtggcgatgtgcagggcggcggggagtccgaccgggataaccgataaaaacagccagccggtgacgctggccagacgtggcccaaaggccatatcgacaaagtgggccacgccgcccgcgctgggaaaatggcggccgagcagggcgaagacgatggcaatcgggaaaacaaggagaatgagcagcggccatgcccacaggctgttatcgccagcgaccagcgccgggacggcgaagacgccggtacccagcaatgaggtggaaagcaacccaactccctgtcccagccctaactcctgttttaaaccactcatgattcaatcctgcgccagtgaaaaaaaagagagtatcacaatcgcttttccttatgaccgattgcctgacatggccgctttttgtgcgccagcgcaaaggtaaaaattttttttaattttgcccttgaagccgtaaatggccatccccatctctctctgcactagccggtaaaccgcgttcggcccggcgtcacccataactgataatgactttctcgaaggagagctatcaatgagtattcgtccgttacatgatcgtgtgatcgtcaaacgtaaagaagttgaaaccaaatctgcgggcggcatcgttctgaccggttctgcagcagctaagtcaactcgtggcgaaatcatcgctgtcggtaaaggccgcatcctggaaaacgggaccgtgcagccgctggacgttaaagttggtgacatcgtgattttcaacgatggctacggcgtgaagactgaaaagatcgacaacgaagaagtactgatcatgtccgaaagcgacatcctggcaattgttgaagcttaattcgcacgaccctgaacgaatttgaggaataaaagaaatggcagcaaaagacgtaaaattcggtaacgacgctcgtgtaaaaatgctgcgcggcgtaaacgtactggcagatgcagttaaagtgaccctgggcccgaaaggccgtaacgtggttctggacaaatccttcggcgcgccgaccatcaccaaagatggtgtttccgttgcacgtgaaatcgaactggaagacaagttcgaaaacatgggcgcgcagatggtgaaagaagttgcctctaaagcgaacgacgcggcaggcgacggtaccaccaccgcaaccgtactggctcaggctatcgtgaacgaaggcctgaaagctgttgctgcaggcatgaacccgatggatctgaaacgcggtatcgacaaagcggtactggctgcagtagaagagctgaaagcgctgtccgttccgtgctctgactccaaagctatcgctcaggtaggtaccatctccgctaactccgacgaaaccgtcggtaaactgatcgcggaagcgatggataaagttggtaaagaaggcgtgatcaccgttgaagacggtaccggtctggaagacgaactggacgtagttgaaggtatgcagttcgaccgcggctacctgtctccgtacttcatcaacaagccggacaccggtgccgttgagctggaaagcccgttcatcctgctggctgacaaaaaaatctccaatatccgcgaaatgctgccggttctggaagccgtagcgaaagctggcaaaccgctggtcatcatcgctgaagacgttgaaggcgaagcgctggcgaccctggtggttaacaccatgcgcggcatcgttaaagtggctgcggtgaaagcaccgggcttcggcgaccgtcgtaaagctatgctgcaggacatcgctactctgactggcggtaccgttatctctgaagagatcggtatggagctggaaaaagcgactctggaagacctgggccaggcgaaacgcgtggttatcaacaaagacaccaccaccatcatcgatggcgttggcgaagaatccgcaatccagggccgcgtagctcagatccgtaagcagatcgaagaagcgacctccgactacgatcgtgaaaaactgcaggaacgtgtcgctaaactggctggcggcgtagcagtaatcaaagtcggtgcggctaccgaagttgaaatgaaagagaaaaaagcacgcgtcgacgacgccctgcacgcaacccgtgctgcggttgaagaaggcgtggtggctggcggcggcgtagcgctggttcgcgttgcggcgaaactcgctggcctgaccggtcagaacgaagatcagaacgtcggtatcaaagttgcgctgcgcgcaatggaagcgccgctgcgtcagatcgtttccaacgccggtgaagagccgtctgttgtggcaaacaacgtgaaagcaggcgacggtaactacggctacaacgcagcaactgaagaatacggcaacatgatcgacttcggtatcctggacccaaccaaagtcacccgttctgcactgcagtacgcggcttccgtggctggcctgatgattaccaccgagtgcatggtgaccgacctgccgaaaggcgacgcgcctgacttaggtgctgctggcggcatgggcggcatgggcggtatgggcggcatgatgtaatcgtgcgctctacggcataaaaaagcagaaacccctggccagcaatggctgggggtttttcttttggcgcgctttttagtataaggcttatacataaaaatcatttaagctgcatcagagcggcaagcacctccgtttcggtagcgacctggtaagcgcagccggggagggaatgaacgcggctcatgccgacgcagtttgaaggatgacagatttacatccgggccagtgcgtccagctcatcgatcatggggaataacatgcaggtaaaatatttagcagggattgtcggcgcagccttactgttggcaggttgcagttccagcaatgaattaacctctgccggccagaatgtgcgtttcgtgcaggagaagccgggcgcagaatgtcagctgttagggaccgcgacgggtaaacagagcaactggctctccggccagaatggcgatgagggcggttccatgcgcggtgcggcgaacgccttgcgtaaccaggcagcagcaatgggtggcaacgtgatttacggcgtcagcagcccgacacaaaacctgttgtcgagctttgtacctaccgacagcgaaatgaacggccaggtttataagtgcccgaactgatgcgtgacgcctctctctgcgagcgcagagagaggcgtggtcgttagatgaggatcaggcgttaagctccgctttcttctccagatagaaggcgtgcagaggacgcaggcactcttccagactgagcattcttcccggctgggaagggatgacagtactgaagatctggcatggcgccagctccgcgtgcatcgccttgagcttggggcttttctcgataatccgcgtcacaacgttattttccagttctgataaatgcggcgcgctggttttgaccaccgctccggagacaattttcttgccttcgtctgtctcgcagcagtacagcacgcccagataatgggaaaacaggtttagcttccagtcttcctggggatactgctggtaatcgatattgggctgagtggttaagtcgacggtatagcacattaaaaaatccatatttgaacttaaatactgaaccagttcctggtcgccgactgtttttaatgcttgttgaataccgataattaatgcttcgatttgcagatcgtcaatacataaagtactaatttgttcatcctgaaatacaagaattaacgttgactgtgtttcgccaggtttgagcgtaatggacatgattcgccgctcaggggatggttgctgtatttcagccatctcaacctgagggatattggcaacaactgcctcattataggtgataagctcatctttataggcctctccttggttttcaagccgctgaaaaatcacagccattctgctctgcagtatcaggagcagatcggctagcaccggtgcctgaagatagtaaatttcgcaaaagccattttccttcttaacttttagcagcaacgctaaaaatcgctcttcaaaggtaattccggcggtattaaaacctataaacgttccttgcatattcatatcctttattaagcagtagtcaccggcttcgattgtgcgagatcgataacacgatcggcggatgcaatggtcgatggtcgatgcgcgacgataatccgggtaatacttagcgctgaaatagactgattgataaccgactcatttctgaggtcaagatggctggtagcctcatccataaataaaatactcggtttgcgatacagtgcacgggcgatcaggatacgctgcttttgcccacctgaaatacccagcccaagttcgccgacaatggtttcgtatcccatagccatcttcataatttcatcatgaatgttgcaccgtctggcacactccatcacaaaatcaagatcggcgctatcatcgaagccacttatattatcaataagggagccggaaaagagacggtcttcctggagtacgcaggcgataccaagacgatagttattcaaaccaatctttttaatctccagattatccgccagtatttcgccggaatccggcgagagcagtccgcacataacttttaatagtgtggttttccctacgccagatgggccaattaacgcaactgattctccaggagcaacggttatgttcaaatttgtaaagatgggttgtgaaaaaggatcgtattgataactaagatttctcacttcaagttttacgccagtgttttccgtaaaaacacgccgcgatggaagttctttttctggttcactaaatgctatttctgatagacgttcgttgtgcagtgagagcatacgaagctgcatcaccaaatcaatgagattcgatgcacgttgagaaaactgaccccgataggcgttaaatgccataaacataccgagcgtcatctcattatcaattaccataatggcacccaaccacagtaccactacctgatcgattgaggtgataaaggtattaatgccaccaaacatcatatcgaatcgagtttgctttatacctgcattgctggcgtcaacgttaagattcagccaatgctgtgagcgacgttcttttaaattcagtgctttgatcgtagaaatgccataaagtgactccataaagtgggagttagcacgtgcgcctttgacgacctgttcttccgttacgcgacgataaaagctataggtagcaaagcgcataatcgcatagcaaatggtaaagccgatgacgacccagactaaccaaccaccatataaggtcagcatcaccaataaaccgattgtcattatcgagtcgatgatgccggtaacgatactattggtaaatattgagcgaatcgtatccaaagacgagaagcgagactgaatatcacctaaatgccttttctcaaaaaaggataatggcaaacttgtcagatgatcgaataacgtcgttttccattgaatatttgtcagggtatttaacgttaacgacgtccatgcacgtagcatgctaataaacgtgcggaatagggtaaaaaatatcaacccgatacagataacagacagtaagctttggtcgtgagccataatcacatggtcagtgactagctgtgtaccaatcggtaacaggagtccgatagcttctaccactacagagtaagcaaagatcttaatcagtgctgattttaaaccaacaattttatgcattaaatccagcaatcgtaatcgggattttgcttcttcttgctggaagttatgatcgggccaaagttcaagcgctacaccggtaaaattgtttgacatctcattgatgccaatgattcttttacccaacgccggatcgtgaataacaaatgcgtttttccttacctttgtaagaacaacgtagtggttcatcccccagtggatgatgcaggggagtttaagctgctttatttcatcaaggtcaagagctaacgctcggctttttaagccggcatgctctgcagttttgcttagagacattagtgaggagccctgggaggggctaccaaaccgctgacggaaattaaacagatcgatattcaacccataaaaaccacagaccattgccagacaggcaattccacattctgatgattctgactgaagaataacgggcgttttgttaacaagagaaaaatttaactttgcaacaacagttttgaaaagttcgttagtcatggatcggcccagtaatgctttgagttatcttatacacaggggtaaacatccacatatagagcggacgctcttccaggaatacaacagcttgagccttgaggccatttgaaagcgaaagcgttttaccattatattcaaaggttttgttttcaattttcacaatggtcttatagagcgccagttcctgctggtttgtgccgttcgtaacattggtatactcagacatttcttgtcgagatgtgggaacagaagatattgaaagtatttttcccgggaattgaccaaatttatctgatgggaatgcagcataacgaatgttaatttcatccccaggttttacataaggtatactattgttaggtaaccataaaataagataatactctatatcaccggtaggttttatctgtgctagactgctgcctttatcaaccatttggcctttagtgacggtcaatgattcaatacggccttcagtcgttgctttaataataatgttaccgtttgcgtttgattcaaccagttgatttttataatcattaatctggttttcttgtgacgagatttgattgtcaaaatcagctatttttgtaattttatcactattgagctgagtgacctgcgattccagttgcattttctgactcaccagagactggtaagtgctttgttgttgaaaatacaaagagtgttgatagttatattggtctttggtaatcagtccgtcacttaaatacttatcatagctggatagattatcatgcattttctttaatccagcctgggcgttagccaacatgcgattagtttcttttaacgaatcattgattgtttttaactgcttctctaaagaaatggttgtttcttttttattatgattcagttttgaaatgatatcttcagcatttgcgatcttttcattaatgacctctatttgtaccgcactaacattacccgttgtggtgttccgggaaatgtcgatctcatataacggctggcctttggtcacaatatcgccgacttttacatattgggagataacaaagccttgctgcggggcataaacgttgacagagtgaggtagagtaatgacctctccctgaacgtcgattctctgggtaaaggagcaaaatactgtggtggctatcaggatcgcaagaaaagcaaaagagagtaatgcaacaagccatgctggaagccctgcgagcagcagtgcctttcctttccagtgatgctttttatactcaatcgcttccttgcgatagattttttttaacatagttatcgcttaaattataaaatgaaaaggcccgatacgtcaggccttaattactaatgaatgcttgtcaacaaactgttgagctaatcattggcgcgtaaacttagttgctccagaagttcagggtgccgtcataaatagcatccattacgcccagagcataatccagagtcatatcccagccaacgatacccgctgcaataccaaagcaaacgccaccgagaataaccccggcgatcatccctacaccctggccgattgagccgataccgaagataccgccacttacgccaccccaacgtccggcgtacgctgtaccaaaaatagcgcccagagaggcgcccagtgcgatagcgccaacttcttttgcggcccaggtgacgatatcggtaagagtatcggtcagcgcaccgccagaaatttcttccatttcaaatacagttaattggtgcatgattagtcctttaactaaaattaaaattatatattcattccagaccagaatttggtccgcagaaaagatagtcgttgctgtagtatgaatcaactcaactaaatatgaattgttgatgaaattagaggttaatagtgaatcaaatctaaactatttataggttcataaaacagtaactaattcagcaggtggtggcacgcagctattatcgatgtgctgcagatatattgatttattcttgcattcatatatgacatttttttggttgttgacataaaaataaaaaaaaggtggatatcattatccaccttttgtaggggtatggaggttatacttttactcttcctgtatgacaacttcaagcatagcttttacatgaccggaagagacttcagcgctattgtcactcatgcgataatagtcggcggtgaaggtaaagttttgtgatgcctgtgccttggcgaagctataagtttcggcgtcgtaaaatattataggcttgttgtcaattttgaagataacgccaacgttatttgcggcttcggttccagttatcatgttatcgatgatcccatccccggcagaactggtgccattaacagggttaaaccagtagtaaagcttgttgccaactgaaccttgtgggcaagtcacatccattttgatagttttttgtgatggagttgtacctcctcgagaaatggacattaatgtgtttttttcaattttattcagggtgatttggctaggccctgatactgaaatatcgcaagaggtatctttatatgaaatagtcttgaacttcagggttgctgttaacaaaaggcggtcagctgcccttgggttggtgcttaagttacctgctgagaatttaaataccgggtttgtactggtgccggatgtatcgatgacctgctttgttttaattaaccataccgtcataaatttataatcttcattcgattctaaaataggtacgattgtagattgagcaacagcaggattaatagaaccatttttgctgctcagaagatctgaaaactgaaagccaattccatctatgccggtttcatagactggtttgccccttatacccgtgacgccggtaacttccggtgctgttgattcaacaatatactggtctcccattattttgctgcactcaaatgttttataatgtccggtaccgacttttttagtatagaggactgtacccaccggaattgttgggtctgttgcgattttaggacttatgttaaacattgcttgtccagcggaaccataataatcgcatttggcaattacctcgctacaacagcatagtagggataaaaaaagaagtatttttctcattctttattgttccttggtcaatattagcgacaaaccgtttcgatttgactgatgccagacgctttgccttccctggctggtaaagtaaatgaagcgttacattgctgcgctgcgcttttgccccactggacgttaaggatcccggtctcttgcaggccggacatatagaccatcccggcgtcgctgacgatacttggctgcgatttactatctccggcgagcagaaccattgcgccataaggcacgtcctggccgctggcggttttcagatgcacaaaggcccgctggccgatattgccgtcataattagcacgcacgatagcgccacgcgtcggaacaacgctcttcgtggtttctggcagctccatatcttcaccaagcgtggtgctgtccagcgtgatatcggtacgacgataaggtgtaacgtacgggacgatagcgtaaccgcgatagtcggtggagatggtgttatcgttggtcaacttgacgttatccaggcccggcgctttaaccagcacggcggcgtcagtgatgtcctggccaagtgtaatgccatcggcatgagcgacgatgctgccgttggcgccgtagtcaatacgttggctgttattgtcatagctatagccggcattaaggctgccgcgggcaccgttataggtcccacgcatatcaccgctgtaatattcccggttgctgtacccttgctgcaggctccattccaggctgtcgttatctagcccgacgccaccaatggagaccgactgatcggtagaccctgggttgctgttggttaactgatagctggtataggtacccggcagccagttgctcagtggcagcgttacggtcagagtgatgcgctgatcgtcctgggcgtctttaccggagctatctccgctccaggtgtaacggttatagctgtagcccagatagtagttcacattgcggaagccgccgttgtaccccacgctgatcgacttgttggtgcgcttatcgtcccaataatcttcgattaacccgctaacggacagactacccaaacctttacctaagctttggttaaccgtcaggttggtacggttgcgcagcgaacgcggactatagttgccgtcattagagtagctatccagcacctcggagagggtattaaacccgcgggtagagtagcggtagcccgcgatggtgacgttggtgccggtttcgacgatgtttttcccgtaacgtacgcgccaggactgcccggaggtcttttcatcgtctttcttttttgaccacgcctgggtgacgtctgccgaggcggcgcctagctcgccgaggttatagccgagacccgtcgatagcgcctggtagcgcgaggccgcctgcatgccgccatatactgtcaggctgctggagacgccgtaggtcgcggtagcctgagtaaatggcgtttcatcgactccaccatcgtaaggacgatatttaccggaagtaatctcatactccagttgattttcacgcaccatgaccggcagggtggcgaacggcacaacaaattcttgtttggatccgtcggactcttccacgctgacgtaaaggtcgccgctaccgccgcttgggtacatatcggtgatttcaaatgccccgggcgccacataggtctggtagacctgataaccgttctgtttaatcgttacgcgggcgttggttttagcgataccacgaataatcggcgcatagccgcgcatactttccggcagcatcgacgtatcggtcgccagttgtatcccggtaaacggcacgctgtcgaagatggtcgagagcgatgaactctcgcccattaccaggttactgttgatcgggcgaatgctgcgctgcatatagagataggcggaatcccagtctccggcaccgctattgtttttattccaggtgctgaggttacggatacgccatgggccaacgttgaggccggactgcaggttcaaactgtagtattcatcattggcctgcatgtcgttcgagccgctgaactgataattcaccagtaaagcgttaatgccgtcatcaaactgatccggtggaatatacccttgcgcggtggtggataaggccgcctgcggaatagaaatatttaaacgttgggcggtgaagtcaaaatccgctttggtatccgggatgacagtaaggttagtgcaaccatttttatcctcgaccagttcaggaaacgctttaacgcgtacaccatactccgctaacgtttttagactcaggcaaggagtgagcgcgggctcgcggttatcgacggtagcacgactattggcgacaaacttcatcgtccgggtatccaggtagcgaccgttaaacatgatatcgacccgataatctcctggcgcctgtgcattctgggtttgaaaaatggataagtcaggagtggttgatggatcgctaccattcaatgaactaatgaatgagggatcgaaaaagtcacgtgcttgcgctttattattcaaaccagaaagcaatgcaggaagcattgcgataaagacggtggatagtttgaataatccattattcttatttggcatagacacatccctataatgataaaataaatttcttattacagcgatgaggagtagagcgacccagctccgccataatcattgaccactttccaggtaatgctggaagcattaatattttcttttaacaccacttctttggtcgtcattggggcgaccgagttgacttccggcttcacttctttgccgccaatctggatgctattgaaataatagaaaaagggcgttggatttttgatcgttagctttgtgccagatttgcgccattcaagctttttcgcttcggtattaggggagaggtcgaaaagtgctttagggcgatagaccagacgcatgcggtggcggaccgccagttgaatggtgttgttattcgctttggcgtcatctgccggagggatcgccatcacgttaaaatagtacatggattcccggtcggtcggcgcattaacgtttccgttagaaaaaagacgaaccgtattctgttgtttcccttcaaggcggaacagcggcggagtggccataaaagagggcgctttccctgccggagcttcaacccaggatttaatgagatagggaatatcatctttattttcgatttgggcggtaatttcacgcgcaccttctttatacagatagcgggtagattcaattacaataccggcatgggcaatactgctgaggagtaatgcgcaggatgcggtgagatttattaaggtcctgaacatggcttttctctgaatgcaaaaagggcccgccgtaaagcgggaccctttggggaaaaattaaacggtgtaatcgatagtaaaggttgcaacccctttaaccggaccttcggttactgtggtcgcagcgttggttcttacataaccagtggtgtacttcagctgagtaccgttggctgcagagtagctttcggtcatggtgtcagaaccgtcgaaggctacgcgatgggaatcgctgacgcgctggataccaataccgatacccgctgcaccgttagcagcggtgttgtccagaatggtattgtcgctggaggtggtgccggaaacgagaactttcaggcctgtaaccgggctagagctgccctgtgcacagtctttcacgtcaaaaccgaagtcctgagttttgaacagtttaccagcggcttcagcatttgcttcagtggtggttacagtgatcagctgaacgataccgttgttcagggtaccagtcggggtcacgacgcaagagttagctgcatcagagacttcacccagtacagttacctgagcggtgttggttgccattgcctgagcactcagcactgcagatgcagcgaccattacagctacgattgtctttttcatttaattaatccatatatagatacttagtcctgtgtagaatcgataacagttatcaagggaatggagtatgcattcgcattgatattgaaaataagcgtcagctttcctttatatagtgctgagaccaatcatcctgttgaacgacgctaccatatcgcttgccatagcgaaccatggagaagcgggagtaatttaaaagtctggtgcaaaaaatgcttgtgaattattgatgaagcacccgtgaatttaatgctgccccccatctctgatgagatgtggattccagttgagattaatttaatctgaaaatgtgaccattaagcaagttagctatcgcttgtttttttatctgcggtatcctgtgggctgaacttcaatgtgaaatgtacctgtttccatctgaaacaagaatgttcacataatcgtttggttgaaatcatttgattttattatggataatagggttacgtggggcaaggatatggatgacgcagtattatttaatgggtgtataattaatcaggagattatatttaatgccaatatgaatgagctgcggccgcttgccggggacggggagtgcatcagcctcaatgcgccaaccgccagatgcttgctgctgcttttgcagaattgcggcaaagtcatttcgcgggatgagttcctggcggctgtatgggaaacacggggggtggtcgtttcgcaaaatacgttctatcaaaatatctctttgctgcgaaaatcgctggtaaaagctgggctatctgaggatatcattatcaccgtccggcaaaaaggctttagcgtcgctccgaatacattggtcattcctctctctgatgaagagtgcgataatatgaatcgggtgacattaacgcattatcagaataataaagttgtcgactttatttctgaagaaaaggaaaagcctgacactcatttaaatcttccactaatagaaaactcatcaaagcatggcagtgatttgatggcaaataaaccggaagaaggtgaaaaagcatctgagcggttgcatgttacttttaaaatacccgtatggttaatcgcgctaattgtcgtgatgattgtaattaatattattgtgttggtcgtgctaaaccggtagctcgtcacagccaggggttatagcgcggtgcgatagtcatttgctggtcaccttaacacccgtctgtcgaaatcttcctatccgaaggtctgccagaacgtcctggcagaccttcagtttattaacgctgcttcagccctaaatccagcggcgtcttgctgggttccccgccaatctcgcgcgccagcttcggcaccatatagccagagatgagggtcaatagttcgcgcatgatttcacgggcttcatcatcgctgaccatgaagtgcgccgctccctgcacccgatccagcacgtgcaggtagtagggcattaccccggcgtcgaacagcgcattactgaggtcggccagggtttgcgcgttgtcgttcaccccgcgcagcagcacgctctggttgagcaacgtgacgcccgcctgacgcagcatggccatcgccgcgcgaaactcaccgtcaatttcattcgcgtggttgacgtggttaaccaggattacctgcagcgacgaacgctggaggcgactggccagcgtctcggtgatgcgcgccgggatcacaatcggcaggcggctgtgaatacgcaggcgcttaacgtgcggaatagcttccagctgggtcattagccagtcaagctcatgatccttcgccatcagggggtcgccgccggagaagatgatttcatcaagctgcggatgcgccgcgatgtagtccatcgccgtctgccagttgcgcctggtgccctgattttcggcataagggaagtggcggcggaaacaataacggcaattgactgcacaaccgcctttcaccagcagcagggcccggttgcgatatttgtgcaacagaccgggcaccacgctgtgctgttcttccagcggatcggtggagtagccgggggcgacgataaattcttcctcagcggtaagtacctgacgaagcagtggatcgttagggttgcctttctccatgcgggcgataaacgcgcgcgggacgcgcagcgggaacaggcgtctggcctcgcgtccggccagcagtttttcatcagcgtctacatttaaaagacgcagcagttcatcaggactggtcacaacattggcaagttgcgttatccaatcttctctggatggggtatttagggttacaatatgcgccattttgtggcttagctaccagttaaacaatttcagagggccttatggcgacttactatagcaacgattttcgtgctggtcttaaaatcatgttagatggcgaaccttatgcggtagaagccagcgaattcgttaaaccaggtaaaggccaggcgtttgcgcgcgttaagctgcgccgtctgctgaccggtacccgcgttgagaaaaccttcaaatctaccgattccgcagaaggcgcggacgttgtcgatatgaacctgacttacctgtacaacgacggtgagttctggcacttcatgaacaacgaaaccttcgagcagctgtctgctgacgcgaaagcgatcggtgacaacgctaaatggctgctggatcaggctgagtgcatcgtgaccctgtggaacggccagccgatcgcggtcaccccgccgaacttcgttgagctggaaatcattgaaaccgatccaggcctgaaaggcgacaccgcgggtaccggcggtaaaccggcgaccctgtctactggcgcggtggttaaagttccgctgttcgttcagatcggcgaagtgatcaaagtggatactcgctctggcgaatatgtatcccgcgtgaagtaatttcgcgtcatgatgaccggcgtagcctccgtgctgcgccgctcttttcgtacaggcacaacgagcacgatacatgaagcgcagcgttaaactcctggtgttactctttctgagcagcgcgctgttggctggctgcaataccgcccgcggtgtgggtgaagatattcagggcctgggccacgctatctctcacgctgtgagctgaatttccctgccgtttcgttaatggcgcttgcctcccggtatgtcagcctcctccacgcatactccttttctcttaaaaatcgcaaagatcccttcatctttggacggtttgtctatgcttatagggcatgaaaacaaaactgacactaaggatgacattatggtgaaaaaaacgattgcagcgttctttacggttttggtcctctcttcagcactgaccgcttgtaacaccacgcgcggtgtcggtgaggatatttcagacggcggcaacgcaatctctggcgcggcaaccaaagctcagcaataaacgccgtcaacggtacggtttagcgccgtaccgttcttcacttctctcattccgttggatatactcaccacgacttttcatccaccttacgggacgacccgtaagcgtttctcatccggggacggccccagcaaaggagccttatgtcctggatagtcttgtttatcgctggcctgctggaagtggtgtgggccgtcggcctgaaatatacccatggctttagccgcctggttcccagcgttatcaccatcgtggcgatggtggccagcatggcgctgctctcatgggcgatgaaaaccctaccggtaggtaccgcctacgccgtctggaccgggatcggcgccgtgggcgccgccgtgaccggtattgtgctgttaggggaatccgccagcgccatgcgtatcgccagccttgtctgtatcgtgattggcatcattggcctgaagatcagcgcgcactaatcatagcgctgattgacccagaccagtttgccgacatcaaagccctgtcgggtggcaatgtccagcatctgctgcctgacctccggggcgatggtcggcgcccgggccagcagccagagatagtcgcgatcggggccgcagaccagcgcgtaacgatactccttatccagagcaatgacgttatagctgccgtagaaagggccgaagaaggaaatcttcagcgcggcgcggctgggctccccggtaaagtacgctaccccgtccgttttctgccacataccacggtcggggttatagcctttattgaccacgtccaggccaccgtcatcgcgtgggtgccaggcgatcgtgaccttttccagcccgctttcaaaagggtggtcaaagcgggcgatttcataccaggtacccagatagcgctgaacgtcgaagggactgaccacggtgacgcccggcggcggggcgggcgtgctgcaggcgacagacaggaacgagacggcaatcgcggtgattatcggcaggatacgcatggcatgctccttgctggcttttaagctaagtgtagagtccagcagggaaaaggcggcaagatttttctatgaagcgagcccggtagcagaaatgcgaccgggctcttgcaggatcagataaacagtacgccaacgagggtgatgacgctgaggattgccgccaggccgtagaagacccatttaccgttgggcacatggattttcagatcgtgcatggcgtggtgaatacgatgcaacccacaccacagcggcaggacaatcatcagaaagatgaatgcgcggccgataaagctttgggcaaaggccagcacacgctcatagctaaaggcgtcggccggggcgagccccagcggcagcaggatgccgaccagcagcaccatcaccggcgcgacgatcgcgccccacatgccgcctgcgccaaacagcccccagaatacgggttcatcggaacgtttcggattgggattaatcatctcagcctccttaccagaacagggcgacaaacaggatcaccacggtgaccaccgccgtcaccatccagagccctttaatgaccggctctggccccattttttcgcctttgatgatgacgttggcggctttcggcgccagctcaaaccaggttttggtgtgcagcagcgccgccgccagagtaatcaggttgaggatcaccaccaccgggttttgcaggaatccgatatatcccgcccagctctcggcgccgtgcttgagggcaaacagcccataaatcagcacaatgctaaaccataccgtcggtaccgccgtgccttcccgtaccatgtagaagcgataaaacggcagctttttccaccaggtggaggtcattggtcgcacgtagggtttgcgtttcgtcgtcataatgcactccttagcgtggtttcagggtggcgataagaaagtctttcgagctttccaccttgccctgctggatcgcggccgccgggtcgacgtgcttcggacacacttccgagcagtagccaacgaaagtacaggtccagacgccattctggccgttaagctgcgccatgcgttcctttttaccgtggtcgcggctgtcttcgttatagcggtgggcgagggtgatcgccgccgggccgataaattccgggttcaggccgaactgtggacaggcggcatagcacagcccgcagttgatgcagccggaaaactgatggtatttcgccatctgggccggggtctgcttgtttggcccctggtcaggcgtgcggttattgccgatgatatacggcttaatggcttccaggctttcgataaagtgggtcatgtccaccaccagatcgcgctcgatcgggaagttggccaatgcctccaccttgatgcctttggtgtaatcgcgcaggaaggttttgcaggccagcttcggcaccttgttgaccatcatgccgcaggaaccgcagattgccattcggcaggaccagcggtagctcaggtctggcgccaggttgtctttgatgtagcccagcgcgtccagcagcgaggtctgttcatcgtaaggcacgtcatagaacgcgctgtgcggtgcggtgtcgacctccggattgtagcgcaccacttcgactttcaggtttttcatctcagccatgggtggtctccttcttctcagccgcgtccgcttctgcgccatagacacgttttgccggcggcagcgtggtgatcttcacatcgccatattccagacgggtagtgccatcggcctcgcggaaggcgagagtgtgcttgaggaagttgacgtcgtcgcgttcggtacagccttcatccagacgctggtgcgccccgcgcgattctttacgggcgatggccgagtgcgccatacattcggcaacgtttaaaccgtgccccagctcaatggtgtaaagcagatcggtattgaacacgctggaattatcggtaatgcgcacgcgcttaaagcgctcctgcagttcagccagcttgtcgatcgttttctgcatcagctccggcgtgcggtagatgccgcagccttcctccatcgacagccccatttcatcgcgaattttcgcccagttttcgttaccttcctggttgacgagatctttcaggcgctgctccacatcggcagccagcgcatcgagggcggcgccgtttgcctcgcccgcctgagcggcgcgctgcatggcctgctccccggccaggcggccgaagaccaccagctcggccagcgagttggagcccagacggttggcgccatgtaagccaacggacgagcattcgcccacggcaaacagccctttgatccgggtttcgcactgctgatcggtttcaataccgcccatggtgtagtgcgcggtcgggcgcaccgggatcggctctttcaccggatcgacgccgacgtaggctttcgccagttcacagataaacggcagacgctccagcagttttttctcgccgaggtggcggagatcgaggtagaccacgtcgccgcgcggcgtcgggatggtgttccctttccgccactcgtgccagaaggcctgggacactttgtcgcgtgggcctagctccatatatttattcttcggttcgccgagcggggtttccgggcccatgccgtaatcctgcagatagcggtagccgtttttgttgaccagaatcccgccttcgccgcggcagccttcggtcatcaggatcccggagcccggcaggccggtcgggtgatactgaacgaattccatgtcgcgcagcggcacgccatggcccagggccatccccatcccgtcaccggtgacgatgccgccgttggtgttgtagcggtagacgcgcccggcgccgccggtagccagcaccacggcgttagcgcggatctgcaccagggtgccttccatcatattcatcgccaccaggccgcgggcctgcccgtcatcgaccagcaggtcaaggacgaaatgttcgtcaaagcgctgaatttggggaaactgaagggaggtctggaagagggtatgcagcatgtggaagccggttttgtcggcggcaaaccaggtgcgttcgattttcatgccaccgaagcgccggacgttgacgctgccgtcggggcggcggctccatgggcatccccactgctccagctgggtcatttccgtcgggcagtgatgaacaaaatagtcgacgacatcctgctcgcacagccagtcgcctcccgcgacggtgtcgtgaaaatggtactcaaagctatcgtgatcctgggcaacggctgcggatcccccttctgcagcgaccgtatggctgcgcatcggatagactttagaaatcagggcgattttagcgttggggttggcctgagcggcggcgatagcggcacgaaggcctgccccgccggcgccaattacggcgagatcggcttgaaaagtttgcacgacattcctccagttttagtgtatttcgccgccgggctggcgaaaaagtatcactgctcctttataggtacaggagtatagccttagggtcagtatggaaaattgacgtgttcgatttttttatcgatatgtgcggttatttatcagtggtatttatgcgtcagggttaacgatagattaatggcatgtagtctgccggagattgcacaaaatttgtttcactcgccggttgcgagtagacttcgtgcccttaatttgcaatcggagaaagtaccatgagcgagacggcaacctggcagccgagcgcacccattcccaatctgttgaagcgcgcggcggtgatggcggaaatccgccgtttctttaccgatcgcggcgtgctggaggtggagacgccttgcatgagtcaggcgacggtaacggatattcatttgttcccgttcgaaacccgtttcgtcggcccgggccattctcaggggcttaacctgtacctgatgaccagtccggaataccacatgaagcgcctgctggcggcgggttgcggcccggtcttccagctgtgccgcagcttccgcaatgaagagatggggcgtcatcacaatccggaattcaccatgctggagtggtatcgtccatgctatgacatgtatcgcctgatcaatgaggtggacgatctgctgcagcaggtgctggagtgccaaccggcggaaagtctctcctatcagcaggcgtttcagcgccatctggaaattgacccgctctctgccgataaagcacagctgcgtgaagtcgcagcgaagctggatctgagcaatatcgccgatactgaagaagatcgcgataccctgctgcagctgctgttcaccatgggcgtggagccgcacatcggcaaagatcgaccaacgttcatttatcatttcccggcgactcaggcctctttagcgcagatcagcccggaagatcatcgggtcgctgagcgctttgaggtctattacaaaggtattgagctggcgaacggtttccacgagctgaccgacgcccatgaacagcgcctgcggtttgagcaggataaccgcaaacgcgccgcgcgcggccttccgcagcagcccatcgataacaacctgctggcggcgctggaggcgggtctgccggactgctccggcgtggcgctgggcgttgaccgcgtggtcatgctggcgctgggcgctgaaagcatcggcgaagtgattgcctttacggtagaccgcgcctgatcgctttttcacctccctccgccggcgggtgggggaggtgaaagacgactttggacctgacaccctcgccccggctttagcccgaatacccacaatttccatccgtgattttgctactatccgcgctctttttatgaggccaggcgtcgctcgtcgggcgatgcccacgtttggatagatttatgcatcaacaactcaagaagatgagcctgatcgggctgattctgatgatcttcacctcggtgtttggctttgccaacagcccatcggcgttttatctgatgggctatagcgcgatgccgttttaccttttttccgccctctttttctttatcccgttcgcgctgatgatggcggagatgggctcagcttatcgtcgcgaagagggcgggatctattcctggatgaaccacagcgtcgggccgcgctttgccttcattggtacctttatgtggtttgcctcgtacgtagtgtggatggtgagtaccgccgctaagatctgggtcccgctatctacttttttgtttggcgcggacgaaacccagacctgggcgctgggtagcctgacgccgacgcagacggtcggtattctggcggcctgctggatggtcgtggtgacctttattgccgtcaaagggatcaataaaatcgctaaaattaccgccgtcggcggtatcgcggtgatggggcttaacctggtgctgctgctggtgagcggggcgatccttctgcttaacggcggtcatttcgcccagccgttaaacttcaccctttcgcctaatcccgggtatcagtcgggcatggcgatgctgtcgtttgtggtatttgccatctttgcctatggcggaattgaggcggttggcggcttagtggataagaccgataagccggaaaagaactttgccaaaggtattatcatcgcggcgattgttatctcgatcggttactcgctggcgattgtgctgtggggcgtgagcgccaactggcagcaggtgcttggcgcgcgttcgaccaacctcggcaacatcacctatgtgctgatgaccagcctcggggcgacgctgggccaggccctgcacctgacccctgcggcgtcagccctgaccggggtctggttcgcccgtattaccggcctgtcgatgtttctcgcttacaccggcgcgttcttcaccctcagctattctcccctgaaagcgattatccagggcacgccaaaagcgctctggccgtcggtgatgacccgtctcaacgtcaacggaatgcccgccgcggcgatgtggctgcagtgtctgctggtcggggtgtttatcgtactggtatcgttcggtggggatagcgcttccgcgttttataacaagctgacgctgatggccaatgtctctatgaccttgccttatctgttcctgaccatcgccttcccgttcttcaaggcgaaaacccatcttgaccggccgttcgtgatcttcaaaaaccgtccgtcgacgctgctggcgaccggcgtggtgctgctggtggtgaccttcgccaatatcttcaccattatccaacccgtcatcgacagcggggactggaacagcaccctgtggatggtcggtgggccgatcttcttctcactgctggcgctggggatctacgaaagctaccgtcggcgcatggcgtccggcgcgctggtgatggagagttaaagagcctgcccggcggtgccgccgggcaggggatggtttacaggctaccagccgtacggcggctggtttttccagccgaggtcatggttttactgctttgcctgccgtcaatactttccagacgcatctggaacggagggaacggcatttcaatgccatgctcgcggaagcccgccaggatcaactgatgcatctcatggcgcagcggcatgcggtgccccatctccgcggcaaaaatacgtagctcgaaaatctggatcccctgctgcaggtcgacgagaaacgcctccggcgccggggtatcgatgaccagcgagcagcgatgcgccgcggcgatgagaattttcgtcacctcttcggtatcggcgtccacaggcgccggcaccgtcagcaccacgcgggtaaccgagtccgacagcgaccagttgataaactgttcggtaatgaacgccttgttcggcacgataatctctttccggtcccagtcgctgatggtggtcgcacgggtattaatgcgggtgacgctgcccgtcaggtcgcgaatggtgaccgtatcgccgatgcggatcggcttctcaaacaggataatcaggccggagataaagttggcgaagatctcctgcaggccaaacccgagacccacacccagcgcggcgaccagccactgcagcttcgaccactcaataccgatcatcgagaagcccaccagcccgccgaccagcatcagcagatacttagtgatggtggtgatggcgtagccggtgccgggcgttaaatcgagatgctggaggatcgccagttccagcagcgcgggcaggttgcgtaccagctgagtggtgatgatcagcaccagaatggcaatcaacaccgcgccaagcgtaataggctcaaggctttccaccccttgtaccgtcgaggtcacgtcccacagcgagatattctcaaggaagccaaacgccgagtgaatctccgaccacagcacgatgaccgatagcagcgcgatcagcatcagcagggagcgcacaagccgcagcgactgggtactgatggcatcgaggtcgacctcgctgacctccgtctccaccgacccttccgggctgctgacgtgaacgggctcatcttcgccgcgggcgcgctgagcgagaatttccgcgcgacgatggcgggcccggtcgaaggccagccggcggcgctggatcagcatccagcggcggatgatgtgatagaccaccagcagcaggaaccagatggcgaccgaggtttccagacgcgcaagcagcgcctgggcggtggcgaggtagccgacggcggccgccagcatggccaccagcggggcgccaagcatcaggttccacagcaggcggttcaccatattgtcgccattcccctctttatccagatagagcggaataccggcgtgcttaaggctcagggtgaccaccgccagcgcgccgcagatcagcaggaagcacaggcggcccagcgaagcggagaattcgcggtcgttaagattatcgaacatgatcagcgccataatcagcggcacaatcagcccgatgctcatcaggtagtagcgcatcgccttcgccacgcggctacgcggccagccgaagtgggcgataaacagcccgtttggccgggcgaaggtggcgcagatcatcaccacccacagcaaaggcaccgtcgcggtgactccatcgccaatcgccaccgccagcgggaacggccaggcggactgcagaccatagccgagcgtcatccacagcaccggcagcggcgaggccaccagtatcgaccagaagaccgtgcgcagcgtcagccagaagtgatcctgggtgactttccccacccgggcgctggagcgctcgagaaagcgggtgaaatggcgccgcgagctgatgctaaagccaaccagcagcagggcggcaaacagcggtagcagggtctctttgctggtaagcatcatcgcgctggctttgcccagttcgctgatggtatccagggagatcaggcgccgcagatcctggacgatctccagcggccatgagaagccgatggggctgacgtccgaagtccagaacagatagcggtgggtggcttcgttgatctctttcagcgcgtcttccagctggccgttggcgaccttcagcttggtgagctccagcatcagggtgtcgccgccgcgcagcagcgagttcagcagctcgttctgcgtgcgcagctgcgcctgcaggatcttgttctgctcgctggtcagcggttcgccgtcggcctggcggatctgccgcagctgcggctgcttactcagcaaatcttcaaagcgcagacgctgcacgcgcagctgcgccatttccgtatccagctgctgcgggcgagggcgctccggcagccgcgccacctgggcgcgcagggcttcgcccagcagattggaggagcccagccactgcgactgctcgcgcagggtgtttaacgcctggcgcacctgcagcgtttgattcgtcgcctgtcgctgctgggatgccaccagatccatgcgctgcgcctgctggttcagcgcctgggagagctcacggttgaccttaaactgggcggtgatgtccggcggcaggttttcactgttctccgccagcagttcggtactctccagcgccttttccgcctcccgctggcgctggctgttttgcagattgcgcagcgcctgcagataggcatccagctgctcgctctgtttttgcgccagctcggaacgggcgcgcgacagctcctggcggttgttggcggagagctgggcgaggtcgagttcatccaccagcgccttcagacgcgccgattccgcctgcagggcaagattttgcgcctgggcgagagcattgttgccggtttgcgtgccgatgcggcgctcaacctcattgagctgacgacgggcatcggtttgctgctgcggcagctggttcagggagtcggcgatttcacgcgcgcgatcctgctcctgctgcgcctggcggctcgattccagcagctgactgctgacctgcaggatctcctggttcagcgcatcggcggtcaggccggttggcacctggcgcggctcttcgctcagattattgagctgggcacgcaggctttgaaacagtttggggaaattgtcgataacgtcctgatactgacgggcgcgctcgagggatgattttcgctcctcaagcgcgttcagcgcggactgcagaacttcaacggtttcaggctgggcgggctttgccgccttcgcctgttccagttcctgggttatctgtttagcatccggggctgtcgcagcgtacgccccgaaactgaggctcaaggccaacaggaaagtgtatatcaggcgcacggcataacccttttgctgaagaattaaccttggtcttgtttatcgtcaaccagcgggctggcgcggtgttcggcgcggatctcttcttccggtaacggcgcgggttcagcggcggcggtcgcttccactgttgtcgccagcggttggccgatcttggtcacggacaggctttgcagcgtgtcgaccagcttcacctggcccggggcaaacaggttgatcacggtggaacccagtttgaagcggcccatctcctggcctttcagcaaggcgatggagccttcgttgtcgccagcgggccaggtccagcgtttaataatgccttcgcgcggcggggtcacggtgccggaccacacggtctcgatgctgccgacgatagttgcgcccaccagaatttgcgccatcgggccaaactcagtatcaaacaggcagatgacgcgctcgttacgggcgaacaggttcgggacgttctgcgccgtcaagtggttaacagagaacaggtcgccaggaacgtagatcatttcgcgcaggatgccgttgcacggcatgtgtacgcggtgatagtcgcgcggcgacaggtaggtggtggcgaagctgccgttacggaacaggtcggccatctgatagttgccggccagcagggcttccagactgtagtcatgacctttagcctgcaggattttatcgttctcaatggcgccaagctggctgatcacgccatcggccggcatcaccagcacgtttggatcggtattcaacgggcgaacgtcgtcgcgcagcgggcgcacgaagaaatcgttgaaggtgcgataagccgcggtatccggcttctgcgcctctttcatatcgaccttgtagtatttcacgaacagatcgatgaccagcttcgtcagccaacctgcgcgtttgctcgcaccccagcctgcgaggcgggtgagccacagtttaggcagaatgtattgcagtgaaagtttaagatcgtttaacaaagtagcctccaggccatgatatgtcgttcctgaccccgcctgcgggcggggacctgaaaaaaggggacgattctatacgtaaaactcgccaaatggcatccgcgtaagctgcgtcatcatcgctgcccggcagcgcctgacgtgatgctcagcttaatgatcagtcatcggacgaggaaaagtttttacgcgtttttacctgtacctgcgccatgctttccaggatgcggtggtagttctcaaaacggctttcggcgatcttgccgttctctaccgcttcgcgaagcgcacagccaggatcggaatcgtgtttacagtcgcgatatttgcaacggcctaaataatcatggaattcgacaaagccgttggtgatttgttccgcttccagatgccacaggccgaactcacgtacccccggtgaatcaatcacatcgccgccgtgcgggaagtggtagaggcgtgccgcggtggtggtgtgttgacctaagccggaaacgtccgagacatcattggtgaggatctgatcctcgttcaacccgagcagggcgttcagcaggctcgatttaccgaccccggactgcccggcgaagatactgatgcggtcggtcagggccgcttccagcggcttaaggccgtcctgagtccgactggaaaccagcagcacgcggtaaccgatgttgcggtagatatccatttgctcattgacgaagcgcagaccatcatcatccagcagatcgattttattcagcacaatgagcggctcgatatcctgcgcttcgcaggccaccagatagcgatcgataatattcagcgacagctcaggcaggatcgcggaaaccaccacgatctggtcgatattggcggcgataggcttcacgccgtcgtaaaaatccggacgcgtcaggacggaggcgcgatcgtgcaccgcctcgacgatccctttgacgcttacgccgtcggcggcgtctttgcccggccgccagaccacgcggtcgccggtgaccagcgagcggatcgtccggcggatattgcagcgatgcacgctgccgtcagcggattcgacgtcggcatgcataccaaagcgactgatgacaatgccttccgacgtttcgccaaacaggttgtcatcgtagtcggccttctccgcagtggttttcagacggcgctggtggttggctttgacgcggcgctgctggcctttggagagtttatttttactcaatcgaactggctcctggtcgccctgatggggcaaaacctctatgatacacgctattttagatgaatatagtcacgcgagaagggtggaaaatagcatgagtgcaaatgaaaacaacctcatttggatcgatcttgagatgacagggctggatccggagcgcgatcgcattatcgaaatcgccaccctggtgaccgatgccaacctgaacattctggctgagggcccgaccatcgcggtgcatcagtcggacgctcagttggcattaatggacgagtggaatgtgcggacgcataccggcagcggtctggtggatcgcgtaaaggccagcaccgtcagcgagcacgatgccgaactggcgaccattgagtttcttaagcagtgggtgccggcgggcaagtcgccgatctgcggcaacagtatcggccaggatcgtcgcttcctgtttaagtacatgccgcaactggaagcctatttccactatcgctatctggacgttagcacgctgaaagagctggcgcgccgctggaagccggaaattctcgacggctttaaaaagcagggcactcatcaggcgatggacgatatccgcgagtcggtcgccgagctggcttactaccgcgaacacttcattaagctgtaaaccgcgaccgggccctgtgcgcggcccggtacacttttctgcgttatttaaaccacttctgctgcatctgctggaagtcaggtgtcgccatgaccgcggccagggcatcgttgatggcgttcagcagctccggatcgtctttgcgcaccgcaatcgcatactgcttaccgtaataagccgggtcggtggcccgttcatccatgatggcgtagtcagggttctcctgctgccaggcgtcgagggtggcgaagtcgcccatgacgccggttatttgcccggctttcagcgcggccagggcgctggcgacatcgtcgtaagggacagcctgtacggctttctgtttatcacgcaggtagcgctgatgcagcgtgcctttcaccacgccgacttttttagccttcagatcggcaaaggtatgggcgacatctttgttgacgatcactaccccggagagcgcctggcgatagggtcggctgaaggcgacctgcttctcacgcatcgggatcacttccatgccggcaatcaccgcgtcaaatttcttaaagcgtaaagccgggatcagggtatcgaaacgctgcgccgtgaactggcactgcgcctgcatctgctggcacagggcgtgcgcgagatcgatatcgaagccaacgggctgatttttgccgttggcggtgacaaacggtggattggccgtggtggtgccaaaatggagcgtctcggctgacgcggttccgatggccagcgtgctcagcagcaggacggtgaggacttttctcatgctaattccctgtttggcgtcggggtggcctcgttatacgtcgcgccaccgctgtatgatgcgagcgattttgcgtcattcagccgggcggaaaaagcgattttgcccgttatgacgcttatttatacaattcagcggcgtagatggcgagaaaatgtccatttaaacaaaaaacgcaaaaaagtgatcgtcagggggttgcaggggcatcgaattctcgtataatgcgcctcccgtaacgacgcagaaatgcaaattacgacgccatcgaaatatggcaaaaaatgcagtaacgcgggaatagctcagttggtagagcacgaccttgccaaggtcggggtcgcgagttcgagtctcgtttcccgctccaaaatttgaaagcaccatcctgatcaaaggatttcatctcgcagatgcggggcgaaagccgaagattaagcgggaatagctcagttggtagagcacgaccttgccaaggtcggggtcgcgagttcgagtctcgtttcccgctccaaaatttgaaagacacaccacaccagtcgcagttttcaggttgctagacggtagcttgaatgacgatgattaagcgggaatagctcagttggtagagcacgaccttgccaaggtcggggtcgcgagttcgagtctcgtttcccgctccaaattttcttccatctcttatttatccacagtgcaatccagcgccggggatgattttcgtttggtccgcagaaatactgtgaacagagttatccacaggttgtcgttccgtcactggcggcgcaaatgcttcgctttgtaaatagtatctttgtatgttattgaaatttaacaaataaatttcatttcaaaatgttaatccgatcacttgaccttggtctgcgccttgaaacgcaatgtgttttagattttattcacagcctgtgaatgaatcaggcgtcgcgcggcaagcctttctctaccactctgaccagacgtaattttttcggcaactgtacttcaacggcgtcggcgttccgctttttcagttgctgggcaatcgcccactcaatgtgttcgtcgagaagcgggtgctcgccccggcggctctccagggcgcgaagatgggcttcatcccagggcgcattgcccaacgcgacggcgatattgcgcagccagcgcaggtggccaatgcgacgaatcgccgacccttcggtcaccttcagaaaccacgcttcgctccaggcgaacagctccaccagcggcggggcatgcagcgctttgcgtgggctgaaatcctcttcatcggtgagctgtgagaaacggttccacgggcagatcagctgacaatcatcacaaccgtaaatacggttgccgattagtggacggaactcctcggggattgcaccttccagttcaatggtgagataggagatgcagcgccgggcgtcgacggtatagggctcaacgatggccccggtgggacagatggtcatgcaggcgacgcagcgcccacactcctccgcgatcgggctgtcgaccggcaggggcagatcaatcagcagttcgccgaggaaaaagaacgatccggcgtcgcggcttaagataagtgagtgcttacctgtccagcctaggcccgctttttctgcgattggccgttccaggataggcgcggaatcgacaaaaggtctaaaattgagcgaagcacactgttcctgaatcttctcccccagctttttcaggcgattacgtagcagcttatgataatcacgcccgagggcataacggctgacgtaacccagcgtgggatctttcagggtgcgggcaaaggcggcgttagcgggcagatagttcatccgcacgctgatgacgcgtaacgtaccgggcagcagttcgtggggacgggcgcgcatcataccgtgacgggccatccattccatttcgccgtggtattgtttatccagccatgcctgcagtttgggttcactggcgctgaggtcggtatcggcgatccccacctgctggaacccaagctctgtgccccattgtttgatttgttgcgctaactgaacgagatcgaggggctgtgacatgatggaccatacaatgacgaaaaaccctgacagtataccatacaacatttggcctgcggaggcgctgcgcctggccgaacgagaggcggcggacagcctggggctgacgctgttcgaactcatgcagcgcgcgggcgaggcggcgttccagctggccagctgtgcttatcctgccagcgcgcactggctgatcctctgcggacatggcaacaacggcggcgacggatatgtcgttgcgcgtctggcacaggccgcggggcggcgggtgacgctgctggcggtggagagtgacagcccgctgccggaagaggcgcaggcggcgcgggaggcatggcttaacgccggcggcgtgatccatgcggcgactatcccatggcccgacgatatctcactgattattgatggcctgctcggcaccggtctgcgcagtgcgccgcgcgatcccgttgcggcgctcatccaccaggcgaaccaccacccggcgccggtggtggcgctggatatcccttccggcctgaatgcgcagacgggcgcgacgccaggtgcagtggtacaggccgaccatacgctgacctttatcgccctcaagccggggctgctgaccggcaaggcgcgggatgtcgtcgggcaactccaccatcatgcgctggggctcgaacgctggctcgccggacaaagcactcctctgacgcggttttgcgccgcccacctcgccgactggctgccgccgcggcgggccacctcccataaaggcgatcacggcaagctggtgattgtcggcggcgatcgcggcacggcaggcgctatccgtatgtgcggtgaagcggccctacgcagcggcgcgggactggtgcgagtgcttactcacccggagaacgtggcgcccattgtcaccgtgcggccggaattaatggtagatgagctgacgccgcagactctgaaagccgcgctggagtgggctgatgtggtggcgattggccctggcctggggcagcgcgaatggggacgcagcgccctgcgcacggtggaaagttttaacaaaccgatggtctgggacgccgacgcgctgaacctgctggcattcaatcccgataaacgtcacaatcgcgtgctaacgccgcaccccggcgaagcggcccgtctgctgaacgtcagcgtggcagaaattgaaagcgatcgcttactttctgcgcagcgtctggtaaaacggtatggcggcgtggttgtgctgaaaggcgcgggcacggtggtggccagtgaaagcggggcgatgggcattatcgatgccggcaatgccgggatggccagcggcgggatgggcgatgtgctcaccggcatcatcgccgcgttgttaggacagcacctgacgccgtatgatgctgcctgtgccgggtgcgtcgctcatggcgatgccgccgaccgactggccgcccgcgagggcacccgcggcatgctggcgaccgatctcttttccacgctcaggcgtgttgttaacccggatgtgattgacgtagaccatgattaaccgagtgattcctttacccgatgagcaggccacgctggcccttggcgaccgcatcgcgcaggcctgtaccggcgccaccgtgatttatctgtatggtgatttaggcgcggggaaaacgaccttcagccgcggctttttgcaggcgctcggtcaccgcggcaatgtcaaaagcccaacttataccctggtggagccctataccctcgagaacctgatggtgtatcacttcgatctctaccgtctggcggatcctgaggaactcgaatttatggggatccgtgattattttgccgacgatgccatctgcctggtggaatggccgcagcaaggcgcaggtgtcctgcctgacccggatgttgaaattcaccttgattaccaggcacaagggcgtgaggcacgtattaccgcgatctcctcacggggtgaatctttactggcgcgtttagccttttagcctgaaggatgacgggatgaagtatcgcataaccacctggcttgccgctgcgctgatgctgtcgagtcttcacgccactgcggcgagtttatccgatatccaggtctctaacggagaccagcaggcccgtattaccctaagctttgtcggtgagccggagtactcctttaccccacagggtaaacgtctggtggcgctggatatcaagcagaccggcgtattgcagggactaccgctgcagtttagcggcagcaacctggtgaagagtattcgcgccggcacgccgcaggatacgcagacgctgcgtctgctggtggatctgacggaagatggcaaaactcgggcggtgaagcaacagaacggggcgaattacacggtggtctttaccatcaacgccgacgcgccgccgccgccgcctccgccgcccgtggtggtgaaacgggccgacccgccgccggtgatgccttcccggacgacgacgtcagggcgtaacccgttcagctcgtcgggtcatgaacggcagacggtgatgacctcctctcagccggcgatgaccaacaatcagaccgtgactcgcccggcggcccgcacggtgtcggcggatgataaagtcattatcgccattgatgccgggcacggcggccaggatcctggcgcgattggcccgaacggcaccaaagagaaaaacgtgactatcgctatcgcgcgcaagctgcgggcgttactgaacgccgatccgcagtttaagccggtgctgacccgcgacggggattactttatttcggtgatgggccgctctgacgtggcgcgtaagcaaaacgccaatttcctcgtctctatccatgctgacgccgcgccaaaccgcgatgccactggcgcctcggtgtgggtgctctcgaaccgtcgcgccaacagcgaaatggccggttggctcgagcagcatgagaagcagtctgaactgctcggcggtgcgggcgatgtgctggcaaacagccaggccgacccctacctgagccaggcggtgctggatctgcagtttggtcattcccagcgcgtcggctacgatgtggcgaccaacgtgctgagccagctgcagcgtattggcaacctgcacaaacgccgcccggagcatgccagccttggcgtgctgcgctcgccggacatcccgtcgatcctcgtggaaacgggctttatcagtaacaacggcgaagagcggctgctggggagcgatgattaccaggagcagattgcggaggcgatttataacggcttacgcaactactttatgcagcatccgctgcaggcggcgcctcgcggcgaggcggcgcagaccgccagcgccgcggcgccgggcgggatgttgattaactaaggagcaggggatgccgattcaggttctgccgccgcagctcgccaaccagattgccgccggcgaggtggtggagcggcccgcgtcggtggtgaaagagctggttgagaacagtcttgatgcgggcgccacgcggattgacattgatatcgaacgcggcggcgcgaagctcattcgcatccgcgataacggcagcggcatcaaaaaagacgagctggcgctggccctggctcgtcatgcgaccagcaagatcgcctcgcttgacgatctggaggccattattagcctcggctttcgcggcgaagcgctggccagtatcagttcggtagcgcgcttaacgctgacttcgcgcacggcggagcagcaggaagcctggcaggcgtatgctgaaggccgcgatcaggcggtgacggtgaagccggcggcgcacccggtcggtaccactctggaagtcctcgatctgttctataacaccccggcgcggcgcaaattcatgcgcaccgaaaagaccgagttcggccacattgacgaggtggtgcgccgcattgcgctggcgcgcttcgacgtcactatcaacctcagccataacggcaaggtgatgcgccagtatcgggccgtcgctcaggatggccagcgcgagcgccggctggggacaatttgcggcgccgcttttctcgaacatgcgctggcgatcgagtggcagcatggcgatctgaccctgcgcggctgggtcgccgatccgctgcataccaccccggcgctggcggaaattcagtattgctacgttaacgggcggatgatgcgcgatcggctgatcaaccatgctatccgccaggcctgtgaagacaagctaggggccgatcagcaaccggcgtttgtgctgtatctggagatcgatccccatcaggtggatgtaaacgtccacccggccaagcatgaggtgcgtttccatcagtcgcgcctggtgcacgactttatctaccagggcgtactgagcgtactgcagcagcagcttgacgcgccgctggcggaaaaaaacgacccgccggcgccgcgcccgatgccggagaaccgcatcgccgcgggaggcaaccagtttgcgcggccagcggaagcgcgggagcctgcgacccgcttcagcatcacgccatcgcgtgagcctgcggcctccagcggcaaaccgggcggcgcgagctggccgcatgcgcagccgggttaccagaagcagcagggagcgctttatcgtcaactgctcgacacgccaacggcgccaaagccagcgttgcagcctccggcggcggcagagttggccggtcacagtcagagctttggcagagtgttgacgattgttggcggcgactgcgcgctgctggagcgcgagggcggtctggcgctgctgtcgttgaccgttgccgagcgctggctgcgccaggcgcagttgaccccgggagcggaggcggtatgtgctcagccgctgctgatcccgctgcggttaaaagttacggaaggggaaaagcaggcgctggccgccgctcagccggcgctggcgcagctagggatcgatgtgcataccgatgccctgcacgtgacggtgcgcgcggtccctttacccttaagacaacaaaatttacaaatcttgattcctgaactgataggctacctggcgcagcaaaacgcattcgacgtcggcaatatcgcccaatggatggcgcgtaatctgacgagcgaacagacgtcatggaatatggcgcaggcgattgcgctgctggcggacgttgagcgtctttgcccgcagctggtgagaacgccgccgggtggcctgttacaacctgtagatctccattcggcgatgaatgccctgaaagatgaatgatgtaaccgaggcgagcctgcccaaggcaatttttttaatgggcccgacggcctccggcaaaaccgcgctggcgatagccttacgtaaagttttgccagtagagttgattagcgttgattccgccctcatttatcggggaatggatattggcaccgccaaaccggatgctgcggagcttagcgctgcgccgcatcggctgctggatattttggatcctgcggaggcctattccgcggcggattttcgccgcgatgcgctggcggcgatggcggatatagtcgccgccgggcgaattccgctgttagtcggcggaacgatgttgtatttcaaagcgttgctggaaggattgtcgcccttaccgtcggctgacccagaggtcagagcgcggattgagcagcaggccgcagagcaggggtggaatgcgttacatcagcaattacaggagatcgatcccgtggctgctgcgcgtattcatccaaatgatccgcaaaggctttcccgggcactggaagtttttttcatttcgggtaaaactttaacggaactgacgcaaacgtcaggagacgctctgccatatcaggtgcatcagttcgccatcgccccggcgagccgtgaactgctccatcaacgcatagaacagcgttttcatcagatgttagcttcaggttttgaagcagaagtacgggcgctttttgcccgcggagatttgcatacggacatgccttccatccgttgtgtcggataccgccagatgtggtcatatctcaatggcgagatcccgtatgatgagatggtttatcgaggtgtttgcgccacgagacagttagccaaacgtcaggtcacctggctgcgcggttgggaaggtgtgcactggttagacagtgaacaacctgaacaagcgctcaacaaagtattacaggttgttggtgcgagccagaactgaacgtgtacaattaaacggtatcgtgcgtaattttttttgagaatcgtaaggttctgagtacaaaacaagcatacatataaggaaaagagagaatggctaaggggcaatctttacaagatccgttcctgaacgctttgcgtcgggaacgcgttccggtttctatttatttggtgaatggtatcaagctgcaagggcaaattgagtctttcgatcagttcgtgatcctgttgaagaacacggtcagccagatggtctataagcacgcaatttctactgttgtcccgtctcgcccggtgtctcaccacagcaacaatgctggcggcggttccagtaactatcaccacggtggtagcgcgcagggttcttctgcgccgcaacaagacagcgacgacgccgaataaggccagtgctgtttttccacgccggggagccaggttttctgcgttccccgctggtattttataaggggtttacgcttgtttgaccgttatgacgccggtgagcaggcggtactggtacacatctatttttcgcaagacaaagatatggaagatctccaggagtttgaaactctggcctcttccgccggtgtcgaagcaatgcaggtgattaccggtagccgtaaagcaccgcacccgaagtattttgttggtgaaggtaaggcagtcgaaattgcggaagccgttaaagcgaccggcgcttcggtcgtgctcttcgatcatgccctgagtccggcgcaagaacgtaacctggaacgcctgtgcgaatgccgggttatcgatcgcaccggtcttattttagatattttcgcccagcgcgcgcgcacccatgaagggaaattgcaggtcgagctggcgcagctgcgccatatggcgactcgccttgtccgcggttggacccaccttgaaagacagaagggcgggattggtttgcgtggcccgggtgaaacccagctcgaaaccgaccgccgtttattgcgtaaccgtatcatgcagatcctgtcgcggctggaaaaagtcgagaaacagcgcgagcaggggcggcggtcgcgtgcgaaagccgatattcctaccgtgtcgctggtgggctataccaacgccggaaaatcaacgctctttaaccagatcactgccgccgaggtctatgccgcgaaccagctgttcgccaccctggacccgacgctgcgccgcattgacgtccctgacgtcggcgaaacggtgctggccgataccgtcggctttattcgccacctgccgcacgatctggtagccgcgtttaaagcgacgttgcaggagacgcgtcaggcgacgctgctgctgcatgtgattgacgcggcggatgtccgcgtgcaggaaaacattgatgcggtaaatacggttctcgctgaaattgaggccgatgagatcccggcgctgctggtgatgaacaaaatcgacatgcttgacgattttgaaccgcgcatcgatcgcgacgatgaaaataaaccgattcgggtctggctttcagcccagaccggggttggcgtaccactgctttttcaggcattaacggagcgtctttccggtgaagtggcccagcatacgctgcgcttaccgccgaaagaagggcgactgagaagccgtttctatcagcttcaggcgatagaaaaagagtggatggaggatgacggcagcgtgagtctgcaggtgcgcatgccgatcgttgactggcggcgcctctgtaagcaagagccaacgcttgttgactatgtggtttaaccttgcagcttgcctgaagatattgacccctgtggggatatcaaaaacaaatatggagcatatacatggcgtggaatcagcccggtaataacggacaggaccgcgacccgtgggggagcagcaaacctggcggcaactctgagggaaatggcaataaaggcggtcgcgagcaggggccgccggatctggatgatatcttccgcaagttaagtaaaaaacttggcgggctcggcggcggcaagggcggactgggcggcggcaatagcgcgcaggggcctcgcggaccgatgggcgggcgtattgtcggcatcgttgccgcggcggcagtgattatctgggcggccagcggtttctataccattaaagaggccgagcgcggcgtggttacccgttttggtaagttcagccatctggttgagcctggcctgaactggaaaccgacctttatcgataacgttcaggcggtgaacgtggagtcggtgcgcgaacttgcggcttccggcgtcatgctgacctctgacgaaaacgtggtgcgcgttgagatgaacgtgcagtaccgcgtcaccgatccggagcgctatctgtttagcgtgaccagcgcggacgacagtctgcgtcaggccaccgacagcgcgctgcgcggcgtgatcggcaaatacaccatggatcgcattctgaccgaaggtcgtaccgtgatccgtagcgatacccagcgtgagctggaagagacgattcgcccgtacaacatgggtatcactctgctggacgtcaacttccagacggcgcgtccgccggaagaggtgaaggccgcgtttgacgatgccattgccgcgcgtgagaacgagcagcagtacattcgtgaagcggaagcgtataccaatgaagtccagccgcgggcgaatggtcaggcgcagcgtatcctcgaagaggcacgcgcctataagacccagaccgttctggaagcccagggtgaagtggctcgctttgcgaagatcctgccggaatacaaagccgcgccggaaattacccgcgagcgtctgtatatcgaaaccatggaaaaagtgctgagccacacccgtaaagtgctggtcaatgacagcaaaaacggcaatctgatggttctgccgctggatcagatgctgaaaggcgccgctgcgccggcagcaaagagcgatagtagtgacgccagcgatctgctgcgcctgccgccagcatccagctcaagcagcgccagcacctcatcaacctcgagctcaaccgggggtagcattatggaccaacgccgcgctaacgcgcagcgtaacgactaccagcgtcagggggaataacgatgcgtaaatctgttatcgcgatcattgtcatcgtgctggtagtgctctacatgtctgtctttgtcgtaaaggaaggcgagcgcggtatcacgctgcgtttcggtaaagttctgcgcgacgacgaaaacaagccgctggtgtatgcgccaggcctgcacttcaagatcccgtttatcgaatcggtgaagatgctggatgcgcgtattcagaccatggacaaccaggctgaccgtttcgttactaaagagaagaaagacctgatcgtcgactcctatatcaagtggcgcatcagcgacttcagccgttactacctggcaaccggcggcggcgacgtctcccaggccgaggtactgctgaagcgtaaattctctgaccgtctgcgttctgaaattggtcgtctggatgtgaaagatatcgtcaccgactcccgtggtcgcctgaccctggaagtgcgtgatgcgctgaactcgggttcggccggtacggaagatgaggttagcaccccggcggctgacgacgcgattgctaaagcggcagagcgtgtagaagccgaaaccaacggtaaagtgcaggtgatcaacccgaacagtatggcggcgctgggtatcgaagttgtcgacgtacgtatcaaacagatcaacctgccggcagaagtgtcggaagcgatttataaccgtatgcgcgcggagcgtgaagcggttgctcgtcgccatcgttcacagggtcaggaagaggcggaaaaactgcgcgcgactgcggactatgaagtcaccaagacgctggcggaagccgagcgccagggccgtatcctgcgtggtgaaggtgatgcggaatcagcgaaactgtttgccgacgcgttcagccaggatccaggcttctactcctttatccgtagcctgcgtgcctatgagaagagcttccagagcaatcaggatgtgatggtcctgagtccggacagcgatttcttccgctatatgcgttcaccggattcggcgcgtaaataagccggagaaggtgtaaacctgaagtaataatgcgaaaaggcgcctgaaacaggcgccttttttcatgctgcgagggcgggaattagttgccgagtagcttgttcagcaggccgccgatcaccggcaggcctgccagcgcactttcgatggtgccgccgatagaagagccgatgctttcgcctaaggttttgcccaggtccggcgccaggtcggccagattgagggtgccaagcagtggcaggttaatgctcagggcatcagtgcccatcgtccatgcggctgcgccgaccttgctgcctaaggccgccagaccatcctgtaaccagcctgcgccgctcacattttcgatttcaaatgcggttaattctctcatcataatcttcctgattaagtagacgtaccgggttgtagtacgcgatggcatagttacaatttaaaaaatatccagcaatacaattagttgtgaattttgtttcacctttccggttcataatgaagctgaaatacgggacaatgtgaaatgagggaatgaattcaccatgctggccgatgacgcccgcgagggcggcaatgatacttttcaattagggttgacgatgaactccaccatttggctggcgctggcgctggttttagtacttgaagggcttggcccgctgctttatccgcgcgcctggcgcaaaatggtcgccagcctgagccagctaccggataatttattgcgtcgttttggcggcggacttgtggttgccgggattgtgatctactacatgttgaggaaatcgattggctgatcaaaaagtggtcggatttgccttattttggatgcaaaaagtgctgtaactctgaaaaagcgatggtagaatccatttttaagcaaacggtgattttgaaaaatgggtaacaacgtcgtcgtactgggcacccaatggggtgacgaaggtaaagggaagatcgtcgatctcctgactgaacgggctaaatatgttgtgcgctaccagggtggtcacaacgccggccatactctcgtaatcaacggtgaaaaaaccgttctccatcttattccatcaggcattctgcgtgaaaacgtcaccagcatcatcggtaacggcgtcgtgctgtctccggccgcgctgatgaaagagatgaagggcctggaagaccgtggtatcccggttcgcgagcgtctgctgctctctgaagcctgcccgcttatccttgactatcacgtggcgctggacgtggcgcgtgaaaaagcgcgtggcgcgaaagcgatcggcactaccggtcgcggcattggcccggcttacgaagataaagtcgctcgtcgcggtctgcgcgttggcgatctgttcgataaagcaaccttcgccgataaactgaaagaagtgatggaatatcacaacttccagctggtgaacttctacaaagcagaagcggttgactaccagaaagtgctggacgatgtgatggcgattgccgacatcctgaccagcatggtggtggacgtatccgacctgctggatcaggcgcgtcagcgcggcgacttcgtgatgttcgaaggcgcgcagggtacgctgctggatatcgaccacggtacctacccgtacgttacgtcctctaacaccaccgcaggtggcgtggcgaccggctccggcctgggcccgcgttatgtggattacgtactgggcatcattaaagcttactcgactcgcgtcggtgcaggtccgttcccgaccgagctgtttgatgaaactggcgagttcctctgcaagcagggtaacgaattcggcgccaccaccggccgtcgtcgtcgtaccggctggctggacgcggtcgcagtccgtcgcgcggtgcagattaactccctgtccggcttctgcctgactaaactggacgtcctcgacggcctgaaagaagtgaaaatctgcgttggctaccgtatgccggatggccgtgaagtgaccaccactccgctggctgccgataactgggaaggtatcgagcctatctacgaaaccatgccgggctggtccgaaaccaccttcggcgtgaaagagcgcagcggcctgccgcaggcagccctgaactacatccagcgtattgaagagctgaccggcgtgccggtggatatcatctctaccggtccagaccgtaccgagactatgattctgcgcgatccgttcgacgcgtaatcactctcaaggggcgccgttcgggcgcccttgtttttgctgttcgcccgccccatttcaaataaattagcggcctgagcgctggctggtttatcatcaataataatgatgtcgctcgacataccctgttttcttttccctgaggtttatgtgcagttaacgagtttcaccgattacggactacgcgcgctgatttatatggcgtcgctgccggaaggacgaatgaccagtatctcggaagtgaccgaggtctatggcgtctcccgtaatcatatggttaaaataatcaatcagttaagtcgcatgggctacgtgactgccgtgcgggggaagaacgggggcattcgcctcggcaaaccagcaggacagatccgcgtcggtgacgtggtgcgtgaccttgaacccttatcgctggtcaactgcagcagcgagttttgccacattacaccagcctgtcgtctgaaacaggcactagctgaagccgcgcagagttttctcaaggaactggataactatacgctggctgatttggttgagaagaatcaaccgctttacaaattattgctggtggagtgacgccactctgccggagatgacaacggaggaaccgatatgtcacaagatccattccaggaacgcgaagctgagaagtacgcgaaccctatcccgagccgggaatttatcctcgaacatttaactaaacgggaaaagcctgccagccgcgatgagctggccatcgagttaaatatcgagggcgaagagcaaaccgaagcgctgcgccgccgcctgcgcgcgatggagcgcgacggtcagctggtcttcacccgccgccagtgctatgccctgccggaacgcctcgatctcctcaaaggaaccgttattggccaccgcgatggctatggtttcctgcgcgttgaagggcgcaaagacgatctgtacctgtcgtcagagcagatgaaaacctgtattcacggcgaccaggtgctggctcagccgctgggcgcggaccgtaagggccgccgcgaagcgcgcatcgtccgcgtcctcgtgccgaaaaccagccagatagttggccgttacttcaccgacgctggcgtcggctttgtcgtcccggacgacagccgcctgagcttcgatatcctgatcccgccggaagagataatgggcgcgcggatgggctacgtggtcgtggtcgagctgacccagcgaccaacccgccgcaccaaagcggtgggtaaaatcgtcgaagtgctgggcgacaacatgggcaccggcatggccgtcgatatggcgctgcgtacccatgaaattccttatgtctggccgccggcggtggaaaaacaggtttccggtctcaaagaacaggtgccggaagagtcgaaggtcggacgcgtcgatttacgctcgctgccgctggttaccattgacggcgaagatgcccgcgacttcgatgacgcggtgtactgcgagaagaaacgcggcggcggctggcgcctgtgggtcgccattgccgacgtcagctactacgtgcgcccggggacgccgctggatgcggaagcgcgcagtcgtggcacctcggtctacttcccgtcgcaggtagtgccgatgctgccggaagtgctgtctaacggtctatgctcgctgaacccgcaggtcgatcgcctgtgtatggtgtgcgagatgacgatttcgtcaaaaggccgtctgaccggttataaattctatgaagcggtgatgagttcacatgctcgcctgacctacaccaaagtgtggcatatgctgcagggtgaccaggaactgcgcgaacactacgcgccgctggtgaagcacattgaagagctgcataacctctacaaagtgctggagagcgcccgcgaagagcgcggtggtatctcatttgaaagtgaagaagctaaattcatcttcaatgccgaacgccgtattgagcgtatcgaacagactcagcgtaacgatgcgcataagctgattgaagagtgcatgatcctggcgaacatctccgccgcgcgcttcgttgagaaggcgcaggagccggcgctgttccgtatccatgataagccaaccaccgaagcgattacctccttccgtaccgtgctggctgagctgggactggagctgcctggcggcaacaagccggagccgcgtgattacgcagagctgctaacctccatcgccgatcgcccggatgcggaaatgctgcagacgatgctcctgcgctccatgaagcaggcggtctacgatccggaaaaccgcggtcactttggcctggcgctgcagtcatacgcccacttcacctcgccgattcgtcgttacccggacctgtcgctgcaccgcgctatcaagtatctgctggccaaagagcagggacataaaggcaacagcaccgagaccggcggctggcactacagcatggaagagatgctccagctgggtcagcactgttcgatgaccgagcgccgcgccgacgaagcgacgcgcgaagtgtctgactggctgaagtgcgacttcatgcaggatcaggtgggcaacatcttctccggcgtgatcgccagcgtgaccggctttggcttcttcgtccgcctgaacgatctgtttatcgacggtctggtacatgtttccagcctggataacgactattatcgtttcgatcaggtggggcagcgtctcattggtgagtccggcggccagacctatcgcctgggcgaccgcgtggaagtccgtgtggaagcggtcaacatggacgagcggaaaatcgactttaccctgatctccagcgagcgtgcgccgcgtaatgtcggcaagaccgcccgtgagaaagcgaaaaagagtacctctggcaagccgggcggccgtcgccgccaggtgggtaagcaggtaaacttcgagccggacagcgctttccgtaaagagaaagagaccgcccgaccgaagaaagagaaaaaagcgaaaaaaccgtcggcgaaaacacagaaaatcgccgccgcgacgaaagccaagcgcgcggcaaagaagaagatcgccgagtgattgacctcccttcaccctgaagtctgctgacgcaggatggggtgaagggggcagataacagaacctaaaacgagtacatcaatgagtgaaatgatttacggcatccatgcggtgcaggcactgctggagcgcgcacctgagcgttttcaggaagtttatattctgaaaggccgtgaggataagcgcttgctgccgctgatccatgccctggaagcgcagggcgtggtgattcagctggccaaccgtcagtttcttgatgagaagagcgaaggcgctgtgcaccaggggatcattgcccgcgtgaagccggggcgtcagtatcaggagaacgatctgccggatctgctggcgcagctcgatcaaccgttcctgctgatcctcgacggcgtaaccgatccgcacaacctcggcgcctgcctgcgtagcgccgacgccgccggcgtgcatgcggtgatcgtgccaaaagatcgttccgctcagttgaatgcgacggcgaagaaagtggcctgcggcgcggcggagaacgtcccgctgatccgcgtcaccaacctggcgcgcaccatgcgtctgctgcaggaagagaacgtctggatcgtcggaactgcaggggaagccgaccatacgctgttccagagcaaaatgaccggcccgatggcgctggtgatgggcgcggaaggcgaaggcatgcgtcgtctgacccgcgaacactgtgatgaattgatcagcatcccgatggcgggcagcgtctcctcgctgaacgtctcggtggctaccggcatctgtctgtttgaagcagtacgtcagcgcagctaaggtattttttcagaaaaagccatcttaaataagatggctttttttttacgtctattgctaaaatatacaacgaagttgatatagattgtatttattatttaatacttaatatatggaataatatatgggatggattcctcaagcgctcgcgagtgcgctccagcaggcggctgagttaaatgtaaaaattgattataacgatcattcatttatcattataatgaatgattacggcgatctacgacttaatgtgttattcacctcccgacaaataattatcgaaactattatctgtccgctgagcgctattcaacggcaggacttgtttaacgccttcattttacgccatcaaaaattactccctctctcctcggtcgcgatatcccgccttaagaatgatgaatattatgtcgcgtttggtgccctgtcgctcaattcctcgctggaagatgtggtgctggagatcgcgacgctggccgctaatgcattagatcttgctgagttgatagaacaatatacgaacaaataacaaggaatgctattgatgggaatattaaagagcctgtttacgctgggtaaatccatggtctcgcaggccggagagacaattgaggaagcgcagggcgtcaggatcctcgaacaacatattcgcgatgcaaaaagcgcactggataaagcaggccaatcgcgtgtcgacctgctcgcacgggtaaaactaagcaacgataaactgcaagatctgcgtgcgcgtaaagacacgctggaagcacgtgccctggaggcgctgaataaaaatgtcgctgcggatttgattaacgaagtcgctacagagattgcccgcctggaaaacgagattgctgtagaagagcgagtgctcgctaaccttgaattttcgcgcgatggcgttgagcaggccgttcatgcgacagctcaacgtatcgcccagtttgaacagcaactggaagtcgttaaggcgacggaagccatgcagcgggcgcagcaggcggtcacaacatccaccctcggggcgtcttctcgggtctccaccgcggcggaatcactccggcgtttgcaaactcgccaggcggaacgccaggccaggctggatgctgctgcgcaactagaaaaggtggcggatggaagcgaccttgttgagaagctcgcgcaagccggcattggtacaaccgacaaaagctcggctgaggatgtactggcacgtcttcgtcaacaacagagcaaatgattgcggccccacggtcagttctgtcctgatgggcgagtctttgaggagtggtcatggcccatttttttcagcgtctttttgctaaaaagagtacgccgactcccgtacgcggtccgctggggttacatcttaaagcgggttttacgctggataccctggcgtttcgtctgctggaggataaccttctgattgagctgccgggcgaggcatataccattgccgcgaccggtcaaattgatttggggggcggcagccggatttatcgttactacaccagcggcgatgagtttctgcaaattaatactactggtggggcggatgtcgatgatatcgatgatattaagctctttgtctatgtccaaagcgatggtatcagccaggaaaaatactggcgttcggcaatcagcccagcgagtattggtaccccgacatttagctggcgccagcagcgttggcagcgtttttttaacggcggcgagccagggaacattgcgccagtttatatgctggagaaagtcgaaaatcagcagcatgccgtatgggaggttcataattttacgatgggctatcagcggcaggtagcagaagaaatgtgggagtacctgctgctaaacggagaagagtcgtttaatgaccggggagaatctgaatggctcttctcgtacgcgttgggagtggatattccactcacctcactggatattattgggtaatttcacggaagaaaaatatgcacgttctgaactcattactggctttttgtacctatttttttatcggtgcagcgatggtgatcttgtttctttttatctattcaaaaatcaccccgcataatgaatggcagctgataaaaaataacaatacgtcggcctcgctggcgtttagcggaacgctgttgggatatgctattccattatccagcgcggcgataaacgccgtcagtattgctgattatttagcctggggtgtcattgccctggtagtacagctgattatctatggtggtgtacggctatatatgccggcgctaagcgaaaaaattattaatcacaatattgccgcaggcttatttatgggctctgctgcgctggccggcgggatttttaacgccgcctgcatgacatggtaatggacgatcatggctaaaaaacgtaaatccagatcccgtaatacggcgcaaaataaagcccaggccactcacgcttccctcgcgcgggttaatcgcccggcgagcgcggtgcaggcaaaacgaaaccgctacagcggcaaatacctgaccctggctattatgggcggcgcggcgttctttgcgcttaaggcctgtagcgatgatacgaatgcggataatggcggtgacggcgtgttttactcctccgtcaatgattgtatcgatgggggtaacagcgccagcgtctgcactcacggctggaacaatgcgaagtcggaattttttgcccatgtgcctaagcaaatgagccaggaaagctgcgaggcacagtatgtcgactgctattttgacagcatcgatcggagctggacgccgatgatgagcggttttttactcagccgggcggtgcgtaaaggtcgcgatgaagaatatacctattacaatggcggctcgtcctattcttccagggctgtctggcgaacatcgtcgggcgcgtatgcctggcgcagtggtaaaaacgatattgccaccagccatacgctgactgcgaaaaaaacggcgactgtttctcgcggcggctacggacgatcgtccagcgcgcgcggccattggggaggttgaacgatgctgcgacacactattcctgtacgcagggatctggatcggattgcggacgaacacggtttcgattttcatgtaattgacaacgagatttactgggacgagagtcgagcctaccgctttacattacgccagatagaagagcagattgaaaaaccgaccgccgaattgcatcaaatgtgcctggaggtcgttgatcgagcggtgaaggacgaacagctgttgcagcagctggcgatcccaccgctatactgggatgcgattgctgaaagctggcgccagggggatccttctctctatggccgtatggattttgtatggtgcggtgccgacgctccgcttaagttgctggaatataatgcggatacgccaacgtcactttacgaagctgcctggtttcaatggttttggctggaagacgccagacgcagcggggtgatcccgcgtgacgccgaccagtacaatgcgattcaggaacggctgattgcccgctttagtgaactttacagcccggaaccgctctacttttgctgctgtgaagggagtgatgaagatcgcacgacggtgctttatctccaggactgtgcgcaacaggccggtcaggaaactcgttttctctatgttgaagagctgggactcggcgtcggcggtatgctgaccgatttggatgacaacgttatccgtcgggcgtttaagctttatcccctggagtggatgatgcgagatgataatggcccgctgctgtgtaagcggcgagagcggtggatcgaaccgttatggaagagtgtactcagcaacaaagggttgatgccgctgctatggcggttctttccccgtcatcctaatctgctacccgcctggtttgccaatgaatcgccacagatcgcgccgggcgagagctatgtgcgtaaaccgatcttttcacgtgaaggcggcaacgtcaccatctttaatggtcagcagcagattatcgaacatgctgatggagactacgcagaagagcccatgatctttcaggccttccagcccttgccgcgctttggtgacagctacacgctgattggcagctggatcgtggatgatgaggcttgcgggttggggatccgggaagataataccttgatcactaaagatacttctcgttttattcctcactatataaccggctaaggctgcttttgtgatctctctccatcgccagtggccgggtcctggccatacttatggctatcgccattgatggagggagacacgatgcactggcaaacgcacaccgtttttaatcaacccaccccgctgaataacagcaatctgtttctgtccgataccgctctgcgtgaagcagtggtccgcgaaggcgccggctgggatggcgatctgctcgccagcattggccagcagctggggacagccgaatcgctggagctgggacgcctggccaacagcaatccgccggagctgctgcgctatgacgccaccggcgcccggctggacgacgtgcgcttccatcccgcctggcacctgctgatgcaggggctgtgcgcgaaccgggtacataatctcgcctggcaggaggatgcccgcgaaggcgcgtttgtcgcccgcgccgcccgctttctgctccatgcccaggtggaggccgggacgttgtgcccgattaccatgaccttcgccgcgacgcccctgctgcagcacgccctgcccgcgccctttcgcgactggctgtcgccgctgctgagcgaccgttacgatccgcaccttgcgcctggcggccagaagcgcggcctgctgatcggcatggggatgaccgagaagcaaggggggtctgatgtgctgagcaataccactcgcgcggagaaaacggcggaagggttttaccgactggtgggacacaagtggttcttctcagtgccgcagagcgatgctcacctggtgctggctcaggctccggcggggctctcatgcttctttgtgccgcgtctgctgcccgacgggcagcgtaacggcgtgcgtcttgaacgcttaaaagagaagctcggcaaccgctccaacgccagtagcgaagtggagttttatgaggcctgcggctggctggtgggcgacgaaggcgacggcgtgcggcagatcctcaggatgggcggcctgacccgctttgactgcgcgctgggcagccatgccctgatgcgtcgcgccttctcggtggcgctgtatcacgcgctacagcgtcaggcgtttggcaaaaacctggtcgaacagccgatgatgcgccagctgctggggcaaatggcgctccgtctggaggggcagaccgcgtttctgtttcgcctggcgcgggcctgggaccatcgggatgatgcccgggaaagcgcctgggcgcgcctgtttacgcctgcggccaagtttgccatctgtaaggccggtatcccgtttgtcgccgaggcgatggaagtgctgggcggcatcggctattgcgaggagagcgaactcccgcgcctctaccgtgagatgccggtcaacagcatctgggaaggctccggcaatattatgtgcctcgatgtgatgcgggtgctgagcaagcagccggcggcgatggagctgctggccgcggagtgtgcggaggtgaaaggacagaaccgccatctcgaccgcgcatggcgtcagctgcagcaactgctgaaacgacccgccgaagagcaggggagagagattgcccggctggtctatcgtcttggcgcgggggcgcagatgctgcgccatgcttcgccgccgctggccgaagcctggtgccggatgatgctcgacacccgcggcggcatacgtcttgacgcgccgaccctcgacgacctgctgctgcgggctatggggcgcgggcgccaggcgcctcaggcgtagagaatggcctgcacgcgccagctgtccggctgttgttcctcgtacatctgaataatgcgataccaggaggcgccttgctcgtctgctttgcgggcaatggcgtgctctacatcctgttggctaccggaaagattagtgacggagatcagaccgatttcattcaggccagtgacgcaatccgcgctggcgaattcggctgactgcgcggacgtattggccgtcgcagcggttaacagcaggctggatagggtaaaagatcgtttcatcgtcagctccatttcacgtagtcccaagggcagtccgttgctaacgtcctgccaggtggttggccgaacgttattatgcacaggagaacgtgaatggacgcaaagctgtgtaaagcagatttaaagacgccgcctcgttatcgacgatagaggatcgcctgcgaataccactggccgggtaccatggtgtcatcgatcatgatgatgacgtagtaatcggctttggccgcttctgctttggccttcagcgccgcttcgacatccatcggcgaaccgtacatcagtacgctcaccgtggccattttatgcaggccagccgtctggtagcgctggatctcctgcggatggtcggtggcgggcggcggggcttccggcgttccctgcagggcgctacacccgctgaggacgatagccagtaaccacggtgaaaacctgcgcataaccatatctcgtttcctgatagtgatagtgtagtggtagccttaacaggattgccggggaatgttcccgaactgttatctctgacgcgattttcgaatgaaaatgttgtgaaagcgtaaccgggttctcaacattatgaatcgtagcaaactgggttgcctggtgaatgaattttcccatgacgcctaaccacgatagagaaggaagacgataaatgattgcactagaaatgcgcaacctcggcggtggtgaaattttacatgcctgtccgcaggagagtctggataagcccttgccctgtatcgtcttttatcatggctttacctcgtcgaagctggtctacagctactttgcggtggcgctggccgaggccggattccgggtgatcatgccggacgcgccggagcatggggcgcgctatcagggcgatgaggccgggcggatgcagcgcttctggccgattctgcagcagaatttcagggagtttcctgcgctgcgcgaggcgataatcgctgaaggatggctggaaggggagcggctggcggtggcgggcgcttcgatggggggaatgacggcgttgggcatcatgacgcatcaccccgagctgaacagcgtcgcctgtctgatggggtcgggctattttcgttccctgtcgcaaaccctgttcccctcgcctgattttgatgtcgatagcctcaacgaatgggatgtcagccatcagctggcgtcccttgcccggcggccgctattgctctggcatggcgatgccgatgacgtggtgccgccggaagaaacctttcgactagaacaggcgctccggcaggcggatcttgccgccaggctgacctgtgtctggcagaaaggcgtccgccatcgcattacgccagaggcgctggctaccacggtcgccttttttcagcagcacctttaaacgcggattacgctgacgccctgatcctcaagctgtttgaggatcgcggcatcggcctgtttgccggtgatcaccacgtctatttgtccggcctggctgaatagcatcccggctcgctcgccgatcttgctgctgtcgaccagcaccgccagtttgccgaccacgttaagcattttttgctcggccatggcggtcaacatatccgttttgtagaggccttcggcggtgagccctttgccgctggtaaacatccagtgtccggcatagaggctgttctcgctaccgtgggggctgagggtgatggcgtggctgcggttgtactggccgcccatgataatcacgctgtcatgctcctggtcgatcaggtagttagccagcggcagatagttggtgatgatctgcaccggtttgccgcacagttcccgacccaacagaaaggcggtggagccgcagttaatgacgatgctctcacccggcgcgatcagttgcgaagcggcgcgtgcaatacgcactttttcatccagattttgcgcctggtggatgttcatcggcgtccagcgggggcgctgttcgctaatggcttccgcgccattacgaacctttttcagtttgccgctttcatccagcttgttgatatcacgtcgggcggtagcgggtgagatcccgagccgcgacatcacctgctccacggtaacaaaccccgtttgggcgagcagatccagcagaatttggtgcctttgcgcttccgtcatgagcgaatccgattaaaagtgaacggcaaagatgatatttgaaatcatgtgaaaatactaaccctgcggcggggtatttccggcaggcagggcctgccggcggcgacttacaggaaggatttgaaaggcagatccggctcaatggtgaagcaatcgttgaaaccgcgcgggtagtgatattcgaaattgtctttatccagcggccaggtaaatttgccgccgacctgccagataaacggcttgaagccgtacttcagacgatcctttttcatctcccacagaacgcggatctcctgcggatcggcctgaaagtttgaccagatatcatggtggaacgggatcacaactttggcgttgagcgactctgccatgcgcaggatatcggcgctggtcattttgtcggtgatcccgcgcgggttctcgccatacgagccgagggcgacgtcaatccgatgctcgttgccatgcttcgcgtagtagttggagtagtgggaatcgccgctgtggtacaggttgccgcccggtgttttaaacaggtagttgaccgcgcgctggtccatgccgtccggcagtacgccagcggctttttggtccgccgggagggtgatcagcgcggtgcgatcgaacgcatcgagcgcatggatctcaatgtctttgatcttcacgacatcgccaggtttcatgacgatacagcgcgctttcggcacgccccaaccgatccacaggtcgacgcaggttttcgggccgataaacggcacatcggccgggcagttctgcatgacggcggcggcgacgttgacgtcaatatgatcgttgtgatcgtgggtcgcgaggaccgcgtcaatctggcgaatggcgaacggatccagcacgaacggcgtggtgcgcaggttaggctgtaattttttcacgcctgccatccgctgcatctggtggccagttttcatcagcggattgccgtggctctgtttgccagtgccgcaccagaaatcgacgcagacgttagccccgccttcggattttaaccagataccggtacagccgagccaccacatggcgaaggtgccgggcgcaacctgctcctgctcaatctcttcattcagccagctgccccattccggaaaggtgttcaggatccatgattcacgggtgatggtctgtactttactcatcgtgctcttcctcgtattttcaatagtaatcaaattttgattggttttgatttatgttgtcactggattttcaagattgcaatcttgttttccatcaattttacgaagatatgcgcatcacctctcaagggttccagcatccataaaggttgtgcttttctttatctatatgatttgaaaatgtttaattatatttctgcgctactgatcggcaatagtcacaatgaaatagaggattattgcggcgcgcgtcacatttaatcaaattcaatcttgttgtgattatttttgattattagagtgggcagcgagaaatgctgagcgtaaggcgcgttcagcgccttcaccatcgggagtgtgttatggcaatcctctacaacatctttaccgttttctttaatcaggtgatgaccaatgccccgctgctgctgggtatcgtcacctgtctgggctatatcctgctgcgcaaaagcgtcagcgtgattattaaaggcacgatcaaaaccattatcggcttcatgctgttacaggccggctccggcatcctcaccagcacttttaaaccggtggtggcgaaaatgtcagaggtgtacggcatcaacggcgcgatctctgacacctatgcctcgatgatggcgaccatcgaccggatgggcgaggcctatagctgggtgggctatgcggtgctgctggcgctggcgctcaacatctgttacgtcctgctgcgccggataaccggcatccgcaccatcatgctgactggccatatcatgtttcagcaggcggggctgatcgccgtctcgttctttatctttggttacggaatgtggacgaccatcatctgtaccgccgtgctggtctccctgtactggggtatcacctccaacatgatgttcaagccgactcagctggtcaccgacggctgcggcttctccatcggtcaccagcagcagtttgcctcgtggattgcctacaaagtggcgccgtatctggggaaaaaagaggagagtgtggaagacctcaggctgccaggctggctcaatatcttccacgacaacatcgtttccactgcgattgtcatgaccattttctttggcgcgatcctgctttcctttggtattgacgtcgtgcaggcgatggcggggaaaacccactggacggtctatatcctgcagaccggtttctccttcgcggtggccattttcatcattacccagggcgtgcggatgttcgtcgccgaactgtccgaagccttcaacggtatctcgcaacgcctgatccccggcgcggtgctggcgattgactgcgccgcgatctatagctttgcgccgaatgcggtggtgtggggctttatgtggggcaccatcggccagctgattgccgtcggcattctggtaggcattggctcttcaattctgattattccgggctttatcccgatgttcttctccaacgcgacgattggcgtctttgccaaccacttcggcggctggcgcgcggcgctcaaaatctgcctggtgatgggcatggttgaaattttcggttgcgtgtgggcggtgaagctcaccggtatgagcgcctggatgggaatggcggactggtcgattctggcgccgccgatgatgcagggcttcgcctccatcgggttggcgtttatggctgtcatcatcctgattgctctcgcttatatgttcttcgctggccgcgcgctgcgcgccgaagaagacgcggaaaaacaactggcagaggcctctgcccaataaggagttctgattatgaccgtacgtattctggctgtgtgtggtaacgggcaaggcagttctatgatcatgaaaatgaaagtggatcagttcctgacgcaatccaatatcgaccacacggtgaacagctgcgcggtgggtgaatacaaaagcgaactaaacggcgcggatatcatcatcgcttcaacccatatcgcgggggagattaccgtctccggcaataaacacgtggtgggggtgcgtaatatgctttcccccgcggatttcgggccaaagctgctggaggtgattaaagctcatttcccgcaggacgtgaaataaggagcggctatgaaactccatgaatcactggcgcagaatcactccattcgcctgcaggcggaagcggaaacctggcaggaggcggtgaaaatcggcgtcgatctgctggtggccgccgacgtggtggaaccgcgctactaccaggcaatcctcgacggcgtcgcgcagcacggcccctattttgtgatcgctccgggattagccatgccgcacgggcggccggaagagggcgtcaaaaaaaccggctttgcgctggtcacgctaaagaaaccgctgattttcaaccacgaagataacgacccggtcgacatcctgatcaccatggcggcggttgacgccaccacccaccaggaagtgggcatcatgcagatcgttaacctgtttgatgacgaagccaatttcgaccgtttacgcgcctgccgcagcgagcaggaagtgctggatttaatcaaaaacgccaccgcggcggctgtttaaaaggaacactatcatgtcattacctatgttacaggtcgccctggacaaccaaacgctggccagcgcttatgaaacaacccgtctgatcgccgaagaggtagatatcattgaagtcggcactatcctctgcgtcggtgaaggtgtacgcgcggtgcgcgatctgaaagcgctgtatccgcataaaatcgtgctggcggacgccaaaattgccgatgccggcaagatcctgtcgcggatgtgcttcgaagccaacgccgactgggtcacagtgatctgctgcgccgatatcaacaccgccaaaggggcgctggatgtcgccaaagagttcaacggcgatgtgcaaattgagctgaccggcttctggacctgggagcaggcgcaggcgtggcgcgaggcgggtattcagcaggtggtctatcaccgcagccgcgacgcgcaggcggcaggcgtggcgtggagtgaggcggatatcagcgcgattaagcgtctgtctgatatgggcttcaaagtgaccgtcaccggcgggctggcgctggaagacctgccgctgtttgccgggatccctgttcacgtctttattgccggacgcagcatccgcgatgctgcctcgccggtggaagcggcgcgccagtttaaacgctctatcgcccagctgtggggttaaggagcgactatgttggcgaaatccattccgctcggcatctatgaaaaagcgctccccgccggggagtgctggctggagcggctaaagcttgcaaaagcgctgggctttgatttcgttgagatgtctctcgatgaaacggacgcccgccttgcgcggctggactggagcccggagcagcgtctggcgctggtcaaggcggtggctgaaaccggcgtccgggtgccgtcgatgtgccttagcgcccatcgccgttttccgctgggtagtgaagacgacgcggtgcggcatcaggggctggagatcatgcgtaaagctattcagctggcgcaggatgtggggattcgggtgatccagctggcaggctacgacgtctattaccagcaggcgaacgatgagacgcgccgccgctttcgtgacggcctgaaacagagcgtcgagatggccagccgagcccaggtaaccctggcgatggagatcatggactacccgctgatgaactcgatcagtaaagcgctgggctatgcccattacctgaataatccgtggttccagctttacccggatatcggcaatctgtcggcgtgggataacgacgtccagatggagctgaaggcggggagcgggcatatcgtggcggtacacgtcaaagacacaaagcccggcgtctttaaaaacgtgccgttcggcgaaggggtggtcgattttgaacgctgcttcgaaacgctcaagcagaccggctactgcggaccgtacctgattgagatgtggagcgaaaccagcgctgacccgctggcggaggtggcgaaggcgcgtgactgggtgaaggcgcggatggcccgcgcgggcctgatggaggcggcataatgcaacagctgaaacagcaggtgttcgaggccaatatggatctgccgcgctacggcctggtgacctttacctggggtaacgttagcgccattgatcggcagcgtgggctggtggtgattaagcccagcggcatcgcctacgagtcaatgaccgtcgatgacatgtcggtggttgatctgcaggggcacgtggtggaagggcgctggcgtccctcctctgataccgccacccatctggcgctctatcgccgttatcccgaccttggcggggtggtgcatacccattcgacgcacgccaccgcctgggcgcaggcggggctggcgatcccggcgctcggcaccacccatgcggactacttcttcggcgatattccctgcacccgggcgcttagcgcacaggaggtggacgaggcctacgagctgaacaccgggcaggtgattatcgaaacgctgggtgaggccaatccgctgcataccccggggatcgtcgtctatcagcacgggccatttgcctggggcaaagacgcccacgaggcggtacacaacgcggtggtgatggaagaggtggcgcgcatggcgtggattgcccgcggcattaatccgcagttgcagcccatcgatagctggctgatgaataagcattttcagcgtaagcatgggccaaacgcctactatgggcaaaagtagatagcgcgctccggggctttcacccctcacggtgaagcaactggtctggccccggagccgtttttaatcctgacgataggccgacggcatcacgcgcatgccgatgagcgtgaccacgcaaattatcgccccggcgtaaaacgtcgaggcggcgccgaaggtttcccacagtacccccgcgccggtgctggccagcagcagagccaggccactcatcagattaaacataccgaacgccgtgccgcgtagctccggtggcgccgtatgggcgaccatcgccgccagcaggccctgggtcattcccatatgaatcccccacagcgcgacgccgatcagcagcgtgctccagtggccgctgagcgccagcacgatatcggcgaggatcagcaccagcagcccccactgcagcagtttgctgtggctcatgctgtctgagagtttaccgaacgggtaagccgtgaggctgtagaccaggttcatcgccaccatcaccagcgggatggtaaagagcgggatctccatctgctgggcgcgcagcaccagaaaggcttcgctgaagcgggcgagggtgaaaatgctgccgatcgcgaccacccaccagtaggcggcggagagctttttcaggttttcgcgcttcagcggattgctgcgtttgtgcgcgatggcggattttggctcctgtaggccgaatccgagcaggagaatggagagcacggcgggaatgaccgccacccagaaaatagcgtgaaaatcgttggcccagataaacatcagcagcaccgccagcagcgggccgagaaaggcgccgacggtatccagcgcctggcgtagtccgtaggcggcgccgcggatctccggcggggtgacgtcggcgaccagcgcatcgcgcggcgcgccgcgaatacctttgcctacgcggtcaatcatgcgggcgctaaacaccaccccggcggtaggggcgatggcaaacagcggtttactgagcgcgcccaggccgtagcccagcagcgccagtcctttacgcttgccgacatagtcgctgattgcgccggagaagaccttcaggatcagggcggtggcttccgccagtccctcgataagaccgataattatcacgctggcgccgagggtagtggccataaacagcggtaagaggctatggatcatctcggaggagacatccatcagcaggctgacgccgccgagtacccaaacgcctttggggatacggcctaaggtggcgaaacgcggaaccatcaatcactcctgattatcaaatggcgagtggctgattaaatcaggttgcgatgacgctggtaagtcggtttgtaaaataattctcaattgcgtttgggcgcagacctcgcttcgcccctcgcgaggagaggcgaagaatcgggcaggcgttagcggtatatcaccgcgctggcgcgaagcgggccgttggtttcgggttcgtgcatcaggataggctgaaagtatttcgccccctgcgcatcgctcatctggctaagggcctgttcggcctcgtgctcagtggccatattgtgattgatatagataacgccgaggctctgcacgtcgtccatgttgcgggcctgacgttcggtgatttggatagctgccagcgcgttggcgctgaagaaaagcgcagccatcatggcgatgattttcagtttcatatactacgctcctgactgacagtcctgacgctgactcggggctctcctgtgatcgttgggctttgatagaagtgtaatcgctgcgcgttcatcgcatggcgaccttttctgatgcagttgttcaaaaaaatgccgcttcctttattggttaattttaaatcacccacttagcccagcttggcgcttagtgcgaattatttgtgcaaatgcgcttgtgttcctgaggggccgccattagaatgacgcgtcaatttttcagccgccctttaacacgttccttgcctccatgggccgcggctgacccagacaggaggctgaataatccgtaaggagcaattcgatgcgtcattacgaaatcgtttttatggtccatcctgaccagagcgaacaggttccgggcatgatcgaacgttacactggtgcaattactgcagcagcaggtacgatccaccgtctggaagactggggccgccgtcagctggcttatccgatcaacaaactgcacaaagctcactacgttctgatgaacgttgaagcgccgcaggaagcgatcgatgagctggaaactaacttccgcttcaacgacgccgttatccgcagcatggtaatgcgtactaagcacgctgttaccgaagcatctccgatggttaaagcgaaagacgagcgccgtgagcgtcgcgaagatttcgccaacgaaaccgcagatgattctgaagctggggattctgaagagtaatcctgatgaccaaccgtctggagctgtccggcattatttgcaggactccacttcgtaaggtcagcccgtcaggaattcctcactgccagttcgtgcttgagcatcgttcagtgcaggaggaagccggttttcaccggcaggcatggtgtcagatgcccgttattattagcggtcacgaaaaccaggccattactcacagtataacggtcggtagcgcagtaaccgttcgagggttcatctcttgccataaggcaaagaacggcttgagcaaaatggttctgcatgccgagcagattgaattgatagattctggagactagccatatggcacgttatttccgtcgtcgcaagttctgccgtttcaccgcggaaggcgttcaagagatcgactataaagatatcgctacgctgaaaaactacatcaccgaaagcggtaagattgtcccgagccgtatcaccggtacccgtgcaaaataccagcgtcagctggctcgcgctatcaaacgcgctcgctacctgtccctgctgccgtacactgatcgtcatcagtaatcggtcacggtccattaatacgactttgagaggataaggtaatgcaagttattctgcttgataaagtagcaaacctgggtagcctgggtgatcaggttaacgttaaagcgggctacgctcgtaacttcctggtcccgcagggtaaagctgttcctgctaccaagaaaaacgttgaattcttcgaagcacgtcgtgctgaactggaagccaaactggctgacgttctggcagcagctgaagctcgtgctgagcagatcaacgctctggaatccgtaaccatcgcgtctaaagctggcgacgaaggtaaactgttcggttccatcggtactcgcgacatcgctgacgctgttactgcagcaggcgttaaagttgctaagagcgaagttcgcctgccgaacggcgttctgcgtaacgttggcgagcacgaagtgaacttccaggttcacagcgaagtattcgctaaagttatcatcaacgtggttgctgagtaatcggcctctgacgttctggtaacaacaaaccgccggccttgtgccggcgttttgctttttagcgcctttcattttgcggcggcgtaacgcttgctgtcgtcttctctgctatcgcgcacgcacaaagctgccgttcgactggcgggtaaacagcacctgctggccgttgccggtatcgatagtgagcccggtgaccacgccgttggcgttctgccgaatctgcaccgtctgtccgctctgcaaagtacttagcggcttgccagcgccttcaacctgcgccatggcgtagacgtcagtggccggcagcccatgatcgcggaacagctgcgccagggttttgcctgactcgatgcgataggtccgccattgctgctcaatacccggcgcggactgctgtgatgaggattgataaggctgggtggcggcgggctgctgcgtctgcgcctgatccggctgctcatcctgaatcggctccggagcgaccggcgccatctgatcggcgtcgctcacggtaggcgtattagtgatcggcggcagcggaacggcctgattgccgccagcttgcggctgggactgcgactgtagattcaggttcgcttcacggctggtggacgccgggctttggctatcatcggagggaagcagaataccgataataaccaacaggaagccagcgataattccccggcggtgcatcggaggcagcgggtccaggaggcgaaaatgatccggggcgtgccagattttcgccagggtagatgtcagttcaaagcgcccgggcatggctttcctcctgctccgcatatttatatcctgctcatgagtatagatggctaacgtcctgatgaccggaacaaagtgaagttaacctgctgccgcctattgtttctttttcgctgagatttgtcatcatccgccgacaaagttttacccatttcgctatggctgttatgctttcgcacgcttttatcttgatggttatcacccaaaaaggaacgacgatggcaaccccaacttttgacactatcgaagcgcaggcaagttacggtatcggcttgcaggttggacaacagctgagcgaatccggcctgcaggggctgctgccggaagcgctggtggcgggtatcgccgatgcgctggaaggtaaccagccgcaggtgccggtggaagccgttcaccgcgcgctgcgtgaaatccacgagcgtgctgacgctgtgcgtcgcgagcgttttcaggccatggccgctgacggccaaaaataccttgatgaaaaccgcgagaaagagggtgtgaacagcaccgagtctggtctgcagttccgcgtactgacccagggcgaaggcccgatcccggcgcgtactgaccgcgttcgcgtgcactacactggcaaactgatcgacggcaccgtcttcgacagctccgttgctcgcggtgaaccggctgaattcccggtgaccggcgtgatcggcggctggattgaagcgctgactctgatgccggtaggttccaaatgggaactgacgatcccgcacaacctcgcctacggtgagcgcggcgctggcgcatcgattcctccgttcagcaccctgatcttcgaagttgaactgctggacattatctaaacagcagcggcttcctcttccccgcggcaggggaagccataaaaatagcgtaaaatccttaagttaaaaattaattggaattatgttttgcattcatcacgtatgggtgtatttttgtgagctatttcgcgttagatgagtgatataacactcactttaaacataaaattaacattatatctaaatcatagtattcatccctccgattcttacctaatatcgactagcccttgctggggttaatgacagacgacgggccatcagagcctgaacaacacagacaggtacaacaggaagaaatcacatggtagatcaggttaaagtcgctgctgtcgagcaggagccgactgaacaatcgctacggcgaaatctcacaaaccgacatattcagctgatcgcgattggcggagcgatcggcaccgggttatttatgggttctggcaaaaccatcagccttgccggaccatccattatctttgtttatatgattatcggttttatgctgtttttcgtgatgcgtgccatgggcgaattactgctgtcgaacctcgaatataaatcctttagcgacttcgcggccgatctgctggggccgtgggcgggctactttaccggctggacctactggttctgctgggtagtgaccgggatggcggacgttgtcgccatcaccgcctacgcgcagttctggtttcccggactctccgactgggtcgcctcgctggcggtgatcctgctgctgctgggcctgaacctggccaccgtcaagatgtttggcgaaatggagttctggttcgcgatgatcaaaattgtcgccatcgtggcgctgatcgtggtcggcctggtaatggtgatgatgcatttcaaatcgccgaccggggtcgaagcctctttcgcccacctgtggaatgacggcggctggttcccgaaagggctgagcggcttcttcgccggcttccagattgcggtgtttgccttcgtggggattgagctggtgggtaccaccgccgccgaaaccaaagacccggaaaagtccctgccgcgggcgattaactccatcccgctgcgtatcattatgttctacgtcttcgcgctgattgtgattatgtcggtgacgccgtggagctccgtggtgccgagcaagagcccgttcgttgagctgttcgtgctggttggtctgccggcggcggcgagcctgatcaacttcgtggtgctgacctccgcggcctcctcggccaacagcggcgtgttctctaccagccgtatgctgttcggtctggcgcaggatggtcaggcgccgaagatgttcgccaagctgtcgaagcgtgcggtgccggcgaagggcttaaccttctcctgcatgtgtctgctgggcggggtggtgatgctgatggtcaacccgagcgtgattgccgccttcaccatgatcaccacggtgtcggcgattctgtttatgttcgtctggaccatcatcctttgctcttacctggcgtatcgcaaaaaccgccctcagctgcatgagaagtcgagctacaagatgccgctaggtaaagtcatgtgctgggtgtgcatggccttcttcgtctttgtgctggtgctgttgaccctggaagacgatacccgtgaagcgctgatggtcaccccgctgtggtttgtgctgctgggcgcgggctggctgtttgccggcaaaaaacggctggcgaaataaacgaaaattttaacgttgcttgcaacggcccgtcataaaaaaggccacccagagtggccaaataagacggacaatgtcgagggcgcccgcgggcgcctttttctttactttccgccgagggcgcgcgggaacagcacattattttccaggctgatgtgttccatcagatcgtcgatcatctcgttgataccgttatacatcgccttccaggtggtacaggcttccggcggcggcgtcacgttgtgagtgatgtgcttaatgacttccagcagttcacccgcttcatcatgctcgctttccatcacgctgatcggccccccggcctgggcgcccattccctgtttaatcatcgggaacaggatctgttcctctttcatcatgtggctggaaagctcctgatgcagcatggtcaggtacttagtcagtcctttcggcacgttcggtttatcggcatggacgcgttcaaccttggtggcctgcaggatcagctccggcagctgttcacggtgccggtcgtgatagcgaacgatgatatggtcgataatctccgcgaggggcgccgcgcgccagtcgcgggagagaggctgttcggccagtttcgccagctcggcttcaatcaccgcgacatccagcgctttgcgcgacgcggcgcgcgccagggtctgtttgccgccgcagcagtaatccatatcgtattgacggaacagggcggaggcgcgcgggatggtcagcgccagctcgcctaaaggttggtcacggaaagccatagcagttacctcgtcatcaggaatataagatgtattttaaatgcatctttttggcgagggaataccccttaaggaggcgaggctactttttttcgtccgccagcggctgcagcatcggtttttccggtctggcgcgtacggcagagaccacgccgagcaccagcagcaggatcccgctcagggtcagcagcggcggtaagctttgccgcagcaggaaggtatacagcagtccggccagggtttcgaagacgataagcgggccgaggatcaccgtcggcagccgctggctggcaatattccagcatagcgcgccgacccatgagcagagcaccgcgatggccagcatcagcgtaataaacaccgccggacgcgggccgaagggcaggggaaacccggcctgctgaccgtgcagccaggcgcaggcggcgagatagccggccagcgaaaccggaagcgtcaccagcgcctgagcggtagcccacatcattggcggttgatgcgggttctcccgcagccagcgggcgttgcgcagagcataccaggcccagcagaccaccgatcccagcgccagcgcaatgccggagccgtagcgccacgggctaaaattcggcagcccctgacgcagctccgcgacgttaacgcagatcaggcccacggcgatgcagatcagcgccggaaacaggcgccgccacggcagcttcccgtcgcgctggctgtagagcagattggcgaacaccggcagtaccaccggcagcgtgccgataatcatggtggaaaccggcgccccggtgcgctgaatggcgctggccaggcagacgtaatagataaggttccccatcattgtcaggcccagcgcggtccaccagtcgtgccggctcaactggcgcagtcgcgcgcgcccgagccacgccagcggcagggcgatcaggcccagcgccagatagcgtcccatcgactgcagcatcgccggatactctggcaccagcaaaggcccgacgaaaattaaaccccacatcagccccgccagcagggcgtataacacaccactaatcatcattgcatccgttgtcattaccgttgtctgcagtgtagaagggggtcgggcaggaatattgtatgagattgcgcattagcgcctggcgacctgcttctgatagcgcaccggcgtaatgccgtaacgctgggtgaaggcgcgggtcaggtgggactggtcggtgaggccgacggctatcgccacttcggcggcgggcatgccgtgggtgaggaacgctttggcgcgccacagacggatggccatcagcatctgatggggcgttacgtgatagtgggctttaaactggcgctgaaagtggtacgggctcagcgccgccacctgcgccagctcgtcgagggtgatgggacgcatatagttatcgtgcaggtagtcgcgcacgcggtcaaagcgatgcccggcctcaccctgcgcagaggcatggtgggccagagggcggaaggcgtcgatgaggtcgagcagcagtccctgctgggccagcggatcgtcgctatgccacaggccataaatcagctggccaatctgtcgggaacgcaggggatcctcgcggaccacctcgctgaaccaccagtcgcgcaccccggtgatggcttccagacggtccggctccagataaatcatccggtagcgccagccgtcggcggtttccgcttcgccggtgtgcagctcgtcgggattcatggtgacaatggagtttgcggcggcaatatgctgactgccgcggtagcgaaagcgctccgcgccttgctcaatcacgccgatgccgaaggcttcgtgggtatggggttcaaaggcgtagcgggatatatgggcgtggtaaagctccaccccgggcagctgttcgagatggcgaaagcgcgcgcggtctttttcatcactaaattggagtggtacgccctgcatgcctgcctcccgacggttatcccttcaatatgagagaggaaccgccgggacgcaaccgcaaaagctgagaggggcggttacagaatgcctttcacgctttcagcaagggaggtggtcgggcggccgatcagcgtactcagggtgcggctgtcgtcaaacagtccgcctttcgacgcgccgacatcggaatccgccagcatatcggcaagcccggccggcaggccgacgcttttcagcgcggcggcgaaatcggcttcgctgaggttctggtagaccacgtttttcccgctttgcttgctcagctcggcagccaggtcgctcagcgtccaggcgttatcacccgccagttcgtaaattttgccttcatgaccctcactggcgataacgcgggcggcagcggcggcataatccgcgcgggtggcggaggcgattttaccctcgccggcggcgccgataaacacgccatgctccagcgccggcggcgcgctggccagatagttttcggtataccagccgttacgcagcagggcgtaagcgataccagagtcggccagcatctgctcggtttcgatatgctctgcggccagacccagcggcgaagtgtcggcatgcagcaggctggtataggcgatgaatttcaccccggcggctttggcggcgttaatgacgttgcggtgctgtacagcacgctggccgacttcgctggaggagattaacagcagtttatccacgccctgcagcgcggcggtcagcgccgcttcgtcgctgtagtcggcctggcggacaaccacgccctgctggctgagcgcctgggctttggccgggttgcggacaatcaccacaatctggctggcagggacggtgttaagcaggtcttgcagaacgtagtggccaagctggccggtggcaccggtaagagcgatcatgggtcttctccttcgtgtttattggcagttgtggtaagctaccaccttaactaacttttagtaagtacgtacaaaaaggtaagtgtgaaatggccgaaccgacgctgagcgagaaactgcgcaccggcaatttgtttgcggaacagtgcccgtcgcgcgatgtgcttaaacatgtcaccagccgctggggcgtgttgattctggtggcgctgcgcgagggaacccaccgtttcagcgatctgcgccgtaagatgggcggggtcagcgaaaagatgctggcgcagtcgctgcaggcgctggagcaggatggttttatcgaccgcgtctcttatccggtggtgcccccgcacgttgaatatagcctgacgccgctcggcctgcaggtgagcgagaaggtggccgccctggcggactggatcgaggttaatctgccctcggtgctggctaaccacggggagtgaaaatgtatcactccctgtagccccggtaagcgcagcgccaccggggaacaggcattacttgctcaaatccagctgataaatggcgaagccgatatcatcggtggccacctggcgcattggatactgcgctttctctttgataaacgccgcggctttgtcgccaggcgaggtctcaaaacgaatatccaacggcgtgttgctgtggatcggcgccagacgccagttgttatccgccgccggatggatcgcgccttccttcttcgattgcgcgccaatccacgccgccagcaccgaacggttttcatccggtgaggcgaaggcgatatggctctcaccggtgccggcgaatttgccgccgtaagcgcgatagttattggtcgcgaccaggaaagtagcctgcggatcaaccggttttccattgaaggtcaggtgcttaatacgctctgcctgcggatggatcatctgacattcgccgtcgtagcgggccggctgagtgacgtcgatctggtagttcaccccgtcaatgacgtcgaagttgtaggtgcggaagccgtcccagttgatcagcgactgcggcttgctgctggcgggatcgatctggttaaactgtccggcagagcattccagccactccttaacctctttcccgctgaccttcatcaccaccagggtgttggggtagagatagaggtcggcggcattgcggaaggtgagctggcctttctccacttcgacaaagctcgccggatcgtttttacgcccgccgactttaaacggcgcggcggcggagagcaccggcagcttcgccagatccgggtcgccctgaatatagtgttcgacgtaggctttctgcgccatgttgaccacctgcaccgtcgggtcgtcctgcaccagcgccagatagctgtacatgttgtcggcggacttgccgatcggcttgctgacgaattcgcgagtggcgtcatgatcggctttcagcaccgccaccagcttgccatcttcggccgccagtgatttcttcgccaccgcgtcatagattggccgcgcttccgctttactctgagttacctgccatttaccgctgtcgttatttagcaccagatcgaccaccccgagatgatcgccccacattcccggcatcaccgccggtacgccgttcagcgtccctttggcgatatccgcgcctttgatgttggcgaagtctttacccgggaacaccgcgtgggcatggccgaacataatggcgtccacgccgggcacctggcttaagtagtaaaccgaattctcggccatcgcctgatacgggtcggcggagaggccggagtgagcgaccactaccaccacatcagcccctttcgcccgcatctccgggatatatttgcgcgcggtttcggtaatgtcattgaccgtcaccttgccgttaagattggctttatcccaggtcatgatctgcggcggcacaaagccgatatagccgatgcgcagggtgtgggattgaccgtcgctgtccacgacccgggtatcctggagcaggtacggcgtaaacatcggttttccggttttggcatcgatgatattggcgttcacgtaggggaacttcgccccggccagcgccttgtgcaggaagtcgagaccgtaattgaactcatggttgcccaggttgccgacggcgtaattcagggtgttcatcgccttatacaccggatgtacatcgccctctttgagcccttttgccgccatatagtcgcctaacgggctcccctggatcacatccccgttatccaccagcacgctgtttttaacttctgcccgcgcctgttcgatcagggtggcggtacgcaccaggccgaatttctccgtggcggcatctttgtaatagtcgaagtccatcatattgctgtgcagatcggtggtttccatgatccgcaggtcgaccgtcgcggcgttgacgctggcggcgatcagcgtggccaggagcgttgcgctaaacttaatcatcagaggcgtccttttttatgagcgatagcacagaagaaaatgtatttatattctgttgcttacagaaatgtgaatcttgccagaaaagcgggcagagaaaccgccatcgttatcacagatagcggaactcgcggtgatgcgatataaataaaacaacgagttaacgccactgtaaccagacgaggtggagaatgttagaacaagtatgtcagcttgcacggaatgcgggcgatgccatcatggaagtctacgatggaaaccagccgatcaacgtcgccagcaagaaagatgattctccggtcacggcggcggatatcgcagcgcataaagtcattgtcagcggcctgcaggcgctggatccggataccccgatcctctccgaggaggacccgccggcgtgggaagtgcgccagcactggcagcgctactggctggtcgacccgctggacggcaccaaagagtttattaagcgtaacggcgaattcaccgtcaatatcgcgctgattgaaaacggcaagccgacgctgggggtggtctatgcgccggtgatgaaggtgatgtacagcgcgcaaaatggcaaagcctggaaagaagagtgcggcgtacgcaagcagatccaggtccgcgatgcccgtccgccgctggtggtgattagccgctcccatagcaacgatccggagctgcaggagtaccttgagcaacttggcgaacaccagaccacctcaatcggttcgtcgctgaaattctgcctggtggcggaaggtcaggcccagctctatccgcgcttcgggccgaccagcacctgggacaccgccgccggccatgcggtcgcggtggccgccggggcgcatgttcacgactggcaggggaaaaccctcgactacacgccgcgtgaatccttcctcaaccccggcttccgggtctctatttattaagcaatttatgcagcaggtcgatcacctgctgcacctcttgttgggtgagggcgccgtctttagcccactgcacacgcccgttcttatccagcaccacgatcgccgagctcttctcgtccagctgccaggccttccgcaccaggccgttgctgtcgacgataaattgcgaccatgggaagagctttttattactttcaatgctgttgcgtacaaacatcccggtgcccgggatggcgtcgtcagtgtttacaatggtggtggtctgatagcgatcgtgcgggaagcccgccgctttaatcgcctcgatcaggttggcattcttctcttttgctgacgagcgtccggcgatgtgctggaccacgcgcacttttcccgccagctgggcgctattccagtttttatagctaaacttttccttatccagaataagctctccccgatccgcgacgccaacgggcgccacgcgctggccgtcgacgaagttatgcgctgtggccagcagcgggagaagcagtaacgaggcggccagtatgctacgtagggtcatgcgcaatccttaatcatttttatgcaggtgatccgaccacttggtctcgtttaatcataagtgcgattggcggtgattacccgcaatgaggatgccagtttgcgtgttgacgcacaaattagtcgtaaaacggcgacttatacttacttcatcgtatgtctgaaacgaaaattctgaattattgtcatcaaagggtaaataaacttatacatactgggtccctctgagattctggactatagttttagggcattaaaatttgcgctcccaagacgtgggctaactgtggcaccacaagagcgtaaccctggcaggagagaagaatgaaaattttccaacgctacaatccgctgcaagtggcgaagtacgtgaagatcctgtttcgtggacggttgtacatcaaggacgttggcgcatttgaatttgataagggcaaaatccttatcccgaaggtcaaggacaagctgcatctgtcagtgatgtccgaagtcaatcgtcaggtgttgcgtctgcaaactgagatggcatagcctggcacgtagcagtacgtagtaggtaaaagacggctcccgatgggagccgttgatgtttttagcccttcatttccgcatagcgtttgcgatattcgcccggtgggatgccgttatgtttacgaaacaagcgggtgaaatagaccggatcgctgtagcccaccgataaagcaattttgttaagtgggagtgtgggataaccatttgggccataaaaaagggcggatggtcatccgcccttaggagagagaaaagattacgctcaggcgttctggctttccgccgtttccgcctgcttcggcaccagcaccgttggcttgttatcgatgcgggtcaccagcagctggtcgatacggtagttatcgatatccacgacctcaaacttatagccggagaacttcaccgcgtcggtgcgtttggggattttacgcagcataaacatcataaagccgccgatggtctcgtaattcccggactgcgggaactcgtcgatatccagcacgcgcatcacgtcatcaatcggcgtaccgccatcgatcagccacgagttttcatcgcgggcgacaatctgctcttccagcccctggccgacgaggtcgcccatcagggtggtcatcacgtcgttgagagtgatgatcccgaccaccagcgcgtattcattcatgatcaccgcgaagtcttccccggcggttttgaagctttccagcgcttccgacagggtcagggtgtccggcacgatcaacgtgttgcggatctgtacgccgccggtcagcaccaggctctggttcgccagcacgcggttcagcagatcttttgaatcgacgtaaccgataatgtggtcgatatcttcattacagacgaggaacttcgagtgcggatgttcggccactttattcttcaggctctgctcgtcttcgtgcaaatcaaaccaaatgacgctttcacgcggggtcatggaggaaggaacggtgcgggactccagctcgaacacgttctcaattagctcatgctcctgcttgcgcagcaccccggccagcgcgccggcctcgaccacggcatagatatcatcggaagtgatatcgtctttccgcaccatcggcagtttgaagatgcggaagatcatgttggccatgccgttaaacaaccacaccagcgggcggaagactaacaggcagaagcgcatcgggttgatgatgcgcagggccactgtttcgggcgcaatcataccgatgcgtttcggagtcaggtcagcaaacaggatgaacaagctggtgaccagggtaaaagagatgatgaagctcagctgctcggagagctccggcgacaaatacccgctgagcaggctatgaaacgccggtgagaaagccgcgtcgcccacaataccgccaagaatggcgacggcgttgaggccaatctgcacgacggtaaagaaggtgcccgggttctcctgcatcttcagcacccgctgtgcgttgacgttgccttcatcggccagcagtttcagtttgattttacgtgaggcagccagtgaaatttccgatatcgaaaaaaacgcactgacggctatcagacagagtattactaaaatactgtttaacatatcttttctgaccgttgaggccagatcctcggaagggaagttgataactcaaatgtggaatacataaaaaaccggtccgaaggcgctggaccggctgtcacactggctagtatagcgtaagggaatgtaaagccgccagagcgttcattgaccgcctcgctgttgaggcggaaatcagaattacgcctgaggcggcaggcagacgccaatgccgccgatgccgcaatagccgtgcgggtttttatacagatactgctggtgatcgtcctcggcatagtagaacggtttggcggtggcgatctcggtggtgatgtgacgggtatcgtgcgcgtcgttcatcgccgcctggaagcgcgcgaggctggcctttgccgcctccgtctgttccggggtcagcgggtaaatcgccgagcggtactgggtgccgtggtcgttaccctgccgcataccctgcgccgggtcgtgattttcccagaacacctgcaataactgctcatagctaatcacctgcggatcataaaccacgcgtaccgcttccgcgtgaccggtctggccgctgcatacttcgcgataggtcggattgggcgtatagccgccagtgtaacctgcggcggtgctgtaaacccccggcaattgccagaacaggcgctcaactccccagaagcagcccatggcgaacagcgccacttccatccccgccgggacgttggtcatcgagtggccgttaactgcgtggagcgtcgccactggcatgggggtattgcgtccaggcagcgcatccgcctgggcgacaagatgcgttttatcaaatagactcacggttggcctctcaatacagaaatcgtcgttaaggttgtaacgaagcgtgtcttttaacacaataaatacgcgtaatacgtctagattaatacataagaattatttgggttattgccactttttcaaccctatgttgttagggttttgttaagccgtggagcggcgccagtgtttcctgtagaggaaacagggatattcaggagaaaatgtgctaaaaatccgccagttatgtgtcaccagccttttgctggtcagcggggtcgccagcgcagcgaatgtgcgtttgcaggttgagggattatccggggagctggagaaaaacgttcgcgcccagctttccaccatccagagcgatgaagtcacgccggatcgtcgctttcgcgcgcgcgtcgatgacgccattcgcgaaggtctgaaagcgctgggttattacgagccgacgattgaatttgatttgcgtccgccgccgaaaaggggacgtcaggtgctgatcgccaaagtgaccccgggagaaccggtgcgcattggcggaaccgaggtgattctgcgcggcggcgcccgcaccgatagcgactacctggcgctgctgaaaacgcgcccggccatcgggacggtgctcaaccacggcgattacgacggcttcaagagctcgctgacccgcgtcgccctgcgcaaaggctactttgacagcgagtttcttaagagccagctcggggtctccctcgaccgtcatcaggcgttctgggatatcgattacgacagcggcgaacgctatcgctttggccacgtcactttctctggctcgcaaatccgcgatgaatatctgcaaaacctcgtgccgtttaaagagggcgactactacacctcgcaggacctggccgagctaaaccgccgcctggcggcgaccggctggttcagttcggtggtggtggcgcctgattttgctaagtcgcggaaaaccaaggtgctgcctctgcagggcgttgtctcgcctcgcaaagagaacaccgtggaaaccggggtcggctattccacagacgtcggtccgcgggtgaaagccacgtggaaaaaaccatgggtcaactcgtatggtcacagcctgacctccagcgtcagcctctccgccccggagcagcagttcgactttacctataaagtcccactgctgaagagcccactcgaacagtattatctgatgcagggcggttttaagcgtaccgacctcaatgatacccaggccgactctaccaccctgggtgtctcgcgtttctgggagatgtcgagcggctggcagcgagcgattaacctgcgctggagcctggatcactttacccaggcgaacgtcaccaacaccaccatgctgatttatcctggggtctcggtgaaccgcactcgctcccgcggcggcctgatgcctacctggggcgattcccagcgctactcggtggactattccaacaccatgtggggctcggacatcaacttcatcgtgatgcaggcccaggacgtctggatccgtaccctctatgaccgccaccgctttgtggtgcgcggcaaccttggctggatcgaagcggacaactttgacaaggtgccgccggatctgcgctttttcgccgggggcgaccgcagtattcgcggctataaatacaaatctatctcgccgaaggacgatgacggcaagctgatcggggcctcgaagctggccaccggctcgctggagtatcagtacaacgtcagtggcaaatggtggggcgccgtctttatcgatagcggcgaagcggtcagcgatattcgcgagagcgatttcaaaaccggcgccggggtgggcgtgcgctggcagtcgccggtggggccgatcaagctggatatcgcccggccgatcggcgacaaagaagagcatggtttacagttttacatcggtctggggcctgaattatgagtttatggaagaagataagcctcggcgtcttaatcgtgttggtgctcctgctgggaaccgtcgggttcctggtggggaccaccaccggcttgcatctggtgttcaaggcggcggatcgctgggtaccggggctggaaatcggcaaagtgaccggtggctggcgtgatttaaccctcgataatgttcgctacgaacagcccggcgtggcggtgaccgccggtcagtttcacctcagcgtcaggttgcgctgcctgtgggacagcagcctgtgcgtaaacgacatcgcgctgcgcgatatttatgtcgccgtcgataccaagaagatgccgccctcagcgccggtcgaggaagaggacagcgggccgctgaatctctccactccttatccgatcaccctcagccgcgtcgcgctgcataacgtcaacgtcaaaatcgatgataccgcggtctccgtacgcgacttttccaccggcctgaactggcaggagaaaaatctgaccctgacgccgacctcgctgcaggggctgctgatcgccctgcctaaggtggcgaaagtggcgcaggagcaggtggttgagccgaaaattgacaacccgcagccgcaggaaaaaccgctcggcgagacgatgaccgacctcttctcgcagccggtgctgccggcaatgaccgatgtccatctgccgctgaacctcaatattcaggcgttccgcggcgagcagctgcgcctgaccggcgataccgatatcaccgtgtataacctgctgctgaaagtcagcagtatcgacggccagatgaagctcgacgcccttgatatcgactccgatcagggcaaggtcagcgcctcgggcagcgcgcagctgcaggataactggccggtggacattaccctcgccggaaccctgaacgtcgacccgatgaaaggggagaaggtgcagctgaaggtgggcggcgaagtgcgcaaaacgctcaaagttggagtggacttaagcgggccggtcgcggccacgctgcgcgcggatgcgcagctggcggaggccgggctgccgctcaatatggagctgaagagtaagcagctcgcctggccgttcagcggcgagaagcagttccaggccgacgatgtccagctgaagttcagcggcaaaatgaccgactatgcgctggccttctccaccgcggtgaaaggtcaatcgctgccgccggcgaaaatcgccctcaacgccaaaggcaatgaacggcagatcaatctcgacaagctgacggtcaacgccctggaagggaaaaccgagctgaaggcgctgctcgactggcagcaggcgatcagctggcgcggcgagctgaccctcgacggcatcaacaccgccaaagaggtgccggactggccgtcgaagcttaacggccggatcaagacccagggcagcctgtacggcggcagctggcagatgtcggtgccggagctgaaaattaccggcaacgtgaagcagaacaaagtggatgtggcgggctcgctgcagggtaacagctatctgcagtggaaaatcccgggactgcatctggcgttaggcccgaacagcgctgatatcaaaggcgagctgggggtgaaggatcttaatctcgacgccaccatcgatgcgccgcacctggataatgcgctgccggggctcggcgggacggcgaagggcttggtaaaagtgcgcggcactgtcgatgcgccgcagctgctggccgacatcaccgcccgggcgctgcgctggcaggagctgaccatcgcccaggtcaacgtcaaaggggatgtgaaatccaccgatcagattggcggtaacctggacgtgcgggtggatcgcatcagccagccgggggtcaatatcagcctggtgcagctcaatgccaaaggtacagagaaacagcatgagctgcggctacgcgtgcagggcgatccggtttccggtcagctggcgctggcaggcagcttcgatcgtcaggccgaacgctggaagggctcgctgagcgatacccgcttccagacgccggtggggccggtagcgctgacgcgcagcattgcgctggactatcgcaatctggagcagaaaatcagcatcgggccacactgctggaccaacccgaacgccgagctctgcgtgcctgaaaccattgacgcgggcgccagcggacgggcgcgggtgaatctcaaccgcttcgatctggcgatgctcaagccgtttatgccggaggcgacccaggccagcggcgtgtttaccggtaatgccgatgtgagctgggacaccaccaaagagggactgccgcagggcaaagtgaccctcagcgggcgcaacgtcaaggtgacccaggtcgtcaacgacgcgccgttgccggtggcgttcgatacgctgaacctcagcgccgacctgcacaacaatcgcgccgagctgggctggcttatccgcctgaccaacaatggtcaactggatgggcaagtgcaggttaccgacccgcaggggcggcgtaatctcggcggcaacgtcaatatcagcaacttctcgctggcgatgatcaacccgattttcgctcgtggtgaaaaggcagagggaaggctcaacgcccgtctgcgtctgggcggcaatgtgaaaagtccgcagctgttcggccagatgcagctgagcggggtggatatcgacggcaactttatgccgtttgatatgcagccgagccagctggcgatgaacttcaacggcacgcgctcgaccctgcaggggacggtgaacacccgccaggggcaaatcgccctcagcggtaacgccgactggacgcagatcgataactggcgggcgcaaattgcggcgaaaggcagccgggtgcggatcacggtgccgccgatggtgcgtctcgatgtatcgccggatgtggtgtttaccgccacgccaagcctgttcaatctcgacggcaaagtggatgtgccctgggcgcggatcgtggtcaacgaggtgccggagagcgcggtcggcgtctcctctgatgaagtgatgctggataaaaacctcaagccgattaagcagcagagcgccagcatcccgatcaacagcaacctgaccattcacgtcggcaacaacgttcgtctggaagccttcggcctgaaagcgcgtctgaccggtgctttgaaagtggcgcaggacaagcaggggctgggcctcaacgggcagattaatattcctgacggccgtttccacgcctatggtcaggacttgattgtccgcaaaggggagctgctgttctccggtccgccggatcagccgttgctgaatatcgaagcgattcgtaacccggatgccaccgaagacgatgtgatcgccggcgttcgcgtcaccggctccgccgatcagccgaaagcggagatcttctctgatccggttatgtcccagcaggaagcgctgtcttatctgctgcgcggtcagggtttgagtagtggtcagagcgatagcgccgcgatgacctcaatgcttattggtatgggggttgcacaaagtggtcaggttgtgggtaaaatcggcgagacgtttggcgtaagcaacttggcgttggacaccgaaggggtaggcgattcttcccaggtggtggtcagcggctatgtactgccgggtctacaggtaaaatacggggtcggtatcttcgattccctggcgacgctgactttacgttatcgcctgatgcctaagctatatgtggaagcggtgtctggcatcgaccaggcgctcgatttgctctatcagtttgagttttagcaatgcgaatatttgtttacggcagtttacgacgcaaacaaggcaacagccactggatgaccaacgcccagtggctgggcgctcatagtgtcgacgattatcagctgtacagcctgggccactatccaggcgcggtgcccggcgaaggcacagtacatggtgaagtttatcgtattgatgcatcgacgctggccgaactggatgcgctgcgcaccaaggggggcgagtatgcgcgccacctgattcagacgccttacggcagcgcatggatgtatgtctatcaacgttccgttgagggttgtacgttgatagcgaacggcaactggttggatcgcgaccagtattaaccacgacagcgccaccttcgggtggcgttgttttttattacttcagttcccatggcgtcattctggcgccctgacgtctggcataacgtaatatggcctgatgtaccttcactctaccggccacccgacgtgacaggggatgggcaatcatacggacaaactccatcactattaacagcaggttaatcgggagcagggtgcctgtcagcctggtaagcatttcacgataaaatggccaactgcccagattaatcatggtgtcgtgcagtttgatggtgagcgtaaaaaacatcactatgagtacgaggccgtacgcgattttataaattgatgccatctgctgattgccgggatgaaaggggctattttttaaataaacactgccatcactgacattgtataacgcctgaagatcatcgtatccatgccggcgtgcggcgataacccagtccccatcggcaagaaatggcgggcgacaacgattattcagggcattgctcagccaggtcaagcgcgctgaaaaaaacgagtgacgagtcgccagctgaaaacaggcgccttctttgataaaataaggccttaccctcgtagcgatccatatttgataataactattcagaatcacgccttcttcaagcgcaaattcttttggcagcgctatctcgttgttggccgatggtggatgcctttcagaagtagcgggtagaatttccagacgctgacagaatgaaatatcgccttgcttcgttcgctgcattttcgcattgagaacacgtaacctgagtgagaaattgcaagagaaaaaagagaagatgccgaagggattcaccaacattgtgataaaacataataataaaaaaatatccaaccatggagcacaagcgagaatgatcaagcaaacaaaaaagaccaagccgacaggtcgaagaagctttttaatactcagcggctgccgggaaggttcgagcaaaatgtggccatcgcttaaccagtggatccagtaactgccatcctttaggcggcaagtgccgatatgtagcggctggccgagcctcagacggtcaaaaagcgaggggtctttaaaatggcgtttatcggtataaaaggcatgctcgcctgcaatgaggcgtaaatagctttgctcttcagaggcggcagtggtgaagccggtaaaattcacggtgaaataatgggtctgtttcacaaggttccttccttgatgaaatgatggtgttttacgtatcacgcgttgccgacccactccttaccagagcgggagatgatccttcgccagccacatcgcggaagccagcgtcgtcagcgcgaggaataataatcgtcgtgttggggtgctgaacattacatgatctcctcgagcgcggtatggcgggccgctccctgcaggtagtgccgcatcgccgagcgcatcttcatccagtcagccacccggtgtgacaataaccaggccgtcgggccaatcagctccagtaccgccaggatcccgccgaaactgagtaataatagggacagcatgtccagtgaatcctgaattaaccacccaaatcccctggctggtttgtatgggttatttagcgacatgccgagtatgaggaggtacatcaccagcaccatgccataaaacaggttatagactagcgacatttgccggtcaccgggataacagggatgatttttcagaaaagcgcacccgtcgctgacgttgtataacgccttgacgtcgttatctttccgttggtagacgacgactatccgatcgccgatagcgagaaagggcggttgacggcggtaaaaaaagggatgcaggccgaagttggcgaagccgttctgccagaagaaggccagcggcgccgtgtcgcattgtatcccaacgccatggtattcccgcgttgggttccccgcgaaccatttcttaaaaatgatattgctaatttttcccgtccggacggcatagcgttccggcagggcttgcgtaaaaggcttcgccgactggcggagggtttgcgccgtagtcggtagcggctggcaaaaggaaaagtcgcggcggcgggcctgcgccatcttcgccaacagatcgcgcatggcggggtgcatttttagcgcccggtggaacagtagctcgcagaggccggttaacaacgcgatgaaggccagtatcgcgataatgccgaagccgaaccttccccattctgaggtgatcatcatgagcgggataagagcgacgatgagcgtcagcaggctgatactcagcagcggccgggcccagcgctttacccgttgactgggctcaaggagcgtttcgccatcgctgagccagtggatccagtaactgccgttgtccaggcggcggacgccaaggtgcagaggctgattgatcgtcaggtggtcaaaaagcgaggggtcgttaaaatagcgtttatcggtataaaagacatggtcgccggcgataagacgcagatacccctgtttttcacaggcggcggtcgtgaagccagaaaagttaagggtgaaatagcgaacgcttttcacgggacaccctccatggtgttatcgcggctatccgtgccgcaatcaggcaggggatgaccctgcctgagacagaattacttctgcttagcgcgctcgaaagaggcaacgatttcggctttcgccgcttccgcgttgtcccaaccgtcgactttaacccacttgcctttttccagatctttgtagtgctcaaagaaatgagtgatctgggctttcagcagttccggcaggtcgttcacatcgttgatgtgatcgtattctttgctcagcttggtgtgcggtacggcaaccagtttcgcatcttcaccagattcgtcggtcatcttcagaacgccaaccggacggcagcggatcacggagcccggctgcagcgggtacggagtcgggaccagcacgtcaaccgggtcgccgtccagggacagggtgtggttgatgtagccgtagttgcacggatagaacattgccgtggacatgaaacggtcaacgaacagtgcaccgctctctttgtcgacttcgtatttgataggatctgcgttcgccgggatttcgatcacgacgtagatgtcttccggcagatctttgcccgcaggtacgttgagtaagctcatgtctgtttcctttaaaatgtatggcaaacaagtgctcggtattatagccaactcacatcgaaagtcttcgcttctttttcccgatatcgccgcagagtgctccgaatttttcgcgtaataatgacatgaaaatccataaacatagccacatcatgaataaatttatgtaaccgttttcattgcatttgattgatttatcatactgcttaaaaaaacgtcataaaccgcaacagccgcgctccctgcgaagccttatcggctctccgctgggcagtagggccatcattaacatctcatttacttttttgaagtgtgatgtaacgcattcagttacatcaccgattgtctatagtttgtccgcaggtgagactttaaccaacaataaccctacgaggatacccttatgtggaagcgcttacttcttgtcacagcagtttccgcagctatgtcgtctatggcgatagctgccccgctaaccgtaggtttttcgcaggtcggttctgaatccggctggcgtgcggcggaaaccagcgtcgcgaaagaggaggccgccaagcgcggtatcaccctgaagatcgctgatggtcagcaaaaacaggaaaaccagatcaaagcagtacgttcctttattgctcaaggggtcgacgcgatcttcattgcgccggtggtggctaccggctgggaaccggtgctgaaagaggcgaaagaggccaagatcccggttttcctcctcgaccgttccattgatgttaaagataaagatctctacatgaccaccgtgaccgccaacaacgtgctggaaggccagctgattggcgactggctggtgaaaaccgtcgacggtaagccgtgtaacgtcgttgaactgcagggcaccgttggggccagcgtggccatcgatcgtaagaaaggcttcgccgacgcgattgccaaagcgtcgaatatcaaaattatccgctcccagtccggcgacttcacccgcagtaaagggaaagaggtcatggagagctttatcaaagctgagaataacggcaaaaacatctgcatggtgttcgctcataacgacgatatggccatcggcgccatccaggccattaaagaagctggcctgaagccgggcaaagatattctgaccggctccatcgacggcgtgccggatatctataaagcgatgatcgctggtgaagccaacgccagcgtcgagctgacgccaaatatggccggcccggcgttcgatgcgctggagaaatacaaaaaagacggcaccctgccggagaagctgaccatcaccaaatcgacgctgtatctgccggatacggcgaaagaagagttagagaagaagaaaaatatgggctactgagtggggagcccctcattccatccctctccccggtgggagagggtaaaaagcagcgttccagaaaccccgggaagcccagcgcgacccggggtaacctgacatcatttgaaggtgacatcgattatgagcgccgaggcacaccaggagatccttcgcaccgaaggacttagtaaattcttccccggcgttaaggcgctggataacgtcaactttagcctgcggcgcggcgaaatcatggccctgttgggcgaaaacggcgccggaaaatcgacgctgatcaaagcgctgaccggcgtttaccatgccgatcgcggcactatctggctggaaggccaggctatttcgcccaaaaataccgcccatgcccagcagctggggatcggcaccgtctaccaggaagtgaacctgctgcccaatatgtcggtggcggataacctgttcatcggccgtgagccgcggcggtttggtctgctgcgacgtaaagagatggaggccagggcgacggcgctgatggcctcctacgggttttccctcgacgtgcgcgagccgctgaaccgcttttcggtggcgatgcagcagatcgtcgctatctgtcgggccatcgacctgtcggccaaagtgctgatcctcgacgagcccaccgccagcctcgatacccaggaggtggagatgctgttcaccctgatgcgccagctcagggataacggcgtcagcctgatcttcgtcacccattttctcgaccaggtctatgcggtcagcgaccgcatcaccgtgctgcgtaacggcacatttgtgggctgccgtgagacccgcgagctgccgcagattgagctggtgaaaatgatgctgggtcgcgaactggaccataatgccctgcagcgggcgggccgtaccctgctgagcgataaaccggtagcggcgtttgaaggctacggtaaaaaaggaaccatcgccccgttcgacctgcaggtccgcccgggagaaattgtaggcctcgccggcctgctgggttccggacgcacggaaaccgccgaggtgatcttcggcattaaaacggcggacagcgggaaggcgtggatcaaaggcaaacctcagaccctgcgctccccgcatcaggcttcctgcctcgggatcggcttctgtcctgaagatcgcaaaaccgacggcattatcgccgccgcttcggtgcgggaaaatatcgttctggccctgcaggcgcagcgcggctggctgcggccgatcccccggcgtgaacagaacgagatcgccgagcgctttattcgccagctggggatccgtaccccgagcgccgagcagccgatcgagtttctctccggcggcaaccagcagaaggtgctgctctcccgctggctgctgaccaaaccgcagttcctgatcctcgatgagccgacccgcggcatcgacgtcggcgcccatgcggaaattattcgcctgattgaaaccctctgcgccgatggcctggcgctgctggttatctcttctgaactggaggaactggtgggttacgccgatcgggtcattatcctgcgcgatcgccgacaagtggcggagatcccgctcgccgagctctctgttccggcgatcatgaacgctattgcggcataaggagtaacccatgatgcctcgatctctttcgcaaaccggcccggagaagcgacacttcacctggccgaagggcaccccgcagattattgccctgctgctggttctgctggtagacagcctggtggcgccccatttttatcaggtggtgctccaggatggccgcctgtttggcagcccgatcgatattctcaaccgcgccgcgccggtggcgctgctggcgattggcatgacgctggtgatcgccaccggcggcatcgacctgtcggtaggggcggtgatggcgattgccggcgcgacggccgcctcgatgaccgtcgccgggcacagcctgccggtggtgctgttggccgcgctggccgcgggcgcgctggccggattgtggaacggcatcctcgtggcggtccttaagatccagccctttgtggcgacgctgatcctgatggtggccgggcgcggggtggcgcagttgatcaccgccgggcagatcgtcacctttgattccccggccctggcgtggctcggcagcggatcgtttctgctgtttccgacgccggtgatcgtcgccgccgctacgctgctgctgttctggctgtttacccgtaaaacggcgctgggcatgtttattgaggcggtagggatcaacatccgcgcggcgaaaaacgccggcgtcaatacccgcatcgtggtgatgctggcctatgtcctgagcggcgtctgcgcggcgatcgccgggatcatcgtggcggcggacattcgcggcgcggatgccaataacgccgggctatggcttgagctggacgccattctggcggtggtcatcggcggcgcctcgctgatgggcgggcgctttaacctgctgctctcggtggtgggggcgctgattatccagggaatgaacaccgggattttgctctccggcttcccgccggagctcaaccaggtggtgaaagcggtggtggtgctgtgcgtactgattgtccagtcgccgcgctttatcggtttactgaaaggggtacgcggccatgataaaacgtaatttaccattgatgatcacccttgcggtgtttgtgctgggctacctctactgcctgacccagttccccggttttgcctcaacgcgggtgatctgcaatatcctgacggataacgccttcctcgggatcatcgccgtgggcatgaccttcgtgatcctctccggcgggatcgatctgtcggtggggtcggtgatcgcctttaccggcgtcttcctcgccaaagcgattggcttttggggaatctcgccgctggtggcctttccgctggtgctggtgatgggctgcgccttcggcgcgtttatggggctgctgattgacgccctgaagatcccggcctttatcatcaccctcgccggcatgttcttcctgcgcggcgtgagctatctggtgtcagaggagtcgattccgattaaccatccggtgtacgacaccctgtccgggctggcatggaccattcccggcggcggtcgtctcagcgccatgggactgctgatgctgctggtggtggtggccggtatttttgtcgcccatcgcacccgctttggcaaccaggtgtatgccatcggcggcaacgccacgtcggcgaatctgatggggatttcgactcgcagcgccacgatccgtatctatatgctctccaccggactggcgacgctggccgggatcgtcttttccatttatacccaggcgggctatgcgctggcgggcgtcggcgtcgagctggatgcgattgcctcggtggtgatcggcggtacgctgctaagcggtggcgtcggtaccgtgctgggaacgctgttcggggtggcgatccaggggctgattcagacctacatcaacttcgatggcaccctcagctcatggtggacgaaaatcgccatcggcattttgctgtttatctttatcgcgctgcagcgtgggctgaccgtgctgtgggaaaatcggcagaatgcggcggtgacgcgggtgagcggggcggggagtcgctaagaaatgctcctcccgcaggcgcgggaggagcgggcagggcgcttaggcgtccgggaacgctttaataaagttctcgacgtcttctaccatgtggttgttgccgacgaagaaggagcgacgctgatgcaggctttccgggataatatccagaatacgctctttaccgtcgctggccttaccgcccgcctgttcggcgaggaaggccatcgggttgcattcatacagcaggcgcagcttgccttccgggtggctggcggtgctcggatagagatagatgccgcctttcagcaggttgcggtggaagtccgccaccagcgagccgatatagcgtgaggtataaggacgctgagtcgctttgtcctcttcctgacagtacttaatgtacttcttcacgccctgcgggaatttgatgtagttgccttcgttgatggagtaggtattgcccttctccgggaagcgcatacgctcctggcatagacagaagacgccaagggacgggtcgtaggtgaaggcgtgaacaccgcagccggtggtatacaccagcatcgtcgacgatccgtagaccacatagcccgcggccacctgcttgttgcccggctgcaggaagtcttcttctgtcaccggcgtgccgacaggcgtcacgcggcggtagatagagaagatcgtaccgacagagacgttaacgtcgatgttagaggagccatccagagggtccatcagcaccacgtatttggcgtgttcacacccttcgaagacgacaatctcatcttcttcttcagaggcaatcccggcaacaatatcgcgtgctcgcagtgcggcttttaatttttcattagcgaacagatcgagtttttgctgaacctcgccctgaacgttttcagcaccgctggcacccaggatatcgaccagaccggccttgttgatatcgcggtggatgatcttggcgcccaactttattgctgacaacaaagcagtcagctcaccggtggcgtgggagaactcgtgctgcttttcaacaataaactcacctaacgttttcataactcgttccctgcatttttatgttgagtaaaacgaacgcaacaatcttaacaaagaatcaaaaaagtgcgcacaggtgaatcgcgccagcaaaatacagattcgcctgaaatgcatttcgccagggcccgggatatgggtaaaatgtgccccggataagaaaaggaaatgacgaatgcgcattcatattttaggaatctgtggcacgtttatgggggggctggccatgctggcgcgctccctcggtcatgaggtaacggggtcggatgctaacgtctatccgccgatgagcaccctgctggaaaaccaggggattgatttaattcagggctatgaccccagccagctggagccccggccggacctggtgatcatcggtaacgccatgactcgcggcaacccgtgcgttgaagcggtgctggaaaataatattccctatatgtccggcccgcagtggctgcacgacttcgtgctgcgcgatcgctgggtgctggccgtcgccgggacccacggcaaaaccaccactgccggcatggcgacctggatccttgaagcctgcggctataaaccggggttcgtgattggcggcgttccgggcaatttcgacgtctccgcgcgcctgggcgacagcccgttcttcgtcattgaagccgacgaatatgactgcgccttcttcgacaagcgctccaagtttgttcactactgcccgcggacgctgatcctcaacaaccttgagttcgaccacgcggacatctttgatgacctgaaggcgattcagaaacaattccaccatctggtgcgcatcgtgccgggcaaaggcaaaattatcctgccggagaacgacatcaacctgaagcaggtgatggcgatgggctgctggagcgagcaggagctggtgggcgagcagggccactggcaggcgaaaaaactgaacgccgacgcctcgcagtgggaagtcttactcgacggtgaaaaggtcggcgaagtgaagtgggcgctggtcggcgagcataatatgcataacggcctgatggcgattgccgcggcgcgtcacgtcggcgtgctgccggcggatgccgcgaacgcgctgggcagctttatcaacgcccgccgtcgcctggagctgcggggcgaagccaacggcgtcaccgtgtatgacgatttcgcccatcatccgacggcaatcctcgccacgctgcaggcgctgcgcggtaaagtaggcggtaccgcgcgcattctcgccgtgctggagccgcgctctaacaccatgaaaatgggcgtctgcaaggacgatctggcgccgtctctcggccgcgccgatgaggtgttcctcctgcagccgcagcatattccgtggcaggtggcggaagtggcggaagcctgcgtccagccggcccactggagcgccgacgtcgataccctagcggagatggtggtcaaaaccgcccacccgggcgaccatatcctggtgatgagcaacggcggcttcggcggcattcatcagaagctgctggataagctggcgcaaaaagcggccgcggctgaataagcgcgtacgcctccggtcactgccctccgcgtgagggcagttttgttttagctaccaggaattgtgtgatgctgacctgcgaaagcgtacgttctactgactcgccccatttcgccatgctggacgcgctttacgcgcgcgcctttccgtggcacgagcagcgcgaaagcgaggccaaacgtcaggcgctgagccacccgcgctacgcgctggaagcatggttcgatgaaggcgtctttgtcggcctcagcggctgctggcagtttgccggctacggttatatcgaacatctggcgatcgacgacacgctgcgctcccgcggctatggtaaacagctgctggcgcagatcctgacgcgcgccccgctgaccattctggaaatcgatccgctaaccacggccatcgcccataaacggctgcgcttttatcagtcgatggggttccatgctaatccctgggcgcatcatcacccgagctatcatcagggcattgcggatcatgagctgctggtgctgagctacccgcagccgatcgatgagcggcagtatcagcagtttgcccgggatctcgggcacgaggtgatggggcgggagtagcccggctcggcgtaccgctccgggcattcgactggcggcgctgttactctttggcgatcggcgtctcgttctccgcgactttgttatcgccctgaatcttagcgattttctgctcaacggcggctacctgggcgctgtcgtgcagcagggtgtaggttagatcaaactgcgcgctggcgcccggctgcagctgcttcacgcgtttttgctcgcgttcaatggtcaccggataggcgtagctggtccccggctcgataccggtgacatagccctgcttgacggtatcggtgtttttccacagcgtcaggaccggcagctgacgggtatcaaactgaatagaggcccctttatcgcccgctttgttgaccacggcggccagggtctggtgattttcatcggccagcggctgaatattaaataccatctcgtcaaaatctttggtcggtccctgataggtctgccaggtttttaacccgctcttcgcgtaatcattgaacgggctgatgctggacatcggggcgaggaaacgcgcgccttcttcgaggatcggggtgccgaagttgctgtggtagatgatctgataatcatgcggatagtcggcatggttggttaagacgtcatgtaagctgaagctgttgctgcccggcacgtagcgcagttcggtcagggtctgcagatcggcttttttaaaggtgctctctttcaccagcccgcggatgcggatttcatacggcgcgctgtcggccacctccacctccaccagagaggccggcgtgttgcccgccttgccgtgtagggtataaatttgcccgtccgcggtcaccggatggccggtccattcatagccgcagcggaccatcatctcgttgaatccttccagccagccgaggccattgcggctttctaggttgataaacgccgggttgacgacctctttaaccggcgaatcccagcccatccggctgccgaaaccctcaatacgcagcaagttcatgccgcgtgtcgggctcagggtgatggtcaggccgtctttactgtgaatggtgaggattttgctgccttcctgcttaccgccgtgcaggactttttgctcaatgctgaacgcatggtctttcaccttcagctgatcgctgttgatctgccagtttcctttatccatcccctcttcagcgttcgtcagcacccatgtttttgccgcggccgagccggaaaccagcagggcgatcgtcgtcagaaccaatgtctttttcatttttattccctttttgctgaatcgattgtgtcattgacgtgtgaaatctaccggcatgggggtgattaaaatgtgaagcgcctcacctggtgagaaagtggccgtttttatgatgttaaatgagatgaaagtcgtattattttgctaagtaatacgtatttatcaccaggatatgtgatctatattgtttttagctttaacgattcagcttggcggtaaggcaataaacaaacgtatcgtcgtgtggatgaggggactcaggcgatgcgacgggaatccccctgctggcgcaagccttagagctggggtgaaggtaggccggataaggcgtagccgccatccggcacaacgacgggaacggggtctggtacagcttgcccggcggcgctgcgcttgcgcgggcctacggtgttgagtaactgtttgatatacagggctccgtaggccggataaggcgtagccgccatccggcacaatgacgggaacggggtccggtacagcttgcccggcggcgctgcgcttgcgcgggcctacggtgttgcgtaaccgtttgatatagggaaccgtagcccggataaggcgcagcgcgccgccatccgggagactattgcgggcaaaaacagggggacttagccttcgttttccgccagttcacgcagatactggaagatcaggcgcgccgatttcggcggcttgttgccttctttctctttcttcgcattgcggatcagcgaacgcagctgctgacggtcagcatctggccacaggttcagcacttcagcgacggcgtcatccccgtcgtcaatcagtcgatcgcggatctgctccagcttgtggaacagcgcaacctgctggttgtgacggtttttcagcttgtccagcgcctgacgaatcggatcgacatcgcggttgcgcagcatcttgccgataagctgtagctggcggcggcgaccctcttttttgattcgctgggcgagttcgatggcgtcgcgcaggtcggtatccagcggaattttatccagcgcgtttttccccaggtcaacgagttccgcgccaagacgcttcagttcttccgcgtcgcgcttaatttcactcttactgacccagatgatttcatcatcttcatcttcaacgtcatcaccgggcacgtcgtcgagccagtcttcgggctgctttgtcatctcaggctccttaaaaaaagaggctaatgttaccagttaaggcgcgcactgaaaaacggttctctgttagacttcagttaactccttcttacattatggcattagcaatgaaagtcatctctcaagttgcacagcagcgtaagacgctggaagaagccgttaccacggcactggaactggcggcaggtaaatctgacggtgcggaagtttccgtcagcaaaaccacgggcatcggcgtcagcacccgctatggcgaagtggagaatgtagaattcaacagcgatggggcattaggcatcacggtttaccatcagaaccgcaagggcagtgcctcctccaccgatcttagcccggacgctatcgcccgcaccgtgcaggcggcgctggatatcgctcgctatacctccccggacccgtttgccggcgtagccgataaagatctgctggcctttgacgccccggatctggacctgttccacccggcggaggtctccccggacgacgccatcgaactggccgcccgcgcggagcaagcggccctgaaagccgataaacgcatcaccaacaccgaaggcggcagctttaacagccactacggcatcaaagtgttcggcaacagccatggcatgctgcaaagttactgctcgactcgccactccctctccagctgcgtcattgcggaagatgacggcgatatggagcgcgactacgcctacaccattggccgggcgatcgaggatctgcagtccccggaatgggtcggggaagagtgcgcccgccgcaccctgtcacgcctggcgccgcgtaagctgtcgaccatgaaggcgccggttattttcgccaacgaagtggcgaccgggttgtttggccacctggtcggagcgattgccggcggcgcggtctaccgtaaatcgaccttcctgctcgattcgctgggcaaacaaattttgccggagtggctgaccattgaagagcatccgcacctgctgaaagggctggcctccacgccgttcgacagcgaaggcgtgcgcaccgaacgtcgcgatatcgtcaaagacggcgtgctgacccagtggctgctgaccaattactcagcgcgcaagctggggatgaaaagcaccggccacgccgggggcatccacaactggcgcattaacggccgcggcctgagttttgcaaagatgcttaaagagatgggcaccggtcttgtggttaccgaactgatggggcagggtgtcagtggcgtcaccggcgactactcacgcggcgcatccggcttctgggtagaaaacggcgaaattcaatatcctgtcagtgagatcaccattgcaggaaatctgaaagaaatgtggcgtaatatcgtgaccattggcgatgatattgaaacgcgcagcaacattcagtgcggttctgtgctgctgccggagatgaaaatcgccgggcaataacacctgtttgcttaaataataaaaaggaagtgagcaatgcgtaaaaaactgttagcgatgctggctgtctctgcttttgcgctcggttcagcgtcggccttcgccgacctgggcgaagacatggacactctggcagaaaacctgcaagtggtacagaagacctccgacgccggcgagctgaaagcggcgctgaataagatgcgtaccgccgcggtcgatgctcagaaagagaccccgccgaagctggaaggcaaagcggccgacagcgctgagatgaaagattaccgtcacggtctggatattctgatcggccagatcgacggtgcgctgaagctggcgaacgaaggcaaggtgaaagaggcgcaggccgccgcggaggagtttaaaaccacccgcaatacctatcataagaagtaccgctaaccgttcttttcgggaggcatcagccgatgcctcccacctgaaagcctaccgatatcacatttttcccttttctttttccggtctttctgcggtcgttttccgctaaacctcgatcattgttgtgatgcgcatcacgtcatatcgcctgtttttacatttatccggcgaatatgtggagtcgatcacctaagccttctccctttccacttcgaagtggaaaacaactcgctacaaactcctgacccccggcgctactttggattccagagacatcagcggggtaacacaagtgaataacggagcggtaataaacgacgtaggggagcaggcggcgcagaccgaacgcctggctgacaagatgttacagcaggtattcgccctgttaagccgtcacgacatcgtccctaacgacgttcaggagcaaatgctgacttcccacgtgcgggccatggcccaccggtcaatcagcggcgaaccgctaccggaagtggatgccagtctgttcgaagaaatttctgaagattcaatgatgctggcccgcgaagtggtcgcacagttcggcaacctgcctgatgaagaggcctggctgctctccgtccacttcgaagtcgcgaaagataacctgtaaggagcaaaacatggaacaaatcaccgtagtcattggcgaccgtctgggtaaaggccaaaaagtcgccgcaggcgctgaaaaagcgggcgcacgtgctgtggtcgtccctggcgttgcggccgacatgaagcttggcgacataatgaaagcggaaaacgccaccttcggcatctccttctgcggcagcggcggcgccggcgccatcaccgcccagaccaaatacggctacaaagcaaaatatggcatgcgctctattgatgagggcgtcaccgctatcaacgaaggctgcaacgtgctgggcttcggctttatggataaagaagagctgggcgagcggctggtcgaagcctggaaaaagaaatacggcgcataagtatgaaagagcaattcaccaccacggtgagggttgccggcaaaggcgaaagcaaatcacgggccttcgccgatgccctgaaccatgtgcaggctgcggtgatgaaatcatcctcgcgcatcctactgcgtattgagccacaggacgtgacggttgttcatgcgcgcgaagcggtacgaaaagaggcgtttctgttcttctttttgcgccgtgaacgacggacctacagcgtggagctggacgtcaccgtcaacgtgaccgccatcgatctcgataaagtggatttcgtcacgcaaacctgattgttagcaaaaggtctgactatgttcctgataattttaataaaatcgcttatcatcggcggcctggtcggcgtcggcgtgggcgccggagcggcacgcatgtttcatgcccccaccacgcaggggatgggggcgtttcgaaccctgggcgagctgaattcctgtgagggcgatccggcctcccacttctcctttggccttggcttcttctttaacgcctgggcctcttccgttgcagcaggctccttcacccaggatgttgaccaccgcattatccccaactggggcgcggcggcgctgatgctgaaaaatcgtaacgtcggcgaaacgctgcacgatccgaaaaaaatggccatctcctgcggcatcatcggcatgatcgtcgtcgccttcctcaacctgaccgcctcgtccgtaccggaagcgctgcaggtgaccgccgttaaggtactggtgccggcggcaaacctgctggtgaacaccgtgatgccggtgatcttctggctggcggcgatcgatgccggtaaaaaatcaggcttctgggcgacgattttcggcggcgccgcgcagctgattatgggtaacgccgtaccgggtctggtgctggggatcctgatcggtaaaggcgtcgaagagagcggctggaaccgggtgactaaagtgatgatggtggccatcgtcgcgctgtttgtcctcagcggcttcttccgtggcttcgacatgaagatgatcgaatccttccatctgaccgtgccgaactggctggacatgatccacaactcactcagcggcaagtaacgggagccggataatggaacagaataaaggtttttggtatgccgactggtcgttcccgatctttgttggcctgctctcctccggcgtcttcgccgggacccacatgtactacctgtacggcatcggcgcctttaacgaagtggccttcgtggcgatgctgaagtcggggattgataccggcgtttacggcgcggtggcggcgtttggcgctagcttccttttcgcccgcatcatcgaagggtcgctggtagggatcctcgatatcggcggcgcgatacagaccggtatcggtcttggcgtgccggcgctgctgctcggcgcgggctttgtcttcccggtggcgaacttcgccgcgtcgctggtcaccggtctggtcctcggcctggcggtgggctacatcatcattctggcgcgtaagttcaccatcaaccagagcgattccacctacggcgccgacgtgatgatgggggccggtaacgcctccggccgcttccttggtcccttgatcatcctcagcgcaatgaccgcctcgattcctatcgggattggctcgctggttggcgcactgctgttctacatctggcagaaaccgatcaccggcggcgccatcctcggggcgatgatcctcggttccatcttcccggtggcgattagctaagcgcccgatggcgctgcgcttatcgggcctacaagccagcgcggtttgtaggccggataaggcggtacgccgccatccgtacactcttttcatcaggagatagctatgtttgatttactcctgcgccgcgcgcgcctcgtcgacgataccctgactgatatcgccattcaggacgggaaaatcgcggcgctgggcgagattagcgcgccctcccgtaaaaccattgagctgaacggcaaggtttacgtcagcgctggctggattgactctcacgttcactgctacccgaattcaccgatttatcacgatgagccggatagcgtcggcatcgccaccggcgtcaccaccgtgatcgatgccggcagcaccggcgccgacgacgtcgatgacttctatcaactgacccgtaaagcggcgacggaagtttatgcgctgctcaacatctcccgcgtcgggctgattgcgcagaatgagctggccaatatggccaatatcgacgccgccgcggtgaagcaggcggtgcagcgtcatcccgactttatcgtcggcctgaaggcgcggatgagcagcagcgtggtgggcgaaaacggcattacgccgctggcgcgcgccaaggccattcagcaggaaaacgacgatctgccgctgatggtgcacatcggcaataacccgccgaacctcgatgaaatcgccgatctgctgagcagcggcgacatcattacccactgctataacggcaagccgaaccgcattctgaatcctgccggcgagctgcgcagctctattactcgcgctctgcagcgcggcgtgcgtctcgatgtcggccatggcaccgccagcttcagctttgaggtggcgcggcgggcgattgcgctgggcattctgccgcacaccattagctccgatatttactgccgcaaccggatcgacggcccggtgcgctcgctggcgctggtgatgtcgaaattcctcgccatcggcatgacgctgccgcaggtgattgactgcgtgaccgtcagcgccgccgaagggctgcgcctgtcgcgtaaagggcggctggaagtgggcttcgacgccgatttaacgctatttcgcctggagcaccggcccacgctgctggtggatgccgaaaaagagagcctgcaggctgacaacattctggtgccgctggccgcgatccgcgcgggcaaaggctatctgaccgaacaagggagcgcggaacatgccttcgatttttgagaaataccatttaaaacaggtgattaatacttctggccgcatgacggcgctgggcgtttccacaccgcgcccggaagtggttgaagccgcgatggccggtatgaaccagtactttgaaatgaaagacctggtgaataaaaccggcgagtacatcgccaaactgttggatgtggaaggggcgaccgtggtctcctgcgcatcggcggggattgcccagtcggtagcggcggtgctggtgaaagacagcgactggctgctggagaacctgcacgttacgccgattgaaaataacgaaatcgtgttgccgaagggccacaacgtcaacttcggcgcgccggttggcaccatggtggcgttgggcggcggtaagctggtggaagcgggctacgccaacgaatgttctgcccaacagctggcggcggcgatcactccgcgcaccgcggcgattctgtacatcaaatcccaccactgcgtgcagaaaagcatgctcaacgtcgcgcaggccgcggaagtggcgcgccagcataacgtaccgctgatcgtcgatgcggcggcggaagaagatctgcagtgctactaccgcatgggcgccgacctggttatctacagcggcgcgaaagcgattgaagggccgaccagcgggctggtgatcggcaaaacgcagtacgtcgaatgggttaagcgccagtcgatggggattggccgggcgatgaaagtgggtaaagagggcattctcggcctgacctgcgccattgaacactacctgacggcgagcaaagagagcggcgagcagatggtggcgaagatgacgccgtttatcgaacagctcaacgcgcttaacggcgtgaccgcgcgggtggtgtgggacagtgcgggccgtgatatcgcccgcgccgaaattaaatttgatgaagtcacgaccggcgtgaataccggcgatctggttaacgcgctgaagcagggtgaatacgccatctacttccgcggctataaagcgaatgaaggcattatcgaagccgatgtccgcagcgtaaacgcccagcagctggaggtggtcgctcgccgcatcgcagaagttctgaataaggagaaacaagcatgaaactgaccccaaacttttaccgtgaccgcgtgtgcctgaacgtcctggcgggcagcaaagacaacgcccgtgaaacttacgacgcggcggaaggtcacgtcctggtcggcgtgctctccaaaaactatccggacgtcgccagcgcggtggccgatatgcgcgactacgcgaagctgattgataacgcgctctccgtcgggctgggggcaggcgatccaaaccagtcggcgatggtgagcgagatttctcgccaggtgcagccgcagcacgtcaaccaggtcttcaccggcgtggctaccagccgcgcgctgctcgggcagaacgagacggtggtcaacggcctggtctctcccaccggtacgccgggaatggttaagatctccaccggcccgctgagcagcggcgcggcggatggcattgtgccgctggaaaccgccatcgcgctgctgaaagacatgggcggcagctccatcaaatacttcccgatgggcggcctgaagcaccgcgccgagtttgaagccgtcgccaaagcctgcgccgcgcacgatttctggctcgagccgaccggcggtatcgatctggaaaactacagcgagatcctgaaaatcgccctcgatgccggggtaagcaaaatcatcccgcatatttacagctcgattatcgataaagccagcggcaacacccgcccggccgatgttcgccagctgctggagatgaccaaacagttagttaagtagtgcccttgtccctcaacctcaaagggtgaggagcagcttatcccactgaaccatcaaggagttgctatgcctgtcgctcgtcatctgcttgtcgcttcactgtccctgtttgccgccgccgcgggcgccgcgcaaacccactatgcctgggtaggcacctataaccccaatggcgaaggtctgtatcgctttaccgtcgatgccaaaaccggcgccctgcgcgataagacgctggtgagctcgttgccgaacgtcgcgcaattaaccgtgtcgcgcgatggcaaaacgctgtatgccgccagtgaggtcgaaaaaggcgtggtgcaggcgtggcgcattgaaaagaacggcgagctgaccgcgctcagccaggtcgcctccggcggcgccgggccggtgtatctctccctgacgccggacggtaagcatctgctggtggctaactatgtcagcggcagtatcgccgtgctaccggtgcaagaagatggtagcctggctgaggcggtggacaggcatcaggatgaaggcccggcaggcgccgaacgcccggcggcggccgtcgagggcagcttcgccatcagcgatcacaacggcccgcatgcccatatgatcgccgccgatcccagcgggaaatacgtttactctaccgatctggggctggatcggatctatcagtatcggctggatagcgccagcggcaagctaacgccgaacgatccgccgtttatcgccgcctcgtcgccgggggccggcccgcgccacttcgtctttacgccacagggcgacggcctgtggctgattaatgaggaagcgtcgacgctgaccttctatcatctggataagcaaagcggcctgctgcgtgaaggcaaaactgtctccgcgctgccggaagggtataaaggcaccagctttgccgccggacttgtgttgagcaacgatggcaaacagctatacgtcgccaaccgcctgcataacagcattgcccacttcacggtgctggccgacggcagcctgagtcaccaggaagatatctggacgcgtggcgattatccccgcaccctgacgctggataatcaggggcagtggctgtacgtcatgaaccagcgtagcgataatattacccgcttcagcgtggcgccgaaggatggcaaattaacctttgcctccgactatacgccggtcggtagcccatcgcagatggtgatatccgcccaaccctgagccgtaattacaaggaactgacatgcgatttcccaaccaacgcttagcgcaactcttcaccctgctgcgaaatgaaacgctgccgcaggatgagctggcgcaacgcctgtcggtttccacccgtaccgtgcgcgccgatattaccgccctgaatacgctgctggtgcaatatggcgcgcagtttatccttaaccgcggcagcggttatcagctgaagatagataatccgacgagtttccaggcgctggaggagaccgcgccgaaggcgcagcacgtgccgcgtaccgcccaggatcgcatcacgtttctgctggtgcgtttcctgacctcggcgttctctatcaagctggaagacctggcggatgagtggttcgtcagccgcgccacgttgcaaaatgacatggttgaggtgcgcgagcgcttccagcgctatcagctgactcttgaaacccgcccgcgccacggtatgaagctgttcggcagcgaggtgtcaattcgcgcctgcctgaccgacctgctgtgggagctgacccagcaaggcgatatcgcgccgccgatcggcgccgaggcctttgcggcggaggtgccagcgctgctggagccggtgctgcaggagacgctcacgcggcatcatattcgcctcaccgacgccggcgagcgctttgtctgcctgtatggcgcggtggtggtgcgccgcgtcagcgaaggctacccgctggccgatttcagcgctgaagatgtggcgcagaacgtccgcgacgccgcgcgcgagctgacgggtgagctgcagcggctggccgggaaacctttatcgcccgccgaagaagagtggctatgcgtgcatatcgcggcccgtcaggtgcaggatgtcgatccggaaactatcagcgccgacgatgatgaagcgctggtcaattacatcctgcgctacatcaacagccagtataactacaacctgctggacgacgcccagctgcatgccgatctgctgacccacattaaaaccatgatcacccgggtgcgctaccagatcatgatccccaatccgctgctggataacatcaaacagcactacccgatggcctgggatatgaccctggctgcggtctccagttgggggaaatatactccgtacaccatcagcgaaaacgaaatcggctttctggtgctgcatatcggcgttgggctggagcgccactacaacatcggctaccagcgtcagccgcaggtgctgctggtgtgcgataccagcaatgcgatggtacggatgatcgaggcgatcctgcagcgtaaatatccgcagctggagatcgccgctaccatctcccagcgcgagtacgaacagcgggacgcgatcgaggcggatttcgttatctcaacggtgcggatcggcgaaaaagacaagccggtggtgaccatcgcgccgttccccaccgactatcagctggatcaaatcggcaagctggtgctggtggaccgtacccgtccgtggatgctgaataagtacttcgatgccgcccacttccgggtggtcgataaaccgatggatcagcaaacgctgttcgccgagctgtgccagcagctgctggaggaaggctttgtcgatgcggagtttcatgcttcggtggtggaacgtgaagcgatcgtcagcaccatgttaggggatggcattgcgctgccgcactccctggggctgctggcgaaaaagacggtggtttataccgttatcgccccgcagggcatcgcctggggcgacgaaaccgcccatctcattttcctgctcgctatcagcaagcgcgagtatgaagaggcgatggcgatctacgatattttcgtgactttcctgcgcgagcgcgccatgagtcgcctcgccgcgacccgcagcttcgatgagtttaaaacggtggcgatggagtgcgtcagccggttttgagaggcgttttccagattcgagtgtaattcaattgtaatgctatactgcattacaaaattccactttccggaggcataatggccacgctcaatgttcgactggacgataaactcaaaaaagaggcttatgccgtgctggagaaactcgatatgacaccaacggaggcggtacgcctgctgtttcaatacattgcggaaaatggccgcatgccggtgaaaagtatgaccatcagtgatggcgaagcggcgttattacgcaccgttcgcgaacggctggaaaacccacggccgggggttaaggtgagtctggatgacctatgaactggagtttgatccacgagcctggcgcgaatggcagaagcctggcgagacggtcaaaaaacagttcaaaaataagctccagcagattgtgcagaatccgcgaattgagtcggccaggctgagcgatttaccggattgctacaaaatcaagcttaaggcgtcaggttatcggttggtgtatcaagtacgagatagtgtggtggtggtttacgttattgccattggcaaaagagagaaagcggccgtttatcatcaggcgaataaacggctctaaacgctatcgcaaatgatgtacgacctggttgctgctgccgcgccagataagcgccggatctttcaaatcctgcacaaacttaccgtcaaccagcacgttaatcaggttcaccacctgcatttgcgcctcattcagctcatcaagtttatagccggtccagacccagatatctttgccggggcattcggcgcgtacgcgctgaaccagctttaaaatatccgcgacgttctgcggatgcagcggatcgccgccggagagcgaaagcccctggcgtttgatgcgggtgtcgttgaggtcggcgatgatacggtcggccatctcagcggtaaacggcataccggagttcacccgccaggtgcttttgttgtagcagccggggcactcgtggacgcagccggagacaaacagggtgcagcgggtgccggggccgttgacgatgtcgacggggtagtactggtgataattcattttcacttctcaattaacgccagagcggcgttggctgcgctcactcaccccagtcacgtactgaatgtacgctcccggggattccttcgtttgccgccttgctctgacgttaattgctttgcgaaaacgaaggagtgcggccatttcctggcgtcgctgcgctcggccgagctacaacagtggtagtggtagcccggataaggcgctgcgcgccgcgatccgggaacggctccttagtggccaaacggctacggggccggtcccttctccccgttggggagagggggaggggctaaaccagctggaattaaccaatctgcccattgcccaggtgcttcacgcggcgcttcacctcttcctgcttgccggcgttgaacggccgcgcgtccgggctgccgagataaccgcacacccggcgggtaacggaaacgcgggcggcgtcgtggttaccgcatttcgggcaggtaaagcccttgctggtgcactcgaactcgccggtaaaaccgcactcgtagcactcatcgatcggcgtattggtcccgtagtacggcacgtgctgatagctgtaatcccacacgtcttccagcgccttgaggttatgctggatattcgggtactcgccgtagcaaatgaaccccccgttggccagcggcgggtacggcgcttcgaaatcgatcttgtcgtacgggttgaccttcttctccacgtcgaggtggaagctgttggtgtagtaacctttgtcggttaccccttccaccacgccaaactcggcggtgtcgagacggcagaagcgatcgcacaggttttcgctcggcgtgctgtacaggctaaagccgtagccggtttcttccttccacaaatcgacggcgtcgcgcaggcgctggacgatggccacgcctttctcacgcaacgcctcgctgtcgtacatatgctggttgccgtacagcgcattgatggtttcatggataccgatatagcccagagaaatggacgcgcggccgtttttgaagatctcggagacgtcgtcgtcggctttcagccgcacgccgcaggcgccttccatatacaggatcggcgccacgcgagccttcactccttccaggcgggcgatacgggtcatcagcgctttgcgcgccagctgcaggcgctcgtccagcagcgcccagaaggcggcttcatcgcctttcgcttccagggcgatgcgcggcaggttgagactgatcacgccgaggttattgcgtccatcatgcacctgctcgccgttctcgttttcccataccccgaggaagctgcggcagcccatcggcgttttaaacgacccggtgactttcaccacctgatcgtagttgaggatatccgggtacatgcgcttgctggcgcactccagcgccagctgtttgatgtcgtagttcgggtcaccgaacttatggttcaggccgtcgcggatcgcgaacaccagtttcgggaacaccgcggttttgcgatttttaccgaggccggcaatgcggttgcgcagaatcgactgctggatcagccgcgattcccagctggtgccaaggccgaatccgaaggtgacgaacggcgtctggccgttggcggtatgcagtgtgttaacctcatactccagcgactggaaggcgtcgtagcactctttttcggtacgggcgcgggcatagccttcggcatccgggatctgccactcttcggcgattttgcgatgctttttgaagctttcgctgacgaacggcgccagcacttcatcgatgcggttgatggtggtgccgccgtaaatatggctggcgacctgggcgatgatctgcgccgtcaccgcggtggcggtagagatagacttcggcggctcgatctccgcgttgcccatcttaaagccctgggtcagcatgcctttcaggtcgatcagcatgcagttgaacatcgggaagaagggcgagtaatcgaggtcatgatagtggatcatgccgcgttcgtgagccatcaccacatcgtggggcagcaggtgctgccgggcgtagtgcttggcgacgatcccggccagcaggtcgcgctgggtcgggatgactttactgtccttgttggcgttttcgttgagcagcgcggagttggtctgctcgacgaggccgcggatctcctgattgagacggccgcgcttctcacgctggctatcgcggtcatggcgatactcaatgtaggcgcgcgccagctgcttataggggccggacatcagctggttttccaccgcggtctggatctcgttgatgtcgacctgggcgcggccctgcatttgttggctaacgacttctgcgacggtggcgcaatagtctgcgtcatcgactcccgctgctttagctgcacgcagaattgcttcctgaatgcgctctgagttgaacggcactttacagccatcacgtttcatcacatgcggtgtcatgatcactccatatatagaacaggttatccacagaggcggaggttatcccgaaggcgctgcacgctacggctcgtgctgtttaccttcgggtccggcccgttttatccacatctcatcaccgccagacatcgacaagatatggtgacataatagacgattaatacaacatgttgggccgaggcgcattttaagttctatatgtagtgatttgcatcaaagatgtttgcgattttattgacccagaacaaggtaaaaaggtgagagtacggatgatgggcgctggcgataaatgtaaatttaggcgcttaaaatataagcaaaaatcgagcccgttcacgcatgaaacgggcaaatattcaggcaatcaacgtatcgttaagcagatcgaccagcagtagcagggcatagcgagcctgctgcgggtcagcgggcagcggcaggatggcgctggccatatcgccaagggcgtgctgttccggcgtcagagcaataatggtcactccctgcgtacgcgcctgcaaagtggcgctttgcaacacagggttggcctcggcagtggccagcaccagcagcagatgatcgtcattgagggtgctggcggtcagccgcatcagcgctgcatcctgacagagattaatcgcgatgccggagggcagtagctgatgctggagcagcgcggccagcgtcacgtcctgggcgccaagggcgaagcagtgtaccgcacgggcgctcagcaggcgcgatttacacttttccaccgccgcttccgcggtatggccgagctgacgagttagggtaacgccaaggctgctaagtttgtcgcgccaggcgacgggcagggcggcgctgtccggcgtaagccagctggcgcgccgttcgctggcctgcgccagctgtttacgcagatcacgaatatcatcgcagcccaccgagcgggcgaagcgggtaatggtggcagggctgacccccgcgctggctgccagctcgtcaatagaggcgctggcggtaaagcttagattttgtagaataaaggtggcgacgcgcgactcctgggcactaaagcggcgcattccttcctgcagctgacctacgatatccatcctcatgttccctttggcaaaacccgcatttgaaaatatttttcaattatcgactgtctctctttatagcactcacgccgcatatttcctatggtcagagcagtaaagggtgacgccctggcgataaaaatgcgcaaaaattgagcctcgatcacatcggtgaaaattattttcatatagccttcactatcacacaatattaacaatatagtcgtccaggccctgggggctgaagcgataacacgtaaaggggaagcgcaatgccacgaatcgtactctgttgtgccgcaggcatgtcgaccagcatgctggtgaacaaaatgaaagcagaagcccagcagcgtgcgctggcgctggaaatctatgcggtggcggtggcggaatttgaacgtgaattgccacacgccgacgtcatcctgcttgggccgcaggttaaatatgaagccgggcgcctggccgcgctggccgcgccgcagggcaaggcggtggcggtgatcgatatggctgactacggcatgatgcgcggcgccgcggtgttggataaagcgctagccctgctcgaacactaattttctcatcccgtttttcatcatcatcacgtgcggtcctggcgatcgcgcgcggcgctctgtatgccgaaaatccgaaaagaggacactatgcaagcactgaaaattgccgttatcggcggcggcagcagctacacgccggagcttattgaagggattatcgttcgttacgagcagcttccggttacagagctggcgctggtagatgtcgaatccggccgggaaaaggtggagatcatcgccgcgctgacccggcggatgctgaaacataaagggctggagcaggtggcggtcagcgtccactttacgctcgatgaggccatccgcggcgccagctttgtgctgacccagctgcgtgtcggacagctggcggcgcgcgccgccgatgagcggctgggtctcaagtaccacctgctgggccaggagaccaccggcgtcggcggttttgccaaggcgctgcggacgatcccggtgatccttgaggtggcgcgtaaagtggaacagctggcgccggaagcgttcattctcaactttactaatccggcggggatcgtcaccgaggcggtcagccgctacagcaaggcgaagatcatcggcctgtgcaacgtgccgatcaacatgcagcacatgatcgtcgggatgctgggcgcccaggagtccgaagtaaaactgcgctttgccgggctcaaccatatggtttgggtgcataaggtgctacaggggcgcgaggatgtcaccggcaaggtgatcgacatgctgtgcgacggtaaggcgctgtcgatgaacaacattaaagagctgccgtggccagcggaattcctgcgcgcgctgaaggcgattccgtgcccctatcatcgctatttttggctgacgccggcgatgctggcggaagagatcgccgcggcgaaaaccaagggcacccgcgccgaacaggtgatgaaagtcgagcaggagctgtttgcgctgtacgccgacccgcagctggaagaaaaaccggagcaactgagctttcgcggcggcgcctactactcggaggtggccgtcgagcttatcaacgcgatctacaacaacctgggcgcggagatggtggtgaatacccgcaacaacggcgcgattcatggtctggatgatgatgcggtggtggaaaccaacagcattattgatgcgcaaggggcgcggccgctggcgttcggcccgctgccgccggcgatgaacggcctgacccagcaggtgaaagccttcgagcggttgacgattgaagccgcggtacacggctgtcgcgaaagcgcactgctggcgctggtgaccaacccgctggtcggtaacgtcaccgatgcccaggcgctgctggatgaagtattaaccatcaaccgtcaatggctgacgcaatttaactgaccgctatttcccctcgggagcacaccatgtcgaatacaagctggattgaacgttacgtcatgccggcggcgctgagaatcgccgggcaaaagcacgtcctgtcggtgcgcgacggcatcattctcaatatgccgtttatgttgattggctcattcttcctgattttcgcctacctgccgatccccggctatgccgatatgatgagcagcctgtttggcgaggtctggcgcgataaaatgttgtacccggtgaaagcgacctacgacatcatggcgctgatttccagcttcggcatcgcctaccggctggcggagaagtatcgcactctcgatccgctgagcgctggggcgatgtcgctggtggccttcatgatgacgatcccgcagaacacgctgtttacgccggtacacggcgcggcggaggtgattaaaggggtgatcccggtgagcatggtcggcagccaggggctgtttgtcgccattgtcatttcgctgctgtcgacggagatttatcgtttggtcgccagccgcaatctcgttatccgcatgccggacggcgtgccgccggcagtggcgaaatctttcctcgccctgatccccggcttctgtgtgctggcggtggtgctggcgctgcgcctggcggttgaggcctcgccgttcggcgacatcaacagcatgatcgccactttgatcggtattccgatgcatcacgtcggcggtacgctgccgggcatgattatttcagtcattttgattggtattttgtggaccctgggcctgcacggcgacgcgattgtgctggtatttattcagccggtgtggctgtcgaatatgtcagagaacctgacggcctttcagaacggccagccgatcccgcatatcattacccagcaattttacgacctgtggattgcgcccggcggcaccggcgcgctgctggggctggtgatatttatgttgctgcgcagccgtagtcagcagatgaaacagctggggaaaattgccgcgcccggggcattgtttaacatcagcgagccgatggtgtttggcatcccgctggtgatgaacccgtactttttcctgccgtttattttaacgccggtgctgctggtgatcgtgtcctataccgcgatggcgaccgggctggtggcgccgcccgccggaatcgcgctgccgttcaccacgccgatcttcatcagcggctatctggcgaccggagggcatatctccggcacggtgctgcaggtggtgaatttagcgatttcgctggtggtctactatccgttcttccgcgcctgggatcggctaaaggcaaaagaagagcacgcctcggcgcaaccccaagcgagcgctgcgattgctgatgccgaccgcgcataacctccagcctgacaaatcgtagccccggtgagcgttgcgccaccggggaaaagcgttatccctgcagccaccatatcgcttcgaacggccgcagcgtcagcccggtcgggcgcggggtggtctcggcatagttgctgatgatcatcttccactcgcccggggcctcagcgggctgccaggcctgcagctcgcggctcaggttagcggcgactaccagcgtttgcccctgccactgacgacgatagcaccacagcgacggatgctccggcagcagatcctcgtaatcaccccaggtcagtagcggcagggttttacgcagcgtaatcagctgctgataggtataaaacaccgaatcggggtccgccagcgccgcctcgacgttgatctcctggtaattatcgccaaggccgatccacggctcaccgtcgctgaagccaccgttctcgccggcgtgccacggcatcggcgtgcggctgttgtcgcgcgacttgctggcgaggatcgccagcagttcgtccgggctttgcccctgcgccgcacgttcgataaacatattgtggctttcgacgtcacggtaatcgctgatgctgctgaagtgcggattggtcatgccgatctcttcgccctggtagatatagggcgtgccctgcatgccgtgcagcaccatcgccagcatcttcgccgccgtcacccggtactcgccttcgtcaccaaagcgcgacacgatgcgcggctgatcgtggttacaccagaacagcgcgttccacgcccgattgtgcattccctgctgccagtggcggaacagcgccttcagcgccacatagtccgggcgggcgagggtccatttctctccgccgggataatcgacttttaaatggtggaagttaaaggtcatcgacagctcgcggccgtccagcgcggcgtactgctggcagtgctccagcgaggtggaggacatctcgccgacggtcatcaggttacgcggggtgaacacatcgcggctcatctcctgcaggaactcatgcacccgcgggccgtcggtatagaagcggcggccatccccgtccagatcgcagggaaaggtctggtcttttgagatcaggttgaccacgtcgaggcgcagaccgtcgacgccgcggtcagcccagaattcgcagacctttttcagctcggcgcgcaccgccggattctcccagttgagatcggcctgctcaatggcgaacaggtgcagataatactgcccgctgtcggcgtgccactgccaggcgttaccgccaaatttggagcgccagttgttcggcagggcgtccggttcgccatcgcgccagatatagaactggcggtagggactctccttattcagcgactgacggaaccattcatgttcggtcgacgtgtggttcagcaccatatccagcacgatacggatgccgcgggccttcgcctccgccaccagggcgtcaaagtcggccatcgtgccgtaggagggatcgatggcgatgtagttcgccacgtcgtagccgttatctacctgcggtgagacgtagaacggcgtcagccagatggcgtcgaccccaagcttttgcagatagtcgaggcgggaggtgacgccgcgcaggtcgccggtaccgctgccagtggtatcctgaaaactcttcggatagatttgataaataacgccgttttgccaccagtgggggagatgattcatagtactttcctgctgcaacgaggggcgccaaaggcgccccgaaagaagaagttagacaatctgcaaggtgccctgacggtacttgcgctgatacaccacgctggtgaggataatcggcaccaccaccgcgatagccatcgccatggcgtacacctgccagtaggtaggctggatggagaggatccccggcaggccgccgacgccgatgccgttcgccagcacgccgttcaggccgcacagcaggccggcgaggccagagccaatcattgcgcacagcatcgggaagcggtatttcaggttgataccgtacatcgctggctcggtgaccccgagataggcggagatcgccgccggtaccgagatttcacgttcattctgcttgcggctggcgatgatgatgccaaccaccgccgacgcctgggcaatattcgacagcgcaatcagcggccacaccggggtgccgcccatgctctggatcatctgcatatcgatagcgagggtggtctggtggacaccggtaatcaccagcggcgcgtagaggaagccgaacagcgcggcgccgatcggcgcgaagctgccggttaacagatggcgtaccgcgaaggccacgccgtcgccgatcaggcggccgaacggaccgattatggagtgcgcgaggaacaccgcgaggatcagcgagcagaccgggacaatcaccaggtagaggtagtcaggcacaatgcgcttgaggcgcgtctcgataaagcctaaggccaggccagccagcagggccgggatcacctgcgcctggtagccgactttggcaatggtaaacaggccgaagttccacacctccggcacctgctggccgaggagataggcgttcatcagctgcggggagacgagggtgacgccaaggacgatcccgaggatcggcgtgccgcccatcttcttcaccgctgaccagcagatccccaccggcagatagaagaagatcgcctcgccaatcagccacaggaagtcatagatggttttcagcgatggatacatctgggccagcgtctggccattgctcatgggcaggtcgccgataacgttgcggaaaccgaggatcagaccgccgctgatcagggccggcagcaggggaaagaagatctcggcgaagtgtgagattaattgttcatgccacttcatattttgccgcgcggcctgcttgacctgctctttgtcggcggaggtctggccggtggtcgccagcagggccttgtagtaatcgcccacctcggtgccgatgaccacctggaactggccggcgttagtgaagcatcccttcaccatgcgcagctgctcaatctcttttggtctggcgatggccgggtcgttcagcacaaagcgcaaacgggtaatacagtggctgacggtggcgatgttaccgcgcccgcccaccagttcgatcagtttatcgatgtcctgctggtttactttgctcatgatgaagcctcaaaaacagaggggagagatgccgtttttaccttgagggcatcctaaccgttccgcttaatttgcaaaatgggaacgttcccgaaacccggcgacgatcacataaatcgtccgagcgagattaattgagggcggcgggaatcacgatctggcggggatcgacgctgccggcgatctgctcgatcaactgccgggcggcccggcgtccggactcggcatagcccggatcgacggtcaagatttccgggtggagaaacttcatcagcggcgtgctgccgacgctggcgagctgcagcgcatcgcgaccctgctgctggaggtacttgctggcgccgagagcgagggtatccgtcgcgcagaccagggcgctggtttcagccatcagcacgctggcgacggtgtcatatccctgcttcatgcccagccccggcagggcggcggtgggcgtcagacgatgcttttcacagaaggcgaggtaggccagatggcggcgttcgccggtggtgacgtcgctgtgcggtacgccaagaaaactgatgtggcggtgtccgcgatcgtagagccgctgcatcagcagcgtgatggccccctcgtcgtcatagcacaccgaggcgaagccgggagcgtcgcgggccatcagcaccagggtgtcgcgccagggggcgagcatcgcttcgtcgatgccggtaaaaccgaacagcaccacgccgtcaatattgcgccgggcgagcatgccgagatgctcctccaccaacgccggggagaactggctctccatcataatcggatcgtaaccctgctcataaaaggcgggcagcatggtctgcacggcaaggttttccgacagcgaatcgagacgggtgacgataatcgccaccactttatcgctctggccgcgcatggcgcgggcggaacgggagggcgagaaaccgtgctgctgcatcaccgcttcgacgcgctcgcgggtccgttcgctgaccccgctctcgttgttaaggacgcgggataccgtcgatttccctacgccgcttaagcgcgcgatatctttgatggtcagccggttctgcatgcggaattctcgtcagggatggtagaagtgagcctaatgctactcaaccaaaccgcaatgagcaaagtctggtttacgttcggtttagttgcgcgggtttatcatcgccattattgccacacaatcctcagcgagggcgctataattcgcgccgtttatattcacttaccggagatagttatggaccccgatcccactcctcatcctcgatggagcaacctttctttccggtaagcctgtttaacactgctttaccggaaagcgtaaagcagtgacgtccttgatgtccctgccataaaaataacatgcctgacaggtaggttttgctacgcccgtcggcaacgctgcgttcgctttggcgagcgcggagggactgtttatgctgaaaaattatacccggcagctgttcgcgcagcttagccgccatctgccacgtcgtttagtccagcgcgatccgctgccggacgcccgccatctggcgagtggtcccattcctgaatcgcttggtcagcattgcctgaacgtggcggcgatggacgaccaggagatctggcgcgcctttgacagccaccctgaagggctcaatgaaggcgaagtggcggcgaaaattctcaaacatggtgacaaccagatcccggcgcagaagccctccccatggtgggtgcatctgtggacctgctatcgcaacccgttcaacctgctgctgaccgtgctcggcatcgtctcctattccaccgaggatctgttcgccgccggggttatcgccctgatggtggggatctcgacattgctcaatttcatccaggaggcgcgctcgaccaaagcggcggatgcgctgaaggcgatggtgagcaacaccgccaccgtgctgcgggtggtgaacgagcagggggagagccgctggctggagctgcctatcgaccagctggtgccgggcgacattatccggttgtcggcgggggatatgatcccggcggacctgcgtatcctgcaggcgcgggatctgttcgtcgcccaggcctcgctgaccggcgaatcgctgccggtggagaaagtggcccgcagccgcgatccgctgcagcaaaacccgctggagtgcgacaccctgtgctttatgggcaccaacgtggtgagcggctcggcgcaggccatcgtcttcgccaccggcggccgcacctggtttggccagctggccggccgcgtcagtgaacaggagagcgagccgaacgcctttcagaagggcatcagccgggtcagcatgctgctgatccgctttatgctggtgatggccccggtggtgctgctgatcaatggctacaccaaaggcgactggtgggaggcggcgctattcgcgctgtcggtggcggtcggcttgacgccggagatgctgccgatgatcgtcacttcgacgctggcgcgcggggcggtgaagctgtcgaagcaaaaggtcatcgtgaagcacctcgacgccattcagaatttcggcgcgatggacatcctctgcactgataaaaccggcaccctgacccaggataagattgtgctggagaaccataccgacgtctccggcaaggtctgcgagcgggtactgcatgccgcctggctcaacagccactaccagaccggcctgaaaaacctgctcgacaccgcggtgctggacggggttgagctggatgccgcccgcgggctggcggaacgctggcagaaggtagatgagatccccttcgacttcgaacgccgccgcatgtcggtggtggtgaaggaggatgacgccgcgcatcagctgatctgcaaaggggcgctgcaggagatcctcaacgtctcgacccaggtgcgctacaacggcgatatcgtaccgctggacgacaccatgctgcgccgcattcgccgggtgaccgataccctcaaccggcaggggctgcgggtggtggcggtggcgaccaaatacctgccggcccgcgaaggcgactaccagcgcgccgatgagtcggacctgatccttgaaggttacatcgccttcctcgatccgccgaaagagaccaccgccccggcgctgaaggcgctgaaggccagcggcatcacggtgaagatcctcaccggcgacagcgagctggtggcggcgaaggtgtgccatgaagtgggactggatgctggcgaagtggtgattggcagccagattgaagccatgagcgacgacgagctggcggcgctggcgaagcgcaccactttgtttgcacgtctggcgccgctgcataaagagcgtatcgtgacgctgctcaagcgtgaaggtcacgtggtgggctttatgggcgacggcatcaacgacgccccggcgctgcgcgcggcggatatcggcatctcggtcgacggcgcggttgatatcgcccgcgaggcggcggatatcattctgctggagaagagcctgatggtactggaggagggggtaatcgaaggccgccgcaccttcgccaacatgctcaagtacatcaaaatgaccgccagctccaacttcggcaacgtcttcagcgtgctggtggccagcgccttcctgccgtttctgccgatgctgccgctgcacctgttgattcagaacctgctgtacgatgtttcccaggtggcgatcccgtttgataacgtcgatgatgagcagatccgcaaaccgcagcgctggaacccggccgatctcgggcgctttatggtcttctttggaccgatcagctcgattttcgatatcctcaccttcggcctgatgtggtgggtgttccacgccaataccgtggagatgcagaccctgttccagtccggctggtttatcgaagggctgctgtcgcaaacgctgattgtgcacatgatccgcacccggcgcattccgttcgttcagagccgggccgcctggccgctgttcgccatgaccctggtggtgatggcggtgggtatcgcgctgccgttctcgccgctggcgagctacctgcagctgcaggccctgccgctgagctacttcccatggctggtggcgatcctggcgggctatatggtgctgacccaggccgtgaagggcttctacagccgccgctacggttggcagtgagggacgcgttttcggatgaaccacgtaaaaaaggcagcctgcgggctgccttttttcatgccgaggttagcgatcagcgacgcacggcgatagcttcgatctcgatcttcacgtctttcggcagacgtgcgacttcaacgcaggagcgcgccgggaaggtggcgttatgctcggtgaagaacgcttcgtaagtggcgttaacggtagcgaaatcgttgagatctttgacgaatacggtggtcttgacgatatcgccgacggtgaggccagcggcttcaacgatcgctttcacgttgttcagcgactggcgcgcctgcgcggacacgtcttccgggacgctgccggttttcgggtcgaccgggatctggccagaggtgatgatcatgctgccgaggtcaacgccctgaacgtaggggccaatcgccgctggtgcattttccgtcgcaatagttttgctcatgttatctccagatgaactgagtaatgttacgcaaaatcattcaggttgccgccaggcggtaagcgctgtatcgccggcgcagacgccgcctgaaggacgaagcgtagggtggtagccattatagggaggcctaccaccaataccaaccgcatttagttggccagcaccacataatgagaaaactctttttcgcagtatttgcatttgagtgcgatgtcatcagcgcgttttttcactgcaaaactggaagaaaccggttcggcgtggctgatacagttgctgttcgggcagaccagcacgctgtcgatacgatccggcaggctcgggcgggatttgcccaccacttcgtaatcatcaatgcggtttaccgtcgcctgcggggcgtacagcgacagctggttaacctgctcgtcggtcaggaaggtgttctcgattttaatcaaatccttgcggcccatctcgccggagggcaggttcaggccgatggtgatgcgctggtcggtttcggtcagtttgaacagggtgagcagcttaaagccgacctgcgccgggatatggtcaatcacggtgccgcgtttgatcgcttctacctgcagtttattgtcgtgtgtcatctctcattcccccttacagtgccagctcgctattcagtaccagtgccagtaacgcctggcgggcgaagatgccgttaccggcctgctggaagtaccaggcgtgcggtgttttatcgacatcggtggtgatttcgtcaatgcgcggcagcgggtgcagcactttcatgttggcgcgcgccccttcgaggtcggcggcgcgcaggacgaactgcgctttgacgttggcgtattccgacggatccagacgctctttctgcacgcgggtcatgtacagaatatccacttccgccatcacgtcgtcgatggcgctatgcaggctccaggcgatgcctttttcatcgagcatatcgaggatgtactgcggcatggccagcgcgtccggggcgatgaagtagaagcggttgccgttgaatttggccagcgcctgggtcagggagtggacggtacggccatacttcagatcgccgaccatcgccacgttgaggttttcgaggcggccctgggtctcctgaatggtgaacaggtcgagcagggtttgggtcgggtgctggttagcgccgtcgccggcgttcagtaccggcacgccgccggagaattcggtcgccaggcgcgcggcgccctcctgcggatgacgcatcacgatggcgtcgacgtaggtgctgatgacggagatggtatccgccagcgtttccccttttttgcccagtgaggtgttggcgctgtcggaaaagccgaccacgctggcgcccaggcggtgcatcgaggtttcaaaagagaggcgggtgcgggtcgaggcttcaaagaaacagctggcgataaccttatgcttcagcagctcgggttgtggattggctttcagctttgccgccgtcgccagcaccagttcgaggtcttcgcggctgagatcgtttatggaaatgatatgtttttgatatagcgggttagccatgcttatctcctgacgcctgggcaaaaaaaagccccttaaataaggggcttcgggaatccaatgagcaacggaaagaaaaacggcaggccagcgtctgcattgagacgcgctaagacagaatgtcgtacgcaattggccatgcttcctcccggcaaaacgactggcattatacgcagaccgttatgacgatcaagcgattcattcacaaacaggtaatcgtttgcctgtcgaaaagtgcgccagcgcaaagaagcgtgaaactgtactggtatggcagccgcgatgggggtataacacgataaaatgaaatgctgttttatatttgaggtaagcaatgattattggcaatatccaccatctgcagccatggctgcctgccgcgctgcgcgaggctatcgaacaggttatcgctcaggtcagcgaggcgacgccgctgggtaaacacgatatcgacggcgacaacctgttttatctgatttctgaagacaccaccgagccgcaggccgcgcgccgcgcggagtaccatgctcgctatctcgatatccagattgtgctccgcggcagcgaggggatgaccttcagcaccttgccgccaggagagccgcagaccgactggctggcggagaaagacatcgcttttcttgccgaaggccagcaggagaaaacggtgatcctcaacgaaggggactttgtggtgttttatcccggcgaagtgcataaaccgctgtgcgccgtaggcgccccggcgaaggtgcgcaaagcggtggtgaagatgctgatggcgtaaaatggcgaaccgaatcccggatgaacgccgtgccatccgggacacagccgcgagcgaggggctatttgctcagcgtcgccaccatcaccgctttgatggtgtgcatccggttttccgcctggtcgaagaccacgctcgccgccgactcaaacacctcgtcagtcacctccatgccgccgtgcaggccgtaatcggcagccatctgtttgcccagcgtggtctggtcgtcgtggaacgccggcaggcagtggaggaacttgacctgcgggttgccggtcagcgccagcatcgcgctgttaacctgatagtcgcgcagcagggcgatacgttcggcccatttttccttcgcctcgcccattgagacccagacgtcggtatagataaaatcggcgcctttcacccccgcggcgatatcttccgtcagggtgatgttgccgccctgctgtttggccagcgcggtgcaggtctccaccagcgcggcctccggccagcaggccgatggcgccaccaggcgcagatccagaccggtcaacgcggcggcttccagcatcgaattgcccatgttgttgcgcgcgtcgccggcgtagaccagcgtcatctggttaaaggctttgcccggcagatgctctttcatggtcagcaggtccgccagcagctgggtggggtggaactcgttggtgaggccgttccacaccggcacgccggcgtattgcgccagggtctctaccacttcctggccgtggccgcggtactgaatgccgtcgtacatccgtccgagcacgcgggcggtgtccttgatcgactctttatggccaatctggctgccgcttggccccagataggtcacgcgggcgccctgatcgtatgcggcaacttcgaaagagcatcgtgtacgggttgagtctttttcgaagatgagcgcgatgtttttccctgccagtttctggacttcgataccgtttttcttatcggctttcagctttgccgccagctcgagcagggcggtgatttctgcaggcgtaaaatcgagtaactttaaaaaatgcttctggtaaaacgcagacatggttccctcacctggcataggccactaattgaattaaaattcaatttatatgtatgaatattcatttgcaagtctgtgatcgaaatctttcactgagaagtggaggcaatgacggcggtatgtgacaatagggataactgccgcacattatgaggaacgagccatggcaaacccggaacacctggaagaacagcgtgaagagacgcgtctgattatcgaagagctgctggaagatggcagcgatccggacgcactgtacacgattgagcatcacctctctgcagacgatttcgaaaccctggagaaagtggcggttgaagcgttcaagctgggctacgaagtgaccgagcccgaagagctggaagtggaagagggtgacatggtcatctgctgcgatattctgagcgaatgcgcgctgaacgcagacctgatcgatgcccaggtggaacagctgatgacgctggcagaaaaatatgacgtcgagtatgacggttggggcacctattatgaggacccgaacggtgaagacggcgacgacgatgacgaagagtatgtcgatgaagacgacgatggtgttcgccactaagtcgcaaatgtcgtagatggatacggcggcgcctgccgccgtatagcaaggaactttcatggattacccgcagattctttccccgattatcaacttcctgcactgcccgacgccgcaggcgtggattgacgaagcccgcaagccggaaaacctggcgctgctgctgaccgaccacatggtgtgcgagctgaaagcggcgcagaacgccatgctgctggtgcgtcgctacgtcgcggataaagctgacgccgacgaactgttggcctgcctgaagccgtacgaagacttcacctaccgccgggggccggagccggattttgtcaccctgcataaacggatcaacaaaagcgccatgccgcagaccgacgacccgtggggtcgccagctgctggacagcatgattttattgattaaagaggaactgcatcacttctggcaggtgcgggagatgatgctggcgcgcgatatcccctatgtcaaaatcaccgccagcaactatgcccgcggcctgcggcgcgaagtgcgctcgcatgagccggtgatgctgatcgataagctgatctgcggcgcctatatcgaggcccgctcctgcgaacgctttgccgccctggcgccgcggctggacgacgatctgcaaaagttctacctgtcgctgctgcgctccgaggcgcgtcactatcaggactatctggatctggcgcagaagattgccggagaagatatcagcgagcgggtgcgccagctcggcgaggcggaagcggcgctgatcctccgtcccgaggccgagttccgctttcacagcggtgtgccggtagcggcgtaacccacgatattcgggccctgtagccccggtagccactaacaccggcagtttcagtagccatggggagagatagcgttgagagcttcagctcgcaatggtacgggccgtaggtcgggtaaggttagccgccacccgacaaaaaaacggcaccgcgagcacgggtaaggtgccattcgggacatacccggctcgcgctacgcttagccgggctaccgaactgtagccccggtaagcgtagcgctaccggggacgcctgcgatatcgaggcgctacagcgttttcagcatccgtacttcgcagtccacgtggccggtgcagcccagcggcccgtcaatgtgctcgaagccaagatgttcatataagccgatcgcctccgtcaggaaggcggtggtttccagatagcagcgcttaaacccttgttcgcgggcgtagtccagcgccagcagcgccagcttcttcgccagcccctggccgcgggcgctggtcataaaatacattttctgcagttcgcagatatccggctcgctgcaggcgagcggcgcgacgccgccgccgccaaccacttccccctcttgctccaccacccagtaggcggagcccggctggctgtacagctcatacagctcatcgagattcgggtcggcgaccgtatagcctttatcggcggtcaggccatattcagccgagacctggcggatgaccctggcgatggcggcattgtctgccgccgtaatgcgacgcagcaacgtcgccgcggggacgctcgtattcatacaatgactcattacccaaaaaagacgaatgatgatgttaataacatcgcgacaggggaaagcgcaagcgaggatgtttcataaaaaacgccccttgccgggtggcaaggggcgggaggatcacagcgcggcgatcaccgcctgctgttcaatcagcttcgctttcgcttccgcgtagccttccagcttctcgcgctctttagcgatcaccgcttccggcgcgcgggcgacaaagccttcgttggccagcttgctctcgatgcggccaatttcaccttcgattttggccacttctttcgccagacgcgccagctcatcttctttattgatgaggcccgccatcgggatcagcagctcggcgccgtcgacaatcttggtcaccgagaccggacctttatcatcggcaggcagcacggtaatgctttccagacgcgccaggttcagcaggaagctgcggttgtcgttcacacgacgctcggcctctttgctgcagccgcgcagcagcagttccagcggtttgcccggagcgatgttcatttccgcacggatgttacgcacggcgacgatcgcctgcttcagccattcggtgtcggccagcgccgcgtcatccacctgagaagcatcgtactgcgggaacggttgcagcatgatggtgtcggcggtgatcccgcagatcgctttcacgcgctgccagatggtttcggtaatgaacggaatgatcggatgcgccaggcgcagcagaccttccagcacggtgaccagagtatggcgagtcccgcgcagctccgcttcgttgccaccgttcataaccggcttggtcagctccaggtaccagtcgcagaactggttccaggtgaactcatacaggatgccggcggcgatatcgaagcggaagttatccagcgcttcgcgatacgctttcacggtgtggttgaattccgcgatgatccagcggtcggcgagggagagcaccatttcgccgccgttgaaaccgcaatcctgatcttcggtgttcatcagcacgaagcggctggcgttccacagcttattacagaagttacggtaaccttccagacgcttcatatcccagttgatgtcgcggccggtagaggccagcgccgccagggtgaagcgcagggcgtcggtgccgtgcggctcgatgccgttcgggaactgtttctcggtacgcttgcggattttatccgccagctgcggctgcatcatgttgccggtacgtttttccagcagttccggcagggtgataccgtcaaccatatccagcgggtcaatgacgttacccttggacttggacatcttctggccttcgtcatcgcggatcagaccggtcatgtagacggtcttaaacggtacctgcggcttgccgttttcatctttgatgaagtgcatggtcatcatgatcatgcgggcgatccagaagaagatgatgtcgaagccggacaccatcacgctggtcgggtggaactgacgcagggcatcggtgttttccggccagccgagggtggagaaggtccacagcgcggaggagaaccaggtatcgagaacgtcttcatcctgacgcagggcaacgtcggcgctcaggttgttttcctgacgcacttcgtcttcgctacggcctacgtagacgttgccgtcgttgtcataccatgccgggatgcggtgaccccaccacagctgacgggagatacaccagtcctgaatatcgcgcatccaggagaagtacatgttttcgtactgcttcggtacgaactggatgtcgccgttttcaacggcttcgactgctggcttggccagcacgtccgcgcgcacgtaccactggtcggtcagcatcggctcgatcaccacgccgccgcgatcgccgtaagggacggtcaggtcgtgcggtttgatctcttccagcaggccgagggcgtcaaccgccgcaacaacggctttacgcgccgcgaagcgttccagtttctggaactccgccgggatctcgctggagtagacgtcggattcattgcctttggtgtcgtagacttccgcgctttcgcggatgtcgccgtcaaaggtgaggatgttgatcatcggcagctggtgacgacgacccacttcgtagtcgttaaagtcgtgcgccggggtgatcttcacgcagccggtgcctttttccatgtcggcgtgttcgtcgcccacgatcgggatgcggcggttaaccagcggcagcaccacgaatttgccaatcagatctttgtagcgcggatcttccgggttaacggccacgccggtatcgcccaagagggtttccggacgggtggtggcgaccaccaggtaatctttaccgtcagcggttttcgcgccatcggccagcgggtagcggatgtgccacatggaacctttcgattcgcggttttccacttcgaggtcggaaatggcggtgcgcagtttcgggtcccagttaaccaggcgtttgccgcggtagatcaggtcttctttgtacaggcgaacaaagacttctttcacggcattggaaagcccctcgtccatggtgaagcgctcgcgctcccagtccacggagttgccgagacggcgcatctgacgggtaatggtgccgccggattccgctttccactgccagattttgtcgataaaggcgtcgcggccgtagtcgtggcgggttttcccttcttcagcggcaatcttacgctcaaccaccatctgggtagcgatacctgcgtggtcggtaccggcctgccacagggtgtttttgccctgcatgcgctggtagcgaatcatggtatccatgatggtttgctggaaggcatgacccatatgcaaactgccggtgacgttcggcggcgggatcatgatgcagaagctctcctggctttcatcaccattcggtttgaaatagccctgcttttcccagtgctcgtaaagcggctgttcgatatcttgtgggttgtatgtcttttccattatttccaggttgccgtgttcaggttgaaaccagccatgcggtacgccttatagcgttcgcgcgccagttgtttcagattgtcttcgtaagggacaaagtctatcacttctgtgaaagcggtggcaaaatctgcaaagtttagccgcaggctgataagaatatcccgcgggctgctgttgcgcttttgcggccaggcaatctctaccggcgcgccgcctctcgggccttcgcccgccaggttatgcggcacaaagctttccggcggccgcgaccacagcgcctcgtcgaggcgaatcgcctgctgttcatcttcgcaggcgatcaggacgcgcttgccgttgcgccaacgttctgcggcaatgtcacacaccagctgctcgacggcgctcaggccgtcgacggtggcgtcattgtccagaagatagaacgttgcgtttttcatatatggggcttcttgttgtggatttaaatgcaaagccgggcggcgctacgcttacccggcctacagtgtgctgccgtttgtaggccgggtaaggcatcgccgccacccggcatgtcacatcactcttcgccgttaaaacccgcacgattgagcaggaactgcgacagcagcgccaccggacgaccggtcgcgcctttggccttaccggaacgccaggcagtaccggcgatgtcgaggtgcgcccagttgtacttgcgggtgaagcgcgacaggaaacagccggcggtgatcgcgccgccaggacggccgccaatgttcgccatatcggcaaaattggactccagctgatcctggaactcgtcggccagcggcaaacgccatgcgcggtcgcccgccagttcggaggcgccgatcagctcatgggccagcgggttatggttcgacatcaggccggtaatgtgatggccgagggcaatcacgcaggccccggtcagcgtcgccacgtcgataaccgcttccggctcgaagcgctcaacgtaggtcagaacgtcgcacagcaccaggcggccttcggcgtcggtgttcagcacttccaccgtctggccggacatagtggtcaggacgtcacccggacgataggcgcggccgccaggcatgttttcacagcccgccagcacgccgatgacgttcagcggcagctgcagttcggcaaccatccgcatcacgccgtacaccgccgccgcgccgcacatgtcgtacttcatttcgtccatgccttcggcaggcttgatggagataccgccggagtcgaaggtcaggcctttaccgaccagcacgatagggcgcgcgtcctcagccgggttgcctttatattcgatgaccgacatcagcgactcgttctgcgacccattgccgacggcgaggtaggcgttcatccccagctcgcgcatctgctgttcgccgatcacccgggtgatgacgtttttgctgtaggtatcggccagctgacgcgcctgggaagccagataggcggcgttacagatgttcggcggcatattgccaagatctttcgccgctttgatgccggcggcaatcgccaggccatgctgaatggcgcgttcgccgctggtcagctcgcgacgggtcggcacgttaaagaccattttacgcagcgggcgacgcggctcgcttttgttggtcttcagctggtcgaagctgtacagcgtctctttggcggtttcaaccgcctggcgaactttccagtagttgttacggcctttgacgtgcagctcggtcaggaagcagacggcttccattgagccggtatcattcagggtattgatggttttctggatgacctgcttatactgacgctcatccagctcgcgctctttgccgcagccaatcagcagaatgcgctcagacagaatgtttggcacatggtgcagcaataacgtctggccaggtttgccttccagctcgccgcgacgcagcagggcgctgatgtagccgtcgctgattttatcgagttgttcggcgatgggggagaggcgacgtggttcaaagacgccgaccacgatacaggcgctccgctgcttctccgggctaccgctttttacactgaactccatgcactatgctcctgaatcttaaagacaacagtggtggctacggctatactcgtcgcctttcaagttgcagatgcgccggctgcgcctgcttaccctgacgtggcacattgtgcgcgccaggggccacagccctgctgccttcttacaactcgaaatccattgagtatataattgcaagctttcgtaactcatatccgctgttgcggtgacttcgtgttaatcttaacgttattaaggcctgggttcgtcagaaaagatcctgacatgcagaaccgatgagtcatttaatcttagcgacgttttcgacgaccaaagagaataaatgacgtttaagccatgaaacaagcaattttcctgcactaaaacgggtttttacgggcgtatttatagtgataatcataagatatctggttcgtgagacgctgaaaagccagttggcgatcctattcatcctgttactgattttcttttgtcagaaattagtcaggatcctcggcgccgcggtggatggcgatatcccaaccaatctggtgctctcgctgttggggctcggcatcccggagatggcgcagcttatcctgccgttaagtctgttccttggcctgctgatgaccctcggcaagttgtacaccgaaagtgaaattacggtgatgcacgcctgcggcctgagcaaagccgtgctgatcaaggcggcgatgatcctcgcgctgttcaccggcgcggtggcggcggtgaacgttatgtgggcggggccgtggtcgtcgcgccatcaggacgaagtgctggccgaagctaaagctaaccccggtatggcggcgctggcccagggccagttccagcaggccagcgatggtaacgcggtgatgtttatcgaaagcgtcaacggcaaccgtttccatgacgtcttccttgcccagctgcgtccgaaaggcaatgcgcgcccctcggtggtggtggcggattccggcgagctgtcgcagcagaaagacggctcgcaggtggtgaccctcaacaagggcacccgctttgaaggcaccgcgatgctgcgcgacttccgcattaccgacttcaataactatcaggctattatcggccaccaggcggtgagcgccgatccggacgacaccgaacagatggatatgcgcaccttgtggaaaacccacaccgaccgcgcgcgcgccgaactgcactggcgcttcacgctggtggcgaccgtcttcattatggcgctgatggtggtgccgctcagcgtggtgaacccgcgtcagggccgcgtgctgtcgatgctgccggcgatgctgctttacctggtgttcttcctgctgcaaacgtcgattaagtcgaacggcggcaaaggcaaaatggacccggctatctggatgtgggcgattaacctgctctattttgcgctggcggtgctgttaaacctgtgggacacggtgccgatgcgccgcttccgcgcccgttttaataaaggagcggcctgatgcaggcgtttggcgtacttgaccgttatatcggtaagacgattttcaacaccatcatgatgaccctgttcatgctggtgtcgctctccggcattatcaagtttgtcgatcagctgaaaaagtccgggcagggcagctacgatgcgctgggcgctggtctctacaccatcctcagcgtgccgaaggacatccagatcttcttcccaatggcggcgctgcttggcgcgctgctggggctggggatgctggcccagcgcagcgaactggtggtgatgcaggcatccggtttcacccggctgcaggtagcgctggcggtaatgaaaaccgcgatcccgctggtgctgctgaccatggccatcggcgagtgggtggccccgcagggcgaacagatggcgcgcaactaccgtgcccagcagatgtacggcggctcgctgctctcaacccagcaggggctgtgggcgaaagatggccacaattttgtctatatcgaacgcgtaaaaggcaacgatgagctgggaggcgtcagcatctatgccttcaacccggagcgtcgtttacagtcggtgcgctatgccgcttcggcaaaattcgatagcgaaaataaagtgtggcgtctgtcgcaggtggatgaatccgacctgaccgatccaaagcaggtgaccgggtcgcagatggtgagcggcacctggaaaaccaacctgacgccggacaaactgggcgtggttgccctggatccggatgcgctgtcgatcagcgggctgcacaactatgtgaaatacctgaagtccagcggccaggatccgggacgctaccagctcaatatgtggagcaaaatcttccagccgctgtcggtggcggtgatgatgctgatggcgctgtcgtttatctttggcccgctgcgtagcgtgccgatgggcgtccgggtggtgacggggattagcttcggctttatcttctatgtcctcgaccagattttcggcccgctgaccctggtctacggcataccgccgatcatcggcgcgctgttgccgagcgccagcttcttcctgataagcctctggctgatgatgcgcaaggcctagcgggtaagcctgaaacgtaagccccctcagcgatgagggggcttttttttagcgcttgcgtccgcccagcaggctgcccagcatgccgcggacgatctgattggtgacctggcgaaccgcgcttttcgctgcggtctgcacgataccgtcgcgtttaccgccccgcgggccggtgctgccgaacaggatatctttcaggccgccaagcagcccgtcgtcatcgccgttctgctggcccttcgccggcggagccgactgctgcccggtggcgacctgcaccccttgctgcagcatttcgaaagccgactcgcggtccacctcctcctcatacttaccgtacagcggcgagtggttcagcagaccattgcgctcgtcatcgctgaccggccccattcgcgaacagggggcgataaccatcgcccgctcgaccaccgacgggctgcctttctcatcgaggaaggagatcagcgcctcgccggtgcccagctcctggatcgcctgctcggtactgaaggccgggttggcgcgcatggtctgggcggcggttttcaccgccttctggtccttcggcgtaaaggcgcgcagggcatgctgcacgcggttgcccagctggccgagcacggcgtcgggaatatccgccgggttctgcgagacaaagtagacgccgacgcccttggagcggataaggcggatcacctgttcaattttatccagcagcacctgcggcgcgtcgttgaacagcagatgcgcctcatcgaagaagaacaccagcttcggtttatcgaggtcgccggcttccggcaggcgctcgtagagctcggagagcatccacagcaggctggcggcgtacagcttcggcatctggtagagcttttcggcgctaaggatattgatcacccctttaccgctggcatcgacgcgcatccagtcggcaatatccagcatcggctcgccgaagaagtgctcggcgccctgttgctccagggtcaacagcccgcgctggatggcgccgatcgaggcgctgttaatattgccgtactggttctggaaagacttggcgttatcgccgataaactgggtgatggcgcggaggtctttgaagtcgagcagcagcaggccgcggtcgtccgcgatgcggaaaataatgttcagtacgccgctctgcacctcgttgagattgagcaggcgcgccagcagcagggggccgagatcggagaccgtcgcccgcaccgggtggcccttctcgccaaagatatcccagagcaccaccgggttggcgtgcggctcccagtcgctgacgccgatcttctccagccgcgcctgcagtttctctgagctctgccccgcggcggcaatgccggtcaggtcgcccttgacgtcggccataaataccggcacgccaatctccgagaacgactcagccagcttctgcagggtgacggttttaccggtgccggtcgcaccggtgataagcccatggcggttggccatcgcgggcagtaaatagagcgcgttatccagcgtgcgcgcaatcaacaggggtgagctcatggtcgattcctccatttatcctgcgacgattataggcaacctcgtcgtccggcgttgggaaaatcgtcacgcgccgcgcacgctgtaccgtgagggtctcaggcgcagtggcgctggatgagcgcgatgctctgctcaatttcgcgctcgatatccgcttcgctccattgcgccagctcgggggcgaagggctcaaaagcgtacaccccctgatagccgcgggcttccagcgctttaacctgctcgcaggtgccgagacgatcctgcggggttagcatgatgcgctcggcatcggtgagctgctcgcgcggacggctatcgtccactcctgaaaggtgcaccagcccgatatccgccacctctacctggctgaactcgtccgccgcctgcgggtaaagatggtgatggaaggtgtcgatcagcagcttaaacggcacgcgggcgtcgtggatcagcgtctgcgcctggtgcgcagaacgcagcgagctttgcgggaagcccagcggctccaccaggccgtggatgccatagaaggcgaacagcggcgccaggtcgcgcagggcgcccagggtttcgctggccggcacctcgctgccgtcgttgagcggacagagcaccagcgatttggcgccgatggcctgggcctctttcagcagcgattcggtcaactgccgcacctcttcgctacgacggttaaaggggtagaccgcgttaatcgtcaggatctcgatgtggtagcgcgccgccagctcgcgcacctgctgatggctcagatcgtcggtcacttttccgctgggtaaatcgttgcgcagctcgaccttattcaggcccagacggttcaccagacggaaaaacgcttcaatgctgagcgctggcgcgattttgcggttaatacaaaaacgttgcattgcgatggccataggacactcctgacggaagagggggtaggttcgttcaattggctaacagtcaaaacgtttattccaaaattagcaagaatggaaatgatgaatgtttgagctgtctcgcaaaatatcaccggcaccgactaccggcgcgacagcggcgggaagcctggcgtcgagggcaacgaggcgcgatgcgggaagcgcacaggcgaccggttagcgcaaaatgcgactgttatcaccaaaatgaaatttcatttcacaacaatgttgaaatataaatttcattttactacggttatagcacagcagaatcagcgacgggccggtgtgcgctggcccccttcactatgaggcgagaacatgacgatcacaggaaactttattggcgggaaaaccgttattagcagcagcaacgaaacgatgccggtgtacgacccggcgacgggcaaagcggtgcgcgaagtcacggtgtcaaccgcgcaggaagtctccgaggcgattcaggttgctcgcgatgcgtttgacagctggtcccgtaccacgccgctgcgccgcgcccgcgtgctgttcaacttcaaaatgttgctggagcagcacgtggaagagctggcggggatcatcgtcagcgagcacggtaaggtgtggtcggatgcgctgggcgagctgacccgcggtatggaagtggtcgaattcgcctgcgggatcccgcacctgattaaaggcgaatactcctctgacgtcggcaccggcgtcgacagctactcgttgatgcagcccctgggcgtggtggcagggatcaccccgtttaacttcccggcgatggtgccgatgtggatgttcccgctggcgctggcctgcggcaacagtttcgtcctcaagccgcccgcgctggcgccgacggccgccgtgcgtctggcagagctgctgaaagaggccggtctgccggacggcgtgtttaacgtcgtgcactgcagcaatgaagatgctgagcagctgtacactgatccgcgtattgcggcggtgagcttcgtcggctcctccggcgtggcggagtatatctataagaccgccagcgcccacggcaagcgcgtgcaggccttcggcgccgccaaaaaccacgcgattgtgatgccggatgccgatctcgacgctaccgttaacgccattatgggcggcgcttttggctccgcaggcgagcgctgcatggcgctgccggtggtggtggcggtgggagatgaaaccgccgacaaactgatcgcccgcctgaagccgctggtggaagcgctgaaagtaggtccgggctgcatgcgtggccaggaagagaacgagatgggaccggtggtgtctgatacccatcagaaaaaagtgctcggctatattgataaaggcgaaagcgaaggggcaaaactggtggtcgatggccgcaaactgcgcgtgccgggttacgacgcgggctactatgtcggcggcaccctgttcgatcacgtcaccccggagatgaccatctggcgcgaagagatctttggcccggtgctggggattgtgcgcgcggcggactatgacagcgcccttgagctggtcaacagccacgagtttggcaacggcagcgccgttttcaccagcaacggccacaccgcgcgtgaattcgtccacgacgtgcaggcggggatggtcggggtgaacgtgccggtcccggtgccgatggcgttccacagcttcggcggctggaagcgctcggtgtttggcgcgttgaacgtccacgggccggacggcgtgcgcttctacacgcgtatgaagaccgccaccgtacgctggccggcagggcagcagaccgtatctgaattcagcatgccgacgttaggttaatcggcgaaggagagcgccatgtcgttactggctaaatcgcgaaaagagggacagatccagcatattacgccgcaaagcgccggttggcgctatatcggctttgatgtctggatgttgaaaaaagggcagaccgtgacgctggagagcggcgatcgcgagctgtgcctggtgctggtcgccgggctggcgtcggtgaaaacgcagcatgccgatttcccgaatctcggtaaacggatgtcgccgtttgaacgcaccccgccgtggtcggtctacgtcccgccgcaggataaagtcgaggtgactgccgattccgatctggagctggcagtatgcagcgcgccgggcaaaggcagcttcccggcacgcctcattcggccggaagacgtcggcgtagagcaccgtgggaaagggcgcaatcagcgccgggtgcataatattctgccggacagcgccgaggcggactgcctgctggtggtggaagtctacaccgacgagggggccaccagctcgtggccgtcgcataagcatgataccgcccagccgggcaaagagacgcagctggaagaaacctactatcaccgcttcgatccgccgcagggctttgccttccagcgggtctacaccgacgaccgcagcctggacgcctgtatggcgccctacaaccacgatgtggtgatggtgccgcgcggttaccatccggtggcagcgattgccggttacgatagctactatctgaacgtgatggccgggccggaccggaaatggctcttcacctgggaagatgaccacgcctggatcaacacgccggagtacccgcgccacgactgacgcgaggtgcagaagcggataaagaaggccggttagcgatgctaaccggccttcctgtttgagggcggcgggtgttttttcgcgaaacgctccgcggaatcccactcccgacccggcaagcgcagcgccgcaggggaggatacctccggcgccatacccgcctttgtgccggatggcgctacgcttatccggcctacggcctcctcccgtaagctcctataccccaggcccggtgctgcttttatgccgggcggcggctcacgccttgcccggcatacggttcgtgcgacctgccgttaatttattcaccattgttgctgaaactgccggtgctgacggcctcaaaatcgctgagacgttcccggaaggccggggcagcccgcatggatgcgggctgagggccgtgttttgcacggacgctgcctcggcccgacccgaagcctgcagggataagtcgaagggaccgcgtagcggcgattttgctggccggagcccggggggacagggggcggcggcgactggccgccccctgtgcgctccctgcgccatgccaggcataacgcagaagattaaccgggagcgcaatgtgcgctgaaatcacatgcgacaaacgctttacccggattaataaagttgcataccaataacattatctccggcaccccgcaggcgcatataccccaggcccggcaagcgcagcgccgccggggaggacaccaccggcgccatacctgcttttatgccggatggcgctacgcttatccggcctacgggagcctcccgtaagcccctataccccaggcccggcaagcgtagcgccgccggggagggcaccaccggtgccatacccgcctttgtgccggatggcggcttcgccttatccggcctacgggatcctcccgtaagtccctataccccaggcccggcaagcgcagcgccgccggggaggacaccaccggtgccattcccgcctttgtgccggatggcggcttcgccttatccggcttacgggagcctcccgtaagcccatataccccaggcccggcaagcgcagcgccgtcgggcaggacacctccggcgctatacccgcctttgtgccggatggcggcttcgccttatccggcctacggcatcctcccgtaagctcctataccgtaggcccggcaagcgcagcgcgaccgcaggcacggtgctgcttttatgccgggcggcggctcacgccttgcccggcatacggttcgtgcgacctgccgttaatttattcaccattgttgctgaaactgccggtgctgacggcctcaaaatcgctgagacgttcccggaaggccggggcagcccgcatggatgcgggctga

SEQ ID NO: 61 - DNA, 269970 bp, Unknown
  source: /note="Description of Unknown: KP2-Mcoc1 Bacteria Sequence"
tgcgccaggaagacgccatctacggcggggagatgagcgcgcaccattacttccgcgacttcgcctactgcgacagcgggatgatcccgtggctgctggtggcggagctgctgtgcctgaagaacagttcgctgaaatcgctggtggcggaccgccaggcggcgttcccggcgtcgggggagatcaaccgcaagctggggaatgcggcggaggcgatagcgcgcatccgggcgcagtatgagccggcggccgcacacatcgacacaacggacggtatcagtattgaataccctgagtggcgttttaacctgcgcacgtccaataccgagccggtggtgcgtctgaacgtggagtccagagcggatactgcgttaatgaatgagaaaaccgccgagctgctcaacctgttaaaagaggaatcgctttgagtcctatgttttcagcgatctatcgctaccgtggctttattattgacagcgtcaaacgggactttcagtcccgttaccagactagcttcttaggcgcggcatggctaatcttacagccgatcgccatgatttccgtctatacattaatcttttctgagttaatgcgtgcccgcctggcgggcatggacggcccttttgcctacagtatctacctctgttccggggtgttaacctgggggctgtttacggaaacgctcaatagtctggtcaacgtttttctgaccaacgccaacattcttaaaaagcttagctttccgcggatctgtttaccaatcatcgtcaccgcttcggcgttcattaacttcctgatcatttttggtctgttcgtgctgtttctgatcgttacgggcaatttcccgggcatgattttctttgaaatcattccggtgctgatcgttcagatgctgttcaccctcggcctcgggatcatcctcggggtgctgaacgtttttgtccgcgacgtcgggcagttcgtgaatatcctgctgcagttttggttctggtttacgcccattgtctacgtgtccaaaacgctgccggagtgggtctctggtctgctggcgtataacccgatggcgaccattatcggttcataccagaacgtgatgctctatcaccagagccctaactggctggcgctgcttccggtcacggtgctgtccgtcattctgtttttatttgcctggcgtttatttaaaaaacatgccgctgatattgtggacgagatttaatcatgagtatcaaagttcagcacgtcggcaaggcgtataaatattatccatccaaatggaaccgggtcattgagaaacttctgccgggcgataagccgcggcacagcaagaaatgggtattgaaagatatcaatttcagtattgaacccggtgaagcggtcggcattgttggggtgaacggcgcaggtaaaagtacgttactgaagctgctgaccggcaccactcagccgaccaaaggcagcattgagatccaggggcgtgtcgctgcgctgctggagctgggcatgggcttccatcctgactttaccggtcggcagaacgtgtatatgtccgggctgatgatgggcctgagccgggaagagattgagcgcttaatgccagagatcgaagcctttgcggatatcggcgactacattgaagagcccgtgcgcatctactccagcgggatgcaaatgcgcctggcgttcgccgtggccacggcctcacgcccggatattctgatcgtcgatgaagcgctttccgttggtgactcccgttttcaggcgaagtgctacgcccgtattgcggactttaaaaagcagggcaccacgctgctgctggtctcccacagcgccggggatatcgtcaaacactgcgaccgcgccattttcctcaaaaatggtgatatctgtatggacggcaccgcccgtgacgtgaccaaccgttatctggatgagctgtttggcaaagccgacaaaaacagcgcgccaaaaagcgcaacggcaacctcgtcagccagcggcgaaagtcagatgtctctcgatgagattgaagatgtataccacacgcgcccaggctaccgtccggaagagtaccgttgggggcaggggggtgcaaaaatcattgattatcatatccagagcgccggggttgattttccgccttcactgacgggcaatcagcagaccgatttcctgatgaaagtcgtatttgaatatgactttgattgcgtggtaccgggtttgttaatcaaaactctggatggcttatttctatatggtaccaactctttcctggcctcggaaggccgggaaaacatttcggtatcacgtggggacgttagagtatttaaattcagttttccggttgatttaaatagcggtgactatcttctgtcgtttggtatttcagagggaagcccgcaaaccgaaatgacgccgctcgatcgtcgctatgactccatcattttgcatgtaactaagagcatggatttctggggagtgattgacctgaagtcgactttcaatagttaccaatgaagatgagaaaaaatcattccatgactactaatacacataaattggttagcgaattacctgaaatttatcagactatttttgggcatcctgagtgggatggcgatgctgcacgagactgtaatgaacggctcgcgctaattagtgaacaatatgacagcttgtccagagagttaggaaggccactacgggttctcgacctgggctgtgctcaggggttcttcagtttaagtttggcaagcaagggtgccagcgtattaggtatcgactttttgcagcagaacattgatgtttgtcaggcgcttgctgaagaaaatccacattgtgatgtcaaatttcaagtcgggcggatagaagacattgtcagcactctggaagaaaaccaatttgatctcgccattggactaagtgtttttcaccacattgttcatctgcatggggttgctgaagtcagatcgctgttagagcgtttggcaaatctgacgcaggcgatgattctcgagctcgctgtcaaggaggaaccactctattgggggaaatctcagcctgaagatccgcgtgaacttattgaccaatgtgctttctatcgattgattggaagatttgacactcatctgtctaatatttcacgtccgatgtatattatcagtaaccacagggttattcttccggaatttaatcagccttttacttcatggcgcgacagtccttacaccggagcaggctttgcgcataaacagagccgtcgctattatttctcttcggagttcatatgtaagttctatcgttttagtacagtaagttgcttactaactgataaggagagcgagcgtaatcgtactgaactcgcccatgaagaagcttttcttaaatctccaccatctggcttaaaagtgccggcgttgtttactgcaggggggaatggagaagcgggatggttggtaatggaaaaaattcccggagagttgttaaacgacgttctggccagtgaacggcatattgatcgggaaaaagttatttccgatctcctcgaccaattagttattttggaagaacatggtctatatcatgatgatttcagaacatggaatgttttaattgacgataatgacagcgctcgtttaatagattttggttcgattggcgatgtacaacaagactgcagctggccagttaatattttccagtcgttcattatttttgtaaatgaaatattttgtgaaaataaatcctggaggggcttctggcgttccgcaccattaagtcctttccagttgcctgaaccgtattcaaattggttgacagcattctggaaacatcctgttggtgagtggagttttgctttactccaacaactcttttcaaccaaagatgctctaccggctgcgagttccattatggacgcttctgatctatgggtccgggctcaggagcccgtattgttggaaagtcaaacgcaaatacgcaatacggatgcgcgggtagtccgtctcgagtcgcaaatcaatgaactcacctccctgattaatattatgggtgagagcattcagacgtttgagaagcgtgagtatccgccacaagacgttactactaatgtacagccgcgtatcgagattgagcagagtaaagccgttgattcagaagagattatgcgacttcatacgcagctcaatgatgctcagcaagaaatagagaatctacgtcatgagattgctaaaattcattatagtcgctcatggaaaatgaccaagtggtatcggtacgctggcttacagtactatctgcttcgtcagtacggcttcaaacagcgttttaagcatttactcaaacgagtgcttagcaacgtattttattttttgcgtgcacatccacgactaaagcagaaggtgatcaatctactgcgtacaattggaatttatgactttgcttatcgtatgcatcgtcgtatgaatcctggttcacataacccttatccaaacgacccacaataccagtcgcagactgaaaagcagatcttacatccagagttattgcctccggaagttaactcaatttttagcgagcttaaaaacaaaagataaggtgagtcacttgcatattttgattgacgtacaaggatatcaatcggaaagtaaattccgtggagttggtcgcagcacctatgaaatgagtcgtgcgatcataaaaaatgcgggccagcatcgagtaagcattttaatgaatggcatgtattcgattgatagtataaatgaaattaaaaaaagctggggtgatatattaccgcaggaagaaatgtttattttttcagctgctggccctacagctcttcgcgactgtgaaaaccatccccggagtgttgccgccacactagctcgtgaacttgctattgctaatatcaatcccgacgttgtttttattattaatttctacgaaggttttgacgatagttataccgtctcaattcctcaaactacagtaccatggaaaacagtttgtgtttgtcacgatctaattccgttactgaataaagaacgctatctgggcgaaccaaacttccgtcagtattattatgataaactagctcaatacgaaagggcggacgctatttttgctatttccagatcatccatgcaggaagttatcgattacacatcgattccggcagaaaaaattattaatatttcatctggagtaagcgattcatttaaaattaaagattatactcacgatgaaatcaaagacttacgtaataaatatcatcttcctcaagagtttattctttctttggcaatgatagagccacgtaaaaatattgaagcgctgattcatgcatatagtttattaccgcatgccctgcaacagagttatcccttagttttggcctataaaattagcaccgatgaaaaggaaaggctgtaccgagttgcagagaactatggtttatctcgtaatcagcttatttttacaggcttcttaaacgatagtgaccttatcgcactttacaatttgtgcaaaattttcgttttcccctctatacatgaagggtttggcctgccgccactagaagctatgcgttgtggtgcagctacgctgggttcaaatgtgaccagcttacccgaggtcattggtatggaagaggctttatttaatcctctggatgtccccgacatttgccgtgttatgcaaagggccttgactgacagtgagttctactcagcattaaaagctcatgctccggcgcaggcggcaaagttcacatgggatcacaccgcgcagctcgcgttaaagggatttgagaggcttgtagataaggcttccgcatcagaacctctggatatcacaagcttcaccgcacacaccattaatagaattaaaaatattgcagaattaagtgaaaccgaacgcttacagacagcctgggcgattgctcgtaatagctttgctacacatcagcgcaagctgctggttgatatttctgttcttgttgagcatgatgcgaaaacgggaattcaacgggtttctcgcagtatacttagtgaattactgaaatctggcgttgctggttatactgtcagtgcggtttattatcgaccgggtgaatgctatcgctatgccaacgaatacctgaatacccattttaacggggcgttcgggcctgatgtacctgtactgtttaccaaagatgatattctggttgctaccgatctaactgcccatctgtttcctgagcttactgtccagctggattttattcgtctatccggtgccaaggtttgttttgttgtgcatgacattctgcctctgagaagaccggagtggagcgatgagggaatgcaacgcgtgttccccatttggttatcttgcattgcgcagcacgctgaccgcttgatttgtgtatcagcaagcgttgcagaggatgtaaaagcctggattgcggaaaacagccattgggtgaaaccgaacccgctgctgaccgtcagcaacttccatctgggagccgacctcgatgccagcgtaccgtccactggcatgccggataatgcccaggcgctgttagcagcgatggccgcggctccatcatttatcatggtgggcacgatggaaccacgcaaaggacatgcgcagacgctagcggcatttgaagaattgtggttacagggcaagaactacaatctgtttatcattggtaaacaggggtggcatgttgatgatttatgtgaacgtttacgtcaccatccacagctaaataaaaaactattttggctacaaaacattagcgatgagttccttacgaagttgtattctcagtctagtgcgttaatcttcgcatctctcggagaaggctttggcctgccgttgattgaagcggcgcagaaaaagctgccagtgattattcgcgacattccggtgtttaaagagattgctcaggaacatgcgtggtatttctccggtgaagcgccgtccgatatcgcgaaagcggtagaagactggttagccctgtacgagcaaaacgcgcatcctcgttccgaaaatatcaactggttaacctggaaacagagcgcggaatttctcctgaaaaacctgccgattatcgcgccagccgcgaagcaataatcgctatcaacagggctaccccggtggcccttgtgatgagttcgttatgaaaattatttttgctactgagccaattaaatacccgttaacgggcatcggtcggtattccctggagctggttaagcggctggcggtcgcccgcgaaatcgaagagctaaagctgtttcacggcgcgtcgtttatcgatcagatcccccaggtggagaataagagcgataccaaagccagcaatcatggtcgtttgtcggcgtttctgcgccgccagccgctgctgattgaggcgtatcgcctgctgcacccgcggcgccaggcgtgggcattgcgcgactataaagattatatctaccatggtcccaatttttacctgccgcatcgcctggaacgcgcggtgaccacgtttcatgacatctccatttttacctgcccggaatatcatccaaaagatcgggttcgctatatggagaagtccctgcatgagagcctggattcggcaaagctgatcctgaccgtctctgacttctcgcgcagtgaaatcatccgcctgttcaactatccggtggagcggatcgtcaccaccaagctggcctgcagcagcgactatattcctcgcagcccggcggagtgcctgccggtcctgcagaaatatcagctggcgtggcaggggtatgcgttatatatcggcaccatggagccgcgtaaaaatatccgcggtctgctgcaggcctatcagctgctgccgatggagacccgcatgcgctacccgctgatcctcagcggctatcgcggctgggaagacgatgtgctgtggcagttagtcgagcgcggtacgcgtgaagggtggattcgttacctgggctatgtcccggatgaggacctgccttatctgtacgcggcggccagaacctttgtttatccctccttctatgagggattcggtttacctattcttgaagcgatgtcttgcggtgtgccggtagtatgttccaatgtcacttctttgcctgaagtggttggcgatgccggcctcgttgccgatcctaatgatgtagacgcgattagcgcgcatattttgcagagcctgcaggatgatagctggcgggaaatcgccaccgcgcgcggtcttgcccaggcgaaacagttttcgtgggagaactgtacgacccagaccattaacgcctataaattactctaagggtgtcagttgagagttctacacgtctataagacctactatcccgatacctacggcggtattgagcaggtcatttatcagctcagtcagggctgcgcccgccgggggatcgcagccgatgtttttacttttagcccggacaaagagacaggtcctgtcgcctacgaagaccatcgggtcatttataataagcagctttttgaaattgcctccacgccgttttcgttgaaagcgttaaagcgttttaagcagattaaagatgattacgacatcatcaactaccattttccgtttccctttatggatatgctgcatctctcggcgcggcctgacgccagaacggtggtgacctatcactcggacattgtgaaacaaaaacggttgatgaaattgtaccagccgctgcaggagcgattcctcgccagcgtagactgcattgttgcctcgtcgcccaactacgtggcctccagccagaccctgaaaaaatatcaggataaaacggtggtgatcccgtttggtctggagcagcatgacgtgcagcacgatccgcagcgggtggcgcactggcgggaaaccgtcggcgataacttcttcctcttcgtcggcgctttccgctactacaaagggctgcacattctgctggatgccgccgagcgtagccggctgccggtggtgatcgtcgggggcgggccgctggaggcggaggtgcggcgtgaggcgcagcagcgcgggctgagcaatgtggtgtttaccggcatgctcaacgacgaagataaatacattctcttccagctctgccggggcgtggtcttcccctcgcatctacgctcagaggcgtttggcattacgttactggaaggcgcgcgctttgccaggccgctgatctcctgcgagatcggcaccggtacctcgttcattaaccaggacaaagtaaatggctgcgtgatcccgccgaatgacagtcaggcgctggtggaggcgatgaatgagctctggcataacgatgaaaccgccagccgctatggcgaaaactcgcgtcgtcgttttgaagagatgtttacagccgaccatatgattgacgcttacgtcaatctctacactacgctgctggaaagcaaatcctgaggccagctacccccgccgttgcggcgggggtcaacgcgttagtgtcgactcttcagattatcaatcacttccccaagatccagcccctggtcctgcagcagcaccagcaggtgatacatcaggtccgacgcctcattcttcagttcgaagcggtcgttcaccgtggcggccagcgcggtctccacgccttcttctcccactttctgcgcaatacgcttggtgccgctggcatacagcttcgccgtataggagctctccgggtcggcgtgcttacgctcggccagcagctgctccagctgatagaggaagagccactggtggccggtttcgccgaagcagctggtggtgcctttgtggcaggtcggcccgatcgggtttaccagcaccagcagcgtatcgttgtcacagtccggcgtgatgctcaccacgttgaggacatggcccgaggtttcacccttggtccacagccgctgcttggtgcgtgaataaaaggtgactttgccggtcttttcggttttctccagcgcctccttgttcatgtagccgtgcatcagcacttcgccggatacggcgtgctgcacgatggccggcatcatgccgtccgttttttcccagtccagctgttcagtcaacatacccttatctccacgccctgtgccgccaggtacgctttcagttcgccaatattaataatctgtttgtggaataccgaggccgccagcgcgccgtcaacgtcggcgtcgcggaaggcttcgaggaagtgttccatagtgcccgcgccgccggaggcgatcagcgggacgtggcacaccgcgcgaaccttcgccagctgctgcaggtcgtaaccgttgcgcaccccgtcctggttcatcatattgagaacgatctcgccggctccgcgcttttgcacttcctgcacccaatcgagcgtctcccactgcgttacccgggtacgactctcatcgccggtatattgattgacgtgatacttaccgctctcggcgtcaaaccaggtatcgatacccaccacgatacactgcacgccaaagcggtcggcaaggcgggtgatcagcgtcgggtcggcgagagcaggggagttaatcgagatcttatcggcgccgaaggagaggatctgcgccgcgtcttcctgcgacttgatcccgcccgccacgcagaaaggaatatcaatcacttccgctacccgcgacacccagctcttgtcgaccacccgaccgtcgctggaggcggtgatatcatagaacaccagttcgtcggcaccttcgtcggcatagcgcttggccagcgggacgatgtcgccaatgatctcgtgattacggaactgtacgcctttcactacctggccgtcgcggacgtcgaggcaggggattatccgttttgccagcattgaatggcctccgttacgttgaatttaccttccagcagcgcgcgaccgacaatcacgccgcgcaccccggtgccgcgcagggcggcaatatcattgagatcgccgatgccgccggatgactgaaacgccacctgcgggtagcgggcgcagacttcctcgtacagcgagacgttagagcctgccagggtgccgtcgcgggagatatcggtgcacagcacgtgctgcaggccgaccggcagataactttccaccagctcctccagcgtcacgccggagttttcctgccagccgctgaccgccacctgcttattgccgtcggcgtcgatacgcacgtcgagggcgagcaccagccgttctgggccaaagcgtttgaaccagcctttcacttcctccggggatttcaccgcggtggagccgaccaccacgcgggcgacgccggcctcaagcagggccgcgacatccgcttcggtccgcacaccgccgccaacctgtaccgggacgtcaaccccggcgaccagcgatttcagcagcgggatttggcgtttcgccggatccttcgccccggtcagatcgaccaggtgcaggacttccgctccctgagcggcataggcctgcaggcgcggcagcggatcgctgccatagtcgcgctgctggccgtaatcgccttgatggagacgaacgacggtgccgtcgattaaatctaaagcaggaataatcatcacatctccaggaagtttttcagcagctgcgccccggcgctcccggagcgctccgggtgaaactgcacgccaaagaagttatctttctgcaccgcggcggtgaacgcctcgccgtaattgcactgggcgatggtgtacgggttgaccggcatggcgtagctgtgcacgaagtagaaatacgcgccttcttcaatgccgcggaacagccgatcgccagctttggcatacacccggttccagcccatgtgcggcagcggcagaccgtggtcggtcatcttcggcacctcttcttcgataatgcccagcagatcgacgccgttgttctcctcgctgcgcttgccgagcagctgcatgcccaggcaaatccccagcaccggctgggtacaggctttgatcaggtcgatcagctcccggtcgcgcagctgatccatcgccgcctgggcggtgccgacgccgggaagaaacagtttatcggcacgcaataccacttccggatcgcggctgaccaccggctcatagccgtggcggccaatcgccgatttcaccgaattgaggttggcgcagccggtatcaaggatcaccacattcattacagcacccctttggaagacggcagggcatcgccctggacgcggatcgcctggcgcagcgtacggccaaaggctttgaacaggctctccacgcggtggtgatcgttcttgcccttggttttcaggtgcagggtcaccgccatggtgtaggagagcgagcggaagaagtgttccaccatctcggtgctcagatcgccgacgcgctgataggtgaagtccgccttatactccaggtgcggacggccggagatatccagcgcgcagcgggcaagacactcgtccatcggcagcacgaagccgaagcgattgatgccgcgcttgtcgccaagggccagcttcagggcttcgccgagggccaggccggtatcttccaccgtgtggtgatcgtcgatgtacagatcgccgccgacgttaacctccatgcggaagccgccgtgggtggcgatttggtcgagcatatggtcaaaaaagccgacgccggtgtggatcttgctgccgccttcgcggtccagccacactttcacatccacctgggtctctttggtgatgcgctcgacgtgggcatagcggtcgcggcgggtcagctgctcgcagatggtcggccagtcgagcgtctcgcggtcatagcgcagaccggtaattcccatgttatccgccagctcaaggtcggtggcccggtcgccaatcacatagctgtgggatttatccagcacgccctcttccagccacggcagcaccagctgcgtttttggcttgcggcaggcgcagttgtcgcccgggaagtgcggacaaatcagcacctcttcaaagttaacgccctgcgaggcgaagatctgcatcatcaggttgtgcgggccatcaaacgcttcctgcggcagactgtcggttcccaggccatcctgattggtgatcatcaccagcttatagccttcctgctgcagcttcagcagcgccgggatcacctgcggctcaaacgccagcttgtcgaaccggtccacctggaaatcctccggcggttcggaaatcagggtgccgtcacggtcaataaagagatacttctgggtcatacattctccgcagtcaaagcgtcaatcacgcgctggctctcggcacgggtaccgatagtgatacgcaaacagccgcttaatgaaggttgtttattctggtcacgtaagataatgccctgatcccacaaagatttaaacactgcgctggaggcggttatccgcgccagcacatagttggtctcggaatcgaagacctgctccacgcaggcgatgccgcgcagctgttccaccaggtagcggcgctcgtcaaggatctgcgccacgcgctggcgcatcgcggcgatcccctccgggctcagggcctgggcggcgatatcggccaccggcgtggagagcgggtacggggcgatcactttcagcagcacgttgatcacctcggcgttggcgagggtgaagccgcagcgcaggccggcgagggcgaaggctttggacagcgtgcgcagcaccaccaggtgtggatagtcgctgagccagccggagagcgtcgcctgcgggcagaattcaatataggcttcgtcggccaccacgatggctttgttgcgggtcatctccagcaggtcgcgcatcgactgcgggtcgataatctgcccggtcgggttgttcgggctgcagacgaagaccaccttcacgccgtccagccgcgcctcgatgcccggcaggtcgagctgccagtcggccagcgtcggcacggtgcggcactcgacgccgatggtttcggcgctgacgctgtacatgccgtaggtcggcgggcagtagagcaccgcgtcttcgccgggctcacagaaggcgcggatcagcagctcgatgccttcgtcggcgccgcggctgaccagcacctgctccggtttgacctcggcgtagcgggcgtagctctcaatcacggccttcggctgcggctccggatagcggttcagcgtctgttcggtaagctggaaggctacggcggtagggaattcgttggcgttgagccagacgtcgcctttgccgcccagccggcgagcggattgatacggggtcagcgcgcggacgttggcgcgggctaaatcttcaatgctcatgcttgctccttcagggcggcaacgcgcagcgttacggcgtttttgtgggcgtcaaggcgctcggcggcggccaggatctcaatcgttgaggcgagggcggcaaagccgtcgcgcgacagctcctgcacggtcatccgcttctggaagtcggccaggccgaggcttgagcaggtggcggtgtaaccataggtcggcaggacgtggttggtgcccgaggcgtagtcgcccgcggattccggtgaccagtcgccaaggaaaacggaaccggcgctggtgatgctatccaccagctcgcgggcctgacgggtctgaatgatcaggtgctccgggccgtacaggttggaaatagccacgcactgcgccagatcgcgggccacgatgatccggctggcggagagcgccacgcgggcagtttcggcgcgcggaagggcggccagctggcgctccacggcttcggcgacgcggctgcccatgtcggcgtccggggtcaggaggatcacctgcgagtccgggccgtgttccgcctgcgacagcaggtcagacgcgacaaagtccgggttggcgccgctgtcggcgatcaccagcacttccgacgggccggccggcatgtcgatggctgcgccgtccagacgctggctgacctggcgtttggcttccgtgacgtaagcgttgcccgggccaaagattttatctaccttcggcaccgactcggtaccgagggcgagggcggcgatggcctgggcgccgccgacgttaaagatggtttttacgccgcacagctgcgcggcatagaggatctcatcggcaatcggcggcggcgagcagagcaccacctgctgacagccggcgatgcgcgccggcgtcgccagcatcagcaccgtggagaacagcggcgctgagccgccgggaatgtacagtccgacggaggcgatagggcgggtgacctgctggcagcgcacccccggcagcgtttcgacatccaccgcctgcagctgttgcgcgttgtggaaggtctcgatgtttttcaccgccaccgccatcgcctgcttcagctcatcgctgaggcgctcgccggcggcggcgatctccgcctcgctcacctgcagcgcggcgacggtggttttatcaaacttcgcgctgtattcgcgcagcgccgcgtcgccgttggctttgacgttattcaggatctccgtcaccgttttactgatgctgtcggaggcggaaatcgccgggcgcgttaagagttgctgttgttggtctgcgctacagccgttccagtcgatgattgtgttgaagctcatgattgtattcccctgtgtgtcccgtgaccggctggccgattactccatcattttctcaatcggcagcaccagaatggagctggcgcccagcgccttcagtttttccatggtctcccagaacagggtttcgctgctgaccatgtgcatcgccacgcgctgcttgtcgcctgccagcggcagaatagtcggccgctcggcgcccggcagcagggccaccacttcttccaggcgttcggtcggggcgtgcatcatgatgtatttcgactcgcgggcctgaatcacgccctgaatacgggtcagcaggcggtcaatcagctgctgtttggcgtcggccatttcgccgtcgcgctggatcagacaggctttggagcggtagatcacttccacttcgcgcaggccgttagcttccagagtggcgccggtggagacgaggtcgcagatagcgtcggcgaggccggcgcgcggcgccacttccacggagccgttcagcagacaggatttaaaggagatacctttttgatcgaggtagcgcttcagcaggtgcgggtaagaggtggcgatacgtttgccgtccagcgccgccgggccgttccaggcttcatccaccggagtcgccagcgacaggcggcagccgccgaagtcgagacggcgcagggtgaagtagcgcgggtcttcgccctgggcgcggcggctgagcagctcttcttccagcacgttttcgccgataatgccgaggtcgacaacaccgtccatcaccaggcccgggatatcgtcatcacgcacgcgcagaatatcgattggcatattttccgccagcgcaatcagacgctgggtgtgcaaattgactttaatgccgcagcggctgagtaattcgcgtgaatcttcgcttaaacggcctgatttctgaatagctatgcgtaaacgggtgttgtctaacattgttcttttcctctgaatacctgtctgaatctgtccgaatttggtccaaaaaaaagcccccggaagtgaatcttccgggggctctctgcgcgttcatgcaccactggaagatccaaacgtcttccagcacacatcgcctgaaagactagtcaggatgatggtgatgatggtggtgtttaaattgaacgcggttcataaaaattctctgtgaatgactatgcatttgatgtcctttaacctaaaccacttccgccgcagaaagcaagggcttttttctatcattaattcatttcatattgagcgaagaaattgtcagttgccgctggctggcgtagcctgtaatcagcacagcgaaagagtcaggagcctgggatgaaaaaggtcgcgatagtcggtttgggatggctggggatgccgctggcgctgtcgttgacggcgcgaggctggcaggttaccggcagtaaaactacgcaggatggcgtggaggcggcgcggatgtgcgggatcgacagctatccgctgcgcctggagccgcagctggtctgtgataccgaggacctcgacgcgctgatgaacgtcgatgcgctggtgatcaccctgccggcccggcgtaccggggcaggggaagggttttatctacaggcggtgcaggagatcgtcgataccgcgctggcgtaccatattccgcggatcgtcttcaccagctccacctcggtgtatggcaacgtcaacggtacagtgaaggagaattccccgcgtctgccgcaaaccgccagcggacaggtgctcaaggagctggaggactggctgcacaacctgccggggacgtcggtggatattctgcgcctggccgggctggtggggccttcccgtcatccgggacgttttttcgccggcaagtcggcgccggatggccagcacgtggtcaatctggtgcatttgcaggatgtggtggccgctatcgaactgctgctgcaggccccgaagggcgggcacatctataatctatgtgcgccccgccatccggcgcgcggcctcttttatccgcagatggcccgcgagctcggtctgccgccgccggtgttcagcgacagcccgggcggcggccagggcaagattgtagatggcaatcgtatctgcaatgagctggggtttgagtaccagtaccccgatccgctggtgatgccgatggagtgatccgccagcggtgattcgcataccgtaaggggggtagcgatgaaaccactgctggatgtcctcgtgatcctggatgccctggaaaaagaggggagctttgccgccgcgtcggcaaagctctttaaaacgccctcggcgctgagctacaccattcaccgcctggaaagcgatctcaatattcagctgctcgaccgcagcggccatcgcgcgcgctttacccccagcggacagatgctgctggagaaagggcgggaggtgctgcatatcgcccgcgaactggagatccgggcggttaagctgcagcaggggtgggagaatagccttcgtctggcggtggacagcacctttcccgtggcgctgctctcgccgccaatcgcggcattttatcaacaacagccgctgacccggctgcacttcacgctgaacccctccctgctggactggcggccgctgactgacgggcaggccgatctgctgctgggggcgctcggcgagccgccgccgctgagcggttatgactatctccccctcggcgagctggagctgctgctggtcgttgccccacagcatccgctggcgcgacaccgcgcaccgctaagctggcgaaccctgcgccgttaccgggcggtggccaccggcgagggcggggcgctactcagcgatcaggagaccctgacggtgtgtgacgccgcggggcagctggcgctgctgcgcctggggctgggctgggggtgcctgccgcgctatcaggtgcagggtctgctggacagcggcgagctggtctgcatgaccgtgcgcgggctgtcgcctcgtcaacgcgcgtggatcgcctggaatgacgccacctgcggtttggctggcaaatggtggcgggaaacgctattagcaaatagtgctatttttacaatttatcatacggaaaccgtatagatattagcacgttaaaaattatgcttacgcaatgaacttcataacatcttgtcaacgccgttgaatttgttgcaaaatatgcggcctgaaaaccagagactagccgacgcttttttttaaagtgtcggttatttttttggtcgaaagacacatcattcaataccaagaggccgggcttcgtaccggatagatatttactaaaaaccgacagtcgttgtcgctgaggaatagaaagaaatggggcaattttttgcttacgcgctggcgttcaccgtaaaaggggataactatgtcgcataacgctactccaaatacctctcgcgtggaattacgtaaaacgcttacgttagttccggttgtaatgatgggcctggcctatatgcagccgatgacgctgttcgatacgtttggtatcgtctctggtatgaccgacggtcacgtgccgacggcctacgcctttgcgttaatcgctatcctgtttactgccctgagctatggcaagctggtacgtcgttacccttctgccggctcggcgtatacctatgcgcagaaatccatcagcccgaccgttggctttatggtgggttggtcctcgctgctcgactacctgttcgcgccgatgatcaacattctgctggcgaaaatctattttgaagcgctggtgccttcgattccgtcgtgggtgtttgttatcgcgctggtcgcctttatgaccgcctttaacctgcgcagcattaaatccgtggccaatttcaacaccgtgatcgtggtgctgcaggtggtgctgattgccgttatcctcggcatggtgatttatggcgtgtttgaaggcgagggcgccggtacgctggccagcagccgtccgttctggtccggtgacgcgcacgtgatcccgatgattaccggggcgacgatcctgtgcttctcgtttaccggtttcgacggcatcagcaacctgtctgaagagaccaaagatgcagagcgcgtcattccgcgcgcgatcttcctgaccgcgctgatcggcggcctgatcttcatctttgccacctacttcctgcagctgtacttcccggatatctcgcgctttaaagatccggatgcgtcacagccggaaattatgctctacgtggcaggtaaagccttccaggttggcgcgctgatcttctccaccatcaccgtactggcgtccggtatggcggcgcacgctggcgtggcgcgtctgatgtacgtgatgggccgcgacggcgtgttcccgaaaagcttcttcggctacgtgcacccgacctggcgcactccggcgatgaacatcatcctggtcggcgcgattgcgctgctggcgattaacttcgacctggtgatggcgacggcgctgattaactttggtgcgctggtggcgtttaccttcgttaacctgtcggtgatttcccagttctggatccgtgagaagcgcaacaagacgctgaaagaccacttccagtatctgttcctgccgatgtgcggcgccctgacagttggcgcgctgtgggtcaacctggaagagagctcgatgattctgggcctgatctgggccggtatcggtctggtctacctggcctgcgtgaccaaaagcttccgcaacccggtgccgcagtacgaagatgtggcctaaggcatagcgtgatgtaaataagaaaagccggagggaaacctccggcttttttttgtctgcgccggttcgacatcgaggcctgatttttttgcagggcggcgcttgccgggcctgggggacataagctgacgggaggccgccgtaggccgggtcaggcgcagccgccacccggcagaagagcttatcctgcctgcaccataactttcagcagcgtatccagcaggccgggaaaacgggcgtccagatcttcccggcgcagcgaaatcatgttctcccgtccctgaggccgttgccagatcacaccgctgtcgcgcaggacgcgccagtggtgggtcatggtggacttggccacctcctcctggcgcagggcgttgcagctcagttcgctgccgtcggccagcgtacgaatgatctccagtcgcagtgggttaccgagcgcggaaaggacattttccaggcgaatttgttctcgttcggggtgattggcgatcataataatcctgtgtcggcggtggcgcggcgcatggcagccgcagcccatatcggcggctggcggctactatacccaaactccggttcagataccacgcgcgccgccgcaacctgcccaatcgtaatgatagcaaaaatagttcgaatatactcgtacagttgtactaagatagacgcagttaaatgaactgcggatcatttcgaccgcagactgaccgtcaaaacgactaaggacgcatcatgccccgacccatccctctcgaacgttatcgcaacatcggtatctccgcgcatatcgatgccggtaaaaccaccaccaccgagcgcatcctgttttataccgggatgagccataagctgggtgaagtacacgatggcgcggcaaccaccgactggatggcccaggagcaagagcgcgggatcaccattacctcggcggcggtaagctgcttctggccggggatggaccgcagcttcgagccgcaccggatcaatatcatcgacaccccggggcacgtggatttcaccattgaggtggaacgttccatgcgcgtgctcgacggcgcggtgatggtgtatgactccgtcggtggggtgcagccccagtcggagaccgtctggcgccaggcgaataaataccacgttccgcggctggccttcgtcaacaagatggaccgccccggcgcggacttcttccgcgtggtgcagatgatgatcgaccgtctgaaggctaacccggtgccaattgtgatccccattggcgcagaagagcatttcaccggcgtcgtcgatctggtgaaaatgcgcgccatcctgtgggatgacgccacccagggcatgaccttcagctatgggcctgtccctgacgatctgctggcgacggcacagcagtggcgggagaaaatggtctcggcggcggcggaagccagcgatgagctgatggataaatacctggaaaccggcgagctggacgaggcggagatcgttgccggtctgcgccagcgcacggtgaagggggaaatccaggcggtgctttgcgggagcgcctttaaaaacaaaggcgtgcagcgcatgctcgatgcggtggtggagctgatgccatcgccgctggatattccggcgatacagggcgtcgatgagcaaggccagccggcggaacgccatccgagcgacgatgagccgctgtcggcgctggcgttcaaactgatgaccgacccctacgtcggccagctgacctttatccgcgtctactccgggacgctgaagaaaggcgatgcggtgtggaacccggtgaagggtaagaaagagcgcatcgggcgtatcgtgctgatgcaggccaacgaccgtcacgaagttgacgaactgcacgccggggatatcgcggcctgcgtcggtctgaaggatgtgaccaccggtgatacgctgtgtgatccggatgcgatcattaccctcgaacggatggagtttccggagccggtgatttcgctggcgattgagccgaagaccaaagcggaccaggagaaaatgggcatcgcgctgcagcggctggcggcggaagatccgtcgttccgtctgcataccgatgaagagtccggccagacgattatctccggcatgggtgagctgcatctggagatcattgtcgaccggatgaagcgcgagtttggcgtcgaggccaacattggccgtccgcaggtcacctaccgcgaaaccctgcgcaagaaagtgacggacgtggaaggcaaatttgtgcgccagtccggcggcaaagggcagtatggccacgtcgtgctgaccctggagccgctggagccgggcagcggtttcgtcttcgaggacgccaccaaaggcggcgtggtgccgcgcgagtacatcccttccgtggagaaagggctgcgcgaagcgatgggcaccggcgtgctggcgggttatccggtggttgacgtgaaagcgaccctgaccttcgggtcgtaccacgacgtggactcctcggagatggcgttccgcatggcggcgatcttcggcttccgggagggcgcacgcaaagcggacccggtgatccttgagccggtgatgcacgtcgaggtggagacgccggaagagtacgccgggaatattatgggcgatctctcttcccgtcgcgggatggtgcaggggatggaagagcgcttcggcagccagatcatccgcgccgacgtgccgctggcggagatgtttggttattccaccacgctgcgctcgatgtcgcagggacgggcaacctacagcatggagttccaccattacgcggaagcgccgcgtaatgtggcggatgaaatcatcgccagccgcgcgaaaagctaagcaacgttcccgggtgcgacgcgaggcgtcttacccgggctactctggtaccagcgcccaggcccggtaaggcgaagccgccaccgggcaaaaaggtaagcgtgaactggggacgcaatacccggcggcgctgctggactgcccccaaaagttggacacccaactgagtttgtagcccgggtaaggcgttagccgcaacccgggtatttcagccaatcagacaatatcctgtgcgtactgccacagcgccttcagctgcgccagcttctctttatcatccgcatactgttgatacagcatctgcagctcatcggcataggcttgcaaaaactctggcgtaaacacctgacgacggtgctctaaccagcgctgctgctcatgttcatcgagcgtgccggggaagttgcgcgcccggtagttaaacagcaggcgttcgatacgcttatcggcgaaggtaatatccagcgccggcagattgcgcggttcggtttccagcacgattttcatcgccgcgcggtcggcatcgctaaagaacccattgtaaagctgggcgtcgacgttttcggacggcacgaacggctcggcttcggcatagaccgccaccactttctcccgcacctgcggattcgcccgcagcagctgggcattctccagacagcgctgaatggagatccccagccggtcggcatcctgcgggcgcagggtattggcctgagccagcaccggacatttattgagatgcaccagcttgatcggcgccgccggcagatcgccaagctcggcgcgcggggtgtaaagccgctcgcgcaaggcatcggcatcgagctccagcagcggcgccatatcgcccgccagatcgaccataatcaccgcattgcggttttccggatgccaggccaggggcgccaccaggctggtgttgccgcgcgcggcgccaaacatgccggagacatgcaccaggggcttcatctgcggcacgtcgataagcgtcgccagcttgcgcttattgcggtggctgtagagataatcaaacagccgcggctgccgggttttcaccagcttcgccatggcgatggtggcgtacacatcggccatcgcgtcatgggcgttctggtgttcaataccgttggcgacggtcagatgttcaagccggaagctcggcaacccttcgtcattctccggccaggcgatcccttccgggcgcagggcatagcaggcgcgcatcacgtcgagcagatcccagcgcgagttatcgtgctgccagctccaggcataagggtcatagaagttgcgatagaagatattccgcgtcacttcgtcatcaaagcgcacgttgttatagccgacgatacaggtttgcggcaccgtgaacagatcgtggatgcggcgggcaaatatggcctcattatcccctttggccagcgcttcctgcggcgtgatcccggtgatcatcaccgcctgcggctgcggcaggtaatcgtcagcgggtttgcagtaaaacacttcgggctcgccgagcacattcagctccgcgtcggtgcggatggcggcgaactgcgccggccggtcgagggaagggctggtgccgaaggtttcataatcgtggaagaggaatgtgctctgtatgctttcgttttttactgtcacctgatgtatgcgctctatgttatatgtatttgattttagtttgttttaacgtcttgactgccatttcttgataacttttgtacaccgctaaacattgtcgattacgccagtacatgcgatattgagtacaggataagtacataaatcatcatttagctgagtacaaaaaacagaatggcaattagcgacacaaaactgcgttctctctatggtaaaccatattcgggcccggctgaaatcactgattcagacgggcttgggatccgcataacgcctaaaggagtaatcagctttcagttccgttttcgttgggacggcaaacagcatcgtctggggcttgggcgttacccatccttaacgttaagagacgctcgcaacaaggttgctgatttgcgcgaggcagttgataaagggattgacccccggattatggccggcgggctacgcgcccaaaacaagcccacggtaaaagagtgcctggactactggaaggaaaattacgtcgatatctcgttgagggaaaaaacacaggcgctctataaatcgacagtcattaaacatttgagcgatgtgtttgcgggggttcctgtcgaagatatccccgtacggctgtgggtggagctgttcactgaagaggagcgtatcaacccccggcgtgccaggcagctgctgattcagctacgatcggcgattggatggtgcgttcgcaggcagtttgtcagtgcacctgaactgatgctcctgcagcctaaggatatcggtgttaagccctcagtcggtgaggtgacgctgagttacaatcagcttgcaaaaatctggctggctattgagcgcagccgcggttcaacatcaaaccggctgttacatcagttattaatgctttatggcgcaagaaatagcgagatacgggattcggtaaagggtgagtttaacagggaagaggggatctggctgcttccagccgaaaggagtaagaccaaaaaagttgtcaggcgacctatttttgacgcggcggatactttgctgaaaaaggcagaaatgacctacggaaatattctctttcccgggcctgatctgactaagcctatgtctatcgccggtgctaatcgcttcctgaaaagaatcgagctttcactggggattggcgaatttaccgcacatgactttcgtcgcacgctggcaactcgcctttctgaagagggcgttgccccgcatgttatcgagaagatgctggggcatgagcttggcggcgtcctgactgtgtacaataagcatgactggatagcagaacagaaagacgcctacgagctgtacgcagaaaagatattctggcatatcaagaagatttcgggttgattccgccgtttaagatccacgcttccacctccgacagcaggtattgtttggggtgggtgcgtatcggttttggaaaattataacgctcggtatatttccatatagtcatacgcgatgagatgcgcatcatctgcatcacttctttctcggttatcatttcaatgctggccactaaccacctcctacggcctactggcctgttttttcatggcatcgagcaggatatcctgcactgtacgttttgaattgcgccgttccatcaccatttcatccatactgctggcggcgataatgtggtgtatgaataccgggcggttgtgtccggcctggatctgccgggttggcccgatacgttcgataatttgctggtactgctccaggtcccaccagtgcgagaaaaacaccagtatgttgccgccgtcctgcatattcaggccgtggcctgcgctggctgggtgagcgaacagtaccggtattttcccggcgttccagtcgcgtagcgtctgcggatcctggtcaagatggcggccgcgtgggaacgctttaagtaaccgctcgaggtcgtgtttccagtggtaggcaaccagcaccggcgcgccagctgcttcggtgagtatgctgtccagcgcctgcagctttgcgtcgtgcaactccgcccagctccccgcgtcgtcggtgtacaccgcgccgctggcaatttgcaggcacttaacggttttggccgccgcgtttggcgcttcgatgccttcgccgttcagctcgaggaacatttctttttccatctcgcgatactgctggcgtgccttcggcggcatgtccacgcggatcacattatggattggctctttgatatcgaaccagtcggcggcgtcgagcgagatagtcacatcggcgagtgcgcgctgtatttcgtcctgcgaatgcgcgaacggctccagctttgtccagctctggccgggaaattgtatcgagttaaaccagcgggaggtaaacgcgccgtacgtgcgcccgaggcgttgcccctgatcaacgaaccacgcttgcccccacaaatcaaccaggccattcggcgctggtgtaccggtaaggttcatccagcggcgcacgtgcttatgcgccactttaccgagtgctgcagctcgcttacccccgccgcgcagccggaacgattttagccgggtgctctcatccgggatgacggtaccgaacggccagcgaccgccgagctcttcaaccagccacgccagattgtcgtagttgatggtgaacacgctggcgttgctgtttgccagcgctgcagcgcgcgctttggcggtaccgacaacgggctgcacctcgatattgcgcaggtggccccactttacagcctcatccggccaggtgctggccgccacgcgcagcggcgcgaggaccagcgccggctgggtttccgcgccgcacatgaagagatcttccagcgcggtcagcgtcgccaccgttttgcccatacccatacccgcccagatgttgcagcgctctatattaatttcgtggttaatgatgagatcttgatatactctgggtttaaactctttaaagttattcgtcataattgtggccttacgtgctgggcgatacgcagggggaaaaatggatatatgggagaagagtaagttttttatttttgtattgtttgtcatgcccggcttcataagtatgaaggtttatgatgtatttcagtcaagacccgggcaggattattcaaaaacgttaatagatgtaattgcttatagttgcgttaattacgctttgctattagtgcctatttattacgtagaaacatctaatttaatgctaaaacatccagtttggtattacttcttttacttgtttaccttttttatacttccaatagcattgccagtgttgttaatctatatcagaacaagacgtgggttcacacgttttatgccccatccaactggcagaccttgggacttttattttaaaaaagctaaaaaaagctgggttatcgtaactctaaaaaatggtaaaaaatatgggggtagatatgattcggaatcatttgcctcaagctctcctgagccagagcaaatatatcttgagcatcattgggccttagatgccgatggtgatctggatcataagttgagagatacgcttggaattatcattttgactaatgagattgagagtatagagtttattgagattaccagtacacctgcgtctggtacgtgatgagataacggagtaatttatgacagttaaagataataaaggtattgcccaagatggctggcagccgccaagaacgactgaaataccccgggcgccggttaacaatggctatcagcctccgcgacaaacccagccgaaccaggttgaaaatccgccacctaaaaaacgttagtattttactgaagctagagtatctatcagtatttcctccagatctttgctatcaagcaccaccacgttaaagcccagtgcgcgtagccgttcgtgctcgcgcagctggtcggcgcgtggtgatttgcctggtgatttgcattccacaaaaacgatacggccaccgggcagcagcacgatgcgatcgggaaccgaacggcggccgggcgacacgaatttataggcaaccccgccggcggctttcaccgccgcggcaaggtgcttttcaataatgctctcgcgttcgtaggccatcagcttttatccagaggggcatgaatgggcccctcgatcggtcggatggattcgagcagcaaacgccggcgcgtacgctctgcaaaatggcggcggccggtttctttgtggtagcactcattcttgccgactacccacatagttttcgtctcgctcagtttcacggtcttcggtccgtcgacggtgataacggtcccggtatgcgttttcacgattgtcataacacctccgcgatagtccacgccagcaacgcccataaacatacgagcagaaacaccaacagtaataccagctgcaacaagaccttacctcgataactcatcgtccaccgccttgcgccgttcgcgcatgttctgcatcaggcagaaatcattccgccgttcgctccattcctgattgagctcgttgcgcgattcccggttggctttcgcccagaccttcgccgcgcggtcgaactcgcctgcttgctccagctgcacggcttcgcgcgcagaccggtaatacagcggactgtctctgtacttgaatgccataggggtcattccttacggtaatgaagcgcttcaaagccgccggcgttcagcggtatatcgggcgcccaggtggggttagtggagagcagggaagaaagcgcggcgtcggtgtagttgtcggagtccggcgcttcgcaaatcacctcatcgtgcacggtcagcacaatgctgtatccggcgttctcgatcagtggcatgttcccggccagaacgtcgcgggcggcagcctgtgtgacgttttcgaccagctttccgccgtaggttttgagccgttgccatttccgcgagtaggaattgatccccatgtaggtgatatttcctttctcaatcgacggcgacgggtagcagagtgcgcgcccggacggcaactggatacgcagccatgcgccatcgcggcgcactttcatatagccgcaatagagtgttttctttggtgtagcgatggcggcgcgtacggtgcgttcgagctggaaccagaaatcgcaggtttccgggtgcgcccggcgccacaggcgcttaagcgaatcgcaagcgatgaatacgcgctcagttagcccgtatgtcgctttacgcttcaccgattcgtcataccagctcttagcctcgcgctgcacatcgcgcgggatattcggcagcgcggcggtcgccagctcttcgagatcgaggccgtagaccagcgcaaaggtcaggaacgccgccacgccaccgccaaagccaaggcccagctccatcactttgccgatctggcgctggtatttggtcacgtcttcgtgcgatatgttgaaggcgcgggcgtaggccagtttgtagagatcgggcccggtgccttcgtcataccgccggaaggcgtccagcttccacgcctcaccggccagccacgccagctttcggccttcgatgttcgacaggtcggatacgacaagctttttacccgctggcgccataatgcagccgcgaagggcggagctggtcagctccatgacgttatcgaaaagcaaatcggcgcagccggatttaagcgcctcaatgccctcgtcgatacgttcctgctcgagcgtcgggcggggcaggttctggggctggaacagccgcccggcccagcgcccggttcgcgatgcgccgcaaaactgcagcgtaccgcgcagacgtccgtcgctgctgatacccttcatcagcgatttgtacttactggtgctcgtggtgctggcctgcaggcggatagccagcagctctttcactggcgacggcagatcagggtcggcaatacggcgttccagcgtgctgcgctgcatatccggcaagtcaacgccgtacgattcgacgatgtgcataatcatcgcatcgcgctgtgtggccgcctgcacttcgccgtcggtcattacctgcgtacgctttgccagttgcttctgttcaaggtccacggcttcgatcgctgcctgcgcgaactgcacatccatgcagacgcctcggtcgttgatctgctggtcgcgatgccacagcgccagctcagcgccctgatagttccactttggcagccgcttatagacttcgcgcattgcctcgatatccagcccggcgtaggcaacgaaccgctgccactctaccgggtgcgttttgctggttgcgcggcgcagcttgctgttcttcggacgaggtttacagaagagctggatcagcgatttgccttctttgtccttcgccttgtcctgcggaacacccagcacttcgcagagcgcccccagcgcgccgggcaggctgtgcgccagcgcctgcaccatcgtgtcgcgccagcgctcaaccggcggagccagccgggggtgggtgtggcgtagcaccgtgcggtcgaagtgtgaattgtggaaataaagcagggtatcgggatcggtaagggctttaaatagagggccggggattggctcgccagcagttaaatcccagacgttaaccggctcgttaccgatcgcccaggcgaacagcatcacctcgacgctctccgcgtacgcgtgggtaccgttggtaatcgggatttcgcaataggtttccaggtcgccccagagaatggtttcagacattttattttcttcatgaaataaaaaaccgcctcttggcggtttttttattgagaggagatgtggtgtgctcagtatgctaaatagtcatacaggcataataacttcctgaaatcggtatcacatcgacctgcgttgtcttcaagatattttttaagctcactaagggagatattatcttccatgactgcatacataattcctccaataactttccagtctgcgagattgttagttatgtcagtaattgatgtataattgttttcacaatccctaacatatctttttagatcatctataatcttgtctatttgtcgtgatttgtacttatctacattgataaggttttcgcaaattgaagaaaaggcaaagattggaaacctttctcttgttgatattacttgcttatttaggagcgaaataagttgggagtttgcttcatcaactattttaaaatagttttgaatcatttcagttttggtttgaaactcatatttgactgttttctcggacccgacagccaacaccatatcctcgttttttagttcgtcgatattttcagtgatgttaacttttatttcaccgccactttttatagtattccatactttttgaacttttctgatatccattgctgatacaggtagtacgagtttagacagcgcgtcgtatatggctgtgtaattatcggttttgattttatttattctaatcgttgccatgccttcaatatcaatatcgtgttcggttatctctattgattgattgtctggcgcatactccactaaaaggaagttatcacggattttttttgctagtgcagtattgacatttacataggaaaaaattgtcttcaagagtgattttatattggagtcactaatgctataaccaatgaatatgatcgggttatgtatgaaaatagataataactgtgcacgaattaattcatatttgttattgaaattatcgtagtcttcacgtgttataatgatattgttagagtcactgacgcaaccatgtattttatatacggagccataaggattgcttaataaaatatcgttgccaattagtgggttaaattcaaaaaatttttcacacaatctgtcgtagttcgttgtaattacagagcctatattttttcgtgctctaatcaatgcgtcaatttcattactcttttcgggttttatcatcagaggggtcagtaattgagttaaatagattttgaatctgcttaactttataccttctttcatgctgtcataaaatatgtcattaatttttacaaacttcccttttcggtcttcggctagtcgtttgttaaattctaactccaatttacttgctaatagatcatagctatactccccatttaccatagattcagcttttaaatcatagtaaaactcttcattctcagtcagttcaaaggatataaactctagaaggccattccaactgaatgagttttgaagatatcttaggctaaatccagtgccgatgaaaagcactgggtgatttttgtaatgccctacaaactcttggatttccataccaattctcaacgttgacattcatatacctcatagaatcaaattttgatagaaaattccaatagtcttgtaaaaaagcccgacgctcagtcgggcgttttttttgctttaaactagaccttcggcgtctgcaccttcgctgatatcgtcaaagtcgtccggtgttgccacaccgccgccagcgaaagcgtcaccatcgcgcaggaactggacgccgcttagtgatgcgttgatgcgcttaccaaagttgttatcctgcgcccagatatccaccacggcgttaacgtagcagccggcatacgggcgaccgtcggcctgaatcagtgcggtacggtcgcggtcgataacagtagggcgggctttgttcgccgcattcaggaataaattacccgggaagccctcatattcggctttctcgtctccgttgtgcaggcagagattgagctttttctccagctggccgtagatggtttcccacttctcgccccatttctctttcgccacctgtttaagcgttttgcgaacttcttcgagttgcgggtgtttcgggtccatcaggaagaccgccgagaagcgcggatcgccttcgccgtttacggttttcgcttcgaacagagcagggaaggccagacgtacgttattgagtttcaatttcatggtgttgttccttaaatcaaatgaggtcagcggcgatcgcatcttcggacacgtcgtcaaaatcgtttacagggttaacgttgagcgcggggcgcgggtcggattctggcgcgatggtgggcttaccatcagagcgggttatcagcgcttcgactttcgtccagcggcgtgggctttctttcttcaacagtttttcggcctgagtcgggcttatcaccttctggctgtacatctgatcctgtttcagcctgaaagatttcagcagctcttcggcttcaacttcatcgcgccatgcacgattgccctgcttaccggttaccagcttgaaccccgataccggatgcctggtggccgagataagcgaactaaggggccttaacactaaagacctcgagtctattaaagcatgggtaaccagaacgcatgataaatgggtaccaaaatttaaagaattcacgaccatattcgctcggcgaggtatccccctgggctcgtctaacgaagacgagttccttgcggacaagaccggtaaccgccgctggttgccggtagatgttgtcgaaatggttagtaccgatgccatagtccgtgacagagagctgctgtgggctgaagcccgcgagacgtttaagcgcctcggcggtatccagttccgcgatgctgaacgcctcggcgcaagcgtccatgagcagtacaccattaaggacgcgtggctcgagacggtcgagaaatggctcgagacgcccgacctgatgactaatgacattccgcgaaattgcgaatttttacgcgctagcgacgtgttgcgcgatgcaattgggttagatccgcgccacatcggaaaacgcgaagaaatgcgaatcagtaatgttttgcaaaattgcggttataagcgcgttcaacgtcgtgttgatggaaaaatgactcgtatcttcgagccagtgtaacaacctgtaccagcctcaaaaaacaggttggtacattttaactaattgaatttaaaggtcagtaccaactgtaccaactgtaccaaccaaatactttatatgtgcgtgtgattatataggctgttttgggagtttatataaaagggttggtacaggttgggtcaggttggtacacattaaattttaccagtagtaactaaacacacgaagcaaaaaggagataacacgatgcaattagctattgatttcgaacaaggtgaactgctttgcccgcattgcggtgggaattacgtacaccacggcgctgtggaggtttttaactgtaaggaagatgccaacgaggggcttcatgttcgcatcgaaggagattcgcttaccgcagacaggaatttaaaaggtaacccaagctctaggcgtcatggattacgaattgcgctttggtgtgaatcctgcaaaggaaactcgtaccttacgattgctcagcataaggggaatacgctaatcgacgtcgcaccagacaacaacggcaaggagtaaagaccatgcgcgcacgtcaaaagctaataaaaaccgctctctatgctcgcgcgtgcgcgcgttttgcgaggtgacctatgccagtcgtcgtcacagttaaaacggactggttgcgagtggtgaccgatatcactaacaccgggataccgctgcaggaactggccaccgggcttgatgtttcaaagtcagcgctcattggctggaagcagggaagcagccccaaccatcatacgggggaagcgctaatcgctttctggtgtgaagtgacacatcggcatcgttcagaacttccggtgcaggtcatcaggcgtcgttttgttcgcagcggaacccgtaatttttggccgaaagaaccaacggcccgccggtaatgaaaacttgcaaaaacagggcgttcaccgactaaaaatgctatgcaaaaaccgccctgttttatgcacgatttatgcagtcgattttcacactttcccgccagcaaaccgcaacaaataacctcttcaagctaaatcggtaacgagtgccgatcgcgtggtgccgataacgtacattatgttaaatcatgccgttttttaacaaattatccatttggtcaggattccgaccaacacccccgcgcacactctaggctccacgttccacaggagccaccacaatggcacgacagaagaaaaccatcgagactaccggggcaggagacaacgcagccgcaggacgccaccggcgcagcgctggcgggcgtcggcattagcggcgagcagctggcgacctctgaagccccaacggttgaccccgaagcaatcgcactcgcgaaccgcaacgccattcttgcaaccatcaacgagcagggcgccgccatcatcgcgcgctttgaatcgctgggtttctccgaccttaccgaccaaagccttaccgacaacctcgacttcctcaacctcgtacgcaaagccactgaggccaccaccggcagcgcgggcgcaacggtgacgaacgaagagggtaaaccgcagccggtacgcggcgcacctgtattaaccgaacacggctggcacgttccgggctaaggagaattttatgtgtggtagtacaccaaaagttgttcagtcagacccgcaggctgaggccgacgaagcagctgacgctgctgcgaaggccgcgaatgccgacgcagcagcgcgcaagaagcgcaagaaaggctcctcgctgctggctagcggtgctgaaggtgcaacggatacaggttcgtccctgctgtccaccggcgcacaggcagcgaaaaacaccttaggggcataaccgatggaagaactggccgtacggctgattaagcgtgtcgattctctgaaagcggcccgccaggtgcacgaaagcgtctggcgggagtgctacgactacacctacccgctgcgcggtgcagggctatccgaaacggttctcgatgcgcagagcgcaaaatccaaagtggcgaagctgctcgacggcacggctaccgatagcgcccgtatgctggcatctgcgctcatgtccggcatgaccccggcaaacgcgcagtggctgaatctggataacgtcaccagaactatcgacggctggttatgtggcgtgaaatgccgaatcacccgaacagccagcggcgataacaacaacaccaaaacggaggtgtatacgctgacggcgctggagggtaccggcgtgcgttgtctgcctggttcgcttttcgtgccggattatgcactgcaggattattcaggcgttgaaatgtggattgatgcaggaataaatgattttcgctcaggtaccgatgtagatttaacggatgatgttgaggcaattcgtgcaaatgttgacgcgatggtagatttcgccgaacgaagcgggagaaacattattttgctaagtttgacagcggataactattccactgaatttctgggcggcatccggtatacgcgtattttggaattgaataaccactggtcacaaaaatatccaaattattacgcgcgtggcaatgacggcctggacctgcgcgaaacgttggttgctaattataatcctgcaatagcccaggatgttatcgattacggccacgatataacgcctttatcactgcgcattgatgacaggcatcctaacactgtgggctacgggatatacgcatctgtggcttatgagttccgacagagacgaggttattaatatgggtatttttgttgtatcggatgcgtcgccaaaacaaagcggcaataaccccatgtatcttgaaaaagattcaattattatccgcagccagacgcttggtcttttggatttcagtaatgatcagtgttactcagccggttctccggtagctgcatatgcaaatatgaaaaatctggtgcataacgggtcgaatgcaacaaatggccctgcgccacgagtactggaagggggcatgctgaaatttgacggcaccgaacccagcaccaccgattatgcgctgctgccaacagatgagttttctttacccgctggatgtaaacgtgcgctggttagtgttgcattaaaactgcccgcgtctggttatggaacgccagcagccacacgttacccgatgttccttggccggatgaataacacagccgcaggaaacattaatttcggcgtgtgggggattgtcagcactgccggtgtgctcacttctgtgcagggggctgcgatgggcagtgttgctgtttcggctacggcgcaactcgcattactcaccaatggaggcgtacatgttgtttccgtatatgctgatggcgaaacgacacctggtacgctgatcacgcgtatttatgtcgataacatcctggtggctacggccacaaataacgcatgggatggggttgtgccagagcctactaatcttccgcgtattggtagttatcctgcgaccatccacagtccgtggaacggcatgaaggtaggccgaccgatggtgatgaaccttaccgggaaagataccgttgcgacggatatcatctctcaatccgtagaactggctaaacagtatctggtttaaggtggtgaaataatggctattaaatatttatccaatctcaaaatagagaacgaaattgacggatccgtgacacatctgtttgatgtggacggcgttattttcggcgttgtggtatccggtgacgctaaacaagtggtcgataaagattacgcagcttcgaatgcttatcaggttgcggatttccctcttcccgtttcataaggtcaggattccgacctgattaacgccttaccctcgcttcactacacagtgaaccccgcgggggtaaggcatgcgaatgaacaacctttcagacgtagcggcaggagcctcctacgtcacatctattggcagcggtggttactggctgctccagctcctcgataaagtcagccccagccagtgggcggcgatcggcgttcttgccagtatcgttttcggtctgctgacctacttcaccaacctttatttcaaaataaaagatgaccggcgaaaggcgcgcgactatgagcaacaaagctaagttcagcgccgcgatgctggcgcttctggccgctggcgcgtcagcgccggtgttgatggaccagtttctgactgagaaagaggggagcagtctcaccgcctataaagacggctctggcatctggaccatttgccgcggggccacgcgtgtggacggtaggcccgtcattcaaggtatgcggctgacgcaggcaaagtgcggccaggttaacgccatcgagcgcgataaggcgctggcgtgggttgaaaagaacgtgcacgtgccgctcacacctccgcagaaagtcggcattgccagtttctgcccgtacaacatcgggcccggtaagtgcttcccctcaacgttctaccgcaagctgaatgccggcgaccgtaaaggggcatgcgctgaaatccgccgatgggtattcgacggcggccgggattgccggttaacgaaaggacagaagaacggctgttacgggcaggttgaacgccgggatcaggaaagcgcgctgacgtgctgggggctgtacgaatgaacggaaaaacgaaactggtgattgtggggggagtgctggcggtgtgcgccggcattttctgggcgggatatctgaagggctggtacgcgcattctgagcacgtaaacagcctggctaaagaaaggctgccgaagcaggagaaggcggtagcagctggcgagaagaaggcggcgacggcgaacgctgaagccaaagtggtttaccgtaccgtttatcgtgatgtggtgaaatatgtcaacgacccgaatcatactgtgtgcgaatttgatcctgctgctgtgcagctgcgccagcgagcaatcgacgcggccaacaccatccccggatttgatgaaccagccgtgcagaataagtgacgctggcgccgatagtgacgccgatctgcaggcggacacgcagacggcggaatgcgtgcgcgagctgcgtacgaacatttatcgttggcaatcgtggtatcgcgcgactgaatagaaatacgagtacataagttagtacattagctaatgttttgtttttataagtatatttaaatcaatgtattacattttgatgttagtagtcgtggatatagatccgggctggttgacgctatcttgcatagtctgttcattatccgtggtggcgtgcgaccggtatggtaaacgatttgcccggtcatcagaaggggcgcggcaagcaacttcctctgctgtgtcatattttcttgcaattaaaccctgatatgaaacgcgaagttccgtaaaaaggacggcggatctgtaaatctagaggatatgccgttgaaaggccgtttgtttattgctgtatctttgctcgcttcgagcgtttcctgcgcatttgccgtcgacttacctgctacggtcgcgccgccttccattcaggctggctcctgggtgctgatggattacaccaccggtcaggtcctgaccgcgggtaacgaacatcagcagcgcaatcctgccagtctgaccaaactgatgaccggctacgtggtcgaccgcgccatcgacagccatcgtatcacctttgacgacatcgtcaccgtgggtaaagacgcctgggcgaagggcaacccggtgttcgacgggtcatcgctgatgttcttaaagccaggggatcgcgtcagcgtccgcgacctcagccgtgggctgattgtcgactccggtaacgacgcctgcgtcgcgctggccgactatgtcgctggcggccagccgcagtttgtcgccctgatgaatcagtatgtcgaaaaactgcacctgcgggacacccatttcgaaaccgtccacggcctcgacgccccgggccagcacagttcggcctatgacctcgcggtgctctcgcgggcgattattcatggcgaaccagacgtctaccacatgtacagccagaaaagcctgacgtggaacgggatcacccagcaaaaccgtaacggtctgctgtgggataaaaccatgaacgtcgatggcctgaaaaccggccacacctcgggcgccgggttcaacctgatcgcctcggcggtggatggccagcgccggctgatcgccgtggtgatgggggcggacagtccgaaaggccgcgagcagcaggccgctaaactgctgcactgggggcagcagaacttcgacaccgtgcaggtgctgcagaaggggcagaaggtcggcaccgagcgtatctggtacggcgataaagagcagattaagctcggcaccgatcaggatttctggttagccctgccgaaggcggaagtgtcgcgcattaaagcgaaatatgtgctggataagaaggatcttgaggcgccgatcgccgccaatcagcgggttggcgagatttcactgtatgacggcgacaaggtggtggggcactatccgctggtcaccctcgaaagcatcaataaaggcggagtgttctcgcgaatgagcgattacctgcatcacgagctgtaaccacgccaaccgcctctttgcaggcggttttttttcgtctgtcgctcgtgctggcggggcgcctgtttttacagcagtgtggtggcgactctgtgaattcgcgcacatactgaggggggatctcctgttaaattaactgtatattcatacagtaatttatctccaaaggaggcaagatgaactacagcatcaccaccctcggcaagaaaaccatcgccggtttccatctggtcgggccctgggatcacaccgtcaagcaggggtttgagcaactgatgatgtgggttgagaaccaccaggtgcccgcccgcgaatgggtggccgtctactacgataacccggaggaagtgccggcggaaaaactgcgctgcgcgacggcggtcaccgtggatgaggattatgtcattcccgccaacagcgaaggggtgatcctggcggcgattgccggcggggattacgcctgcgcccgcgcgcgggtggtggattacgacttcgccaccccgtggatgcagttttttgacagcctgcagcagagcacggcgtatcgcatcgccccccagccctgctttgaggtctatcttaacgacggcaaccacgacggctactgggatatcgacatgtatgttcccgttgagcgcgtcgcgtcgtagcggtttacccctgtttcggacaaggttttttacattcccggcatgctccgggcgaaaaagcagttacaattggccttttcgttttgccggagagggttgtgcgcgctgataaatcactcaagccatttgagatccgcttgtatcgccattatcgggtggtgcatggtgtgcggattgcgctggcctttgtgctcacttttttgctggtgcggctgctgaacgtgcctgagggaacctggcctctcatcactctggtggtggtgatggggccgatctccttctggggtaacgtcgtgccgcgggcgtttcagcgtatcggcggcacgatcctcggttcggcgctggggctggtggcgctgaagcttgagctcatctccctgccgctgatggtcctctggtgcgcggcggcgatgttcctctgcggctggctggcgctgggcaagaaaccctatcaggcgctgctgatcggcattactctgtcggtggtggtcggggcgccgcccggcgatatgcataccgcgctgtggcgaagcggcgatgtgatcttcggctcgctgctggcgatgctgtttaccggcatctggccgcagcgggcgttcatccactggcgcatccagatggccagctatgtcaccaactttaaccgcctctaccaggccggcttctcgccaaatctggtggatcgaccgcggctggaaaagcatctccagcaggcgctgaatgacgtggttaaaatgcgcgggctgatcacccccgccagcaaagagacgcacatccagaaggcgatcttcgaggctatccagaccgtcagccgcaacctcgtctgcatgctggagctgcagataaacgcctggtgggcaacgcgtccgggtcacttcgtgatgctcaatgcgcacaccctgcgggagacgcagcagatgacccagcagacgctgttgtccatcgcccacgcgctgtacgaagggaaccctcagcctgtgcgcgccaacaatgaaaagctgactgagatcgtcctcgaactgcgccagctgctgaaagagcagggtgatgacggcctggcggaaaccccggtccatggctatgtttggctctcaatcgaactggcgcgccagctggagctgctctcgcatctgatctgccgcgcgttgcgcaaataaacatcagatgcaccgggtaaccacatgggttgtttcgattcagcagcgtttagggttatgataaacgcaaaggaaaaaacattgtcatcagcggctgctagcagttatgttagccctataacgcagtcgctttacgaatccgaatctcaattattaggggtgtaaaaatggaaacaactaagccttctttccaggacgtactggagtttgttcgtctgtaccgtcgtaagaacaaactgcagcgtgaaattcaggacgttgagaaaaagatccgtgataaccagaagcgcgttctgctgctggacaacctcagcgactacatcaaaccgggcatgagcgtggaagccatccagggcatcatcgccagcatgaagagcgattacgaagatcgcgttgatgattacatcatcaaaaatgccgagctgtccaaagagcgccgcgacatctcgaaaaaactgaaagtgatgggcgaagccaaagtcgaaggctaaaccctgccggtccggcggcggtcagcgtcgccgggctgttccgcgtttccctctcttccctgcttttttctgcgaaaactttgttccggcaactgcctctcctcaccgacactttgctatactggcccgcgaaaaacgtattgatatcggaaaggtttctctcatcctggccgggcatctgacgcagcggcgtcagggcgatatctcaacacctctcacctctccgacgatcgattcgccagaagacaaactcaggtgctgaccgggcgcgacagaactcttccgctgctttcgccgacaggagtcaacctcacgtgattaagtcattctttgctgcactctcgtttatcagccgcctgccggtcccggcgcggttatctcagggcctggagatcgaacagtaccagcgcagtatcgtcacctttccgctggtcggtttactgctcggcgccatcgccggcgcggtggcgctcctcctgcagccgtggtgcggcgtcccgctggcggcgctgttcggcgtgctggcgctggcgctgctcaccggcggattccaccttgacgggctggctgatacctgcgacggcattttctccgcccgcacccgcgatcggatgctggagatcatgcgcgacagccggctgggcacccacggcgggctggcgctgatcttcgtgctggtggcgaaagtgctggtggttggcgagctgctgctgcgtgatatccaccccatcgcagccctggcggcggcctgcgccgtcggtcgcgggatggcggtgctgctgatgtatcgtcatcgctatgcgcgggaaaaggggctgggcaatctgtttatcggcaaaattagcctgcagcagacgctggtgacgatggcgatggcgatcgcgctggccaccgccctgctggggctgcaggggctgcgcgccgcgctgatcaccctggtgctgatctggggtctgggatgggcgctgaagcgaaccctcggcgggcagaccggagataccctcggggcggcgattgagctgggcgaattactctttttactggcgctgctgtaaggcctgacgccaacggtgaggaacagaatggaaacactttcggcgttactggctgccattccgcagcccgatgtggcggccatggcgcgcgctcagcagcatattgatggcctgttaaagccgcccggcagccttggccgtctggagacgctggcggtgcagctggccggtctgcctggcttgcaggggcagctggcgctggcggagaaagcgattgtggtcatgtgcgccgaccatggcgtctggcatgaaggcgtgaccccttcgccgcaggtggtgacggccattcatgccggcaatatggtgcggggcaacaccggcgtctgcgtgctggcggcgcaggccggggccagggtgcaggtagtggatgtcggcatcgatgccgacccgctgccgggcctgattaacctcaaggtggcccgcggtagcgggaatatcgcccggacggcggccatgagccgccagcaggcggagacggtgctgctggccagcatgcatctcacccgccagctcgctgccgacggggtgaaagccttcggcgtcggcgaattgggaatggccaataccaccccggccgcagcgacgatcagtgtcctgacgggcagcgaccctgacgcggtggtgggctgtggggccaatctgccgctggcgcagcggggccataaggtggcggtggtgcgccaggcgatagcccataatcagccgaacccggcggacgggctggatgtcctggcgaaggtggggggttacgatctggtgggcatgaccggggtgatcctcggggcggcctcctgtggcctgccggtggtgctggatggcttcctctcctatgcctctgccctggccgcctgccgcatggccccttcggcgcacccttatcttattccttcacacctgtcggcggagaaaggagcgcagatcgccctcgacgcgctgggtctgcggccgtatctcgatatggacatgcgcctgggagagggcagcggcgccgcgctggcgatgcacctgctggatgccgccagcgtgatgtacaaccagatgggaacgctggcgcagagcaatattgtgttgcccgatagcgcgccgtcgtcctgatggtaaaacgcatcgtcccgcgatgggggcgatgcgccgggtttacagggcttgctgccagaccgcctggggcaggagataaaccttcgccggggcgcgcatgccctcagtgacaatatggcggatgccgctggccatcaccgccagggtgacgtcaaaggcgttcaggctatcgccgaagccagcggtcagattgagcatcgaaccattggccagcagatagacggttttgtcggccatgcggtaggcattgatatacggcatcacctcttcctgggggtgctggcgcaggtaatcgccgtcgatctcttccgccacgtggccgacgttaaggataaatactcccgctttcgcgcggtccagcgcctggcgattaaccacgtttttaccgcctgtcgccgtggccaccacgtccgccgaggcgatagcctcctggaggtccaccacgtgccagccgtcgtaggccgcctgcagacggcgggcaggatcgatctccgccaccatcacctgaccgccaaaagcttttgccgccgccgcgacgccctggccgaccaggccgtagccgatcaccagcacttttttctcatgcagggtgaggtgagtggtctggaagaaggtgtgccaggcagtgagaccgaccatatggcggttgtgcagcccctctttgaccggcagatcgtcccagttaaagatcggatagcctggctgaatatcccccagccgattgacgcccgagccggtggcttccaggcccgccacgatgttcccaaactcgccgcgctggtggagcagggtggtgatatcggcgcccatctcgcacaggtgagtgggctgccaggcaatcgctttttcccatgactgttgccagtcggcatcgctcatattgcgccacgcgcaggcctcggcgccgcgctccaccagccaggccaccacgtcgtcctgcacggtggtggggttacaggtgattaaaaagacctgagcgcccttgtcgaggatcccctgcaccagcgggatcattttcatgtcgaggtgcatacagcaggccagacgcacgccgctgaggtcgggcagcgcggcgacctgacgcagggtacgcggcatattctggctggcccatgccacttctttcgctaaagagattttattattcactgggttatgaccttcaattcgcaaaaggggtatccccctgaccgaaaagggattctatcagcccccgcgagaattcacagcacaatgccgtcggacatcgccgcgcgcgctatcccctgcgaaagacagggttgttaatttaaggttaaaaaaagaaaataaaatataagtaatttctatgatttgagcgatgaagcgatgttgagtgttattcctgcggggatgttttcacggctgcggattttccttggccgcctgaagccgcacgcgctgccggtggcccgccggcatatcgtgctgggatccattggcgccggcaccggactggcggtgaccagcatgttcagccactggctgctcggcgaagtcaatctgtggtttattgccccgatgggggcctcggcggtactcctgtttggcgtaccgagcagcccgctggcgcagccgtggtcgattgtcggcggcaacgtgctgtcggcgctgatcggcgtcacggtcggtatgctggtccccgatgcggcgctggcctgcggtctggcggcggctctggccatcgccgggatgtattttctgcgctgtctgcatccccccggcggcgcggtggccctgacggcgatcctcggcggcgccggggtgcacagcgaaggctatcactttgtgctgaccccggtgctcctcaactcgctgatgctggcgctgctggctattgtgtttaataacctggttggccgccgttatccgcatccgctggcggcggaggaggtcaaatccagggcggtgccgctgggtatttcggtcacccgggaagatattcacgccgcgctgctggaaggccagttcctcgacattgatgaagacgatgtccaggagttgctggagaatatcgagcagcaggcgcggcagcgtatcgcgacggcagcccgccgctaagggcgtacagtgggctgcgggttacagatcgccggtaagatactgcgcgaccccgcggccaaagctccagtcgcctttctggttactgataatcgacaccatcagatcatcgccgctcaggccgcagtgttccgccagctcctcctgcaaaatggcgaagaagcgctgcttctgcgcctcgctgcgcgggctggtatagacccgcaccaccaccagatcccgcgtgcgggtcaatccgaggccggtatcttcaatcaccatatggtgggctttgttttcatgaacaatctggtaacggtcgcgttctggtacctcgaaggcgcgcagcacggcgcgatgggcggcatccagcagggttttgacctcctgttccgtacggccttcaatcaggtcaaatgtcagtaatggcatgcaggtgctccttatcgttagggaataatgatgggctcaacaagatgctagccgatgccgccgccggcaaaaaccgctatagttgaatacattgtttttactggtgaacaatcacatgagcgagagtcgtccggagagttactggccccatctgtactggctgacggtgctggaagaacaaaaaagctatacccgggccgcggaaaagctggggatcagcaagtcggctatcagccagaaaatcagcgagctggagcgggtgaccggtaaaaccctcgtccatcgcaccacccgcagcgtgagcctcagcgacgacggactgcggctggtggcggagctcaacgagccgtttggtcagctgcgggatattttcaccggcgcctgcgatgagggcgggccgctgcggggaacgctgcgcctgaccgcgccggtggccttttcccgccagcagctggtcccggcaatcgcgccttttttgcatcagcatccccaactgcatctgcagcttgaggtcaccgaccggctggtctctctggccagcgaagggttcgatctcgccatccgccactgtcggcgcgaggcgctccccgatacccacgtcgcctggccgctgtgtcacaccgcgacgcttaccgtcgcgtccgccgactatattcgccgccatggccgcccggagacccccgaagatctgcgccaccaccaatgcctgacctatccccgtgggccacagcgcccgcagtggacgttcgcctcccgtcagtcgcccgatgctcgggtgaccatcaacgtgcaggggccattcgccaccaataacagcgagtcgctacgtgatgcggtgctggcggggcttggggtggcgctgttgccggatttcagcgcccgggaggccattggccgcgggctggtgcaggagctgctgccggcgtggcagccagtagatgtgtttgccgatcggctgtacgtcatccggccctataccccgcgcgtgtcgcgcgcggtggaaaccttcagccgctacctgaaagcgaccttcagcgagacgcgtccagctcctgcgccagcgcctcgctaaagcggggcagcagatggcgctcgccggtaagcagctgcgcgagagtaacggtcttgtcagcgcaatagacccgctcgctgccgagctgcgcttcgaaggcgttcgccgcctgatgcgccgcgctcagatcggcgtcaataaggatcaccgcatgggccagcaccacgtggccgccgcccgccgccagcggccgccagtactgggcggtaccgacaatcttgcgcgcctccgcgccttctccgcaggcaagattataccgtccatcgcaaaaggaaccgctcaccgcccgggcgtggctggcaacgccgaagcgcgcgagggtgcgctgcagcacagcgcacagcgaatgatagatcggttcggcggcttcgccgagcggctgctgcaccggccaggcgaggctaaggttgataatgcccggcccctggggcaccagaccgccgccggagcggcgaagccataccggccagccgcgcgcggcaaaatgcgcgctgaccgccggcagatccgtaaactgacgatagctccccggcaccaccaatccctgcggcgcctgccagagctgggcgacggcctcgccggcgctggctttggcaaacagcggctgttccgcctgggtgggatcctcgcaaaactgcagcgccagcgaagagggggaaaaacggcgaggccagcagtcggccagggttaactgagacatgtattctccttaccggagggcacgggttacgccctccgctggtgggtcagtcgacggggtgctttttcatcagcagcgcggtgagcgctgacagcaggcatcctgcggtcagatagagggccacgctgtgccacgatccgccggagaaagtgaccagcgccgcggcaataaacggggtaaagccgccgccgaccacgctcgccacctggtagccgacgccggcgccgctatagcgatagctggcgccgaacagctcggtaaacatcggctgctggacgcagaccaccatatcatgggcgatattggccagcatcagggcgaagaacaggatccagaaaacggactgactctctagcgccataaagaacgggaaaccgctcaaagtgccgatcagcgccccggtgatatagatccgtcgacggccaaagcggtctgccagccaggcgaagcaggggatagtcaggcagctaagaccgcccaccagcaggccaatgttgagaaacagctcgcgcggcaggccgaggttttgcgtggagtagttgagggcgaaggcggtgacgatatacatcgtcagcagttcacacagccgcagggcgataatcagtaaaaatgctcccggatggcgaagcagcgcttccactaccggtagccgctttttcatctgcggcgcgttgtcctggctctgctgcgcttcaaactcctgcgattccgccatgccgttacggatccacagcgcaataaggaccagcaccacgctgaacaggaacggtacgcgccagccccagctgaggaactgctggtcgctggtcaggctgctaatcagcgataccagcccggtagagagcaggaggccgacgccgtagcccacctgcaccccactgctgtaaaaggcttttttcccctgcggggcattctccaccgagagcagcgccgcgccgccccattcgccgccgacggcgaatccctgaaccgctcgcaggaacaccagcagcaccggcgcccaccagccgatctggttgaacgaggggagcaggccgatgcaggcagtggcgatacccatcatccagacggtcatcatcagcatccgtttccgcccgaggcgatcgccgaagtggccaaaaataattccgccgagcgggcgaaaaagaaacccaacgccgaaggtggcaaaggcggcaagcgttcccatcgccgggccgatttgcgggaaaaattcgcggttgaacaccagcgcggcggtaatgccatagagaagaaaatcgtaccagtcgaccaccgcgccggcaaaactaccccaggccgcccgccgggcccgatgtagtgaatctggcgcctcgccgggctgcacgcttattgttgaatccataccctgtcctgtcagtcacgtacttcattgttattggaatgagacgcttttaccgttgcgtctgctctgagactaccgcgcagcggccgtggaggaaagtagtttgcctgctaagcgggggagatggcgcaaaaaagaatcgatgggaaagacggtcgaaatcacaccctggacttaacattctggcaatttgccatccagcttatacttttaattaaatcaacggataacaaagatggacaccttttaagaatcgacgtaaatggtttacacttaacgtgtctccctctctggaatggtgagtaaaatgcgtctacttcttgcagttttattttgttctgtcatgttgccttctgcttatgctgaaaaactgcctgcgccgacaggaaaacctgtactgaccatttccggaaaaatcggaaatatgaatgtcggcgacaaggccgtttttgatctcgcaatgctggaaaaactggggatgaagacgatagaaaccaccaccccctggtacaccggcaaggttcgttttgacggtattccccttagtaaactcatggatttagtcggcgcgaaaggcacatcggcccgcgtgctggcgctgaacgactacaccaccattatcccgattgatgatttttataaattcccggtcattatggcgttaaaaatgaacggtcaatatatgcgcattcgtgataaaggcccgttatttattgtctacccttacgacagcagtgctgaattacagaaccagatctattattcccgatcggcctggcaagtttcaaagatgattatagaataagggttggatcttgaatcgaatactcacggctattattttgtcgttatttgttgtcaccggatatattacttatctggtgcatgagcgacaaagtgagttgcaaaaatttacccgctatacggactcgtagtcaatgtcgcagatggtgtcggaatatatgcggctggagtctcgtctggcgggaatggcgattggggccgaaggggcggaccacgatgaggtgcgcctgcgtcttgagatcatgatgagccagatcgagcttctgcaggagggcgatctgggtaaatttatcaataaaagcgagcagcggaagacggtggttgcgacgctgattcgtaatcttcatctgctcgataaacaagttgataccatgacgccggagcaggtcagacagatcctgccggtgttaagcgagctggatggtccgctgacctcaatggccgccgccaccctgacgcaagatatcaatatcgttaatatcacccatgataaaatccagcatctctattatatctactcggtgatctccattctgctgatcgccatgtgtataactctcggtctgctgatgctccgacagaataataatctgcgtcgcgcccatgttcgtatgaaaacgctggccaacgatctgcaggcctcgaaagagaagctgcaggtgcagaaccgccggctgcagtacgatgcctaccatgattcgctgaccggtatgcccaaccgtctctctttctggcagcggctgcaggagatcgtcaaccaggtgcgtccgtataagggatgcgccgtggtgatgcttttcgacctcgacagctttaaggatgtgaacgatacccttggccatgatgctggcgataagctgctgcaggatctggccagtcgcctctcttttttccgcaaaacctccgagacgctgtatcgccttggcggtgatgagtttgcgatgctctcctacgatctcactgaggagatggcccttgagcgggccaatgttatccgggagaagatcagccagccctatcagatctacgatgcgcagattaatatcgacgcctgcattgggatcgtgatctctgacggtgaaagccgtaccgattatctgtacaagtgcgccgacctcgcgctgtatgaggcgaaaaaagagggtagcggccatgtgcaaatcttccggccggggatgctgcagcgcctgcaggagaacaaatcgtttgaagacgatctgctgcaggccctggcccatgacgaattcaaagtctactatcagccgatcgccgataccgtcacgcgcgaaatctacggctatgaagcgctggttcgctggttccatccggtgcgtggcgccgtgccgccgacggtgtttattccggtggcagagaaaatcggtcttattaatgcccttggcgaatgggtgctgaaaaccgcctgtgccgaagcggccagctgggcgacgccgctgaaggtctcggtcaacgtttcaccaattcagttgatgaatacatcgctgaccgacaccattatcgaggtgctgcatcagaccggcctcgatccgcgacgtcttgatctggagatcaccgagtcggacgtattcaatgagaacacccgttcgctggaaattctcagccagctgcgcgagctgggcattcagatctccatcgatgactttggtaccggctattcttccctgtcccgtttaagctacttcccgttcgataaaattaaaatcgaccgctcgtttgtcatcaatattccggagcaaaaagacgatctggatatcgtccgcctgattatcagcatgggaaagagcctgcatatgcgcattgtggcggaaggtgtagagaccgaagagcagttggcttcgctgcaggcgctgggctgtgacctggttcagggatatttaatcggcaaaccgagtccgctgcgctaacaaatttttaacgcgtttatttttattctccgggcgatttcaggatcctgaaatcgccttttttattttctcttagcgctaatccctgcgaggtataaaaaggagtaggcgtaaaattccacaacaaaataatatccttaacgtttaaaaggggtatatgatatgcatcatataggctatttctgaacgtcgcgtttgagacggtaaagtgaggcacaatcatgcagcgaatcattattcccacccattacgttcacacccgcagcacgccgctgtggaccaaagagaccgccccggcctctatctggcgccgccatctggatgccggcacccggcagggcgtctaccctcgtctctcggtgatgcagggggcgatccgctatctcggctatgccgatgaaaccagccccgagcccgttgaaaccctgactattgaagccggccagtttggcgtctttccgccggagaagtggcactgtattgaggccctctcagaggacacggtttttaatgtcgacttttatgttgatccaaaaattctcatcgagggataacaagagatgaccagtgaaaataaaggttataccttagcgctagagaatggccgacttcaccagaagcaggaaaaaatatttctcaaaccaatggtgttgtatattccacagcaggcggtggaggccgttaatgacctgctgagcaagttgccggacgacagggaagagggggagtttctgttgacggtcaccaataataataacggcgtctcggttgataaaaccttttcctcgctggcggcactgcgcgacccactcaccgcggctgatgcggtgaaggatctgatcaatatcgttcgcggttacgagtccgatgaagagaccaacgtctgcggctggtaagcccgctatcccgcagtcggatggccgccgtcgcccgacgccatctggctgagcagccactcccgcagagcgataatatccgcccgctgcgctaccgcttcggtagtgaccaggtagtagcgggcgccaggcaatgcgttgctgaacggcgcggataatacgccgcgctgcagcagatcccgcgccagcagttcgctggcgatcaccactccctgaccggccaccgccgcctgcagggcatgggtctcatcgctaaaggttaaccccgcatcaatattcagcgtcggcggtccatagcgccgacgccagttctcccagctcggcgaatcagctggcacgcgccggttggcaacgtgaaacagcgtcacccgctgcagatcttcaggccggctgaggcccagagtcgggctggcgaccacgataaagcgatcctcatacagcagcgtgcagtacaggtccggctccggcgtttcacgatagcgaatcgcggcgtctaccgtgcccagatgcagatccactcgttcgacgctggtgtgtagccgcaggtcgatagccggaaagcgggcggtgaaatccgctagccgcggcaccagccagtgggtgagaaaattggaggtggtggtgacggttaaggatggcggctgacgggcatgagcgatctggacgacggcctgttccagggcgctaaaggcgcgttgggtggcggcgtaaaggatctcgccatcagcggtcagactgacgccctgcgcgctgcgttcgcagacccggcactccagcaccgactccagcagtttaatctgatggctgaccgccgtcgcgctgacgccgagcgcctcggcggcctgtttaaaactgcggtggcgggcgacggcatgaaaagcgcgtagcgcccccagcggcggcagacggggtggtctcatggctgagtttttctcatctatggctgaaaactatgcgtttgtgtaaggcaatatagtggcgataggctacgggcatgtaaagacaatgacatgaattaaattcatgcagcttcgcctgtcaggagtcaactatgcacgttgtaagccgctacaccgccgcggaagccgcggcaacgatcgacccccgcggccgcgctatcgcccttagcgtggtcatcgccgccggggccttgctgttaatcatgcccccggttatcggggtgaccggcacgctgagtctgctgacggcgctgattgcggcctttggcgtcgggtggggattcactcgcggacaatcctggctttatcgctcacccctggcggcgacgcgctgggcctttctgctgtcagcggccggctggctgctggcgctggtggcctggtatggcgggcaggactggccggcactgctgccgggcgtggcgtgcggtggggcgggagcggctgtcgcctggcgcattgcggcgggtaggacggcgctgccggggatgcgggtcagcggcgccacggtgctgagcgtagctatcgccatcgcggcgacgctgctgacctggcatactgcgggaggaggacgccatggcgtctgctttgccttcgccgtgctgcttgactgggcgctgctcggcgcgctgatggtgcggatccgccagcaggagagtgcggcctgataccagacgcggtctggtccaggatcggcgaatcaagcgagacagggtaagttgtcccgcccggcgttaaatatcttctacactgttacaggcatcacattcctgtgcggtcggcactcctgccggccgccgtcggcgttcagcccaggcacgggcctgcgggctggttatcctgaaagaggagtctgtaatatggcatttgtcaccacccaagacggcgtcaacatttactttaaagactggggaccaaaggaagctcagccgattgtctttcatcacggctggccgttaagcgctgacgactgggataaccagatgttatttttccttgccgaagggttccgggtcatcgctatcgatcgtcggggtcatggccgctccgatcaggttagcgaggggcacgatatggaccattacgcggcggacgtttcggcggtggtggaacatctggatctgcacaatgcggtccacgtcgggcactccaccggcggcggccaggtcgcacgctacgtcgcccgctatggtcagccgcaggggcgggtggcgaaggcggtgttaattagcgccgtcccgccgctaatggtgaaaaccgagcagaatccgggcgggacgccgatcgaggtgtttgacggtttccgcaaagcgctggcggcgaaccgcgcccagttctatctcgacgtcgcctctggcccgttctatggcttcaatcgtgatggagcagagatatcccaggggacgatccagaactggtggcgacaggggatgatcggcagcgccaaagcccattatgaaggcattaaggcgttttcagagaccgaccagacggaagaccttaagtcgatcactttgccggtgctggtgatgcagggagatgacgaccaggtggtcccctataaaaatgcggccatcctgcaggacaagctgctgccgaacagccagctgaaaatttatcctggcttcccgcacgggatgcatacctcccacgccgatactatcaacgccgatctgctggcgtttatccgcgcctgatctgccctctttgccgggcagagtgccgttaatggcattccgccagcgccctgggcgccagtcgcctggggcgcgccggttgacgtgcagaggaaatctgcttaactcatggggtacctgacgactattttcccctcgcaggataaaacgccgggtttctctgcggaaacccggcggaattctgcgcaagagacaagtgagagacaatgaaattagccggacttcatcccgacgagcagcgtcgcctgcaatcgctacgctcttccgggctgttgaatagcggaaaagaagaacgcttcgatcgcctgaccaggcttgcccgttcgctgtataacctgccggtggcgtccatcagtctggtgggggaagatctcctgcatatcaagtcctgtgccggtctcgatgtggacacggtgccgagagatatttcattttgcgcccataccattctgcaaaccgacccgcttatcgtcaacgacatgcagcaggacgagcgctttcacgataacccgctggtcattgaggcgccgtttatccgcttttacgccgggtatccggtgcaactgccggatggcgcgaccgtcgggtcgttctgcctgatggatcaccagccgcgatcgttttccgcccatgaaatgcagatcttaagcgatctggcggcgatcgtggaggatgagttcaaggtgctggatgcggcaacctaggatgagctgacgggactgtttaatcgccggggattcctcaccctggcagagtatgccctgctgacggcccagcgccgccatgagccggtgagcctggcgtttgtcgacctcgatcgcttcaagcacatcaatgatacctgggggcatgaagagggcgatcgcgcgctgatcgccatcgccgacttgatgaaagcggccttccgcgagtccgatatcctcgcgaggcagggtggggacgaatttatcattctgttcgccaataccagccgccacgatgccgcgacggcgatggagacgctcagccacaacgtggcgcgtttcaaccagcaggcggccaatccctggcagctggcgttctcctggggctgcgtcgaatatgatcccgccagccatcccagtctcaacgcgctggtggccaccgctgaccgcctgatgtaccaggcgaagcagaagcagggacgcgagcgccgttaatcctttgcggcggtggcactcaacaggtactgctgcgcctgctgccgcttctgcgcatagctgctgagcagcgcctgctgcgatttcccttcgttatcgtaaaacaggccgccttcgtcggcgataaagcgataatgctgttccagctggtttatcacccagtcaatgcgttgcagggtgagtaaggtacaggactgaccatgcaggtcgtcttcaatatccagcacatgtgagcgaaaggcctctacggcaaacagccggctcagcgcggcagggtccgccagcgctgactcccagcgcgccgtcaactgctgaaagtgagccagcaccagcgggtcagcgcgccgggcgcgaagccagaccagcttccggcggtagctttcgaccgccagccgcttcatctcgcgatattgcgccagctgctgttcggcgtcagggatccgggtcatcagccagctaaaaaagaagcgagtctcaaaacgttcgacaaagtggaacagcgggtcggccagaccattgctgttgaattctctcagcgggtcgaagggatacatatagccaaaatcgaacagccacagctgctcctgccggtccaccagcagattcccgctacagagatcccactccatcagcccctgctcttcgcaggcttccagagtagtaaatagctgggcgatcagcgacggggttaactggtgtatcggctcgccctcgatccagggggagagcaggatgccgaggcgataatcggcatacagcgttgggacgatgtgggtgaagcgcggcgtggtgaccgggtcatccttcagctgttgcaatgcttgccgacgctgtacctcatttaaaaacgacagctggccgttgaggttggcaacgccggcgacggcgcgacgtttctttaaattgtactccttgccggcgatgcgcagacgataaacctcgccggtcaggcctgagccgtatacctgcaccacatagggggaatcggggcccagtgcggcgagggtctccggcggcagcgggcagtggctgacgttgccgacgataagaggttctccgctgcgatcgaacgcctgctgttgctgttgtctgaggttcatggtgcctccgggtataacgttagacagagtggataatccacgctatctcacccgcaaacggtagtgaattcatcctactggcaggcgctttttcaggctgagctggggtgcgttcacggaggacacgcggggcgtagggaggcggtagggaaaggcaagcgtctggaacgcatacctgacgtcgttgtcaacgaggtgcttgccaggctggatgcgatgctgagttaacgtcagcgacgcaaaaaagcaaaaagcctgctcgaaagcaggcttcttaaatttggctcctctgactggactcgaaccagtgacatacggattaacagtccgccgttctaccgactgaactacagaggaatcgtgtggagtcgtatcttagcggcgaaaaaacttttgtcaaacatcaattcgcctgttcaggtgcaactgccgcttacatcgacaatttgttgtcatttccgacaattattacggaaaatactttgcaggatatccatttctcaatcatcatttgaaatgttgtttcaacatttctcactaaggtctctcttgaacgtcacctccgccgtacgccaggccgtcgaacggacatcctggtttaaaaaacgtcagcgttatcgtgtgctgtactggcgcgaaatcagccctctcgctgtgcccattctgctggaaaatgcctgtgtgctgctgatgggggtgttgagcaccttccttgtcagctggctgggaaaagaggccatggccggggtggggctggccgatagctttaacatggtcatcatgtccttctttgccgccatcgatctgggcaccacggtggtggtggcctttagcctcggcaagcgcgatcggcggcgggcgagggcggccgcgcgccagtcgctggccattatgacgctgttttccattttgctggcgggggtgatccatgcctttggccaggagattattgattttgtcgccggcgatgccaccgcccaggtcaaggacctggcgctgacctatctggaactgacggcgctgagctacccggcggcggcgattgcgctgatcggcagcggggcgctgcgcggcgccggcaccaccaaaatcccgctgctgattaacggcgggatgaacatcctcaatatcttaatcagcagcgtgctcatctacggcatcttctcctggccggggctggggtttgtcggcgccgggcttgggctgaccattgcccgctatattggcgcgatagccacgatctgggtgctgatggtgggcctcaatccggcgctgcggctgtcgctgaggggctacttcaaaccctttaacttcgccattatctgggaggtgatggggatcggcattccggccagtatcgaatctgtcctgttcaatggcggcaagctgctgacccagatgtttgtcgccgggatgggcaccaacgttatcgccggcaactttatcgccttttcggtggcctcgctaattaacctgccgggcaacgccctcggctctgcctcgacgatcattaccggcaagcggctgggaaaagggcagattggtcaggctgaattccaggcctggcacgtattttggctgtcgacgatcattctgacgctgatcgcctggggcagcgctcccttcgccggctttatcgcctcgttctacacccatgaagaagatgtaaaagaagtggttaaacagctgctgtggctcaacgccctgtttatgccgatctggtcgctgtcgtggactttaccctgcgcttttaaaggcgcccgtgacgtacgctacaccatgtgggtgtcgatgctcggcatgtggggctgccgggtagtggcgggctataccctgggcatcgtgctggggatgggggtgattggcgtctggttagggatggtgctcgactgggcggtgcgcggcgtgctgttttatttccgcatggtgagcggccgctggctgtggaaatatccgcgcgtgaaggcttcatcggaggaaagctgagtcgtttgcaaggctaaacgccattttttgcgcaaagtgaagaataattcggcaaacgattcattttattgaaaacaggctttgacagcgccgggcgtcatcgataatatgcgccccgttcacacgattcctctgtagttcagtcggtagaacggcggactgttaatccgtatgtcactggttcgagtccagtcagaggagccaaatttaagaagcctgctttcgagcaggctttttgcttttctgtctaccacctttcttccgtggacaaacaccgccgggtcgtttgtttcgcttatccggacgctgacgctccctggcgggtaacgtcagcgtttatctcacgattcccacgtcatcgacgattaacggaacggcggctcgttgaaggtgcgcagcttacgcgagtgcatgtgatctccctcggcgcgcagcaggtcaatcgcccggatgcctatctgcagatgctcggagatagcgccctcgtaaaagcggttagcctggccggggagcttgatttcaccgtgcagcggcttgtccgagacgcagagcagcgtgccgtaggggacgcggaagcgatagccctgggcggcgatggtcgcgctctccatatcgatagctaccgcgcggctgagattaaagcgcagcgccgaagcggaatagcgcagctcccagttacggtcgtcggtggtgaccaccgtcccggtacgcagccgctgcttaacctcttcgccgggcatcccgctcacctgcttggtggcgtcgtagagggcgcgctgcacttcggcaatgctggggatcggaatatctggcggcagcaccgcatccagtacatgatcgtcacgcagataggcgtgggccagcacatagtcgccgatggcctggctttcgcgcaggccgccgcagtggccgatcattaaccagacgtccggccgcagtaccgcgagatgatcgcagatggttttggcgttggccgggccgacgccaatgttaatcagggtgatccctttgccgtcgtgggtgatcagatgccaggccggcatctggtgcttcttccacgccagatcggaaatggcctgttccggcgcttcggtctcggcggtgatccagatcccgccggcgcaggagagagcgatataggggctgtcgggatcgaggatctggctgcagccccagctgacgaactcatccacgtagcgggtatagttggtgaacagcacgtagggctggaagtgttccgccggcgtgccggtgtagtgtcgcagacgcgccagcgaaaaatcgacgcggcgggcgtcaaagggcgacagcggatagaactcggtgggatggaacaggccatccgcggtctcatcgccaatttgtgacagctcggtggtagggaaatagcgcgtcagaccggcgctcatcgagcggtcgagtgtcagggtggaaccatctatcacgtaaggataggggatctcatgctgcgacagctcgacgctgatatgcgcgccatagtcctgatacagcagggtcagctgttccagcaaatagttgcggaacagtttcggattcgtaatggtggtggtatagcaaccggcatgggtgaaacgtccccaggcgcgcgttttgagggctttatgatcggcgccgtcccaggagaccgacagctgcggatagacaaaaagaccttccgcgcgggcttcggtatcggggagcgtattatggtcgatatagtcgccgatggctttgcgtaacgccgtgaccgaggcttcatagcgcgcttccagctcggcaagcgcttgttccggggtcagactggcggccttgatattcatgattcgctccttgtttcaggtctgctgacattcccgatagtatgtcacagcgggaaaagggcgaaggagaatttatctgtcaaatgcgacaatactcagaccataaccagtaaagggagcgggctcgtgttatttgccggcgtttgtccaacgctcgctgctataatgagtggcgttgcggatcttcaaagtttgcgtcggattattattcagacaatagcgcgcatcggccagcggagtgagtttatccccttcccgcaggcggaggcgacaggcttcaatctctgcgatcatctccagcgcaccgctctgaagcacgacgcggcagaggctggccgaagcgttgtcctgtactttttttacccaccactccatctgttttttatcctctcatagcgacatgtgcgtcgataattcatgtttcttaaaaatctgacaataagattatccccttggtttatgcagtgtttaaaaatacgcaaccgattgttgatctgtgcgctaggtttttttatgccgggggggaatgatctgccaggtttaatttgcaggaagcgatgactatgctgaaaagcagaccgtgagaatagcctgtcaggaagagggctgataagtccggctacgcaataaatataagagagagcgtcatgaagcatctatttcgacactggcgaacgtcgggcgccgttatcggctcactgctgaaaaaagggagcattgcggtactggcgctgctggtggtctttctcgccgggcggatctatgagtcccagcgcggcccggccctgcatcgctggcatacctggagtggcaacgagatgtcggccgaagagatcgaccaggcgacctttgcccagtatctggcgcgggagaagacgattttcgccgatctccagcgtgaggtgacagaggctttgccggaggaagataaaaccccggtcaaccgcttttatcgtcacagccgggtctggccggggcagtttcagcaggactggaaccgttcttttgtgttgatgccgctgggcaagccgcgcggcagcgtggtgctcctccatggcctgaccgattcgccctacagcgtgcgctatctggcgcaactctggcagcagcggggttatgtggcggtggtgccgcgtttgccgggacacggcaccgcgccgggggcgttaacggcggttgactgggagacctggctggcggcgacgcgtctggcggtacgcgaagcgacccgccttgccggggcggacgtgccgctgcatctggtcggctactctaacggcggcgcgctggcgctcaagtatgcccttgatagcctggaggatagccacctgcgtcagccgcagcagattattctgctgtcgccgatgatcggcgtgaccgcgtttgcccgtttcgccggcctcgccgggctaccgtccgtcttcccggcgttcgcccgcgcggcctggctgaacgtggcgcctgagtttaatccgttcaagtacaactcctttccggtcaaggcggcgagacaatcgtggttattgagccaggcgctgcagcagcagattatccgcgcggcccggcagggcgagctgaaagcgctgccgccgatcctcacctttcagtcggtgatggattccacggtcagcacccgcgcggtggtggagtccctgtatcgctatctgccggataacggcagcgagctggtggtgttcgatattaaccaggcggcggatctccgggtcctgtttcgccctgcgctctatgcggcggtgaatacgctgctgcccccggcgccgcgggcctataccaccacggtggtgaccaacgcgacggcgcacacgctgcagaccgtcgcccggaccacgctggcccaggaacgggaagagcatcgttatcctttacacctggcctggccggcggatatgtactctttgtcgcatgtggcggtgccgtttcccctgggcgactcgctgtatggtcgcgagccggacgagaagaaccgctacggcattagcctgggcaccatttcactgcgcggagagaccgggacgctgagcgtggggctggagacgttaatgcgcgtcacctccaatccattctttccatggatgatgacgcgcgtcgatgagcgcatcgcctgcggcgaacaggcggcggtgacggcctgcctgaaagcgcaggccagagcagaggcgttaaaacaggatcaggtgcagaacggtacgcagcaggatgccgacgatcgccgcgggagccacgaagcggaacaggcggacaaaccgtgagctgatgccaagaaaaatgccgataccgggaagatcaaaggtctggatcaatagacctgccgaggcgttgacctggtccacggtgactttgccctgctggatcagctcggaaatgacgccaaagtaggcggtgcccccggcaacgcacttcaccagcgccggcagcacaaagttctgggggatgtgcagccagctgagaagcggcttcagcagctgctgcagcaggtcgatagccccggcgccctgcagcagcccgacgatggttaacgacaggatcagcattggcaccgcgccgagcgccaggcggatggcgtcggagccggcgctattaatcacggccagaattccctggctgttctgctcggcattcggcagcgcttccgcgcgggggttctcggcgaccgataagcgccgtccggtgacgtgccaggcgacggcggccgcgcacaggccgccgaccaccgagataacgatcgaggccagccagtgcagaccaaaaggggtaagaggatagaagacgttgccttgccccatggcgaacaccatggccagcgtggcggccatttgtcggtccgagacgccgcgtttatccataatcgacagcgtggcgagcggggcggcaaagctgacaaagttaatctggatcagggcgaaggcgctcatcccggttaagccgaagggcttcagcagcggggccacccagcgaacaatcacatcgaggataccgcggacctcaaggtatttcatgatgatcagcatgatcaccatgatcggcaacagcgtatacagcgcgacgtcaacggacgacttgcccgccgccataatgatgcttatgacatccatttactttttttaccactcgcagagctattcgttcgcgtcatcataatcccgtggggaaggaaatgatatgccttgatccctctcgggatccggcgccgcacgggcgccgggagaagaggattactggccgatattgaccagcgtccgaccatgaatattattgctgaggaaatctgcggcatacgctggcgcctgctccagcgtgatttcagtggccgcctgctggtagtagctctccggcagaagctgggccagacgctgccagacggcgtcgcgttcagcggtcggcaccatcaccgaatccaccccctgcagacgcacattgcgcaaaataaacggcatcacggtggtcggcagatcgaagcccccggccagaccgcaggcggcgacgcagccgcgatattgcgtttgcgccagcactttggccaacactgggccgccaacggtatccaccgcgcccgcccacagctgtttctccagcggacgggtctccgcgaagtcgctgcgcggcaggatcgtatcggcgcccagctggcgaaggtaatcgtgtgtcgattcccggcccgatacggccgtcacccggtagccaagggctttcagcaacaccacggcggtgctgccgaccccgccgctggcgccggtgaccaggatatccccgctatcaggggtgacacccgcactaacgagagcatcaacgcatagcatcgcggtaaagccggcggtgccaatgatcattgcctggcgcgcgctgagcgtctccggcagagcaaccagccagtcgcctttaacgcaggcttcggtggccaggccaccccagtggttttcgcccacgccccagccggtgaggatcacggcctggccggtaacaaagcgcggatcgcggctttctttcacctgaccggcaaaatcaatgcccggcaccatcggaaactgacggataattttgcctttgccggtgagcgccagagcgtctttataattgagactcgaccagtcgatggcgacccggacgtcgccttcggcaagagcgggcaggtcgatatctttgacagtggcgacggtgcggttgtcgatctggtccagaactaatgctttcatgacagagtattcctcgtcggaagggggttatcggcgctagcgccgtcctgtgcaggtgtttttgttgtcatactgtgcgcaaaaaaatcccagtactggttaagcggtgcggcagactggaccagcctggcgcgcatcaccgcgccttcccagccgatccagaacacctgggccagcgcctgcggtgaggcgtcgctggcgatggccccggctgcctgcgcttcgcgcaggcagcgcgccacgcgcgactcccatgccgccaggatagccatcaaccgttggggaaacgtctcgggtaacaacggggcttcctgcagcaggttgcccaccaggcagccgcggcgaaactggaatttctccattccctgaccggcatgacgcacaaaggccgccattcgttccagcggcggcacggcgtcgtccagcaggaatttatctaatttatgcgcaaagaagtcgccataggcggcaagcacggcgaggccaaaagcctctttgcttttaaagcaatgataaaacgacccctttggcacggcgatattcttgatcaccgcatcaatacccgccgcgagatagcccgtttcggtcagcacttcaaggcctgagcgaatcagcgcctgacgcgtatcgtcaaactggcgatcgaccttgggtggacggccgcggcggggcttcaggacggtggaggtattgggattcatgatttagaccgtgtggtttaattgtttgtcagggtacgcccaattcagggggagggcaagcattgcgcgtagcgtaaggctggctgtccaatcatcctgaaatgggggggcgttaagaattatttatcgcaaatacgtggttcgcactgccggcgggggcacgaaatataactctgccgggtatattagactggtcattaatatccatattcacaatgcataatacgaattaataatattgggaatatataaacagcggagggctggagcggttgagtggttttgtccatgtgaagaggctaatttgcgaagtccccggtcgacagtcctgtgaggacttctccccggaatgccggccggggatgatttgcagacgatagcggattgacaaacgcggcttgataaaagacattgtcacccctgatccggcaccggttgccacctcagtttaaatattatcgccggcagacaatgacgtctgtcttaaattatcggtgactgggtaaataatctgttaccgaaacaacacctgcgaaaaaggattaacagtctgatgtacagaatgaatattgccgtcagaggaggggatgaatgtcgctaattgctatcgtgctggtctttatcatggccatcgtggtgaccgtgttcctgtcccatcttctgcccgttaaagtgccgctaccgctgatccaaatcgccgcgggcgccgcgctggccgccagtggctttcaggtcgattttgacccgcatatttttttactgctgtttatcccgccgctgctgttcctcgatggctggcgcatccccaaagacgcttttttccgcgatatgaagccgattttatcgctggcgataggcctggtgatggtgactattctcggtattggcctgtttattcactggctgatcccggctatcaccgtggcggcagggttcgccctcgcggctattctgtcgcctaccgatccggtggcggtatcggcaatgaccgccagctcgccgcttccctcaaggatggcgcatattcttgaaggggagtcgctgttaaacgatgcttcagggctcgtcgcctttaatttcgccatcgccgcggtgctgaccggcagcttctccccgggagacgcggtggtgaaatttttcctgatggccttcgggggcatcctcagtggcctcgtggtggtgtgggtcaccggcaaatgtaataactttctggttcggcgcacccgcgaggagccagccatccagatcctgatcagcctgcttatccctttcgccgcctatctgctggccgaggcgttccatgtctcgggcattcttgccgccgtcgccgccggcattgcgatgcattatgagcagctgtcggggccccggcttccggcgacgcgcatgaaaagcagcgcggtatggtccatgctgcagaccaccctcaacgggatgatctttctgatgctgggcgagcagctgccgcgcatgctcaggacgctgccggcggtagccagccaggccggcgtctcttcgccctggtatctgctgctgtacgccgtggccatcaccctggcgcttggtctgatgcgcttcgcctgggtatggctgtcgatgaagctgacaatttttcgccgcaaacgtcggggcaaggccatcaccgtccgtccacgcttcagtatcctcgccgtcatggcgctggcgggagtgaagggctctgtgaccctcgccggtattctgacgctgccggtggtgctggcagatggttcgccgttcccgggccgtgaactactgatctttctttcgatggcggtgatcctgatgtcgctggtggtggcggctatcggtctgccgtttatgactcgttatcttgccgatgatcttccgcatgacaccggtaaggatgacattggcgccgtgatgaccgaggtggccattaaccgtcttaacgcgctactggacgagccggtggaggatcccagtgagcaggccctgcgggccgatgccggcaatatgctgctcgagacctatcagcggcggcttcactataacgacaatgacgaggggcaggatgtcgggctggagctggctaagcgcgccaggctggagaaatatatgcaacgagaggtcattatcgcccagcgtcaggagctgttccggctgcgccgcgcccataacatcagcgatatcactttttatgaggtgctgcgggagatagatctgaaggaagagagtttacgctaaagccgcaaccgccggagggtggccattcgccttccggcagaaataccggcgctgaaaagcaaaaagcctgctcgaaagcaggcttttttaaatttggctcctctgactggactcgaaccagtgacatacggattaacagtccgccgttctaccgactgaactacagaggaatcgtgtgaacggggcgcatattaacgatgccatccggccttgtcaaagcctgattcaaagaattgcgttcgactgctgacaatttcagcaatcgccacccatgcgctgtttttttcaccatattgcaccgttgtagtgcgaaggtacccctaatggggcataccacaatctgcttaccgggcaaataaaaaccgaattgctatcactatcccttataacactgcctgcggcgggcgacagccgaggaaatgcaaagctggcaagcaaattgcaaaagccagtgcatcatactcccagcgttgacgctggcgttccttacaggaggcaaaatgaacttaagacgactgaaatattttgtgaaaatcgtcgatatcggcagtctgacccaggccgctgaagtcttgcatatcgcccaaccggccctcagccaacaggtcgcgaccctggaaggtgaaatggaccagcagttgctgatacgcaccaagcgaggggtcacgccaacggaagccggtaaaattctctacacccatgcgcgcactatcctgcgccagtgcgagcaggcgcagctggcggtcaataacgtcggccagacgctgcgtggtcaggtgtcgatcggcctggcgccgggcaccgcggcctccgccattaccatgccgttgctgcaaacggtgcgcaatgagttgcccgaggtgatggtctatctgcaggagagcagcggcacagcgctgaatgacaagctgctggcgggccagctggatatggcggtgctctatgagcgttcgccggtggcaggcatcgtcagccagccgctgctgaaagaagacctttacctggtcggcacccgcgactgcccggggcagagtgtggatctcacggcggtggcggagatgaacctgttcctgccgcgcgattacagcgcagtgcgggcgcgggtcaccgaggcattcaccctgcgtcgtctgtcggcgaaaattatcggcgagatcgaatccattaccaccctgaccgcggccatcgccagcggcatgggggcgacggtgttaccggaatccgctgcccgttccctgtgcggggcggcgaacggctggatggcgcggatcagcacgccttcaatgagcctgtcgctgtcgctgaacatgtcggctcgcggcagtctgtcgccgcaggcgcaggcggtgaaagagatcctgctgtctctggtgagccgcccatcgctggaaaaccgtgaactgcagctggtcagttagggtatattctcttaaggaataagttgctggtttttattatttgttacctgggacaacagactttaacaatagcagatacgttaagtccattggcccggaggaaagggtgaacttccagcagctgaaaattatccgtgaggcggcccgtcaggattacaacctgacggaagtcgcgaatatgctctatacctcgcagtcaggcgtcagtcgccatatccgggaactggaagaggagctggggattgagatctttatccgccgcggcaaacgcctgttaggcatgaccgagccgggtaaagcgctgttatcgattgccgagcggatcctcaatgaagccagtaacgttcggcggctggcggatctcttcactaacgatgcgtcaggcgtcttaactatcgccaccacccatactcaggcgcgctacagcctgccgccggtcattaaagctttccgcgagctgttctcagatgttcgcgtcgagctggtgcagggtaccccgcaggaaatcgaagcgctgctgcataacggcggagcggatatcggcatcgccagcgagcgcctgagcaacgatccgacgctggcggctttcccctggttccgctggcatcacagcctgctggtgccgaaggatcatcctttgacgcaggtttctcccctgacgctggaggcgatcgcccgctggccgttaatcacctaccgccaggggatcactggccgttcgcgcattgatgaggcgttcaaccgcaaggggttgatgccggatatcgtgctgagcgcgcaggattccgatgtgatcaagacctacgtggagctggggctgggcgtcgggctggtcgccgagcagtccggtgatgcccgggaagcggacacctttacgcgtcttgatacccgccatctgttcgatgccaataccgtgtggttgggactgaagcggggccagctgcagcggaattacgtttggcgctttatcgaattgtgcaatgccggactgtcgctggatgagattaagcgtcaggcgatggagccggaagaggccgcaatcgactatcagatttaaggaaatgctggccagcgggtcggggagtggaaataacgctataattcacacacgtgagtcgcgactgaggaagggaaaatgacgatgcggcgtgtgaaattactctgtacggcgctgatgctgcttgccagccacggcgcgctggccgtcagctatccgctgccgccggaggggagccgtttggtgggcagcgcatttaccattgccgttccggacaataacacccagccgctggaaagttttgccgcccagtacggccaggggttaagcaatatgctggaagccaaccccggggtcgatgtctatttaccacgctccggttcgacgctgaccattccgcaacagctgatcctgcctgacaccgtgcgggaggggatcgtcatcaacgtcgccgagatgcgtctctattattacccgccgctgggcaacagcgtcgaagtcctgccaatcggcattggccaggccggacgcgaaaccccgcgtaactgggtgacggcagtagagcgtaagcaggaaggccccacctgggtgccaaccgccaatacccgccgcgagtatgcgaaagagggcaaaaccctgccggcgctggtgccccccgggcccgataatccgatggggctgtatgcgatctacatcggcaggctctacgccatccacggcaccaatgccaactttggtatcgggctgcgcgtcagccagggatgcatccgcctgcgcaatgacgatattaaattcctgtttgataacgtgccggttgggacgcgggttcagctgatcgatcagccggtgaagtacagcgtggagccggacggcagtcactggctggaggtgcacgagccgctgtcgcgcaaccgcgcggagtttgaatccgacagaaaagtccccttgccgatgacctcggcgctgcgcgactttacccaggggccgggagtgagccctgcccaggtcgagcagaccctgcagcgccgctccggcatgccggtgaatatcagcgccacagcggcgcagggaagtttgtagcgggtcgtttagtctgattaacggctattgtaagaaggctcttttgctgtcgatgcattcaacgttgttgggaataaggatcgggaaaccgatccttaacttatcagcagtggcggtgatggcgttttaatgagggcgccaggagatgctcaggaggggatgataaagtctgcaaatatatctatggacttaatattgttactgaggatcttttttttggctgccattgtccatgaaagcgaagatcccctttatgatagccattatccagaatataagacggatgagttctgctgaatccctattgtcaaaacacgcctgaccacagtcactaccgctgaaccccatcgtcgttgataagcgaatcagggagctgggatgtcgttacttattgttggtaatggggacatgctgctgcatcaattcaacgatccagtcaataaaaacgcgcagcttggcgttgacatggcggttcggtggaaacgccaggtacagaggcattgggctaatccgccattgtgtaaataatggaatcaaagcgccaacggcctgatgcgctgccgccatatagttgggcagcgcaatcacgcctaagccaactaacccagcttcgaggtaagcattgccatcatccacggcaagtacgtagttgcccgtgatttcaatacgttcattctcactgcacagtaccaaaggatcaatcttactggtgcgcgaggacaagaatcccactatgcaatggtcagtattttgcagctcgcgcgggtgtgcgggagcgccaaggcgttccacatagctgggggcgacgtagacgccgatttgcaaatcgccgacatggcgtgcgattagggactggtcggtgatttgaccaccgcgcagaacgcaatccacgttgtcgccgatcagatccacttcccggtcgctcacacccatgtcgatctggatatcagggtagcgggcgtggaaagccggtagcgccggcaccagaataagacgggccagcggactcggtacatccacccgtagccgtcccctgggcgtcatcgccgcactggacaggctgttttcagcatcctccatgtccgccagcagacgaatgacgcgttcgtagtagaccgcgccatcgggagtcacaccgagcttgcgggtggtgcgatggagcaatctgacgcgcaggcgcgattccagctgctgaatgagttgcgtcaccgtagttttgctcatatgaagcgtttgggcagccttcgtgaagctccctgcctctaccacccgagcaaaggcgcgcattgcatcgaaacgatccatttcttatcctgtctttcatcgattgtttggatattacaaacaatgagggacaaagtcgcttgtttatccgcccgatctcgtcgttgtacagtgtctttacattcaccgggctgatttcgccccagcataaaggtacaaacatgacagcacgcgaagccgtttttcccttcggtcgtcaggcgctctatgagcgcaatcgttattcaccggccatcaaatccaatggtttcttgtttgtttctgggcaggtgggtagccacgaggatggttcgcctgagcacgatctgaaagcacaggtcaggctggcgttcaaaaatcttaatgctgtgctcgcagcggcgggctgcacgtttgaggacgtggttgatgttaccctctttgtcgtcgatcctgagtcaaatctcgacgctatctggagtatcctgccagaatattggggagaagcgccttaccctacgctgaccgggatcggcgtgacgtggctttatggatttaagttcgagattaaggttattgccaggctaccctaagcgttacgggtctttccgccagtggaaaatgcatttgggcagcccgcgctgtctgtaaaggtaactgccggatcgggatcgtctgctacgcagcggcagacccagcggttaccgccggatcgaaagtctgtagccataaggttgggagcagcatcgctgcttttcacctgcggggatcacatacggaaccttggacggtacctacggtacgatgctgcttatacccgctggcggagagatgtcagaagcggcggtgttgccgatcttttttggaaccgcgcatgattgccttacacccaggtatggtccggcacggttaaaccgcctttatttaagcctttgcgggagcgtggggctcacggccgttcagcttgcctcatagcaagaaaatagcacctacaccaggataagattgcatgcttggggagcggagaggatcacggaaagcaaaaatcccgctcaggtttccctgagcgggatttttaaatttggctcctctgactggactcgaaccagtgacatacggattaacagtccgccgttctaccgactgaactacagaggaatcgtgtgaacgaggcgcatactactggcctcgcatttttgtgtcaacactaaaattaacctgctgattcaaatggctaaatttagctcaacacgttgttttagtgaacaatgcgccgatcgccttcgtcctgcaggccattctcacgtctacgcgccagcggatcctggcggtaaaagtggcaaaaacgctgccacagggccgggaagcgaggcgcgaacagttcaggcgcactgaaaaaatattccgagaggacagcaaagcactctgcgggatcggtggcggcataggcgtcaatactggcggcgctttcgccgaccagatctatctcatcctgaatgttgttcatcgcggcgtggagatcgtgctcccagccggcaacttcacgcaacgggataagcggcacgccgctggcccggtcgccgttccgcgtatcaagcttatgcgccacttcatgcaccacaaggttaaagcctgacgcatcaaaagagtcttgaatatccagccagttcagcactacaggaccctgttgccagctttgtcccgactgtaccacccgctggttgtggaccagaccaatatcatcctcccattcatcatcgacgatgaaaggggcagggtagatcagcacttcatgaaagccatccagccactcaatgcccagctcaagcaccggcagacaaaagagcatagcaatgcgcgcctgatgcagcggggtcagctccagcccctgcaatgccaccagccgcttttgctgtaaaaaacgggcagccatctgcgtgagcttgtgctgctcagtggacgaaagatgggctaaaaccggaatggcaagcgcttgctcccagggcatctctgcgttgccggactcatcatctgctttccagggccatttaaacatcatattgctcgcaaagtcgtcacttgaacacaattaccgaaacgggagctattaaaatgccaaagatcctggcattatagcaaccatcacagcggagagatgccggagcggctgaacggaccggtctcgaaaaccggagtaggggcaactctaccgggggttcaaatccccctctctccgccacttttcttgctctaaccttcccttcaataacaccgttagcttcaggtataacgcctgcgctggggtatcaccatcatcatcgtcctggtttcagcgtagagtcgcggtagcgcgctttatccttttggcaccttatcgccgcttttagcccgaacgagcttaaacgcatcataaagagggaaggtacgcctggaaagcggcaatgtcgaaaagagtgatctcaacggagcgggaacataaaaaagcccgctgaacgcgggctttgacggggatcagaactgatagaccaggccgagggcgacgatatcatcggtcgcgataccgctgtttttgtagaagcggtcgtcttcatccagcaggttgattttataatccacataggtggacatatttttgttgaagtagtaggtcatgcccacgtcgacatacttgaccagatccttgtcgccgtagcgagaataggcgtagagatctttacccttcgactgcagataggccacggacggacgcagcggtaaattaaagtcgtcgaactgatactgcgcgaccacttcgaagttctgcgttttgttggcaattccgccaaaactatcgttgccatagaaggtcatgttgcgggtctcagcatacatggcggccagatagatgttattggcgtcatatttcgcgccgacggtccaggcatcggctttatcgccgttggcataacgctggctgctacgcgcggccgccagctggttatgggtacggtcagaagacgaatacgctgccccgaagctgatgcccatatcgagatcatagtagctggagataccaaaaccgtcgccattttcccgcgccagcttacgtttcccaccgttattagtgccttcgccagaaccggcgttttcattattaccctgatactgcagggcgaaatgcaggccgtcgacgaggccgaagaaatcgctgttacggtaggtggccacgccgttagtacggccggtcatgtaaacgtcggtctgggtgtaggtatcgccgccgaattccggcagcatatcggtccaggattcaatgtcgtagaccacgccgtagttccggccatagtccagcgacccgcagtcggcaaacttcaggccggcaaagccgagacgggtccaggagttcgcgccttctttttcgctggtgttcgcctgaatgttgtattcccactgaccgtagccggttaactcggaagtaatctgcgtttcgcctttcagaccaaagcgaacataggtctggtcgccgtcctctgaagcgtcgtcagagaagtaatgcaggccgtcaactttcccgtagaggtccagtttattaccgtttttgttatagatttcggcggcattagcggcgctagccattaataatgccggaaccatgagtgccagtacttttcttttcattatatattcccttttaataataatttctatgaattatgacaatccctccggaatgacgatccgatactaacgactaagttcatctttatttaaaataaaatatgtaaataaataatgttaaacatttcaaaatatttctaagtggttctttatattaaattttgatgtttgtgcaaaattcattattttcttatatagcaatgggttattgtatctttggttggttgttgttaattttatgaaataaaatgaacaaataacaatcaagcacattattcattatggaaatttattttgtgtgaatgtaaatatccagggaattatcaacccagcttgcgataattaaggaatgaatagctttaagcgtacgggagataataaggacatctcttcagcctgtgcgcattggcagcataagtcgcgagaaggcgcagaagacgaagatgtaactgctgcctgtgacgcaggttagcggtataatgtgatgcgtgtcacgttttgagtgacaatagtctgttgtgtcacggagaggaatgagatggaagagcaggcaaaacgcagcccgggagggaaacttgcgctctgggcgttgtatgctttttgcggatattgtgtctgggtcattgtgcgttactggtgggtagtgggaaaaattcacagcgttcccggcgccagcgtggagggtgattttggaacaacggccgggaaatggcttggcgccctgttgggtatgctggtcctcggcggcattggctctattctcggcgcggtcgtctggtatacgcgtccatcccgcggcgagcaggatcatcagcgctaaaattgctatgctcgaggctgaccctcagataaaggaaagcctatggacctggttgactggcagcaacgatttgagcgctggatactgacgcaccatgcgcaggatgacgccgcacacgatctgtcccattttcgtcgcgtctgggcgaccgccactcagctggccgcgggggaggaagtcgaccggctggtactcctcacggcctgctattttcatgacatcgtcagcttgccaaaaaatcatccggagcgaagtcgatcctcgatgatggccgccgagaaaaccctcgccattctgcagtcggcctttgctgattttcctgcggatcgttacccggcggtcagccatgccatcgaggcgcacagcttcagcgcggcgatcccaccgcgcacgctggaggcgaaaatagttcaggatgccgatcgactcgagtcgctgggagccattggtctggcgagggtcttcgctgtcgccggcgctctgaataccatcttgtttgatgccgaagatccttttgctgatcggcgggcgctggatgaccgcaaatatgccctcgaccatttccagtgcaaacttctgcgcctgccggaaaccatgcaaactgacaaggggaaagcgatggcgcagcataatgcccgttttctcgtcgaatttatggctaagctcagcgcggagctgcagggggagccgctggcgctggatgaagcggttttgcgccgctttgcaccgcaggcgtcaaccgaccggtgatttatggtactctctgccaaaatcgtccgcgttggttgaggatatgccgcaaaagttaagcaaggaacacaggtcgttgtcgttggctgaacaggccggggaagacgctgaggcgctgctgcgtcagctgatgacgatctacgatgtaaaaacgctggttgccgaactggtgagcgtcggcgaacagcactggagcgcggcgatcctcaagcgcgtggtggcgcttggccgcgtggcggagcgtttgcgcccgcaggaagttgctcatctggcgacgctcctgccttcgccgccggcccatcatccgcactatgggttccgttttatcgatctgtttgccggtattggcgggatccgcagtggttttgaagccatcggcgggcagtgcgttttcaccagcgagtggaacaagcacgcggtacgcacctataaggccaactggtactgtgatccgcagcagcaccgttttaatgaagatatccgcgatattaccctcagccaacgctctgacgttagcgacgaggaggcggcgcggcatattcgtgaatctatccctcagcatgatgtgctgctggctggcttcccctgccagcctttctcgcttgccggcgtctctaagaaaaatgcgatgggccgtgcgcatggctttgcctgcgaaacccagggaacgctgttttttgacgtggtgagaattatcgcggctcgtcagccagcgatttttgtgctggagaatgtcaaaaacctcaaaagccacgatcaggggcgcaccttccgtatcatcatgcagacgctggatgagctgggatatgaagtagctgacgcggggcataccgggccggatgacccgaaggtgattgacgggcgccatttcttgcctcagcaccgggagcgcatcgtgctggtgggtttccgtcgcgatctgcagctgcatgctggatttacgctgcgcgacatcgcggcgcagtacccggcagtgcggccaacatttggcgagctgctggagccgacggtcgatgcgaaatttattcttacgccggtgctgtggaaatatctttatcgttatgcccgcaagcatcaggcgcggggcaatggctttggttatggcctggttgaccccgccaatccccacagcgtggcccggacgctttctgcccgctactataaagatggtgccgaaattctcgtcgatcgcggctgggaccggccgctcggtgagaagcattttgacgatccgctgaatcaacagcggcggcctcgccggttgacgccgcgcgaatgcgcccggctgatgggctttgaatccccgcagggggcgcgttttcgcatcccggtatcggatacgcaggcctatcgtcagtttggcaactcggtggtggttccggtcttcgccgcggtggcgaaactcctggcgccgcgcatcgctcaggcggtggcgcgccgcgaagcggatgataatgatggcggatgttcacgataaagcgacgcgcagtaaaaatatgcgggcgatcgccacgcgcgatacggcgatcgaaaagcggatagcggcgctgctgaccggggcgggattcacctttgtcgcccaggatcgcgcgctgccgggacgccccgatttcgccttacccgactaccgctgcgttatctttactcacggctgtttctggcatcaccatgactgttatctgtttaaggtgccggccacccgcacggcattctggctggacaaaatcgccggtaacgtggcgcgcgacgcccgcgaccggcaaaagctggccgaagagggctggcgggtattaatcatctgggaatgcgccctgcgcgggcgcctcaggctgagtgatgcggcgctcacccaacgtctggaagagtggatctgcggcgccggacacgacgcgcagatcgatacgcaggggatccgcgaactgacgactacttcgacgccttacaaggagtagcctcgctgcggacggggaagagatatttccccagcgtcaccagcactacggcgaaaataatcaccgccagcgccagccactcaatgagcgacaggctctcgccgccgaacccagtaccgaggagcaccgcgaccaccggattaacataggcgtagctggtggcgaccgccggggtgacattgcggattaaaaacatgtaggcgttaatggcgatcagcgagccaaagatggccagataggccagggcggcgatcccggaccaggaagggacgcgggttaaggtttcaccgctcagccatgaggccgccagcaggacgatcccggcggcgagcatctcgattgcccccgccatcatgccggtcggcaatacgattcgcgaaccgtaaaccgagccgaaggcccagcttagggaaccaatcaggatcagcagtgcgccccaggggttgccgttcaggttgcctccgctgttgagcatcacgatacccgcaaggccaatggcaatgcccagccactccagtttacgggtggcgatgccgaaaaagcggctgaagcataaggtgaacagcggtacggtggcgaccatcaccgccgcgatgccggaggggacgtgctgatgttcagccagcgtcacgaagccgttgccaaccgcaagcagcaacacgccgatcagcgcagcgttaagcagcggacgacgcgccggtagcttatggccggtggccagtagccaccccagcaacagcacgccggcagcgagaaaacgaatgccggccatcattagcggcggccagctggcgaccccgacggcgatagcgaaataggtagagccccagatgatatacagcgcaaacagcgccccgatgagcggtaaaagctgacgggtagacatacttcctcacgacggtgcagagatagaaaggggacatatagtaaacgtgaaaactatcgtgctggcgagtggttaatttgcgtcaggttgttaaatttatattgactaattgtaccttgggcaccggccgttttttaacgcatactcgagggagacattgatgaaaagagaaggaaaatcattttggcaggaagtagtcttttaacattacttgatgatatcgccacgctgctggacgatatttccgtgatgggcaaggtagcggcgaaaaaaacggcgggggtgctgggcgacgatttgtctctcaatgcccaacaggttaccggcgtgcgggcgaatcgcgagttgcccgtggtctggggagtggcgaaagggtcgttcgttaacaaagtgatcctcgtgccactggctttgttgatcagcgccttcatcccctgggcgattacgccattgttgatgctgggcggcgcgtttctctgtttcgaaggggtggagaaggtactgcacagtctggaagcgcggaaacacaaagaggatcctgaacggcggcagcagcgtctcgccgcgctggcggagcgcgatccgctggcctttgagcgtgacaaagtaaaaggcgcgattcgcaccgattttattttgtccgcggaaattgtcgccattaccctcggcatcgtggcggaagctccgctgcttaaccaaatccttattctttcggggattgcgattctggtcactatcggggtgtatggcctggtgggggtgatcgtcaagctggacgacatgggttactggctggcggaaaaacgtagtgcgctggcgcagtggctgggtaaagggctcctggccgtcgctccccgcctgatgaaggtgttgtccatcgtcgggacgctggccatgttcctcgtcggcggggggatagtcgttcacggtattgcgccgctgcatcatgccatcgagcactggagcgcggggttgggtggggtgatggcctccacgctgccggtcgtcgccaacctggtgctgggttttatcatcggcgcggtggtgctggcgggcgttaaggcggtgagcagcctgcgtggcgctggaaagtagcatggcgaaacgcagcgtaacggcgccgcgtgttctaccctgaaaacgccccgggtatcgacagagaccggggcgctgacgccgcgaggtttgcgcaacgtactgcgagagaaagatggataagccactgcggttgaagttaaaaaagtgctaccacctggctcgcccggcgcatgtggttaacgcttgttttatcgcagtgctgtttttctccacgctgctgatctggcgtgaaatcaatgtcctggaagaggcctacgtggccaaccagcgtaacaatctggctaacgtcgctcaagaaatggatgggctgttgcagttcaacatcgacagaatgatgttttttcgccatgggatgcaggcggcgctcgaacagccgctcgatatcgatgtattgcgtaaggccagccaacgctatctgagccagcgccatcagcaggcctggcgggtggcgctaccgaatcggcgtacgctgccggtgtttggcatctcgggcagcgtcgctggcgacaaccctatcctgctggtggacgatccgctggcggctgatgaactaatggcgacgctcgagctgggctatctgctaaatctgacgcagcacgatcgcgatttcgccgagcggatgcagtatatctctcgtagcggcttttttacctcgaccctgccgctgcgggatgagtcgcaggtgataacgcactattcccaagccctcagcgctccgtggtttacccgccagacccaacgaaataatccggggcgaggcgttatctggcaaacctttcctgacgatgacccgcagctggaagagcaggtggtcaccgcttcgataccgttggattttgccggttactggcgcggcgtgctggcgatggatttctcagtcagtgaaatcaaagcgtttttggttagcgccatgcaggggggacaagagggagagtaccaactttatgatagccatttgaacctgctggcttcttccgcgccggggaatgtcctgaccctgctgtcgccgcgcgagcaggagctgctgagccgcgcgtttgtccatgataaccagggagggctgcgtctgctgacgcgctatatcagctgggccaaactgcgcaattttgacggcgtgctgctgcggatccacactctgcgggaaggcgtccgcgggaactttggcaccatcaccatcgccctgaccctgatgtgggtcctcttcaccttgatgctgttgctctcctggctagtgatccgccgcatggtccgcaacatgagcgttctgcaaacctctctggagtggcaggcatggcacgatgccttgactcgcctgctcaatcgcggggctctgtttgaacaggcgatggcggtagccagcgactgccagcgcagcggacggccgctggcggtgatccagctcgatctggatcattttaagcacatcaacgatcgctatggtcatcaggcgggggacagggtgctgtcgatggtggccagtacgctgtccagcgcggttcggcagggcgatctgctgggcagagtgggcggagaagagttttgtatcgtgatgccgaataccaccctgcaggaagcggcggcggtggcggagcgattgcgccagcgtatccagggacgggaagtctttttgcataacaacgtgacgctgcgggttagcgcctcgttaggggtgagcgccagcgaagagtggggggagtatcagtttgaagcgctgcagtcggtggccgatgggcgactctatctggccaagcaaaatgggcgtaaccaggtctgttttcgcagcgcagcgtgagtaaaacgtttcgatgccgattggcaaaatgagaattatcttaaagtgatcgcaggcgatcgcgctatcgaatgaaaccggtttgcggctaagccttctcacatcagccttgcagcccgataagtcatcaagcgccaacattctcaatattttgcgtcatgaatatctcttgtcatgcaaaataattgaggataatgtttcaacgcatcggatttcccggtgtaacgaattttcaagtgcttcttgcattagcaagtttgatcccgactcctgcgagtcgggatttttttcgcctgccgctaacggttggcttcactggcgctgaaatcgtgaatatcgagttcgaatgcctccgccagctcacgccaggtatgtgacccgcggccatcgatgctggcgcgctgcgggtcgtccagcatgcgatggacttcgctttcgctgatctcattaattgccgccagcagggcatctacgttgacgtcaaggtcgtccccggtctggcctgttaattggtgcttcatcattacccccctcgctgagcgttgctcaagcctctctaagtatagtcggtctaaaaaagcgccagtcacgtgccgcgacgctgcgagttgcgtggttttgttctacactggctgaaaatatagaggagatgattatgcaggtgaacgatcgtgtcacggtgaagaccgacggtggcccacgtcgatcgggggtagtgctggcgattgagtcgtttagtgaaggaacgatgtatctggtttcactggaagactatcctctggggatctggttttttaatgaaataggccacccggatgggattttcgtggaaaaagaggtctcgtaaaactgaactggcgggagcgccgccagtttgtttcagcgcatatttacctgaataccggaggtgatgttttcggtcagccgaacgatatgataaatcacctgcttattatgcgtttgtattttctttttaatattgcctttatgcgacgataccgtcttcgctttgatgttcatttgcgttgagatttgcgaagtaccatgcccggccatccacatttgcagcatatttgattctgttttactcagtgacaatgtcggtaaagttaactgccctacactggtgtttttgtatttaagataattaaccagaataacatcaaggtcttttggggttatcgattttgaactgattagcagattcttccgtacccgcaaatagcggtcaaaatggatgttcgccagcgacataaagataacaaacagcgtcgccgggttttgcgtaatgatctggcgaataatgccattactttcatcatcatgcacgaaacagtcttcattcagaaacaccaccgccgggcaacacgacgtacagtgtttctgcagatccgcagcactgttgacctcaacgatttcctgttttttaattccccgactggtcagatatcccgtcaatcccaaccgggtatagctgcacaaatccataatcatcgttgacatgacccatcctcaatcaacacgtaacgatatacacttcgcactggctgtgcgaagcagtccttgcgggcgataataatagtaggtttagaaagaacccattagctccattaaactattccgcatctatgcatataatttgccaggaaaactcttaaagtaaagtcaagaaccggtagtgtgaccgaattaaaaacaaaaagtgcccatagatgctatggttacgcgcccagtattcttttactttcagaatttccttacttcaaatgaaacccacgttagcggttgctggcttgctcgcttatccctttgcggtgggggtggaaggcttaacgctttaatgccacaatacttttttatcggcttgtgggatgaatgatgaaaaagttattttttgctggcatggtggtggcgctggccggttgcgtacaggttgatcgttatgaggacgtcgttaaagcgccggcgccggctggccttgcaggtttctggcaaacgaaagggccgcagagcgcgatgatgagtcctgacgccattgccagcctgattgtcaccaaagaaggggacaccttcgactgccgccagtggcagcgcgtgattgcgcagccggggaaactgatgaatcgtgacagtgagatctacaacgtgaccgcttccctggacatctatcctgtcgagcgcgagggcaacacgatctcctacgatcggatgacgttgtcccgtgttgaacgtctcactccggagtgcgagaaggcgtgggccaaagcgcgagcgacggggcccgtcagcgcgccggcctccacgcgctgagattttggcgggccatagctggcccgcccgacgtcagaggactacaatacctcctctaacacccacacgctcacgctccccccgttacatgtaaaggtcgcgcagccttcgccatcggtttcgacaatctcttcccggttaccgagaaaatcccgccagcgtttgttgccatagttttcgcccagcgtcagcgccttttcgccctcatcgccattggacatgatcaccacgcagcctggatcgtcgtcagtaccgctacgactaaaggcgatgcagttaggatgatcgaaccaaagggtttgcacgccatgggcaaaacgctgacgggcgtcgatcagctcgtggagttgttcgataacgggcatctcaatggcataggtctctccgtcgccgccggtatcctcataggaagcgccgaagagatcggcataaaagaccgagggcacgccattctcccgcagcaggatcagcgcataggcgaggggcttgaaccagggttcaaccggcgcctcaagggcctgcagcggctgcgtatcatgattggtgaccagagtgacggcatggaaagggtcggcttcgaccagcgtcccgctgaaaatctggctcatgtcataatcgcggccctggcgcgacgcttcatgaaatttcatctgcagtggggcatcaaacagcatcgttttgccctcgaccaggtcgatatactgctggagcttctccacttcatgggaccagtattccgctacaataaacagcggctgcggggccacctcctgaacatgctcgatccacgctttataaaaccaggcggggatatgcttgaccgcgtcaagacgaaaaccgtcgcagccggtctgctccattacccagcgcgcccagtatttgatctcctcggtcactgcatgattgcggaaatcgatattggcgcccatcagatagtcaaagttgccgagctcatcatcgacctgttcattccagccttcgccggtgtaatcgttgacgattttaaacacaccgtcttccgtcgggttctcgatgtggtcaatgccgctaaaacatttgtagtcccagacaaactgcgaatactgtccggcgcgcaccgggaaggtgtagcgcgtccatgcctcgcactcaatgatctcctcgtcaatttgcgtacgatcctgctcatcgacgcgctgaacgcgcagagcctctttttcatcagcgcccattttatggtttaccactacatccagcagcacggcgatattgtgctccttcagggcgttgatcgccgccagcaactgcgctttgtcgccatattttgtggcgacagaccctttttgatcaaactcgccgaggtcaaagagatcgtaggtatcatagccgacggagtaaccgcccgaggcgcctttgtaggcgggtggcaaccagaccatattgatgccgatttcattcaggctgggcgccagcgcttcgacctcaggccacagctcgccgccggtggggtagtaccagtgaaaacattgcaataaggtggggtttttcatcttccatgctccagacgtcaacaggctgacctttgcagtatgggagatatccagcaaaaagggtgaggaaagccctgattttcgctataccctaaagcggatcatatataataaatttgcataagatgtagcgtaacgatgttggtgtcagggcgttaagcgccttacactacaggaaaatcctaaccttcggggtatctatgaaattagcacttctgggtcgtcaggcgatgatgggcgcgatggccgttgttttgatggctggcgtcagcgtgagaacttttgcggcggaaaacctgctcaatcagattaaagagcgcggcaccctacgcgtgggcctcgaaggcacctaccctccctttagtttccagggggatgacggcaagctgaccgggtttgaagtggaattcgctaacgaactggcgaaacatcttggcgtgaaggccgatctcaaaccgaccaagtgggacggtatgctggcctcgctggactccaagcgtatcgacgtggtgattaaccaggtcactatctctgacgaacgtaagaagaaatacgatttctccaccccatataccgtctccggcgtgcaggcgctggtgaagaagggtaacgaaggcgtgattaaaaccgcggcggatctgaaaggcaagaaagtgggcgtcggactgggcactaactatgaagagtggctgcgtcagaatgtccagggcgtggacgtccgtacctatgatgacgatcccaccaaataccaggatctgcgtgtaggccgtattgacgccattctggtagaccgtctggcggcgttggatctggtgaagaaaaccaacaatacgctggcggtaaccggcgaagccttctctcgtcaggaagctggcgttgcgctgcgtaaaggcaacgacgacctgctgaaaacggtagatggcgcgattgcagacatgcagaaagatggcagcctgaaggcgctgtccgagaaatggtttggcgctgacgtgacgaaataacggacagcggtgaaaaaaggcgctcctggaagcgcctttttttatttagcgcgtaactgtgtgcataatgaagcataactgagtcaggaggggccatgtcactgcaaaacttaacccgctttccgcgcctggaattgatcggcgcgccgacgccgctggagtatctcccgcgtctgtccgatcaccttgggcgcgaaatttttattaaacgtgatgatacgacgccgctggcgatggggggcaacaaactgcgtaagctggagtttctcgccgccgatgcgctgcgcgagggcgcggataccttaatcaccgccggcgcgatccagtctaaccatgtgcgtcagacggcggcagtcgctgcgaaactgggactgcattgcgtggcgctactggaaaatcccatcggcacccgggcggagaactatctgagcaatggcaaccgtctgctgctggatctctttaacacccaggttgagatgtgtgatgccctgaccgatccctccgcccagctcgatgagctggcgacccgcattgaggcgcaggggtatcgtccgtatgttattccggtcggcggctccaatgccctcggcgcgttaggctatgtggaaagcgcactggaaatcagccagcagtgcgaagacgcggtggcgatctcgtcagtcgtggtcgcctccggcagcgccggcacccatgccggattggcggtcggccttgaacagctgatgccgcaggcggaactgattggggtgaccgtgtcgcgctcggtcgctgaccagttgccgaaagtggaggcgctgcagcaggccgtggccaacagtctcgagctacagtcgaaggctgaaattatactgtgggatgactactttgccccaggatacggtacgccaaacgaagatgggatggccgccgtgaagctgctggcgcagctggaaggtattttgctcgacccggtctataccggcaaagcgatggccgggcttatcgacggcatcacgcagaagcgctttaaggatgaagggccgatactgttcgtccacaccggcggagcgccggcgctgtttgcctatcatcctcacctctaatacagaaacgacagcatgcaagaaagtatccaactggtcattgattccgccccttttctgctgaaaggggccgtctttacgctgcagctgagcattggcgggatgtttttcggcctggtgctgggctttatcctggcgctgatgcgcatgtcgccagtctggccggtaaaatggctggcgcgcatgtatatctccattttccgcggcacgccgcttatcgcccagctgtttatgatctactacggcttgccgcagttcggcattgagcttgacccgatcccggcggcgatgatcggcctgtcgttgaatactgcggcctatgcggcggaaacgctgcgcgcggccatcgcctcgattgataaagggcaatgggaagcggcggccagtatcggtatgacgccctggcagacgatgcgtcgggccattttaccccaggcggcgcgggtcgctttgccgccgctgtcgaacagttttatcagcctggtaaaagatacctcgctggcggcaacgatccaggtgccggagctgtttcgtcaggcgcagctaatcacctcgcgaaccctggaggtcttcaccatgtatctggcggcctccctgatctactgggtaatggcgacagtgctctcctcgctgcagaattattttgaaaaccagctgaaccgccaggagcgtgatccgaaatgagtgcgatagaagtgaaaagcctggtaaaaaaattccatggccagacggtgctccatggtatcgacctggaggtacagaaaggggaagtggtggcgatcatcggccccagcggctcgggcaaaaccaccctgctgcgtagcatcaacctgctggagcaaccggagagcggcactatccgcgtcggcgatgtgacgatcgacgccggtcgcagcctcgggccgcagaaagggctcattcgccagctgcgccagcacgtcggctttgtcttccagaactttaatctgtttccccaccgtacggtgctggagaacattattgaagggccggtcatcgtaaaaggtgaagataagcaggagtccatggcgcgggcgcgcgaactgctggcgaaggtggggctcagcggaaaagagaatagctatccgcgccgtctctccggcgggcagcagcagcgagtggctattgcccgcgcgctggctatgcgtccggacgtgatcctgtttgatgaacccacctcggctctcgatcctgagctggtgggggaggtgctcaacaccatccgtcagctggcgcaggaaaaacgcaccatggtgatcgtgacccatgaaatgagtttcgcccgcgacgttgccgatcgggcgatatttatggatcagggacgcattgtcgaacaaggcgaggcaaaagcgttgttcgcttcgccccagcagccgcgtacccgtcagttccttgaaaaattcctgatgcagtaaagcatgggctggcgcggcggctcagcttcgcgggagccgccgcgtttagcccactctcgcggcggggtaacgcccccgcgacacgtctttgcgctattgactcccacggccgtatacaccgcttcccatcgcccttggcagggtgtagaacatgatgggagaaaaacgctatgtttctgtgcggcgagcgggaaaatggcaagccttcagactaataaatgcgacagctacgatattttatacatataaataagatttatgtgttagttttctgtatttataataatgattatcaatcaggagttatttgcacagctatgagggacaatgattttttcagctggcggcgggatatgctgcaccaatttcagtccatggccaccggcgaggaggtttataatctcctgcaacgtgaaaccgaagcgctggaatatgattactacacgctttgtgtgcgccacccggtgcctttcacccgcccccgcgttacgttccagtcgacttacccccgcgcatggatgtcgcactatcaggcagaaaattatttcgcgatagatcctgtgttacggccggagaattttatgcgtggccatctgccatggaacgacagcctgtttcgtgatgcgccggcactgtgggacggggcgcgtgaccatggtctgcaaaagggcgtgacgcagtgcctgacgttgccaaaccatgctcagggatttctctctgtctccgcgaacaatcgtctgccgggcggttaccctgaagatgagcttgagctgcgtctgcgaacgctgactgaactaagcttgctgacgctgctgcgtctggaagatgagatggtgatgccgccggagatgaagttcagccgccgcgaactggaaatcctcaaatggacggcggaaggaaagacttcggcggaggtggcgatgattctctcgatttcggaaaatacggtgaatttccatcagaagaatatgcagcggaaatttaatgcgccgaataaaacgcaaattgcctgctacgccgtggcgactgggctaatctgaatgcgcctgccgttctgcgtgtcagacgtgataccggctgtcagtgatactttcagccggcacaggattactgccgataggcttgtttaatctgcttaacggtgctggagaatacggcggcctgagcctcatcttccatctgtgaaatctgcttttccattttaataatcacgcgccccgcatccgcctggcccatcgcctgcagcatcagcgtaatcatcgctttcaggcaggagacttcctgcgccagttcctgcttattttctgcagtggaaaaatctggtgtgctcatcgatatcctcgtttactcgctgcgctattgcgctctagtcaatgtgaaggccgcgcagtataccacaagcgacagaaaaaaaaggtgtgcttaatttctgttctctcatctgagctgtgaatgttttgatgcttcggataatacgtaatagccgtcggcaagccaataatttcccccatctatttagctcgttaataattgttacatattttgcttcgtatttatgcgctacgtaatctgttgtgttttttgtgccttctgtatgagtattgttaaaaaataagagccgggcaactgactgttctcaatgactttccacttagtgtgcacagacattgccataaatgagagccaaatcgaggcgagggcatttttttgccttttaaaatagcaataaaacccggtaatatgtgggagataaagtatcagtagcgttatccctcattctggagattattcctttgatcaacgttcttcttgttgatgaccacgaactggtgcgcgcagggatacgacgcattctggaagatataaaagggattaaagtcgctggcgaagcctgctgcggcgaggacgccgtcaagtggtgccgggctaattccgcagatgtcgtcctgatggacatgaacatgcctgggatcggtggtcttgaagcgacgcgcaaaatcgcgcgctccgtggcgggcaccaaagtgatcatgttgaccgtgcataccgagaatcctttacctgccaaggtcatgcaggcgggcgcggcaggctatctcagtaaaggcgccgcgccgcaggaagtggtgaatgccatccgctgcgtcgcgtccgggcagcgctatattgcctccgatattgcccagcaaatggcgttaagtcagattgaacccgaaaagacagaatcgccgtttgccagtttgtctgaacgcgaattgcagattatgctgatgatcaccaaaggtcagaaggtgaatgagatctcagagcagctaaatctgagtcctaaaacggttaacagctaccgctatcggatgttcagtaaattaaacattcatggcgatgtcgagctgacccacctggcaattcgccatggcctgtgtaatgcggagtcgttagcaagccagtgagtgatgtttttgacgcaaaagctttcctgaaaacggtgaccagccagcccggtgtgtatcggatgtatgatgctggcggaaccgtcatctatgttggcaaagccaaagatctgaaaaagcggctcagtagctacttccgcagcaaccttgcgtcgcgtaaaacggaagcgctggtagcgctgatcgcgcaaatcgacgtgaccgtcacccacaccgagacggaagcgctgctgcttgagcacaactatattaagctgtaccagccacgttacaacgtgctgttacgcgacgataaatcgtatccttttatttttctcagcggcgatactcatccgcgtctggcgatgcatcgcggcgccaaacatgcgaagggcgaatattttggtccttttcccaacggctatgccgtgcgcgagaccctggcgctgctgcagaaaatctttcccatccgtcagtgtgaaaacagcgtctaccgcaatcgctcccgcccctgtctgcagtatcagattggtcgctgcctggggccgtgcgtggccgggctggtcagcgaagaagagtatgctcagcaggtagagtatgtgcggctgtttctcgccggcaaggatgaccaggtgctgacccagctcatcgcgcggatggagaaggcgagccagaacctggagttcgaagaggccgcgcgcatccgcgaccagattcaggccgtccgccgcgtgacggagaaacagtttgtctccaacaccggtgacgacctcgacgtgatcggcgtcgccttcgatgccggcatggcctgcgtgcatgtgctgtttatccgtcagggcaaagtgctgggcagccgaagctacttcccgaaagtgccgggcggcaccgagctgggagaggtcgtggagacctttgtcggccagttctacctgcagggcagccaaatgcgcacgctgccgggggagattttgctcgactttaaccttggggataagacgctgctggccgactcgctgtcggagctggcgggtcgtcgaatcaatgtgcagactaagccgcgcggcgacagagcgcgttatcttaagctggcgcggaccaacgccgcgacagcgttaacgaccaaattgtctcagcaatcgaccattcatcagcgtttgcaggcgctggccagcgtactggagctgccggccgtcaagcgaatggagtgttttgacatcagccacaccatgggcgaacagaccgtagcatcctgtgtggtgtttgatagcaatggcccactgcgcgcggagtatcggcgctacaacatcaccggcattacccctggcgatgactatgcggcgatgaatcaggtcctgcgccgtcgctatggtaaagcgattgatgacaacaagatcccggatgtgatcctgatagacggcggcaagggacagctggcccaggcgaaagccgtgtttgctgaactggacgtcccctgggataaacatcatccgctgctgctgggcgtggcgaaaggtagcgatcgaaaagcgggtctggaaacgttattctttgagccggaaggggaagggtttagcctgccgccggattcgccggccctgcatgtgatccagcatattcgcgatgaatcgcacgatcatgcgatctccgggcatcgcaaaaaacgggcgaaagtgaagagcaccagctcgcttgagactatcgagggggtggggccgaagcgtcgtcagatgctgctgaagtatatgggtgggctgcaggggctacagcaggccagcgtcgaagaaattgctaaagtaccgggcatctctcacgctctggcagaaaagatcttctactcgttgaaacattaggggctctgtagcaacatagggctaatttttacttacaacagatagttacccgtcactatgcaatttaatatccctacgttgcttactctgtttcgcgtcatcctgatcccgttttttgtgctggcgttttatctgccctttagctgggcgccgtttgcctgcgcgctgatcttctttgttgccgcggtaaccgactggtttgatggtttcctcgctcgtcgctggaatcagagcacccgttttggcgccttcctcgacccggttgccgataaagtcatggtggctatcgccatggtgctggttgccgaacactatcacacctggtgggtcacgctaccggcggcgaccatgattgcccgtgagatcattatctccgcgctgcgtgagtggatggcggagctggggaaacgcagcagcgtggcggtctcatggattggcaaagtgaaaacgaccgcccagatgaccgccctggtatggatgctgtggcgtccttatccgtgggtggagtgggccgggatcgcgcttttcctcgtggcggcggtgctgacgctgtggtcgatgctgcagtatttgaacgcggcgcgcggcgatttgcttgatcagtgatcgtttcgccgttattttcagcaaacgatacaaagttgcgaaaaataccgttgactcaccgcgagagataagtagaatgcaacgcatcgaacggcggcacagtcttccagacgataacaaaatcaagtgattagcaaataacttgatgatgcgggaatagctcagttggtagagcacgaccttgccaaggtcggggtcgcgagttcgagtctcgtttcccgctccagattaacagcatcggcagttgcgggtgcttcagtattaaaggcgcgttagcaaagcggttatgtagcggattgcaaatccgtctagtccggttcgactccggaacgcgcctccactttatatcccgagcccggatggtggaatcggtagacacaagggatttaaaatccctcggcgttcgcgctgtgcgggttcaagtcccgctccgggtaccattgggaaatacagaataatcaaagcaataagcagtgtcgtgaaaccacctacgggtggtttttttgtttctgtactttcgctttctgatacctttcccgccagcctgacgccacggcgtttttcggttaactcttgccttacagtcaatttctcatttgtcccaggacaaaacgatcgcgccttgctactatcaaacggactctcagcccagcctgccggaggcatcatgttcactggactttgcgcatttcctttgacacctttgcatcagcaaaattttgatgaaaaagcgtttattcgtattctcgcccgtcttaccgatgccggagtcgactctctgggcatcttaggttcaaccggtagctacgcttatctcagccgtgagcagcgcagacgagtggtgcaggtggcgaaggcgcatgcggggtcgatcccgatgatggtcggcgtcggcgccattgcgactaacgaggtgctacgcctggtggaggatgctcaggaggcaggggcggatgcgttattactgccgatgatgtcctatcagccgctttccgcggaggagatctttgccttttacgaagaggtctgtcggcatgtctcggtgccggtttgcctgtatgacaatccccgcactacccacgtaatgctggcggatgagctgcaggggcgcatcgccgccttgccggccattgcctcgattaaaattcccggcctgcccgcgccacaggcgagcgaacgtgtagcggccctgcgtcagcatcttccctctcgcgttacgcttggcgttagcggcgatgcgtgggccactgccgggttgcaggccggctgcgaagcctggtattcggtctgcggcggactctttccccgcttctcactggcgctggtaagagcgatacgtagcggcgatgtggcgcagactgcggcactgaatgagcagctggcccccctatggcgatgctttgatcgctatggtggtagcctgcgagtgatagccagcgccgcagcgatgctcggactctgcgatccagactcgcttccccgtcctttgctttcgttaggggaggaggcctgtcgtgaggtggcgtcggcgctgcgcggcctggcctgatcgcgtatcgttgacaccggcgcaataggtatcgccgggtggctttctgtcggcaattcggctactgtaggcccgatttttgccatgcgagcctgtgaatgaataccggacctttgaacgaaaacgaactggaatggctggatgacactctggcgaaatacgccgccgaaggcgccattctggatgtctctgaactggatggcctgctgacggcgatcctctctgcgccgaccgacatcgaacccgctcagtggctgctggcgatttggggcggggcggataatgtcccgcgctgggccaacgatcgcgagcgcgatcgctttgtcaatctgacgctgcagcatatgagcgatatcgccgaacggctggagtcttatcccgatcagttcgaaccgctgttcggcacccgcgaagcggaaggtcaggagctgaccatagttgaggagtggtgctttggctatctgcgcggcgtggcgctgagcgactggtcgacgttgcccgctgaactccagccggagctggacgctatcgcgctccacggcagcgaagaacagtttagcgcgctggataatctgacggcggatgaatttatcgccagcatcgagcgtatcacgccggcggcgctggcgctttaccagtactggatagcgaatccgcagccggtggaggccccgcagccaataagaaatgaagcgaaagtcggacgcaacgatccctgcccatgcggcagcggtaaaaagtataagcagtgttgcttagcgaaatgaacaaggggccagcaggccccttttttatcccaccgcgggcaacaacccggcagcgatgctgaactgaatagccacgatgccgatcccgcacagcagaaccagccatagcgtcggtgcgccgccggcgacccgccaggtagcctgcggatgctctcggcgactcttcatgaccagcagggccggcattatcagcgccagcacggctaatgccaccccggcgtagccgagggccatgacgaaaccgcggggatagaacagggcgaacgccagcggcggcaggaaggtgattatcccgctctgcagacgcccgccgacgctgtttttacgctgaaacatatccgccagataatcaaacaggccgagcgagacgccgaggaatgacgtcgccagcgcaaggtcggcaaacaggtgaacggccagctccacatgcggtgacgccaccacttcgcggatcgcctccagcaggccgttcagaccagcgttatttgccagcagggcggtaaaggccggggcgtcgatactgcccagcgtcgccagctgccagaaaatataggccaccagcggaataaagctgccgatgataaatacccggcgcaatttgcgaatatccccccccagatagctgacgatgctcgggacgctgccgtgaaaaccaaaggaggtgaaaatcaccggaatggccgacagggccaggccttgctcaaccggcagcgtcagcaggttcacctgatgaatgtgcggcatcagcagggccagcataatcaccaggaagacgattttggcgctaaacaggaagcgattgaacaaatccaccagcgcggtgccaatgcacactaccgccccgccgaggagggtgaagatcagtacgcctgcggccggcggtagctgccagtccagccactggttgaggctggaagcgagtaattcaccggcgccactgatataggctgccgtgagggcgtacagcagaaacagcatgcagaatccggtaacccactgcccataacggcccagatagcgcgccgccagagaaccgagccccatatcggcagggacatgctggtagacttccagcagcaaaagggcggtatagcacatcaatgcccacaaggtgaaaagtaaacccaacgtgacggtaaagccgacgcctgcggcggccaatggcattgccaacattcctgcaccgatggtggtgccagctacgattaaaatactgcccagagtgcggtttttcacgcttttcgctatccctacagcaaataacaataaattatgccgcgcagagtaggggatattacggctttcgtcaaatcgggattacaagttgtgtaatgaaatgtttacataataagagggcgaaagcctgcgctggcgcaaggcgcgggttgacggtctggcctaagctggcggtttttgcaggaggggttatgtcttctattcatggtcatgaagttttacagatgatgctcgcctcgggtgaatcctggacggtcgcctcgctggaggccgccattcgccgccgctttggcgaagaggcgcggtttcacacctgttcagcagagaatctaagcgccgcacagctggtggcgtttttagagaaaaaaggcaaatttattgccagagaggaaggttttactaccgcagaaaataagatctgccgacattaagagggccgcgacacggactgtcgcggcgcgggggattaattctgcgcgtcgagggtagccagctctttatcgataaagtacagaccttcgccgctttttccagcgagggtcagtttatcgatcaccgatttaaataatttctcttcttcatgctgttcagcaacataccactgcaggaaattaaaggtcgggtaatcctggctggtcatggccgcgtgcgccagttcatttattttttgcgtgttcagctgctcatgctcgtaggtctggcggaacagctcgtcgagtgaggcatattcggcaaacggggaggcgatagcgttgatccgcggcaggctgccggtgtcggttagatagtcgaacaggcgctgcatatgggtcatctcttcctgagcatggcgacgcaggaaggccgcggcgccttcaaaactgtggtaactgcaccaggcgctcatctgctgataaagaagagaagaatagagttcaagattcatctgttcattgagtttgtcaatcatgtccgttttcagcatcgttgcactcctggaattaaataatagatgttattggctgccactataatttgttatttaattatttgcaaaaagtaaatttaaaaatgttttatttaaaatgctaatgggaataacacgcattggcagtttaataataaatgagaatgcttttaatttattattcattattgcctgggcggtcagggttttgtcgccggcgggtggtaagggaggacgaagcggatacgccagcatgcagagggctgaggtcaacagacaaagggagcctgcgaaagtgtgaagcactgcgtaaattttaaaacaacttttcataaaatttgaaagtttgttttcaaggtagtagagtgcagtcaacgccaatgacattctgcgggcaggcccgcacagcattcaggagagtaaaccatgaagattgcactgatgatggagaacagccaggcgaacaaaaacgccatcatcctcaaggagcttaacgcggttgccgacgaaaaaggattcccggtctataacgtcggcatgagcgatgagaacgatcatcatctgacctacatccatcttgggatcatggccagtattctgctgaattcgaaagcagttgacttcgtggtcaccggctgcggtaccggtcagggggcgctgatgtcgctgaacatccatccgggcgtggtctgcggctactgtatcgatccggcggatgcgttcctgtttgcccagatcaacaacggtaatgcgctgtcgctgccgtttgccaaaggcttcggctggggcgccgaactgaatgtgcggtttatctttgaaaaagcctttaccggccgcaacggcgaaggctatccgccggagcgcaaagaaccgcaggtgcgcaatgccgggatcctcaaccaggtcaaagcagcagtagtaaaagagaactacctcgataccctgcgcgccatcgatccgcagctggtgaaaaccgcagtctccggcccacgcttccagcagtgcttcttcgaaaactgccaggataaagcaatcgaagactttgttcgccagatcgtcgcttaaccgtcatcagggccagcgccgctggcccttccgtcgtttattttttcttctatttcttcttctccgacacgctgctgccggccgttttggccagatgcaggctgtcgatcatccctaccagacagatcaaggcgataaacacaaacgacaggcggaagctgatccccggtagttcagtaagatgcagccagtcgccgacctgctcgcccaggcgaatgccaatcgccccgagcgtgatccccagccctaccgccagctgcgacgcggtactgaacagcgtattggcatcactcatctgcgcggcggggacatcggcaaaggccagcgtgcttacaccggtaaactggattgagcgaaacaccccgccgagataaaggatcagcatgatggcccagaccggcgtctgcggcgtaagcagcgcgcaagccagcagcgaacagacgttcaacgcaccattgatcagcagtagccgacgaaagcccagccagcgaatgagcggtgtggtggcgggtttaatggttaaattaccgacaaacaccgccagcaccagcaggccggaatgaaaaggatccataccgaatcccacctggaacagtagggggagcagaaaaggcaccgcgctgatggaggcccggaacaacgagccgccgtacattgtcacccggaacgtcggcacctgcagggcgtcgagacgaaccataggcgccgccgcccggcggaaatgacgaatggaatataacagacagccgaagccaagcgcggcgagagccagcgtcggccagatctgcggctggcgatcgccgagccgctccatcgcggtcaccagactgaccatcgcgaccgaggtagtgataaatccgctgagatcgaaggagcgccgttccgtttcgcgaatatcagggataatgcgcagcgaaaggatgatggcggcaaggcccagcgggacattgataaagaagatccagtgccagctggcgtagcgggttataaagccgcccaaaggcgggccgataatgggggccaccagcgccggccaggtcagggtggcgatggccttgatcagctggtgtttcggcgtggtgcgtagcaccgcaaggcgaccaacggggaccatcagcgcgccgccgactccctgaaggatacgcatggcgacaaagatatgcacctcggtggagaggccgcagaagaccgaggcaagggtaaagatcgccagggcgagagtaaaaatagcccgggcgccgaagcgatcggcgatccagccgctggccgggatcaggaccgcaagggtaatcagataggcgctgatgccgatattcagttcgaccgcggtgacgccaaaatccctcgccatatcgggcagggcggtggcgatcaccgtcccgtcgagaaactccataaaaaaggcacctgccaccagcagcgccggcgctgaaaaagcacgttcatcgcgggaagagatcgcggtattcatgttgtcactgccatcaagagtgtgatcctgtgcaaagcggcaggagacgacccgccagccagtagagtagataaaaaaacctgcgacggcaggttttattatcgttaacgatttagggtactattacgctcctgaaaaaaggagtaattaatgtctcaacatcttaccgaacacgacgagctggtttccgatgtggttgcctgccagctggttatcaaacagatcctcgatgtcattgacgtcattgcgccggtggaagtgcgtgaaaaaatgaccactcagctcaaagctatcgacttcgccagccatccggcctctgccgatccggtgacccttcgcgcggtgcaaaaagcgatcgcgttgattgagctgaagtttactccacaggaagaaacgcattaataccaggcctcgccggataccggcggggccttcttctttaatgggaaacgacggtctgcgcaggcgcaggggcagcatctttgaacaatttgctgttgccccagcactcttcgtagcgatggccgaccagatcctccacgataacccgcacgtccggcgcaatatcgctaattttgccgcccgcttttatccgcgcgacttcctgcagcaccaccagatgggccttccggtccagcttcatctgcttgctgaagacgatggcggccagggctaatgcgatcaccccgacgcagaataccactgcgatagcggtcaccgcgctttccggttggctgtgcgcttttgactggaaaccgtagaagctcaggatcgcccccatcgagaacaccacaatcgagcgcagaatttttcctgagaaggtcatggcgccggcatagatcccttcccgccggcgtccggtgtagatctcatcgacatcggccaggaaggtgtaaacggtccagggtatatagtaaaccccgccggtacccaggccgaacagcacggtaatgccgaacatcagcactgtcgccaggccggacggtagatggaaaaaccacagcgaggtatacagcagaaccgcgaaaatgacgatccccagcgccaggatatagggtttgctgaagccctttttcacgcacaggccgataaacagcgccgtagagatcagctgcagaatcgagttcaggctgttcagcccggccaccatcgctggatcgtgttgtagaacgaagatcacgaaataggtgaagatggaggcaaacagccattccgcgccaaagccgcacaggtacataccaagatgtttgcggaatacgcgtagataaaaagtcgaacgcatatctttcgccagcgacagcagggtgctcagcagtccttttttcgcgctggtttccacctcttccccgcgctcacgctcccagctgcacaaccacaggcaggaaatagcgacgatcaggatcgcgccataggtcagaccggtgaggaagaaaggggtggcagaatctttgccatacagcagaatgaactggccgggaataaacgccgcgaggaagttggccagcttaccaaagatagctttatagccggtcagttttgaacgcagtgagaaatcatcggtcatctctgtcgccagcgtttcataaggcaccatgatagaggtgtagatgatctcaaacaccacataggtgctaaggtagtaccagaaactcaggccttccacccacagcagcgggtagaacatcatcagcggaataccgattagcagaaagaaacgccggcggccgaagcgcttgcccaggcgcgttttgccaaaattatccgtcagatagcccatcagcgggttgctgatagcgtcaatgatgctggcgacggagaagataaatgaggcctcgatcagcgtcaggccgcaaaaggtcgtataaaaatagagtagccatgcgccgcttatcgccagtgcgccgctccctaacagatttccgccgccgtaggctaactgatggcgtaacaagatcggtcttccctgcagcccttcagaggctgaagccgtgtatctagccataaaaaataaacctcgtgttttatatttttgaaacactgtttttatatttctttatggttcgtcaaaaagtgaccgcgctcactaatcccccttatggggtaacggtgatgagggaatgggatcgagttaaaacttttttattcttgaaaggaataataggggagaaaaaatagacggaatggattaataaaccgggcggggcagcgcagacgcgctccccctggcagagcgataaaggcttgattaatgcgctttctgcgcttctccaacgatagccatcagacgccgatcggtctgctccatcccgagaccggctttatcggcattacgaatttcctcaagcacgctttgcaatagcaggccatcctgctgctgctcttccgccaacagcgtgagaaaccgccaggtgctgtcatcgctttgcgctttggcttcctgagcgagaccgctcagcagacgactgcgctgttggtaatcgctcagggtttgggtaaacagatcttccagcgaggtgcactcagggttacaggcgtggtcgggattgacgatcggccagctgccggcttttttcaggtagtcaaatacgcgcatggtgagggtgatgctgctttgcgcgcgggtgcgcagaaacgtcgcggcgccgtcgaagcgatgtcgggcgcaccactcacttaagttcaggtaaacgttagaggcgtgaaactcaagattcatttgggtgtttagcttttgtgccattcctggaactgccataaaaaatatccttattaaccgggaaggggttactggtgcgcgtcagcggatcctgcggataactacaagataaaatagtgacacgcggcactgttgcagaataataaaactctacacattccgtataagtcgggtattttttccatttgccgacgatttaagaatactcgcttaacgaaattaagaaaactctcaagcgcggtaatttacgttttgttacaccattatttttgcaaactaccagggctgagattgtgcgccgttggcaggggctcgctggtttcagattggttataagatataagtatttgactacgagattcgtcgtagaagagaacggaataagttatttcattagtaatgtttcaggttgatgatcattatttttattttttgttgcaggcgcttttataaagaggaatatattttttctattcggaataaattacgccaaagatccgttttttcgcgatattaagcgggccatgtggctcagcggtgcgaggtgggttgccatttgagtggcgcacaggcgatcgcccgtagcagcgccgtcaatcgctgatgataacagtgctgtaacccaccgttaaacatcctctgacaacacaaggataagcctgctgatggtatagatgatcctgctatgccccggtaaaattgtatgacaattgtgtcattttttatgtcattttttgctaaatgtatgtacgcaattactgtaattccgcgatgtgataatgctctcgtatggagaaataatttccgggtattactactctaacaacggcagtggggaatgcgatttttctaatgccttgttttgatgccgattaaattgttaattccgatttttccctacatgaaagcgaattaaagctggagtttaccatgcacaaatttactaaagcgctggcggccattggtctcgctgcggttatgtcacaatcagctatggcggaaaatcttaaactgggttttctggtgaaacagccggaagagccatggtttcagactgagtggaaatttgctgataaagcaggaaaagatttaggctttgacgttattaaaattgcggttccggatggggagaaaaccctgaatgccattgatagcctggcggccagcggcgcgaagggctttgtcatctgtacccccgatcccaagctcgggtcggcgattgtcgccaaagcgcgtggctatgacatgaaggtgattaccgtcgatgaccagttcgtcaatgcgaagggcaaaccgatggagagcgtaccgctggtgatgatggcggcgagcgaaattggcgcccgtcaggggcaggaactctataaagagatgcaaaagcgcggctgggatgtcaaagacaccgccgtaatggcgatcaccgccgatgagctggataccgcgcgccgtcgcaccaccggctccatcgatgccctgaaggcggccggtttcccggacgcgcaaatctaccgcgtgccgacaaaatccaacgatatcccgggagcgttcgacgccggtaactcgatgctggtccagcatccgcaggttaaacactggctgatcgtcgggatgaacgacaacaccgtcctcggcggcgtgcgcgcgaccgaaggtcagggctttaaagctcccgatgtgattggcatcggcatcaacggcgtggatgccgtcaacgaactgtcgaaggcgcagccgaccggcttctatggttctctgctgccaagcccggatatccacggctacaaaaccagcgaaatgctctacaactgggtcaccaagggcgtcgagccgccgaagttcacggcggtgaccgatgtggtgctgattacccgcgataacttcaaagaagagctggcgaaaaaagggctgtaacagcctgattaaactggcccccgccgcggcgcgggggctgagtgcagaagagcggagtcgttatgcaacagtctaccccttatctctcatttcgcggcatcaccatgacgttccctggcgtaaaggccttgtccgatatcagttttgactgctacccgggacagatccacgcgctgatgggcgaaaatggcgcaggcaaatcgacgctgttgaaaattctcagcggcaactatatcccgaccgcgggccatctgcagatcggcggccagcagatggcattcgccaataccatggaggcgctgaatgccggcgtggcaatcatctaccaggagctgcatctgatcccggagatgaccgtcgccgaaaatatctatctcggtcagctgccgcacagaggcggcatcgtcaatcgctcgctgctcaactatgaggcccgcctgcagctggagcatctgggtctggatatcgacccggagacgccgctgaaatatctctccattggtcaatggcagatggtggagattgccaaagcgctggcgcgtaacgccaagattatcgcgttcgatgagccgaccagctcgctctccgccagagagatcgacaacctgtttcgcgtcatccgcgagttgcgggaggagggaagggtcatcatctatgtttcacaccggatggaagagatttttgccctcagcgatgccatcaccgtctttaaagatggccgctacgtttgcacctttgacgatatgccgagcgtcagccacgacgccctggtccaggcaatggtaggccgcaatctgggcgatatttatggctggaagcctcgcccctatggcgaggagcggctgcgcctggaagaggtcaaagcgccgggcgtgcgcacgccggttagtctctcggtgcgcagcggtgaaattgtcggtttgttcggactggtgggtgccgggcgcagcgaactaatgaaaggcctgtttggcggcacgcagataaccggcggtcaggtgtatatcgatggccagcccgtctccattcgcaaaccggcccaggccatccaggccgggatgatgctgtgcccggaggatcgtaaagcggaggggattattccggtgcattccgtgcgcgataacatcaatatcagcgcccggcgcaagcatattcacgctggctgcctgatcaacaacgcctgggaggcggacaacgccgatcaacatatccagtcgctgaatattaaaacgccgggcccggaacagctgattatgaacctgtcgggcggcaaccagcagaaagcgatccttggccgctggctgtcggaagagatgaaggtgatcctgcttgatgagccaacccgcggcatcgacgtcggcgccaaacatgaaatttacaatgtgatctatggcctcgccgcctccggtgtcgccgtggtgtttgcctccagcgacctgccggaagtgctgggcgtcgctgaccgcatcgtggtgatgcgcgaaggacaaatcgccggcgaactgctgcatgaagaagccaatgaacagcaggcgttaagccttgcgatgccaacagtgagccaggctgtcgcctgagtaaggagtaaatgatgtcatcagtgactacgtccggggctacccgctcaacctttagctttgcccgcatctgggatcagtttggcatgctggtggtgtttgcggtgctgtttatcggctgtgtgatttttgtgcccaactttgcttcattcgtcaatatgaaagggctggggctggcgatctcgatgtccgggatggtggcctgcggcatgctgttttgcctggcctccggcgattttgacctgtcggtggcgtcggttatcgcctgcgccggggtcaccaccgcggtggtgattaatctcagcgaaagcctgtggctggggatcgccgcaggcctgttgctgggggcgcttagtggcctggttaacggctttgtcattgcgcgccttaagatcaacgcgctgatcaccacgctggccaccatgcagattgtccgcggcctggcctatattatctccgacggcaaagcggtggggatcgaagatgaacgtttcttcaccctcggctacgccaactggtttggtttgccggcgccgatctggctgaccgtcgcctgcctggtggttttcggattattactaaacaaaaccacctttggccgtaatacgctggctattggcggcaatgaagaggcggcgcgcctggccggcgtcccggtggtgcgcaccaagattattatctttgtgctctccggtctggtatcggccgcagcggggatcattctggcgtcgcgcatgaccagcggccagccgatgacctcgattggctatgagctgattgttatttcggcctgcgtgctgggcggggtgtcgctgaagggcgggatcggcaagatctcctacgtggtggccgggatcctgatcctcggaaccgtggaaaatgcgatgaacctgctgaatatctcgccattctcacaatacgtcgtgcgcggggtgatcctgctggcggcggtgatcttcgaccgctacaaacaaaaagccaaacgtgcggcctgaattttaacccaactttttagtttacagagtaattgccgccagcgcccgtttcgctggcggtaactatcaaaaatggcgaggttggtcacactgtctatacttacatggctcacatataattaacaaccagcttcggctggccatgataaggaggaaacagggtggataaccagatatctgtaccgcctgcgctaaccggaaactacgcttttttctttgacctcgacggtactcttgccgatatccagccgcaccccgatcaggtggtgatacccgacagcacgctgcaggcgctcaatgcgctggcccagcagcaggggggcgcggtggcattgatttcagggcgctcaatggctgaacttgacgcgctaacccatccctggcggctaccgctggccggcgttcacggggccgagcgccgggatatcaatggtaaaacctacatcgtctctctgccgacagcgctgcgcgatgagatcgcggctgagctgacgtcggcgctggaagcgctcccgggatgtgagctggagagtaaagagatggctttcgcgctccactatcgccaggccccgcagcagcagagcgccgtgctggagctggcgcagcggattgttcagcgctatccgctgctggcgttacagcttggcaagtgcgtggtggagattaaaccccgcggcgtcaacaaaggggaggcgattaccgcgttcatgcaggaggcgccattcgccggccgcgaaccggtatttgtcggcgatgatttgaccgacgaggcgggattcagcgtcgttaatcaactgcagggaatgtcggtaaaagttggcgccggggaaactcaggcgcattggcggttggcggatgccgccgctgtaaggacgtggttgcaacatctggcgtatgacgcgcaaaccgaaaggagggatgaccatgagtcgtttagtcgtagtctctaaccgtatcgccttaccggacgataaaaaatcgagcgctggcggtctggccgtcggcatcctgggggcactgagagcggcggggggtctgtggtttggctggagcggcgagattggcgatgaccagcagccgctcaagcaggtctcccgcgggaatatttcatgggcgtcgttcaaccttaatgaacgggaccatgatgaatactacaaccagttctctaacgccgtgctgtggccggctttccactatcgccttgatctggtcagctttcagcgcgaagcctgggagggatatctgcgggttaacgccatgctggcggacaagcttctgccgctgattgagccagacgatacgctgtggatccatgattaccatcttctgcccttcgccagcgagctgcgcaagcgcggggtgaacaatcgcatcgggtttttcttacatattccgttcccgacgccggagatttttaacgctctgccgccgcacgctgagctgctggagcaactgtgcgattacgatctgctgggcttccagaccgaaagcgacagaaccgcttttctcgacagcattgctatgcagactcgcctatccgacctcggcgataaacgctatcaggcatggggtaaggcgttcagtaccgaggtttatccgatagggatcgatccggacgaaattacgcgcaacgctaaaggtccgctgccgccgaagctagcccagctgaagaacgagctgaaaaatgtgaagaatatcttctccgtggagcgtcttgactattcgaaagggttgccggagcgattcctcgcctacgagacgctgctcgagaagtaccctcagcaccacggcaaaatccgttatacccagatcgcgccgacctcccgcggcgatgtgcaggcctatcaggatatccgccaccagttggaaaccgcagccggacgcatcaacggacagtttggtcagcttggctggacaccgctctactatctgaaccagcattttgatcgtaagctgctgatgaaggtcttccgctactctgacgtcgggctggtgacgccgctacgcgatggtatgaaccttgtggcgaaggagtacgtcgcggcgcaggatccggataaccctggcgtactggtcctgtcgcagtttgccggggcggcgcaggagctgaccagcgccctgatcgtcaatccttacgatcgcgacgaggttgccgccgcgctggatcgcgcgctcagcatgccgctggcggaacgtatcgcccgtcattcagcgatgctggacgtgatcagagaaaatgatattcataactggcaggcgcgctttgtcgaggatctgcagcatatttcaccgcgcagcgaggagagccgtctgcgggggaagatagccaccttccctaaactggcctagttcaggaaaagggctaaccggcgttagcccttttcaagggaaaccaacaggacatcaacgccgcagctgccgacgatacttttcgccgagcaggtggcgcgtgaaaagagggaatggttgtgattgccgcagatcaccagatcaacacggtgcgagcggcagaagtccttaatatgatggcctagctcgccgcaggcgatggtcattctttctattgggtagtccgcgtggcgagcaagttcattgagaaactcccgcgtctcttcctgcatcacttcgcgcagattttccatcatcggtgcggcgaactggttatacagctccggatccgtagcgagagtgattaagctcactttcgcgttaacggggcgggctatcgacaccgcttttttaattaacacctgactctccggcgttggcgcgacggcaaccagcagatgggtataaggcatctggcctccttgagatacgcggaataaccctttcttccattctttactcctgtttccccgactgcgcaagggccgatcccgggatttgcgagcctgttcgttagtcggcgaccttccaaccagatcacatcaatgaacctgtcttttgattaaaaagaaatgctgttttataaatgagtgaagtggcgacgtcatctctttgtcattttgccaccggcgactgttccgtggcaaaagtacaaaggtaacctcctttcacagcttttagtgtagccaggtacccactcccttccggtggcaaatccggaacgattgtcggcgttcttttaaaaaaaagacacaggatcacggcgatgaaaacacgaaaaattggactggctaactatctggcctacggcgcgggcgattttctcggcgccggcacgacggcgctaaccgccgcatggctgctctacttttacacgaccttttgcggactgaccccgattgaggccacgcttatttttgctgccgcccgcgtgctggacgcggtggtaagcccgctgatgggctttctcaccgataactttggcaccacctggcttggtaagcgcttcggccgcagaaaatcctttattctgctcggcatcccctgcgtattcagctattcagcgatgtgggtcggcgagatgggcttctggtactacctggcgacctatctgctgtttgatatggtctataccatgattctggtgccctatgagacgctggtgccggagatgaccgatgactttaaacagaaaaccaaattctccggcgcgcgcatttcgatggcgcagatgtcggcgattttagcctccttcctgccggggatccttctctcctggctcggcaaagataatgccagctcgttcttctatgccagtctggtgttctcggtgctgtgcgcggtgatgctgactctggtctggtgtttcacctgggaacgaccgcgggaggcgtggtcggaagcggccctgcgggcggaagcggaaaaacaaaacttaacccttgctcagagcctcaatcgcctggtgattgagctgagttctacgctgcggataaaaattttccgccagcacctcggcatgtatctggggggctatatcgcccaggacgtcttcaatgccgtgtttacctattacgtggtctttgttctgatgcaggaagccgccgtcgcctcgaacctgctggggacgatggccatcttccagtttattgcagtaatcgccatgatcccgctgtgcattcgttttggccccgcgccgtcgtaccgcatggtggtggtcctgtttggcctgagctcactctcctacgcgctgctctattacgccggactgagcgacgtctattccttattgctgctcatctctgctgtcgccggactgggacgcggcgggataaattacgtaccgtggaatacctacacctatattgccgacgtcgacgaagcgatcaccggccagcgccgggaggggatttttgccggcatcatgactctgacccgcaaagcctcgcaggcgggggcggtgatgctggtggggatcattatgcagttgtcggggtttgtttccgggcaaaaaatacagcctgaaggggtcagccataccattctgctgatcctcagcgtcggcactctggtggtgttagcctgcggcttcctcgtctcgctgcgcttcaagctcaacctgcacacccacagcgtcctgcgcagcgagaccctcagaatgcgcgagctcggctacgctcagtcggaacagaccagtgcggaacaccgcgcggtggtcgagctgctggcggggatgccttacgactgtctgtggggcaataacaatattggctatctgaatcgtcataaacctgctgccccggcgctcattaagggcggcgctttgaattcgacatatacccgaggttaacaacatgaaagtttggccggtcaaacatagcccattattgcgtcagcctgagcgttttatcgcccgtagcgaactgcaggcgctgatccgcaacgtgacgcaaaacctggtgaatattaaggatgagagcgggcaatttttactacgcctggatgacgggcgcgtgattgataccaaaggctgggccggctgggagtggacccacggcgttgggctgtacggcatctatcagtattaccagcaaaccggcgatatcgagatgcgtgatatcatcgatcgctggtttgccgaccgcttcgccgagggagcaacgaccaaaaacgtcaatactatggccccgtttctgaccctggcttaccgctttgaagagaccggccgtatggcgtatctgccgtggctggagagctgggcggagtgggcgatgcacgagatgccgcgcaccgagcagggcggtatgcagcacatgactctggcggaggagaaccatcagcaaatgtgggatgacacgctgatgatgaccgtgttgccgttagccaaaattggcaagctgcttaaccgcccccagtatgtggaggaggcaacctaccagttcctgctccatgtgcagaacctgatggaccgggagaccgggctgtggtttcacggctggaactatgaggggcggcataactttgcccgggcgcgttgggcgcggggcaacagctggctcaccatggtgatcccggattttctggaactggtggatctccccgaggggaatgcggtacggcgctatctgattacagtcctcgacgcacagattgccgccttagcagaatgccaggacgacagcggcctgtggcataccttgctggacgacccgcactcttatcttgaggcctcggcgaccgccggctttgcctacgggattctcaaagcggtgcgcaagcgttacgtcgggcagcactacgccggggtggctgaaaaagcgattcgcgggattgtgcagaatatttcgccgcagggggagctgctgcagacctcatttggcaccgggatggggtcagatctcgacttttatcgccagatcccgcttacctcgatgccctacggtcaggcgatggcgatcctttgtctgacggagtatctacgcaagtacttctgagcagggcgccccgctggcgaggcgccgaataaaactaacccggctttcgccgggttgcttgttacatacgctcgacggtttcgataccgagggtatcgagacccagcttgagggttttcgccgtgagcagcgccagcttcagacggctgttgcgggtctcttcgctttccgcgctgaggatcgggcagtgctcgtagaagccggagaacaggcccgccagatcgtagaggtaggcgcacatcacgtgcggcgtcccttcgcgagcgaccacggagagggtctcttcaaactgcagcaggcgcgcggccagctgagcttcgcgatcttcggcgatgaccaccggcgcgtcgatcatcgcgttttcgtcgatgccggctttgcggaacacggagagcacgcgggtataggcatactgcatatacggcgcggtgttgccttcgaacgccagcatattatcccagtcgaagacgtagtcggtggtgcggtttttcgacaggtcggcatatttaaccgcgccgatacccaccactttcgccagattttccagctcgtcagccgacatatccgggttcttctcggccaccaggcgacgggcgcgctccagcgcttcgtccagcagatccgccagcttcacggtaccgccggcgcgggttttaaacggcttgccgtctttccccagcatcataccgaacatatggtgctccagcggcacggagtccggcacgtagcctgccttgcgcacgatggtccacgcctgcatcaggtgctggtgctgacgagagtcgatgtagtagagcacgcggtcggcgtgcagcgtttcatagcgatacttcgcacaggcgatatcggtggtggtatagaggtagccgccatcctttttctggatgatgacgcccatcggttcgccctccttgtttttgtactcatcaaggaagaccacggtagcgccttcgctctcaaccgccagccctttggctttcagatcggcgacgatccccggcagcatcgggttgtacaggctctcacccatcacgtcatcgcgggtcagggtgacgttcaggcgatcgtaggtgatctggttctgcgacatggtgatgtcgaccagcttacgccacatctgcaggaagtactcatcaccgccctgcagcttaaccacgtagctgcgcgcgcgctcggcgaaggcttcgtcttcgtcatagtgctttttcgcttcgcgatagaaaccttcgaggtcggccagggccatctcgccggcgttttcctgctgctgtttttccagatacgcgatcagcatcccgaactgggtgccccagtcgccgacgtggttggcgcggatcaccttatgacccaggaactccagggtacggactgaagcatcgccaatgatggtcgaacgcagatggccgacgtgcatctctttcgctacgttgggtgccgagtagtcgacgacgatagtctgcgcctgcggtttcgtgacgcccaggcgctcagattgcagcgcgcggttgacgttgtccgccagaaacgcggggtcgaggaaaatattgataaagcccggcccggcgatttcaaccttgttggcaatgccgttgaggtcaagatgagacagtacctgctctgcaagttgtcgcggcgccatacccagctttttggcgacagccatcacgccgttggcctgatagtcgccgaactgaacgtttgctgactggcggacctggggttcgcaatcggcaggggcgcctgccgcgatcagggcctggctgactttttctgagagaagagcctgaatattcaccggaataccttacgtgtaatgcgcctgcccccgagggaggcggcgccataatgtggacaaattagggcgggagtatactgcatttgtccccgtccgtcagcattgcgcgcggcgcgccggcgtgcgcaatccatcgccggtcagttgcccatcagcggggcggcggttggtccgcaggccgaaacacggtaaattaccttttcattactgacgagcattattgacgagcaaacccatggcaaactggcagcaaaatgaacaactggccgatattacggcggatctcccgcgattttccgatgcgcttgagcgcttcactgcgcgactgggactggagatcgccgggctcgacgccgaccatatctccctacgctgtcatcagaataccactgcggaacgctggcgccgcggtctggagcagtgcggcaccctgctgtcggagaatatgatcaacggccggcccatttgcttgttcaaactggcggagccggtctgcgtggcgcactggcgcttccatatcgttgagctgccgtggccgggtgaaaagcgttatccccatgaaggctgggagcatatcgaaatcgtcctgcccggcgatccggcaaccttaaatgcccgcgctctggcgctgctggccgatgacggactcagccagccggggatcgtggtcaaaaccagctcgccgaaaggggagcatgagcgcctgccgaatcctaccctggcggtgaccgacggcagcgtgacggtcaaatttcatccgtggtctattgaacaaatcgtcgccagcgagcaagccgatacgtaacagtgtgaagccgcgcggcgtctgccgcgtgaaattgtgacatgctgcaaaggttgtctggatcagggagagaggaatggcggtactggaagtgtgttgctacagcgtggcgtgcgcccgggaggctgagcgctacggcgccgatcgtattgagctctgcgccgcgccgcaggaagggggattaaccccctcttatggggtgctggtctcggcccgcgaggcgattactctcccggtgcatccgatcgttcgcccgcgcggcggcgatttctgctacaccgaggaagagttcgccgcgatgcttaacgatattcgcatggtgcgggatctgggctttcccgggctggtgaccggcgtgctggatgctgatggccaggtcgatatcccgcggatgaaaaaaataatggccgcggcggggccgctggcggtgacctttcatcgcgcgttcgatctgtgcgctgacccgcgtcaggcctggaaaacgctgggtgagctgggggtcaaacgtatcctgacttccggtcagcaatcctcggcggagaaaggtatttcattaattacggaacttattgccgcaggggatactccaatcattatggccggtgcgggagtccgcgccgcgaacctgccgctgtttctgcaggcgggggtgaaagaggtccatagctctgctggccactggttgccgtcggaaatgcgctttcgtcatccgggcgtttcgatgtcagccgatcccgatgccgatgaatacagacgctacgccgtgaatggcgcagcggtggcggagatgaaaaggattatctccgcctggagaagttaaacggttttttgctgcacatcatgtcgcccaatatgatgattgcccgtaccaggcccctgcccattaaacaggggcctttttttatctcgcttttttcgccagcgactgctgggtttccggtttggtggcaatgatcacagcccgtaatggcgccggatatccttccaccgttttgcgctgatcctgtgggtcgaggaaatcggccagcgattcggtcgtcatccattcggtgcgtcgctgctcctctgtcgaggtgacgcaggcgtcgacgatgcgcacgtcaataaacccgcacttctccagccacattttcagggccgccgccgaggggataaaatagacgttgcgcatttgcgcatagcggtcgcccggaaccagcaccgtattttcatctccttcaaccaccagcgtctccagcaccagctcgccccctggcgccagctgatctttcagctgccacagatggtccagcggcgagcggcggtggtagagcacgcccatcgagaacacggtgtcgaaggcctccagcgccggcagctgctcgatgcccagcggcagcaaatgcgcccgctggtcgttaccgagcagcttacgcaccgcttcaaactggcacaggaacagctgggtgggatcgataccgaccgccagatgtgcgccggcgccgatcatccgccacatgtgatagccgctgccgcagcccacgtcgaggatagtccggccagtgagatcggacaggtgcggcagaacgcgctcccatttccagtcggatcgccattcggtatcgatattgatgccgtacagcgaataagggcctttgcgccacggcatcaggtttttaagcagattttcgatccgccgctgatggccttcgctgagcggcgtttcgctctcggcggtgacgctgtgcagaagatccagacgccagggcgttaactccggcagaaattctacggcgcgctcccattcacgaaacttgccgtgcagggcatcgcgctgccaggcggctacctgggcaggcagcgtctccagccagtgagacagcgggcttttggcgatcagctgatagaagttactgaagtcgatcatgcctgctccccggctttaacagccaccagcgagccaaagttaaagcactggaaccacagttcggcatgttcaaacccagcctgacgcaggcgggctttatgggtttcgacagagtccgtcagcatcacattttccagcatgctgcgtttctggctgatctccagttcgctgtagccgttggcgcgcttaaagtcatgatgcatattgaacaacagttcgccaacgtgggcgtcttcgaagctgaatttttccgagagcaccagcgcgccgccccgattcagcccctgatagactttattgaggatcgcctggcgatcgcccggctcaaggaactgaatagtaaagttcaggatcaccagcgaggcgttttcaatggtcacgtcgcggatatccccttcaatcacttcgaccggcgtcggcgctttataagcgtcaatatggcgacggcagcgctccaccatcgcgggagagttatcgatggcgataatgcgacagcccggatggctaatattgcggcgcacggagagggtggcggcgcccagcgaacagccaagatcgtaaacctgagtgttgggctgaacgaagcgctcggccagcatgccgatcatcgagatgatattggagtagccgggcacagaacgctggatcatatcggggaagacttcagcaacccgttcatcaaaggtccagtcgccgaggctggcaatcggcgcggaaaaaagcgtatcgcggtgagacataacgttaaacccgaaaaaacgaaaacggcgtattgtgcgctaacggagggagaaaaccaactcccagggcatataccaaagattggccagcaccattagcaacaacgcgcaccaagtggcgctcatgccggagcggcgccagtagtagacgcggtgatgaaagccccaggagtgcatcagtcgcccgacaatcaataaaatcccgcaaacgtgcaccatccaggtctgagcgccgttcatctccataaataacagcaaaatgaggccaatcggcacatattcgacggcattgccgtgaacgcggatggcaacctgcagctcgctaaagccgccgtcaccgtagcctacatggtattgggtgcgcagacgcaccacgtcaaatgagaacttcactaacaataacgcacctaaaacggcatacagcgcgctgaccatacgaaaactccctttaactctggcagatggctccggatatgatagcaggatatcagaaaagagaagattgctgcggaatcgacggcgcatttcctgccgccggcagggcagcgcgcaggtcaccccacagggtatccaccagcgccggggcgaaggcaatgtccggagtatgcaggaacaaccacggggtccccgactgatgccacttcgccagggtctgcagccagacgcgaaacagttcccggttatgggccatatcgtcaccgccgataaagcgcaccattggctgtcgggcggtcatcaccgcatgtaccggcaccttcggtttcttttgttgggcatcgatcatcgccggactggtggccgcagcgctatggaccgggcggctgtcgagaattacacctttcttatgatacacttcttcaatctcttcataactcatcataaacaccatgccaaaagcaatctcatacatacgattttctactaagattcaatcagttggtgattctactaagcgtcaaagcaagtacattaacgactggttaaaaaggaatcctgattactatttagacgaatcactacgctttcaggatttgggtataagcggcttctctggcgctaatgctaagtcaggggctttcagtgaatttctagccgctgtggaatctggctacattgaagcgggttcagttcttcttgtcgaatctctggacagggtaagccgtcaggacatcgacacagcaggtgagcagcttagaaaaattctcaggtctggcgttgaagtggtgacacttgtcgataacgagtggtacacgaaagaaagtctcaaagattcactcagcatgattaaagcaatgctggtgatggaaagagcacacgaagaatcagcgatgaaatcaacccgtttaaggtctgtatgggctgctaagagggaaagggctgctaaaggtgaaatcatgtctaagcgttgtgcagcatggttaaaggtctctgaagaccgttcacactttgaattcatccctgagaatgtgaaagctgttcaacgtgtctttcagctacggttagagggcttgtctcacgtcaagatagccaaacaaatgaatgatgaggggttttccactctgaaccagttcaaatccgttacaggtggctggtctcaatcgtcggtcactgagttactttcaaaccgttcagtgattggtttcaaagttccttctaaatcaatggctgtaaagggggtctcagagattcctaactattacccgtcaataattaccgatgagcaattctacgctgtacagcagcttaagcagggttcagggcgtaaaccttcctctgacctacctttgctaacaaatctcttcaagggcgttcttaggtgctctgagtgtgggtttattgtcgttgttgcgggtgtctctgctaagaggtctggtatatacaaatgctcgatgaagagtgaagggcgctgtaatagtgttgggttcagcagattacagactgaccgcgcattggttcaggggctgctttacaacactaaccgccttaccctgaatagttataaagcctctgctataggctctcttcaaagtgagttagaacagcttcagaaacagcgtgagaggctcattaagctggctatgctggcagatgataccgaatcaatggctaaggatttgaaagccctgaatagtcaaattaaggacgctgaaaaggctgtctcagaggttcaccaacgagagcaatcaagccagcttgagacaatcagccatttggatttgactgtgaagaaagacagggtggaggctcaaatcatcatcaaacggatagtgaaagagattcgactaaacacggctcaaaagaagtgtgatgtcttcttacacaacggcttgaaattgttaaatttcccactggatagagttgttgatggggaaattttcttagaagtcttacccctgttagaagctgatgagttcgactttgacacttacaggattattgagtaagccctctaaagggggtaacttattgctcaaacaaaaatattctcaggggtagttatgtctaacaaaaaacatagcgtgttcaaagctcttacaatgggctttgaaaaggttcttgatgagcgtggttacgataatggtgcttattacgtcaaggatggaaagatttggatttttgatattgtagctttaaagcaaaaattaggtgtctcttcaaatgaagaattagaagcacaagattatgatgttgagacatatctttcactggaaaaagaaccgaatgaattagcagcactatatgaagatatggctgttgaagatggtgaaccagtttatcttgaaggtggaatgtatctttaccctgatggctcaattcgttgattagtcccttttaaagggatgcctcaattggtacgagttcggtgaatgaataggggcgaaacagccccttatgaaggtttaatagttatccctcaccacttcatcatacctttcaataaacgttaactgtttattgctgtcacgataagtatcaagccatttatcaatagcttcatcaaataaaaataaaaaatctgtaaagttcaaataaacaatgtcagcgtgacactgagttgggtggcctcgtttgcaaacagcaatactaaggcggcgctctttgccttgtgtcaccttatgtgaattcaggttagtcatgtgtaagagtgagtttcttaactcatataattcatcagatgttatttcaagttttttaatttctgagtaagtatcaagccagttttggaaaacccttttggaattaccatattcaatgtaagcaatggtgtcaatgaaggacattaacagcttgaaactagacaggtaatgtttttcattaaaaagcattctgatgggcttcatatggtcgtcattgagtaatttcttaatatgaaaaccatcttctttcatgtaatcatcaaggtaatcagggaagcttttaacaccttctatgtggtgatggggcatgtgcttatgccttagttgttcagacaatgatagttggatgtgataatgaagtttaccttctaccactggcgtaacaatagataaagggtgaaggggggcattcatagcctgtagagctaattcaaaaggggctaaattgtttcctaccctcatattcgaattatatcttgccagagttagttgtttgtcaccatcaagcaccgaagggtgaatgtcatgaaatgacctacaggaggctaaatcaatgtctaactgttttcttaaaaattccagcttttgattatcgtcaccttcaaaatcatgagcaacgattccgcaatgcgtgatgtgaactccatcaggacaaaagcagaagatgttataaatggtttctttcatttcctttgaagctccttatgctgagtcatccttatcatcttagtgaaaagttagtttgtgagacagttatttagccgctatggttagccagatttccttttcgattcttgaaatttccataatgaccccttcaatgacttgctaacgctgaagaatagccgtttagatggctaaattaacagtaaaaaacagtctctccaaatggtgttaaaacccctatcaacaccagtgatttcaatagctctagcctattaactgttttagttccgaaaagagataagaatcagtatttatataacctgtttcaatggtttggattgcctcaaaaggagatagttttgatactgctgaaaaaggtctaaaaaggtgtgtttaggctgtctcaaaaggttgaatttgagttttgatacaggtattattttgaaactaggttttgagacaactttcagggaatcaccatcatgtcatctgtaatcgcttacgtccgtgtatcaacttctgaccagacagttaccaaccagaaacagcagattgaagaagctggttatcaagtggctaagtggttcaccgatgaagctgtatcaggtggggttaaggctacagagcgtaaaggtttctctgacctactgcactatgtccgtgaaggtgacacactggttgttatcgggatagacagattaggccgtaacactattgatgttctctcaacggttgaacttcttcaggccaaaggtgtgaaagttatcagcttgcgtgaagggtttgacctctctacaccagttggtaaagcaatgctcactatgatggctggtttagcctctttagagaaagacctaatagcagagcgtagaacagcagggattaaacgtgctcagtccgaaggggttcactgtggcagaccaattaaagcaaccgctgaacaggttcaggaactgattgcacaaggttgttcccctgctcaggtacagaaagagttacagattagtaaggcaactttctatcgactgaacaagtaacaattagatagtgattcacaatgcccctgtattggggcttttttatgtctgtcgtttatcagaatccctgtaacgcattctaagcagtctttattattaacctatggggcagggttgctatcattaaacaatcgcttagaacgctgcacaggctcagatatgttcattttttgccattggtacgaaaccttagaaaaggtcgctaccaagtagagagattcagactatccaaaatcttagaaggtgctttagatatgctggaagtttctggtgaagctgaaataaaaacaggtctgaagattttttagaaaaataatatttgtgaaaattcatccaccagcttcaaagccgctttcacggatccctacatgatttactgtcaagctacaaggtggaaaccagaatcaccgatgagctgaaagcaggtgaggtttagaaaggctttctttaaagaactcttaaaagatactcagagacaagaagatgaaaaacaaagaacaaaaagaatctgttaagaggttttagggtagcataaaaaacaatcaattacaatcggttgatgtaaataaatcatgtgattcagggcgttagccctctttacaatattctgataaattagttttatttctaatcttatctctagtcttatagtgttcccttttggcataccccctgtgccgttttggcataccccttatccctttatgacataccccccatgccgttttggtatacccccctattcattatttcgaaatcacttacaccatcaagaaaaataagtcaaacaaatttattgacaaattgttaatgtgttgttacagtatttatatagcttattgaattgcaagaaggaaatcccaatgagaaaagacatcccacaacaggtaactatccgtgttgaagtgtcccacgccattcaccgtaaaattgttgaaatggcagctaaacagggtgtgagctactcagccctgattaaaaacatgattcgtgaaaatgtagtcacagcttaaatcgaacaatatacggccttgttaagaggcatttctgatattaggaaaatcccatgaatgaaactctatgaaatcccgtttacccccgcttatagtgatgtaacccgaatcacttctttcaacggtgttaagttatctctttcagctaaaatgatttacctgtttatggtaggtcttcaaagaaacggtcaagaagtcttcccctcaatcaattacctgtgtgaattgttcggtattgggcgaaaggttgctttaggggctttaacccaattacatgaatcaggtcttattagttctattcagcgttatgatagctctaaggtatacacagttgaaatcatgcctccagaattgattaaaagccaccagcaagaaaataaacctgaatcagtatctgaatcagaggccgcaatcaccagtgattccgataatgtcttacctttcccgttaatcgaaaggaatgaaaatccagttattgacgctgtagaagagattgaaccagttattatccgtctttctaaaccaaagcctaaaccagaaagtaaactgaattatctgtttgctactgatgcagaggaagacgacgagccatttaaaatgccaatttacgaggaattgtaaaatgaaacactcagtaattcacattgcaccagcgttaatgaaaaagctggaagcgttatcagaattgtacggcctgaaccgtcagcagactttagaaattatcctgaaagaggaattgaataatgtcgaataagaaagaacgctcagttatcaatctttcagctaagactcttgaactgctgaaccagttaagtgaaaagtatgatttgccacgacagcaaacattagcagtattactcaacaagaaaatgaaggaaatgaaccaatgaaaaaccgatttttgaatatgctaaacaatcctgtaccgcatcccgatttaacagacgcaatttttaattcggtatctgaaccagagttatgcttaacagtcctgaaaactcttccagagattaaccaaatcactattgctacattcttcagcggtcaagggctatcactgatgggtgctgcactaatctatgaaatggtactcaaggcacacgatgcaatgacagatttaatctggaatgaatatgaggttaaaaatatgaatggctaactatactgtagatgaatttatcatccaattgggctttaacgaaaacgtttcaaagaatcttcaaaaactcgaaagcagaacattaaaagtcgctgaacgaatcgaaaagaatctcaaccgttcattcacaccaaagggtgattttggaagagtaatttcttcagcaaataacgcatcaaaacaaattaaccgtgcattctcaaagagtatggattttgatgaagctggtaaatcatcggtgaaatctgtagagaacgctgctaaggcttctgcaaagcgcattaaagatatgtatcaggacgcctatggagctaaaggaaaaggccgctcaaatccaccagccggaaagccacaaggcagaggctcagatttaacagcttctaattcaatccgttcacttgctaacactcagttctattcgaatctgaccagacgtcttgagggtatgggttcaactggacaagcaagggcgatgaaattgcgtcagcagattcacggattgagagatgatgctttagccaatccttcagccagcctgaaccagttccgtttagctctccgtgcagccactgacagcgcgtctaaatgggcttctcagaaccgtaagcaggtatctaatgcagaagggttatcaagctccttcgggcgtctggtaagcgtttcagcagcgttatatgggacatttgaagccgtccgtaaggtggttgaaacaggtgtggcccgtgaaggtgtgaatctctccgctgaagctgttttcaaggggcaatcgaaaaatgctaagacattcgcggctcagttctctgaccaaatcggacagggtgtcactgagaccttgaaacagtacactggctttgctgctggtgctcagaactcgttaggctatcagggtacacaggacttctataagaatgctgctgtattcggtcgcatcagggggcttgatgctgaacagcttaaaggcatcatgatagcattcacacagatggcatcaaaagggcgcgtacaggctgaagaactcagaggccagttgggagaccgtttaccgggtgctgaacagatgttcgcagatgctttgggtgtgaacactcagcagcttgataagctcatgagtaacggtaagttactgtctaaagatgttcttccccgtgtatctgctcagatgaagaaaatggctgatgaagcagggggattagagaccgtttctaatatggctgtaacaggtatcggacgtgttaaagcagcgatggaaaacgatttaaacaaggctttcacaagctctgaaaagggtttaggccagtttaacgcttctgtagctaacatgcttaacgatgcttcaccaatcgcagaggctttgggtcacatcctcggaaaagttgcctctatgacctctggggcggttgaccacgtggacgaatggagccgtaaactctcagcgttaatcctcagaacttcagcgtggtacgatgacttatcagacggtcaaaagaaactggttgattctgctgaacagttcgctattggggctgctggtgtattggtgctggttaagtctatcgctggagtagccaataagctgaaatggttaagtgctctgttaggtggtggtgctgaagctggtgcggctgctggtgcaggtgggatgctgaaaggtgcttcccgtttagctggccctgtaggagttgctttagtcgctcatgatgctgtagacgcttcaggagttgaacagaagtacccaaccgctttaggtgtcgataaccctattgcaaaggctcttaactggctttcaagcccttctaaggtgttaggtgctcaggatggtgattcaatcactaacagcccgttcacacgtgctatgggttcatttggtgattggcttcagggtaacaatgcactgaacggtcagactaatacatttgctgtaccatcaatgtataaccctgctcagacaactatcaagaatgaccagcgcattaatattagtgtgaacatggatagccagaaaattggaacattccagacacaggttttaactggtggctttgaagacctgaatattaatgctgaacatttgggcgattaatgtctgtttgagttttacagattagagttatcatgtgataattgttttatctggttttgcttaaatctcaaaatactggtgcaggtcgttcaagaggttttgagaaagcaatgtaaaagggctgctcttatgagtggccttttttatttgcattgagaaaggttcgattatgaatgagaagatattacaaagtaacagggagaacctgtcacactatccatactgagttacggaagattggtgatttgattagtccaattcctaacaaggaatatcacatccccaaactgatgaccaaagcaagacgcttattactcattaaatcaatctgtgaaaagattaaaaataaacgttgacaatttgttaatatatgacagaatggttatatgagttaggaatatttcaccgtccatcaaatcaccgacttatttctgactcaaacaatttccttcttatctgtctttttaaggcatccatttcaagttccccttgagaagacagataaaccctaattagaaaacattgaacctcgtcccgtaacattgagttggctggatggggttttgtgctttctgaaatctaagcaaaccagactaagagtaaattaataatgactactttacatcaagctgtaaaaattgaatcaccagttgcttcaatcagtcacctgttaccgttcgaacagaaacagcatatcgaaaaattgtacttcccacggattcaacaggcaactgaccgaatgaataaggctgaagctgaatatcaggatgcagtagaatcacgccagcaattgattaatcgcaaagctcaagagttcttagcatccccttcagagcgtcacggatttattgtgaagcaggtttatccaacgaaccaacagcagattattcagtcaatggctgaacaaggctacatggttcatcgtgtaggaatgggattaatctatttcatctcaactaaaaagaatgctctgaaagacgcaactgacaaggcaactgctgaagctgagagttatattgataatatgactgaacgtctgaaggtaaaagcctctgaagctgtccaccagcgtaatgtgattgttacccaagcccgtaaaactctggattcgattaaatcatttgaaagctatttaaacgtgattgtaactgattctgaagaggtgtccgaatgagtattccaatgaaaggactaacaaaacgcgggagctataataatctaactgattcggtcgaatacaaatatttcaacggtcaagcagaaatcagtgaatcaacttataagctacttgcttcaggtaataaacctaaaccaactgtgaaaccagctaaagctgtcaccacgtataaggtgaagcctaagccgccaacagttgaacagcaaagggatgcagctttaaaggctgctattaaacggatggtaagcgggagctgataaaatggaagagacaattaacgcacctattaactattacgactctaacggctgtttggttattggagcaaaccttatcggaaagattcatcctcagttaatggataagttaacccgccgtgctggtgatggctcaaaacgtacacagcaagcccgaattacagaatacttagaaggactcttaaccaatgtctaatacaaccacgattaacacccctgataagccgtgtattcattgcggctcaactgttcgctatatctcatcgggtagttgcgtggactgttcaaagacacgtcagccgcctaagccaaaaccaaaggttgcccgtataacagctacagcagccgttgcaccgttccattcagaaggtggagacaatagcaataacatcattgtgaagctctctaaacccgctttagataaccttgaccgtgtaggatatgagttggttagaaagtatcgtctagccggatattcaccagaacgaatccgaatgattgcactgtcccatctgcttgaagccgcttaatccccgctacaaaatcccatctttagagtgtatcaatagaaaggtctcttcaggatcacgcggttgacgttacgctcgtgcagcccgcggttgagctgctgttccgcttcccctttggcgaaaaactcgggatgacgaacttcgacgccgtaggtgaaatccttcggcagtccgtcgagaaaatgccatagcgcggggagatcgcgaggaccgaacgtcgccggcagctgcagccagtactggccgatgcgcgaggccagcggcgccaggcgggcaaaaaattcgctgcttaactcgtcgcaatggcgcagggcggcctggtgcgagatggtggccgggaatttgaagcagaagcggaagtcatcgtgggtctgttcgtaccagcgggcgacaatctccggctttggtagcgcatacagggtggtgttgccctccacgcagttaaagtggcgggcgtactcttcaaggctggtgatgccaaggcgcacccatttcgggtgcgaccactggggaagcccaatataaatcatagcgccgtgaggatctcctcggtactgcgcacccggccgatgcgcgggaaaatatgcgtcatactgccctgatgctgctcggcggaggcggcgctgcaggcatcttcggcgatgaccaggttaaaacccagctcccaggcattgcgggcggtggattcgacgccgatgttggtggagatgccgcagagaataatggtgtcgatcccgcggcggcgcagctgaagctcaaggtcggtgccatagaacgcgccccactggcgtttggtcacttcgatatcgctctcctgcttacccagcgtggccgggtaggtccaccagttttcgggcagcgtatgcgccccggcctgagcgtcgacaggctgtttcagcgcttcggcgaaatcggccgaccagcccacgcggaccatgatgaccggcgaaccctgttgccggcacttgtctgccaggcgagcggcgcgcgccaccacctcgtcagcccgatgcgggccgccggcgaaaggcagaatgccttcctgcagatcgattaccaccagcgccgtgttttttgcattgagttctaacatggtatccccgtatcttcatctgttgtcaggcggctacaatacctttgcggcttcagcaaaagagtaacaaattttgttaatttatgtgagtgtggacgttaagcgcgcagcaaagcagcgtacatcgtgcgtcggacttatcgaacgacagaatttccagtataatagccgccttttttcattcagttgtgacatcagctaaagctgcgacctcgtcgcctgcagggcagacgacaatccgccgacggctaagttaagggatatctcatgcgtacagaatattgcggacagcttcgacagtcccacgttgggcagcaggtgactctgtgtggttgggtcaaccgccgtcgcgatctcggtagcctcatttttatcgatatgcgcgaccgcgaaggcatcgttcaggtgtttttcgatccggatcgtgcggatgcgttgaagttagcctctgaactgcgtaatgagttctgcattcaggtcactggcaccgttcgcgcgcgtgaagagaaaaacatcaacgcggacatggccaccggcgctatcgaagtgctggcttccgatctgacgatcattaaccgctcagaatcgctgccgctggactccaatcacgtcaacaccgaagaagcgcgtctgaaataccgctacctcgacctgcgtcgtccggagatggcgcagcgcctgaaaacccgcgcgaaaattaccagctttgtgcgccgctttatggacgaccatggcttcctcgacatcgaaaccccgatgctgactaaagccaccccggaaggcgcccgcgattacctcgtgccttcccgcgtgcacaaaggcaaattctacgcgctgccgcagtcgccgcagctgttcaaacagctgctgatgatgtccggcttcgatcgctactatcagatcgtcaaatgcttccgcgatgaagacctgcgtgccgaccgtcagcctgaattcacccagatcgacgtggaaacctcctttatgaccgcgccgcaggtgcgtgagatcatggaggcgatggtgcgtcagctgtggctggaagtgaaaggcgtcgacctgggcgagttcccgatcatgaccttcgccgaagccgaacgtcgctatggctccgataaaccggatctgcgtaacccgatggagctggtggacgtcgccgacctgctgaagtctgtggaattcgcggtctttgccggcccggccaacgatccgaaagggcgcgtggcggccctgcgcgtcccgggcggggcctctctgacccgcaagctgattgacgaatacggcaactttgtgaagatctacggcgcgaaagggctggcctatattaaagtgaccgagcgtgccaaaggcatggacgggatcaacagcccggtggccaaattcctgaccgctgaaatcgtggaagcgatccttgaccgcaccggcgcgcaggatggagacatgatcttcttcggcgccgacaacaagaaagtagtggccgacgcgctgggcgcgctgcgtctgaagctgggtaaagacctgagtctgactgacgagagcaaatgggcgccgctgtgggtgatcgacttcccgatgttcgaagacgacggcgaaggcggcctgacggcgatgcaccatccgttcacctcgccgaaagatatgaccgcggatgagctgaaagccgccccggaagaggctgtagccaacgcctacgatatggttattaacggttatgaagtcggcggcggttcggtgcgaatccaccgcggcgagatgcagcagaccgtatttggtattctgggcattaacgaacaggaacagcgtgagaaattcggcttcctgctggatgcgctgaagtacggtacgccgccgcatgcgggtctggccttcggtcttgaccgtctgaccatgctgctgaccggtaccgataacatccgcgacgttatcgctttcccgaaaaccaccgcggccgcctgcctgatgaccgaagcgccaagcttcgccaatccggcggcgctcggtgagctgggtattcaggttgtggagaaagaggcaaaagcgtctctggagaacaagtaatatgtcatttaagctgcccgtttcggtgctggtggtcatttacgccgaagatacgaaacgggtgctgatgttgcagcggcgcgacgatcccgcgttctggcagtcggtcaccggcagcctggaagctggagagaccgcgctgcaggccgccgcgcgtgaagtaaaggaagaggtcgccattgacgttgcctgcgagcaactgaccttaatcgactgtcagcgcacggtggagttcgagatattttctcatttgcgtcatcgctatgcgccgggtgtagagcgcaatacggaattctggttctgtcttgcgctgcctcatgagcgggagattactttcaccgaacatctggcctatcgctgggtcagcgcgacggaagccgctgcgctgaccaagtcgtggagcaaccggcaggcgattgaagaatttgtaattaacgccgcctgaaagggcgcgctttttggagagttttttatggcaggtcatagtaaatgggccaacaccaaacaccgcaaagcggcacaggatgccaaacgcggtaaaatctttacgaaaatcattcgcgagctggtcaccgccgcgcgtctgggcggcggcgatccggcttccaacccgcgtctgcgtgcggccgttgataaagcgctgtctaacaacatgactcgcgacaccctgaaccgcgccatcgcgcgcggcgtcggcggcgatgaagacgcgaacatggaaaccatcatttatgaaggctacggtcctggcggcaccgcggtgatggtggaatgtctgtccgacaaccgtaaccgtaccgttgcggaagtgcgtcacgccttcaccaaaaccgggggtaacctcggcaccgatggttccgtctcctacctgttcagcaagaaaggcgttatctccttcgagaaaggcgatgaagacactatcatggaagcggcgctggaagcaggcgcagaagacgtggtgacctatgacgacggcgccatcgacgtctacaccgcctgggaagagatgggcgctgtgcgcgacgcgctggaagccgccggcctgaaagccgacgctgccgaagtctcaatgattccgtccaccaaagcggatatggatgccgagacggcgccgaagctgctgcgtctgatcgatatgctcgaagactgcgacgacgtgcaggaagtgtaccataacggcgagatctccgacgaggtcgcagccaccctgtgatgcagccgcatccacggttaaccggaggcgcgtgatggctattattctcggcattgacccggggtcgcgcgttaccggttatggcgtgatccgccaggttgggcggcagctgagctacctgggcagcggatgcatccgcaccaaagtggacgatctgccgtcgcggctgaagctgatctacgccggggtgacggagatcatcacccagttccagcccgactatttcgccattgagcaggtctttatggccaagaatgccgactcggcgttaaagctcgggcaggcgcgcggggtggcgatcgtcgcagcgaccaatcaggcgctgccggtgtttgaatacgccgcccgtcaggtcaagcagaccgtggtcgggattggcagcgccgaaaagagccaggtccagcatatggtgcgcaccttgctcaagctgcccgccaatccgcaggcggatgcggcggatgcgctggcgattgccatcacccattgccatgtcagccagaatgccgctcagatcagcgagacccggctcaatctggcgcgggggcgcttacgataatcgcaaatcaggctggatatctatccagcctttttttatgataccgccagatacttagaccataacgcaggagccccacgtgataggcagactcagaggcatcattctcgaaaaacaacccccgctggtgttgctggaaacggcgggcgtcggctatgaagtgcatatgccaatgacctgcttctatgagctgccggaggccgggcaggaggcgatcgtcttcacccactttgtggtgcgtgaagatgcccagctgctgtatggatttaacaacaaacaggaacgtaccctgtttaaagagctgattaaaaccaacggcgtggggcccaagctggcgctggcgatcctctccggcatgtcggcgcagcagttcgtcaacgccgttgaacgggaagaggtcgcctcgctggtgaagctgccggggattggcaaaaaaaccgctgaacgtctgatcgttgagatgaaagatcgcttcaaagggctgcacggcgacctgttcaccccggcggccgatctggtgctgacctcgccggcaggcccaacggcggacgatgccgagcaggaagcggttgccgcgctggtcgcgctgggctataaaccgcaggaggccagccggatggtcagcaagatcgcgcgtccggacgccaacagtgaaacgctaattcgcgaagcgctgcgcgctgcgttgtgaggtaagggatgattgaagcagaccggctggtatcggcagacagcagcggctttgaagaggccgctgaccgcgccatccgcccaaaattgctggcagagtatgtcggccagccgcaggtgcgttcgcagatggagatctttatccaggcggcgaagctgcgcggcgacgccctcgatcacctgctgatttttggcccgccagggttggggaaaaccaccctggccaatatcgtcgccaatgaaatgggggtgaatctgcgtaccacctccggcccggtgctggagaaggcgggcgatctcgccgcgatgctcaccaacctcgaaccgcacgatgttctgtttatcgatgagatccatcgcctctcgccggtggtggaagaggtgctctatccggcaatggaagactaccagctggatattatgattggcgaaggtccggcggcgcgttccatcaagatcgatctgccgccgtttaccctgatcggcgccaccacccgcgccggttcgttgacctcgccgctgcgcgaccgctttggcatcgtgcagcgtctggagttctatcagatccccgatctgcagcatattgtcagccgcagcgcccgccatatggggctggagatgagcgacgagggcgcgctggaagtagcccgccgttcacgcggcacgccgcgtattgccaaccgtctgctgcgccgggtgcgtgacttcgcggaagtgcgccacgacggcaccatctccgccgatattgccgcccaggcgctggatatgcttaacgtcgatgcggaagggttcgactatatggaccgtaagctgctgctggcggtgatagataagttctttggcggcccggtggggctggataacctcgccgccgcgattggcgaagagcgggaaaccattgaagatgtactggagccctacttaattcagcagggctttctgcagcgtacgccgcggggaagaatggcgacggtgcgcgcctggaatcatttcgggattacgccgccggaaatgccgtagcgcgttgcggttgagcagttcatggtgaagcccggtcagcagcgtgaccgggctttttcattttcagctggcggcttttttcgtcatgctgagaataaacagcaccgcggcgcagagcaccaccgacggcccggccggggtatcatagaaagccgagaaggttaacccgccggtaacggccagcatgcccacgcccaccgccacggcggccatctgctccggcgtacgggcaaaacggcgggcggtggcggccgggataatcagcagggaagtaatgatcagcgccccgacgaacttcatcgccacgccgatagtcagggcggtgaccagcatcaacagcagcttgacccgctgcagcttcacgccgtcgacaaacgccaggtccggactgatggtcatcgccagcagattccgccactgccagagcagaatgccaatcacaatcaccacgccaatggcaatggcgatcaggtcctgcggcgtaaccgccagcagatcgccgaacaggtacgccatcagatcgacgcggacgttagacatcagactgaccaccaccagccccagggacagcgcgctgtgcgccatgatgcccagcagggtatcgatcgccagatgcggtcgtttttccagccacaccagcccgccggccagcagcagggtcacgacgatcaccgcatagaacggattgacgttaagcaataaaccgaaagcgacgccgagcagagacgcatgcgccagcgtgtcgccgaaataagacatgcggcgccagaccacaaaggagcccagcggaccagcggcgcaggccagcatcatcccggcaagccagccaggtaacagaagttcaatcattagcggctgtttccccgacgcagtacaattcgcccctgaaggtcgtggcggtgattatggtggtggcggtatatccccagctgttccgcgccgcgcgggccgaacatggagataaactccgggtgcatggagaccacctccggtgcgccagagcagcagatatgctggttcaggcacagaacttcgtcggttttggccatcaccagatgcagatcgtgggataccattagcaccgcgcagtccagttcatggcgcagctggttgataagatcgtagagcgccacctggccgttgacgtcaacaccctgggtcggttcatccagcaccagcagctgcggacggttgagcagggcgcgggccagcagtacgcgctgcgtttcgccgccggagagcttttgcatcggcgcatcgatcagatgccccgcctgcacgcgcttcagcgccggcaggatgtcgtctttacgggtgcccgggcgcaaacgcaggaagcggctaacggtcagcggcagcgtggcgtccagatgcagtttctgcggcacatagccgatgcgcaggcgtgcgtcacgcttgataacaccctctgtcggtgctaccagcccgagaaccacccgcacaagggtcgatttgccggcgccgttggggcccagcagggttaagattttgcctggcgtgagagccagcgagatgtcagacaacacgcggcgttggccaaaggccaccgagacattttccagcgttacaaggtttgtcatagtaatttaggggttgcacaagctagtgaatgttataatatcacatcaaactcacttatttcgatgactagacgcattatgttacataaaaatacgcttctttgcgctggacttggcgctgtttttttgttcgcgcaggtaccgctggccagcgccgccgtggtgacttctatgaaaccgctgggctttatcgcggcggccatcgccgatggggtgaccgagacccaggtgctgctgcccgatggcgcctccgagcatgattattccctccgtccttctgatgtaaaacgcttacagaacgcagacttagtggtgtggattggtccggaaatggaagcctttatggataagtcgacgcaaagcattgcggcgaataaaaaggtgacgattgccgagctggatggggtcaaaccgctgctcatcaccggggcggacgacgatgacgatcaccatggtcatgaccatggcgcagcagaaaaaggtgacggcgatcaccatcacggtatttacaatatgcatctgtggttatccccagagatagcgcggctttcggcggttgcaatccacgataaattattggaacttatgccgcagagtcgagccaaactcgacagcaacctgcagcagttcgagaccgcgctggcggcgaccgacaagcaggtgagcaatgagctggcaccgctgaaagggaagggctatttcgtttttcatgacgcctacggttactttgaaaaacactacggtttgacctcgctggggcactttaccgtcaaccctgaaatacagcccggtgcgcagcgtttacacgaaatcagaacacaactggttgagcagaaagccacttgcgtttttgctgagccacagttcaggccagcggttatcgaagctgttgcccggggcacgtctgtgcgcatggggaccctggatccactggggacaggaattacgctgggtaaaacgagttacccgcaattcctcacccaactggcgaatcagtattcgagctgcctgaaaggagattaacgaggaagtgaatacgtgcaacagatagcccgcgctgtcactcaggcattcaacaatctgccacgacctcatcgcgttatgctggggtcgcttagcgttcttaccttagcggtcgccgtctggcgaccctacatttaccacccggaatccgcccccatcgtcagaaccattgaactggaaaaaagcgagatccgctccctgctgccggaagcctccgagccgatcgaccaggccccgcaggaagaagaagccattcctcaggatgagctcgacgaaaaagccgatagcgatgccggcgggcacgaatacgtggtgtcgaccggcgatacgctcagcagtattctgaaccagtacggtatcgatatgggcgatatcgcccagctttcctccgccgataaagagctgcgcaacctgaagattggccagcagctctcctggaccctgaccgccgacggcgatctgcagagcctgacctgggagatgtcccgccgcgagacccgcacctatacccgtgtggataacggttttaaaatgagcagcgagctgcagaaaggcgattgggtcaacagcgtgctgaagggcaccgtcggcgccagctttgtctccagcgcgcgtgatgccgggctgaccagcacggaaatcaacgcggtgatcaaggccatgcagtggcagatggatttccgtaagctgaagaaaggcgacgaattctcggtattgatgtcgcgcgaaatgctcgacggcaaacgtgagcaaagccagttactcggcgtgcgtcttcgctctgacggtaaggattactatgccatccgcgccgaagacggcaaattctacgaccgcaacgggacgggtctggcgaagggctttatgcgcttcccaacggcgcgtcagttccgcgtctcctctaactttaatccgcgtcgtctgaacccggtcaccggccgcgtcgcgccgcaccgtggcgtcgatttcgcgatgccgcagggaacgccagtgctggcggtaggcgatggtgaagtagtcgtggccaaacgcagcggcgctgccgggtattacgtcgcgatccgccacggtcgcacctataccactcgctacatgcacctgcgtaagctgttagtgaagccggggcagaaagtgaagcgcggggatcgcattgcgctgtcggggaataccggacgctctaccgggccacatctgcactacgaagtgtggatcaaccagcaggcggtcaacccgctgacggctaagctgccgcgtaccgaagggctgagcggttccgaccggaccgactatctggcacaggtcaaagaggtcgttccgcagctgcggtttgactaaccaccggtcagtggaaagccggtgccccagggcgccggctttttcttttgtaggatacccgacgtctcgctacactatcccattatcttgattaagcagtcgatctgcggattgggcatggaaacgaaaaaaaataatattgagtttatccctaagtttgaaaaatcctttttactgccgcgctactggggcgcctggctgggggtctttgccttcgccggtattgcgctgacgccgccatcctttcgcgatccgctcctcggcaaactcggtcgtctggtagggcgtctggcgaaaagctcgcgccgccgggcgcagattaatttgctgtactgcttcccggaaaaaagtgagtacgagcgggaagcgatcatcgacgccatgtatgcctcggcgccgcaggcgatggtgatgatggccgagctgggcctgcgcgatccgcagaaaatccttgcccgcgtcgactggcaggggaaagcgatcatcgacgagatgcagcgcaataatgagaaggttatttttctcgttccgcatgcatggggtgtggatatcccggcgatgctgatggcctccggcgggcagaagatggcggcgatgttccataaccagggtaacccggtgttcgattacgtgtggaataccgtgcgtcgtcgttttggcgggcgtatgcacgcgcgcaacgatgggatcaaaccgtttattcagtcggtgcgccagggctactggggctactatctgcccgatcaggatcacggcgccgaacacagcgagtttgtggatttctttgccacctacaaggccacgctgccggcgattggccgcttaatgaaagtatgccgcgcccgcgtcgtaccgctgttcccggtctacgatggcaagacgcaccgcctgacggtgctggtgcgcccgccgatggacgatctgctggacgctgacgatacgaccatcgcccggcggatgaacgaagaagtggaagtgtttgttaagccgcacaccgagcagtatacctggatcctgaagctgctgaaaacgcgcaagccgggtgaaatcgagccctataaacgcaaagagctgttcccgaaaaagaaataaaaaaagcctccgtcaggaggcttttttatctctaccgtgcttactcgacggtgaggatacgggtggtgttggtgctgccgatggtgctcatcacgtcaccctgggtcacgaccacgaggtcgccggagaccagatagcctttgtcccgcagcagattgacggcgtcgtgcgcggcggccaccccgtcattctggctgtcgaagaacaccggcgtcaccccgcggtagagggcggtcaggttcagggtgcgctcgtggcgggaaagggcgaaaatcggcagaccggagctaatgcgcgaagtcatcagcgcggtacggcccgattcggtcatggtgatgatggcggtgatgcctttcaggtggttggcggcatacatcgccgacatggcaatcgcttcttccacgttgtcgaactggacgtccagacggtgtttggagacgttgaggctagggattttttccgcgcccagacacacgcgcgccatcgcggccacggtttccgaaggatactgaccggcggcggtctccgcggagagcatcaccgcatcggtaccatccagcacggcgttggccacgtccatcacttccgcgcgagtcggcatcgggttggtgatcatcgactccatcatctgggtggcggtaatgacggaacggttcagctgacgggcacgacggatcagcgctttctggatgcccaccagctcaggatcgccgatctcgacgccgaggtcgccacgggcaaccattaccacatcggaggcgaggatcacgtcgtccatcgcatcctgatcgcaaaccgcttcggcacgctcaactttggcgacgattttcgcatcgcagccggcatcgcgcgccaggcgacgggcgtagttcaggtcttcgccgcagcgcgggaaagagacggccaggtagtcgacgccgattttagcggcggtgacgatatcagctttatctttgtcggtcagcgcttcggcagacaggccgccgcccagcttgttgatccctttgttgttggacaacgggccgccgacggtcacttcagtgaacactttcatcccctgaacttcgaggactttcagctgcacgcgaccatcgtcgagcaataagatatcgcccggcacgacgtccgccggcaggcctttatagtcgatcccgactttctctttgtcgccttcgcctttgccaaggtttgcgtcgagcaggaatttatcgccgacgttgaggaaaattttgccttctttgaaggtcgatacgcgaatttttggtccctggaggtcgccgaggatggccacatgacggcccagttttgccgcaatctcacgcactttgtcggcacggagctgatgatcttccggggtgccgtgagagaagttcatacgtactacgtttgcgcccgcggcgataaccttttccaggttgttatcgcggtcagttgccgggcctaaggtagtaacgattttggttctgcgaagccttctggacatgtaatactccgttgactgatacaactttggtgttgcgtgaacatggattcggtagcgccagcctgcaacgtcgcacagccggatcgttatcgaaggtgtaatggggtactgcttgttatcaacttttattgattatcactgggtacgaatggttctttatcaaaacgcgattccttcagcgcttccttgaccctcttcaagttatctctgaattttgccccccgacgcaaggtaaagccagtcgccaacacgtcaatgacggtcaactgggccaaacgggagaccatcggcatatagatgtcggtatcttccggcacatcaagggtaatggcgagcgtggcttccctggctagcggcgtaccggcggaggttagagcgatcaccatggcatcgttttcacgagccagctgcgccagctccaccaggctcttggttcttccggtatgcgagataatcaccaccacatcatcgtcatcgcaattcatacagctcatgcgttgcaggacaatgtcgtcggaatagatgaccggcacgttaaagcggaaaaatttgttcatcgcgtcgtgagcgaccgccgctgaggagccgaggccgaaaaaggcgatttttttggcctgagtcagcagatccaccgcgcgatttaccgccgacatgtcgagagaatggtgcacctgatctaaactcgccatggccgattcgaatatttttcccgtgtatgactcaacgctgtcgtcttcatcgacattccggttaacatagagcgtgccgtgcgcaaggctctgggccagatgcagtttgaagtcagggaatccgcgggtttcgagactacggcagaagcgattgacggtcggttcgctaaccccggcctcaagggcgatggcggcgatgctcgaatgaatggcctgctcgggggtggcgaggatcacttccgccactttgcgttcagatttgctaaggtgttccagtcgggactggattttttccagcatgttcattagtaacagggcgctcatcaatggaaacgatttcattaatgggtgaaatcattgggcgttttagcaagaatatacccctccgcaagcgcaagcggtgaggaatgacgtgaaatgatgttgttttttttcattacatgatcagggtcgtattttactgacctgaaccaggtacaaacaacgaacaataacggccgaatgcccaaatcatcgccgaatgttttcaccctgtgcggttttaccgccgcaaacgaaggggaaggctttcgggaaatacgtaaacacagtacagtgcagtgtaagaaaattacaaatatagcctggcaaaagcaccagactatcaactgaggagaatgacatggcggtaacgcaaacggcccaggcatgcgacctggtcattttcggcgcgaagggcgacctggcgcggcgtaaattgttgccttccctgtatcagcttgaaaaggcgggccagatccacgctgacaccagaatcattggcgtcggccgtgccgactgggataaagcggcttataccaaagtcgtgcgcgaagcgctggaaaccttcatgaaggaaaaaattgatgaaggtttgtgggataccctgagcggacgcctggagttctgtaatcttgacgtcaatgacaccagcggcttcacccgcctgggtgagatgctggatcaaaagaaccgtgtcaccatcaactatttcgccatgccgccgagcacctttggcgcgatctgtaaagggctgggcgaagcgaagcttaatgccaagcctgcgcgcgtggtcatggaaaaaccgctcggcacctcgctggaaacctcccgtgaaatcaacgaccaggtcggcgagttttttgaagagtgtcaggtctaccgtatcgaccactatctcggtaaagagacggtcctcaacctgctggcgctgcgcttcgccaactccctgttcgtcaataactgggactgccgcaccatcgatcacgtcgaaatcaccgtcgcggaagaggtgggtattgaagggcgctggggttacttcgaccaggccgggcagatgcgcgacatgatccagaaccacctgctgcagatcctgtgcatgattgccatgtcaccgccgtccgatctcagcgccgacagcatccgtgatgaaaaggtcaaggtgctgaaatccctgcgccgtattgaccgctccaacgtgcgcgagaaaaccgttcgcggccagtataccgccggctttgcccagggcaaaaaagtgcctggctatctcgaagaggagggggccaacaagaccagcaacaccgaaaccttcgtggcgatccgcgtcgatatcgataactggcgctgggctggcgtaccgttctatctgcgcaccggcaaacgtctgccgaccaaatgctcagaggtagtggtttacttcaaaaccccggaactgaatctgtttaaagagacctggcaggagctgccgcagaacaagctgaccattcgcctgcagccggacgaaggggtagatatccaggtactgaacaaagtgccgggcctcgatcataaacataacctgcagatcactaaactggatctgagctactccgaaaccttcaaccagacgcacctggccgatgcctatgaacgtctgctgctggaaaccatgcgtggcatccaggcgctgttcgttcgccgcgacgaagtagaagaggcgtggaaatgggttgactccattaccgaagcctgggcagccgaccgcgatgcgccgaaaccgtatcaggccgggacctggggaccggttgcgtcggtggccatgatcactcgcgacggtcgttcatggaacgagtttgagtaaggctggaggctaatccgtcagggttattttaccggtaacatgatctgacgcagaaagtcgcacgctttttaatcttttaagccccgtgaggattcacccacggggctttttttattacactgcctgcagacattttgcccctgagcgctggtgtttgtggcctttaccacgtcaacacgtcatcacgcagcggccggacagataaaaatttgaggagcctttatgaattcgacaatgttacgggtaacaaatcgcattatcgaacggtcgcgtgacacccgcgcggcttacctcgcaaggattaaccaggccaaaaccgacaccgtgcatcgtgcgcaactggcctgcggcaatctggctcacggattcgcggcctgccaggctgacgacaaagcctccctgaagagcatgttgcgcaacaacattgccatcatcacctcctacaacgacatgttgtccgctcaccagccctatgaacactacccggagatcatccgcaaagcgctgcacagcgccaatgcggtcggccaggtcgccggcggcgtgccggcgatgtgcgacggcgtaacgcaggggcaggacgggatggagctttcactcctgagccgcgaggtgatcgctatgtccgccgccatcggcctgtcgcataacatgttcgacggggccctgtatctcggggtctgcgataaaattgttcccggtctgaccatggcggcgctctcatttggccatctgccgtcggtctttattccctccggtccgatggccagcggcctgccgaataaagagaaggttcgcattcgccagctgtatgcagaagggaaagttgaccgtatggcgctcctggagtccgaagccgcctcttatcacgcgccggggacctgtactttctacggaacggcgaacaccaaccagatggtggtcgaatttatgggcatgcagctgccgggctcgtcctttgtccatccggatgctccgctgcgggaagcgctgaccgccgccgccgcgcgccaggtcacccgcatgaccggcaacggcaatgagtggatgccgctgggcaaaatgtttgacgaaaaagtggtggtcaacggcatcgtggcgctgctggcgaccggtggctccaccaaccacactatgcacctggtggcgatggcccgcgcggcgggaattatcattaactgggacgatttctccgacctgtcagacgtggtgccgctgctggcgcgcctctatcccaacggcccggcggatatcaaccacttccaggcggcaggcggcgttccggtactggtgcgcgagctgctgaaaggcggcctgctgcatgaggatgttcacaccgtggccggctttggcctgtcgcgctacaccctggagccatggctgaataacggcgagctggactggcgcgaaggggcgacagcgccattggacgaccaggtcatcgcgacctttgaaaaaccattctcccgccacggcggcaccaaggtgctgagcggcaacctgggacgcgcggtgatgaaaacttcggcggtcccggtggagaaccaggtgattgaagcgccggcggtggtatttgagagccagcacgacgtgttgccggcctttgaagcggggctgctggacaaagactgcgtggtggtggtccgtcatcaggggccaaaagcgaacgggatgccagaattacataaacttatgccgccacttggtgtattattggaccgccgtttcaaaatagcgctggtgaccgatggccgactctctggcgcctccggtaaagtcccgtcagccattcacgtcacgcctgaagcgtatgatggcggcttgctggcgaaagtgcgcgatggcgatcttattcgcgtgaacggacagacgggggaactgacgctgctggtggatgaggccgaactggcggcgcgtcagccgcatatccctgacctcagcgcgtcgcgcgtgggaaccggtcgggagatgtttggggcgctgcgtgagaagctctctggcgcggagcagggcgcaacctgcatcactttttaagacgatttaatttctagatctggcgagagaaaatcctgatgaaaaactggaaaacaacagcagaagcaatcctcacctccggtccggttgtcccggttatcgtagtgaaaaagctggagcacgcggtaccgatggcgaaagcgctggtggcgggcggcgttcgcgtgctggaagttaccctgcgcaccgagtgcgccctggaggcgatccgcgcgattgccaaagaagttccggacgcgattgtcggcgcgggcacggttaccaacgttgagcagttgaaagcggtaacggaagccggcgcgcagttcgctatcagcccgggtcttaccgaatccctgctgaaagcggcgaccgaagacggcaccatcccgctgatcccggggatcagcacggtatctgagctgatgctgggtatgcagtatggcctgaaagagtttaaattcttcccggcggaagccaacggcggcgtgaaagccctgcaggcgattgcgggtccgttcggccacattcgtttctgcccgaccggcggtatctctccggccaactaccgtgactacctggcgctgaacagcgtactgtgcatcggcggttcctggctggtgccagccgacgccctcgaagccggcgactacgatcgcatcaccaccctcgcgcgagaagcggtggaaggcgcgaaataaaccacgcctccaggtcaacaacccggtctgcggcaacgcgaccgggtttttttgtctttacccttcgacgatgaccgccgcggcggcggctttagcccgcgccacggcctcctcaaccgaatcggcgacggcgagggttacccccaggcggcgggtaccgtcaatctccggcttgccgaacagacgcagctgcaggccagccccgacggccgactgcagctggccaaagctgacgttctggctggacaactgcggaaggatcaccgcggaggcggccgggccatactggcggatagcgccgacgggtagcccgaggaaggcgcgaacgtgcagggcgaattccgagagatcctgggagataagcgtcaccatcccggtgtcgtgtggtcgcggggagacttcgctgaagatcacctcgtcgccgcatacgaacagctccacgccaaacagaccataacctcccagcgccagcaccaccttgcgggcgatggtctgggcacgctcgagggccaggtcgctcatctgctgcggctgccaggactcacggtaatcgccgtcttcctggcgatggccaaccggagcgcagaaatgcacgccgtcgacggcgctgacggtgagcagggtgatttcgaaatcgaagttcaccaccccctcgacgatcacccgtccggcgccagcgcggccgccctgctgcgcatagcgccaggcttcgctgagctggtcagccgagcggataaagctctggcctttgccggaggagctcatcaccggtttaacgatgcatggcaaatcgatctcggtaaccgccgcgcggaagccttcttcgctgtcggcaaaacgatagcgggaggtgggaagctgcagctcttccgccgccaggcggcgaatgccttcgcggttcatggtgagctttgccgcccgcgccgtggggaccactttctgcccggcctgttccagttcgaccagggtgtcggtagcgatagcttcgatctccggcacgatataatcaggtttttcctgttcaatcagggcgcgcaggctctcgccatgcagcatattgatgacatgggcgcggtgggcgacctgcatcgccggggcatcggggtagcggtctacggcgatggtttcaatgcccagacgctgacattcaatagcgacttctttacccaactcgccggaacctaacagcataactttggtggctgccgggcgcagcgcggtgcctaatacagtcataactctcatccgcagtaaaaaaagatggcagcgattataaacgaaaacgtttgcgtatgtctttacgcgcgtaacgcgcgtgagttgagtccgggagggaaatttgctatactgtataaaaatacagtgttgagaggctgcagtatggcggttgaaattaaatatgtggtgatccgcgaaggtgaggaaaaaatgtcttttgccagcaaaaaagaggccgacgcttacgacaaaatgctcgatctggcagaggtgctgaatgactggctggtgacatcgccgctggagatggatgacgtccagcgcgataccatggcgatgtggctggcggagcgtaaagaagcgctgcagcatatcctgcgagttggccgactgccggagcaagagacgcccgcacaggacgcctccgcgccgtcggctaccgccgagacttctccggcgggtgatgacgccgtgccggcggccaaagcgcgcaaagccaaggcagcctgaacgctggcggtcagtcactggtcggtcggccccgatgctgccgtcgcacgtacctttgcgcatctttagccatatctaacatttcctgacatcgcgtcgtttaggctgataacagtgtttgtcacctgagaggaaaaccatggctaactggctacatcaactgcagtcgctgctcgggcagcagggtgcgtcaccgtccggcgagtcgtcaaaagggagcggcctgctgcccggcgccatcggtgggctggccggattgctggtggccagcaaatcgtcacgcaaattattggcgaaatatggcactagcgcgctgctggcaggcggcggggcggtggcgggcacggtgttatggaacaagtatcagcagaaaatgcgcgcgcagaatacatccgcccaggcgcctgagacggcagcggcggaggtcgatccgcgtagcgtgcggctgatcacggccctggtatttgccgcgaaaagcgacggtcatattgatgaccacgagcgggcgaatattgaaactcagctgcgggcggccaatattgacgttcaggcccgggtgctaattgaccaggcgctagcccagccgctggatccgcagcgtctcgccgagggcatcatcgacccgcaggaggcgctggagatctactacgtcagctgcgcggtgattgatatcgaccattttatggagcgtagctaccttaatgcgctgggagacgccctggcgctgccgaaagatgtccgggccgatatagaacaggatatccagtcacaaaaacaagcgctaagcgtctaaatcatcacgtttcgcttgcatcgctcgcgtcttttgccacccttatagacacgtcatcattcaggcgccaccctgcggcctgaatgctcttgtgtcacgataaagcagcagaagaataacatgccacctaaagctaaacggatccctcacgccatgaccttgcatggcgatacacgcatcgataattattactggctgcgcgacgatgagcgcgcgcgacctgacgtgctggagtatctgcacgcggagaacgcttacggcaagcaagtgatggattcgcagctcagcctgcaggagcgtctgctgaaggagattatcgaccgcattccgcagcgggaagtctctgccccctacagtaaaaacggctttcgctaccgtcaggtgtatgagccgggctgcgaatacgctatctaccagcggcagtcggtgctgaaagaagagtgggatgagtgggagatcctgctcgatgccaaccagcgggcggcgaagagcgagttctacaccctgggcggactgggcattgcgcccaacaaccagctaatggcggtggcggaagattacctttcccgccgccagtacggcctgcgcttttgcgacctcagcaacggcgagtggtacccggaaatcctcgaaaatgtcacctccggctttgcctggagcaacgattcacgctttgtttggtatgtgcgtaaacatcccaccacgctgctcccttatcaggtctggcgccacaccgtcgggacaccggcgcagagcgacgcgctggtctacgaggaaaaagatgagaccttctacgtcagcgtgcataaaaccacctcccagcagttcgtggtaatttatctctccagcgccaccaccagcgaagtgctgctgctcaacgccgaactgccagacgccgagccggtctgctttctgccacggcgtaaagatcatgaatacagtcttgatcactatcagcacgctttctatcttcgttccaaccgggaggggaagaatttcggcctctaccgtaccgtgctacgtgatgaagaacagtggaccacgctgatcccgccgcgtcacgacgtgatgctcgaaggatttaccctgtttaccgactggctggttgtggaagagcgtcagcgtggcctgaccagtctgcggcaaattaaccgcaagacccgggaggtggtggggatcgcttttgacgatccggcctatgtcacctggcttgcctataatccggagcccgaaacgtcgcgactgcgctacggctattcctccatgactacgccggatacgctgtttgaactggatatggataccggcgaacgaagagtgatcaaacagcaggaggtaaaggggctggatacgagctgctaccagagcgaacacctgtgggtgaccgcccgcgatggcgtcgaagtcccggtctctctggtctaccatcgcgaacattttcgcaaagggagcaacccgctgctggtctatggctatggctcatatggcgagagtatcgatgccgatttcagcgccagccggctgagcctgctcaaccgcggctttgtctacgccatcgcccacgtccgcggcggcggcgagctgggtcagcaatggtatgaagacggtaaattcctgtgtaagaaaaataccttcaacgactatctggacgtctgtgacgcgctgcttgcccaggggtacggcgatccgcggctctgctacggcatggggggcagcgccggcggaatgctgatgggcgtggccgtgaatgaacggccagagctgttccatggcgtgatagcccaggtgccgttcgtcgatgtggtgaccaccatgctggatgaaactattccgctgaccaccggtgaatttgaagagtggggaaatccgcaggatgaaacctattatcattatatgaaaagctacagtccctatgacggcgtgagggcgcaggcgtatccccacatgctggtgactaccggtctgcatgattcccaggtgcaatactgggagccggctaaatgggtggcgaaactgcgggaactgaaaaccgacgataacctgctgctgctctgcaccgatatggattccggacacggcggaaaatccgggcgctttaaaagctatgaaggggtggcgctggagtacgcctttttcatcgccctggcgcaggggacactgccgggaaaagcggcagtgtaggggctattccccgaggtaatgcctgagcgtcaggcgcagttcggggctcatgcggtcgagattgttgaataaccagcgcagatagcctggatcgttttcagcaatctcggcgacggccttaccccggtatttgccgaaggtaaaagtagtcagcagcgccggccgaccggtgatatcggccatttcgtcaggggtccagccggaaacattgatgatatccagcagcagcgcggcggtgatatagcagtcatacagcgcccggtggtgatgcagtcccggcggcgtagtcacgttcagcttacgtgacttatataaccccatattgctgtatttgattcccggccacaggcgtcgggccagcttcatcgtacagatccactcgccgtgcatctccggcaacacccggcgatcgaagctggcgttatgcgcgacgtaccacgggctgccatgatagtgcggaataatctcctcaatccacggcttatcggcgaccatctcttccgtgatccggtggatagccatcgcctgcgggctgatgggccgatcgggacgcaccagatggctcatgggattggtaatttgcccgtcgactatatcgaccgaggcgatttcaacgatgcccccctgcaggccgcaggtttcggtatcaatgacgcgcagcatggctcgctccagagcaaaacaataagcgtaatggaattggccgggcttgccaaccgacggggaggaggcgagcgcgcattatttctgtttcggctcccacggtagtcgcgaaagggagacggaggccagccgatgggcgatcagtcgttcatggaaccagtcgcgcagatgtgcaggctgttcacgctcgactaaatcagcgaccaccggcatattgtaccgttccttaaaagcaacgccggcggcggcgagatcgacattgactttatccatctcatcttgcgaaattttggccagatttctttccatcatccactccactctgcttataaatccggtcagggccagatgcctggctcgactctggcattatacagggttattctctgtgctacagacataacaaaagggaatgacgaatatgcgacttcttgctggacgcgcgttgcgtctctccgttgcgcttgccgggatgttaaccgcggcgggcgccttcgcccacgctcacctgcagcagcagatcccgaccgccggggcgcagctttcagcttccccacagacgttgacgctcagtttttccgaaggtattgaacccgcattcagcggcgtgaccgtcaccggtccgcagcagcatgcggtggctaccggaaaactgacccgcagcgccgataatccggccgaggtcacgttacctttggcggaagccttgccgccgggagagtacaccgtggcatggcatgtggtctcggtggatggtcataaaaccaaagggcaatatacctttagcgtgaagtaagcgatgctgaccgggctctatattaccctgcgctttgggcactttatctccctgatgctggcttttggctgcgtgctatatggcgcctggtgggcgccggtaccgctgagacgcgtgctgatgctgcgcttttatccactactgcgcccgctgctgctgatcggcgcgatctctacgctggcgctgtatctcctgcagggaggaatgatgggcgagggctggacggatgtctggcgacccgccgtctggcaggcggtggccgggacccgctttggtggagtgtggatctggcagatcctactggcgtggatcgcgcttgcggtagtgtggatccgtccccgtcacggcgcccgccagctggtggccctgctggcggcacagctgctgctttccgccggggtagggcacgccgctatgcacgatggtctcaccggcgtgctgcagcggacaaaccacgctgtgcatctcttctgcgtcgccagctggtttggcggtctgttgccctttatctattgcctgcgcctggcgcaggggcgctggcggccggccgcggtctataccatggcgcgcttttcacgttacgggcatctggccgtcgccggcacgattgccagcggagcgctcaatgcgctgttgatccagggaggattgattggcgcatcgccgtggggacgcatgttgttgatcaaatgtgcgctggtcgccgggatggtggtaattgcgttagtgaacaggtatgttctggtaccgcgcatgtcggcaagcggttcgcgggcggaaagcctgatcctgcgaaccacgcaggctgaaatagggctcggcgcgctggcgctgctggccgtcagtctgtttgccacctgggaaccttattgaattaactggcaaaatcatgaaaaaaattgttctgaccatgttgttactggcaagctccggggctgctctggcagcgccacaaattatcaccgtgagccgttttgaggtggggaaggagagctgggcgttcaaccgggaagaggtcatgttgacctgtcgaccgggtaacgcgctttacgccatcaacccgagcacgctggtccagtatccgctcaatgaggtggctgagcagcaggtcaaagccggcaaaaccaccgcgcagccgatctcagtgatccagatcgacgatccgcagcatccgggacaaaaaatgagcctcgcgccctttatcgagcgagcgcagaagctctgctaaactttctcgctatcctgctgtaataacatcaaaaaaaccgcccttgccggacaacggcagtggcggttttttcgctggcagaggccccctttccaggaattatgcagccactttggccgcggactggaaaagctgacgcgttaaactattcttatagtgcaaggcggcttagcctgcattaatgccaacttttagcgcacggctctctcccaagagccatttccctggaccgaatacaggaatcgtattcggtctctttttatctttatctgtcttctttcccaagagccagcgacatcctgtcagtcaaacacccgctggcctctggatgtcccgttatagcacaccgtttttagcatacacaattcatttacacataaatcgcatcctgtggaaggggaggtggcaacggtggaaccgtaaacgagggcggagaaaagaaaaaacctgcacctaaacaggcccggcgtgcaggttaactggcgggccaacatcggaagcctgctagtatacatatttgtatgataaataaaataagcaaaatctaaacgatttggcaattcatgcgattacacctcgccggctgacgaggtggcataaataataagcacgagcacttttgcgggcggaaaatattattgcggaacgctgaatgtagggtatatctggctttccagatagcagagcaatagccaaatttcatcgctgaaaataaaccatatgctcccgagcagaatgaccgccagaataatcagcagaaaaatttcggttttactcattatgcaagcgactatccggtggccttcggggaccctgatagtagcgaaatattgacataataagcaaacgccatgttgtaattcggcttcaccgacagtgcaatttagtcaccggcatgccgctgcgtcaatattgccacctgctccgtcagctgatccagcagctggaatcgccgccgatattcagcccgttttttactggcgatactctccagcgattttctttccagacatagcggtagccgccagcgccatgggctttccggctggccgtcgatagactgccagaactcgtcgtagctggcgtggaaatggcggcctttgctcaggcgatagcgcagggcgcggaacacgtgaccgttatcgctgacgccgtaaatagccgcgatttggctgcgagcggccagctgccagataaactccagcagcaggcgcttcggaaacaggccgtagcaggcgcgagtcgcctgcttaatcacctcatgagaaacgtgacgtcgtggcccctgcagaccgccgataaccagctgccaggcatcgtgatcacgggttacgctgaaggtggcgctggccagcagggtgtggtcgctgtcgcgcagccacagagtggtttcaccctcacgttcggctttgcctgccgaggaggcataaagagtaaaccggcggtcctcttttccgtttaacgtcagcagcgggacctcagacaccgcggtcatagcgtgcgccagccgcgatccgcgtagggtgtcgatatagcgataatggttgattaccgccaccgcccgctgccaggcgttgagatcgcgggtcagatattgacggtgtactttgcccggcagcgtagcctgtgcggccagcagctgattaaaatcatcccgagcgctgagcgcttccagcatcgctctggtggcgttataaaataaggccgtgcgcagcaaaaacttaaagcggtaatttttttgccgccagatgggggcaggtgtcaatctgcccatcaccagatcggcaataagatgcgagcgcggcgctagcacgccggatgaatgcaggctattgtctgtcacgataaacacctcgttgtgatttccccctattttaaagcgagccactgacaagcttaatcctctggcggactatatttgccgtctgtttaaaattgattgaggtgtaaattaaattccgtggacctttgctggaattacctataattaccgctgagaggtaattatatgtatcaacgtattaacggcagcgactggcgtaatatctggctgatgggcgatctgcatggctgctttgcgctgctgatgaatcgcctgcgtcagttgcgttttgatccctgggccgatctgctgatctcggtgggcgatctgatcgatcgcgggccgcagagcgccgattgtcttggcctgttgcgctgtcgctggttcagggccgttcgggggaatcatgagcagatggcgctggaggcgctggagagcggagatatgcggctctggcagatgaacggtggcgactggtacgtcaagggtgatgcgcggcagcgggccgacgtcgatcggctgctggcgcactgtcggcggctaccgttgattattgaagtggaatgcgggaaagcgcggcatgtgatcgcccacgccgattacccggcgccggtctatcgctggcagcagccggtggatccccaacgggtactatggagccgctatcgtctgagtgaacacctggcggggcgccatggcgctattgccggcgcagaccatttctggtttggccatacgccgcttcaggcgcgttatgaccacgataatcaacactatattgatacgggcgctgtgtttggtggggcgctgacgctggtggcgctgcagtcggcaggctaaaagtcgctgtattcgctggcgggttgccagaagccatcaataaaatcttctatcgggtagcagccaccgtggcggatccgctgatcctccatcgccactaagcactgcgtttcctcgcggtagacgtctaccacaatgtcctcgcagccgccatccagatagcaaataaacaacactaaggcaaacatcctggcctcatgctcgggttcacatactatttagtgtaggggatgacggcgggacggggaaataaataacccgtctcaggcgacgggttcattggtgtcaggcaaggcgcatgacccaggcatcggactggcggtcgtaatgtttacggtagagaacggaatgttcgccattgagaatcgcgggcacgctggtgtcggcatcccaggcgtcaagctgcatacataagtctggatcggatttgcagggtatgcttaacgttcgctcaccctgatgctcaccgtgcagttcggcatcgtctatttcgaacgcgccgatgcggacattggttttactcatcgcttcaccccatttttcagctgagttgtggtacgaccagttatggccgttatttttcagcgtagtcaatggggcgaaaagcgccagtcaaaaagtgcgcattttttgcgcggcctcacaccttgccggcaaaaagttttccatcgcgcaccagttcgcgcggatagctgttcttcagtcgggagccgacgcgcttcgccaggcccagcgggacgccctggaaggtcacaatggtttcatcctgcccaggcgcggtttgcggatagacgtcgcgcccgcgataccattcctccgcttcctcctgcgacagctcgaaggcgcgctgcggcgcggcaaaggcgataaccgcctcatgctgccagcggtaccccttattgtgcagctccgccaggcgcacgccgatgcgagaaaagcgcaccttgccgaacaggggctccaaagccagcggaaacagccacagctctttatcccgctgccacagcgtatggcctgcgtcccactccaggccaacagccctggcggcggcagttaccgcggcggcctcccggtccttcagcggcgtaaacgggaatttaccgaccttatagcctggcgccgggagcggatcgatcgccgcagttttgcgcaacctcgcgacaaagaagccttcgcaatcgtaaatttgcggaaaaacgtgcagaaaaccttccgcggttaaggcgtcggctgcgccgggaaacaactctcccagcggcaggatctcaaccgcctgcggatagcgggacagcagccactcaatgaccgattgattttcttcacgattcagggtgcaggtggaatacaccagcgtcccgccagggcgcagagcatggaaggcgctgtcgataagctcgcgctgagtggcggcgatgtcgaggttgctctccggcgaccagtttttcagcgcgtcggcgtctttacgtacaaccccttcgccggagcagggggcgtcaagcaggatggcatcgaaggtttcgggcaaggccgcgccaaaaacccggccgtcgaagtgggtcagagcgacgttgctgatgccgcagcggctgatgttggcatgcagcaccttcacccggctggcggagaattcattggcgagaatgccgcccgcgttgcccattcgggctgcaatttgggtggttttcgatcccggagcggcggcaacgtccatcacccgttcgggctgccggttatcggcgaacagggcggcgaccggcagcatcgaactggcttcctgaatatagaacagcccgctgagatgttcggcggtactgcccagcggcagcgcgtcgtcatcctctcgctcgatccagaatccttctgcgcaccaaggcaccggcgcgagttgccagccgtagggggcaaccagagagaggaaatcatcgacgccaatcttcagcgtattgacgcgaatactgcggcgtagcgggagctgacaggcggcgataaagtcgtcgaaagagagatgcgctggcatcgccgcgcgcatttgagcgagaaacgcttcagggaaatagacagtattttcagccacgggcagcgcaccacagaaaaaaagggtgcgcagtttagcacaaacgccccggcgcgtgacaccggggcgtgcggtttaccctctccccgcgccaggcgttgcccggggcgggagaagggggcattactgcggcagagcggtgccccactcccgccactctttcggctcgctctcctgcagcaggaagtgcttgccatcctgggccttcggcgccagcggcgtgcccggcggcgtggcaaaggcgatcccgccgcggataaactgattgaaggtaccggttttcaccaccccgccaatcaggccgaagtcgaggctgtaacccgaggccagccagaacaccgagttattacgtaccaggtactggtagcgcttactgatgcgcagcttaaccatcacccggtcagacatcgaccccagcgacagtccggtaaccgtcccgacttccagtccgcggaacaggaccggcgtaccgatgccaagcgaccccgcctccggcgcttccaccacgatgttcaggccgtcgatataacgcgaatcgctgatcgtcgtatcctggatctcaaaatcgcgtcgtgccgggccgcggccgggctcaacgttgatgtaggcctggaacagggtgtcgagatgttccacgcccgcggcggagatttgcggagtgatcaccgagaagcgggtcccggcgcgagcgaaggtgccgacgtattccggatagagcaccgctttcgcctgcacttcgtttttggcggtgattagctccagcgactggatttgaccgatgtcgatgccgagataacgaatcggcatcccggccgccatcttcccggcgtcgtacgcgtgcagggtgatttggccgcccacggcgcgcgccgccgtttcagatgcataaaggatacgtttgttattcagccgtgctccggcgctgctgccattgaggttatcgaaactgatcgcccctttgatcgcgcgcgccagcggcgaggcctgcacggtgagtccgttaccgtcaagcttgaccttcgcaccgccttccgcccagaagacgctgttgttggtcagcaggtagcggtactccggcttgatatgcagatcgatatcgaatgcatccttgcgcggtttgacggcgatgatctcgccgacggcgaatttacgatacagcaccaccgagccggcctgaacgtcaggcagcgtctcagcagacaggctcagggtagtggtcggcacttcgctcaggctattttcctgcgccttttcaaggttagcgtacagcggatagctgctttgcattttgcctttttcgccggggatcaccctgatcccgccgttcacccattcgctggcgctggcgcccagcacctgcacgccgtcgagccccactttgacgtccagacgactgttaaccacaaatttgctgtcgccgtgaattagatcgcggtattcagggtcaatggcaacctgaaaggttacccctttggccgtcagtttacgctccagcacctggccgacttttactccgtgcagcaccagcggctgaccgccgtcgatgccgtagctctccggcgccgagagggtaacggtggcgacgttgggctcatccagcagcgctttatccgccggcattaccgagaagtgattgcgtggctcgccttcgccgggcaccagctcaaaggtattgccggtgagcagggtgctaatgctggggttatcgagggagagcttcggcttcttcatctgaatcagcgttttctcccgcagcagcgtcaccacgctcgggtcgacggtcatctcgccagtaactttgccgccggggtttagattcagtttgcttaactggcccacctccagcccctgatacatgagcggcgtcgagcccgctttcagtccgtcgccatcaggcagatcgagggtcactaccacgccgcgctggctatgcgccagatcttcatacaggtgatattcatcgttttgcgaggcgacatgcgaatcggcgggggagtcaaaggcgatggcgccgttcaccagcgcggacaggttctccagttgcactttggccccgctcaggccgacgtcggccttgacgcctgagacgttccagaagcggctgccttttttcaccagattggtaaaccggcgctcgattagcacatcgatggtcaccccctgattattggcattcagggaataatcatacactcgcccgaccgggatttttcggaagtagaccagcgagccgctgttcagagagccaagatccggcgcctgcaggtggatcattagctcgccgttgttgatgcggtatttaggttgggtgtcgagggcgacaaagtgatcttcgggttcacccttgcccggcatcatgccgatgtagttcccgcccaccagcgcatcgaggcccgatacgccggccagagaggctttcggcgtgaccagccagaactgggtctctttgcgcagcgcatctttcatatcgcgtttgatgctggccgaaacctcaatcttactcagatctttactgaggctaatatcctggacggtgccgacttcaaccccctgatagcggatcggcgtccgtcccggcacgatgccgttcgcggactggaaatcaatcgtaatcgtcgatccgcgatcgtcaaagctggtccagattagccaggcggcaatcagcaacgcgatgaccggcagcagccagaatggcgaaatacggcgtttggtttttattctggcttcagtctgcgaagcgggcgtttcctgactcatgtgcgtcccaaagtaagcggctgtccagccattcaactgcaagaatagttaaaattaccgcgccgccaaagtaaaccgcagccggccccatggtgaaggcgaggagctgatcgcgatttattagcgacatggtgagtgagataacaaacagatccagcatcgaccaacggccaatccaggtgattagccgcagcagcaggatgcgggtgcgcaatccctgctcgcacttgaattgtatgctgagcagcagggtaaataacactataactttggtgaatggcaccaaaatactggcgataaacacgaccccggcaatggcgatattgctgctggccagggagatgatccccgagaggatcgtgtcgtcctggcgcgcgccgttgacgtagataatggagattggcaacaggttggccggaaagaggaaaaccagcgaggcaatcagcgccgcccagctgcgctgcaggctctgcggtcggcgatgatgcagcggcgtgtggcagcgtcggcagcggccgcgcgcgtcgcgatagccggtgtaatggcagccggtgcacacctgcagattattatcggcgcgggtcgccggacgctcgggatagaaacgctcccatagctcttcgacgttcatatgaataagcgtcaggatgctcaacaacgtcagggagataaacgccaccagaccgatgcccggctgcaggaaggcgtaatcctgcaccttgatggaggcgacgccgatgcccaccagatagatatccagcatcacccactctttaagcttgccgagcatcagcagcaccggccgcaggttcatccccagcacattgcccagccagagatagctgatggagaccaccagcagcaccggggcgaccaccgcgcaaaacagtaccatggcggcggtaatcggatcgccctgcgcggtcatctgccagatcccctgcaggacgttggcgtcgatgcgtacgcccaacagatgcaggcgcagcagaggttcagaccaggcgaaaggcatgagcaatagcatcgcgagggccatgctgcccaggcgggtcagcgaccagtcgcgaccatcgcgcaccttcgcgttacagcgcggacaccaggcgctttggttgcgtttgagcaccggtaagcggaagagcatgtcacactgcgtacagcgctgataatgcgcatagggaagcggcgtgctgacggtatgcacgaccatctttttcgcaggtttgagggtgggtgtttttatcggcatttattacgtacaggaatgaatgtatctcactatcttaacctatgaatgaattcatcttgagcccaagcgcatttaatgcttattttagtaggctgtacgtatcaggcagtaagacaacaaagtgaagatataatgagcaaaacagaattttacgcggatctgaaccgcgatttccaggcattaatggcaggtgaaaccagttttctggcgatgatcgccaataccagcgcgctgctgttcgagcggctgagcgaggtcaactgggccggtttctaccttctggaaggcgataccctggtgttgggaccgttccagggcaaactggcctgcgtgcggatcccggtcgggcgaggcgtatgcggcgcggcggtggcgcaggctcaggtccagcgcgtcgaggacgtccacgcctttgacggccacattgcctgcgatgccgccagtaattcggaaattgtcttccctctgcgcgtgaatggccagattatcggcgtgctggatatcgatagtccggcttacgggcgcttcaccgctgaagatgagcaggggttgcgcacgctggtcgagcatctggaaaaactcattgcggccacggattatcaaaaaatctttacccgtgtcgtgggataatcaacggataacgtagcatttagcgaggacgtcattataatgtcgcctgttcatgcctgcggcttgttggctacgtccgttgtaatcaggaaatttcatggaaaatcaacctaagttgaatagcagtaaagaagttatcgcctttctggccgaacgtttcccgcagtgctttagcgctgaaggtgaagcgcgccccctgaaaatcggaatttttcaggatctcgttgagcgagtgggtggtgagatgaatctcagcaagacccagcttcgcgctgcattacgtctctacacgtccagctggcgttatctgtacggcgtaaaagccggcgctattcgcgttgacctggatggcaatccgtgcggcgaactggaagagcagcacattgcccatgcgcgtcagcagctggaagaagcgaaagctcgcgttcaggcgcagcgcgcagcccagcaggcgaaaaaacgcgaagccgctgcggccgcaggccagcaggatgaaggcgttcgccgcgagcgtaaaccgcgtcctcagcagccgcgtcgtaaagaaggcgctgaacagcgtaaaccgcgtcctgttgcggccaaagccccgcgtgaagagcgtcttactccggtatcggatgtttccgttctgaccgtcggccaggcgctgaaggtaaaagcaggcaataacgccatggacgccaccgttctggaaatcaccaaagatggcgttcgtgtacagctgacttctggtatgtcaatgattgtacgcgcagaacacctggtgttctgaaacggaggccgggccaggcatgaacacattttttaaaatcaccgcgcttgcgggcctgctggcaatagcaggccatgcattcgctgttgatgacataacccgcgcagatcaaatccccgtgctgaaagaagagccgcagcacgcgacggtaagcgagcgcgtgacgtcgcgctttacccgctctcattaccgtcagtttgatctcgacaacgccttctcggcaaagatttttgaccgttacctgaacctgctggactacagccacaatgtgctgctggccagcgatgtggcgaagtttgcggctaaaaaagaccaaattggcgatgagctgcgcagcgggaaactggacgtcttttacgacctctacaacctggggcagcagcgccgcttcgagcgctatcagtatgcgctgaaggtgcttgaacgtccgatggactttaccggcaatgataatttcaaccttgaccgctccaaagcgccgtggccaaaagacgaggccgagctgaacaagctgtgggacgctaaggttaagtttgaccagttaagcctgaagctggcgggtaaagacgataaagagatccgcgacaccttaacccgtcgctataagtttgctatccgtcgcctggcgcaaaccaacagcgaagatgtcttctcgctggcgatgaccgccttcgctcgcgaaatcgatccgcacacaaattatctgtcgccgcgtaataccgagcagttcaacaccgaaatgagcctctcactcgaggggatcggcgccgtgctgcagatggatgatgactataccgtcattaattcgctggtggcgggcggtccagccgcgaaaagcaaagcgatcagcgtcggcgatcgcatcgttggcgttggccagaccgggaagtcgatggttgatgtcatcggctggcgtctggatgacgtcgtggctctgattaaagggccgaagggcagcaaggttcgtcttgaaatcctgccggccggtaaaggagccaagacgcgtattgtaacgctgacccgcgagcgcattcgtctggaagaccgtgcggtgaagatgtcggtgaaaaccgtcgggaaagaaaaagtcggcgtgctggatattccaggcttttacgttggcctgaccgatgacgtgaaagtgcagctgcagaagctggaaaaacagaacgtcagcagcatcatcattgacctgcgcagcaacggcggcggagcgctgacagaggcggtatcgctctcgggtctgtttattccgtccggtccggtggtgcaggtgcgggataataatggcaaagtgcgcgaagacagcgacaacgatggcgtggtttattacaaagggccgctggtggtgctggttgaccgctttagcgcctcggcgtctgagatcttcgccgcagcgatgcaggactatggccgcgcgctgatcgttggcgaaccgaccttcggtaaagggacggtacagcagtatcgctcgttgaatcgtatttacgatcaaatgctgcgtccggagtggccggcgttgggttccgtccagtacaccatccagaagttctatcgtattaacggcggcagtacgcagcgcaaaggcgtgacgccggatatcatgatgccaaccggcaatgaagatcgcgaaaccggcgagcagtatgaagacaacgcgctgccgtgggatagcatcaacgcggccacctatgtgaagtccggggatctgaccccgtttggaccggagctgctcaagcgccacgacgagcgtattgcgcaggatcctgaattccagtacatcatgaaggatattgcccgttataacgcgatgaaggacaaacgtaacatcgtctctctgaactacgcccagcgtgagaaagagaacgaagaagatgatgcgattcgtctggcgcggattaacgatcgcctgaaacgcgaaggcaagccgccgctgaaaaaactggacgatctgccgaaggattaccaggagccggatccgtatcttgatgaaacggtccatatcgcggtagacctggcgcatctggaaaaagcgcgcccggcggtggaaccgccggctagcaaataagttgctaacgggcaccctgagaggtgcccgttttttttgtgcgcgttgtcatcgccattcagctcatctaacaaaatgtcaacctgcgctgccgctgtcagcaagatgctacaaaatgtaaagttgtgtttttatcgtgacttagcgggggctgatggttgaaaattgcagcctgacccatacgatgtgggtaatcgcatagtgcgttttgttaaattgaggtaaaaagaaaattatgatgcgaatcgcgcttttcctgctgacgaacctggcagtgatggtcgtgttcgggctggtgttaagcctcacggggatccaatccagcagcatgaccggtcttctgattatggccctgctgttcggcttcggtggttctatcgtttcgctgatgatgtcgaagtggatggcgctgaagtcagtgggtggggaagtgatcgagcagccgcgcaacgaaacggaacgctggctgatgaataccgttgcgcagcaggcgcagcaggtaggtattgccatgccgcaggtagctatctatcacgcgcctgacattaacgccttcgccaccggcgcgcgtcgtgacgcctcgctggtcgccgtcagcaccgggctgttgcaaaacatgagccgtgatgaagcggaagcggtcattgcccatgaaatcagccacatcgccaatggcgatatggttaccatgaccctgatccagggggtggtgaacaccttcgttatctttatctcccgcgttatcgcgcagattgcggccggtttcctcggcggcaaccgggaagatgaaggggagagcagcaatggcaacccgctgatctacttcgcggtcgctacggtgcttgagctggtgttcggtattctggccagcataatcaccatgtggttctcgcgttaccgtgagttccatgctgacgccggctcggcgcgtctggtaggccgcgagaagatgattgcagccctgcagcgtctgaaaaccagctatgagccgcaggaagccagcagcatgatggcgttctgcattaacggtaaagcgaaatccatgagcgaactgtttatgactcacccgccgctggataagcgtattgaagccctgcgtagcggtgaatatctgaaataatctatcttctgacgctgaaaacgaaaatccgcagcccgcaagctgcggattttttttaccgtccgtcaggctgcgcgcggctgagtgacccgcagaccgctaattagcgcggcgacgatagccagggtgccggccagcagcagggcggtgtgggtgccgttgttaccgagcaaattgaatagcagcgccaccagcgccgcgccggtgctctgtccgagcaggcgagcggtgcccagcatgccgctggcgccgccgctacgatggctcggagccgaggcgacgatggtatggttgttcggcgactgaaacagcccgaagccggcgccgcacagcgccatgcgccagatgatatccagatcggagggcgacgagggcagcagcgccaggccgaacaggccgcaggccataatcagcaggccgatagcccccagcagcccggcatgacatttctcgatcaaatagccggccagcggcgccatcaccatggtcgctaacggccacggcgttagcagcagacccgtctccacttcgctgcgccccatcatcgactgcagaaaaaagggcagggagaccatcgccagcatctgcgcgcagaaggagcagatggaagtgcagatagagagagagaagagtgggatacgcagcaggtcgaccggtagcagggggacgggcatcgtgagctggcggcgaacgaagaagaaccccaccaccagcatagcggcgacctccgccagcaccagctgagtggactgcccctgggcgaaaccgctcagggcggtgatcagcagcccgaaggtaagggcgttcataatggcgctcggcagatcgaagcggatgattttgctgcgcgcgctgttgggcggcagaaagcgcatggccagaacaaaggcgacgatgccgagaggcacgttaattaaaaacagccattgccatgaggcgagggagaggatcgctgcggcgatagtcgggcctgccgccgaagagacggcaacgacaaaggagttaatgcccatgccgcgaccaagaaagcgctgcggataaatcagacggatcagcgcggtgttgacgctcatcagcgcggcgccgcccaatccctgcgcgacgcgagcgaaggttagcatttcgaggctacgcgacagcgcgcaggccagcgaggtaaagataaacaccaccaggcctatcttatagatacgccgatagccgaccatgtcgccgaggaaggagagcggcagcagggcgatgacaatggcgatttggtaggcgttaacgatccagattgaagccgccggtgaggcgttgagatcgctggcgatagtcggcagcgcgacgttggcgatagccccgtcgagcacggccatggtcagcccaagcacgatggtcagaatggcgccatagcgttgcggcaacggcacgccatcagaagaatttttatccatggtgaatatgagtcttaaatgaaacggttttttgaatgatgagtttagcattgattaattcgcagtatgtcgcagatttgtaacgaagtggcagaagaatgattgcggctcagaggcggcgaatttataataaaaaccggttctaatttttataaaacagttacgacgaggtgataaatggcaggtgcagatttggataaacagccagattctgtctcttcggtattgaaggttttcggcatcctacaggcgctgggtgaagagcgtgaaattggcattaccgaactgtcccagcgcgtcatgatgtcgaaaagcaccgtttatcgctttttacagaccatgaaatcactgggctatgtggcacaggaaggagagtctgagaaatactctctcaccctcaagctgttcgaactgggcgcgcgcgcgctgcagaacgttgacctggtgcgcagcgccgatattcagatgcgcgaactttcgcggctgacgaaagagaccatccatcttggggcgctggatgaagacagtatcgtctacatccataaaattgactcgatgtataacctgcggatgtactcgcgtattggccgccgcaacccgctgtacagtaccgcgattggcaaggtgctgctggcatggcgcgatcgcagcgaagtggagcagatcctcgacggcgtggagtataagcgcagcaccgagcggaccattaccagcaccgaggagttgctaaaagtgctggatggcgttcgcgagcagggctatggcgaggataatgaggaacaggaagaggggctgcgctgcattggcgtgccggtgtttgaccgtttcggcgtggtcatcgccgggctgagcatctctttcccaacgctacgtttctctgaagaacgcttgcatgaatacgtggcgatgctccaccaggcggcgcgtaagatttctgaacaaatgggatacaacgactatccgttctgaggcggcggataacggggttggcgaccgcggcgctacgtcgcgatcgccggttcgatgttagccgttatcaaccacggttgtgcttttacgcagcagagggcaactgctgacgccgatcactccgctgtcggaatgaacataaagtgcggtgctgactccgcgggcggtgagatattggcacttaagacccagaccgccgacgttttcctcactgtggaataacaccccataaccgctcaataatacgccaatccataagatagccaccaagataatagtacgaatgattaatcgcattgatgcctcattatttgtatgatccctggcttgattttgacacgaacacgttttgaaacaagtcgatgattcctaaacttacctttcgtaatacagttagccgcggtttaagaaggccgtgctatcctggcgacattgcgtactgatgcggagagtggagtgaaaaaattacggtgggttttactgatagtcatcatagcaggctgcctgttgctgtggactcagatgcttaacgtaatgtgcgaccaggatgttcagtttttcagcggcatttgcactattaataaatttattccgtggtaagacatttttctgccgactgatttccttctgcgccgcgggtggtagaatgaacgccttctctttgaggtggtgaaatgagtgagttactaaatcctgggattttaaatctggcatcgctggctgtgtccgtggcgctgctgcttgtcggtctgttgttatggttcttcgtcaaccgcgccagttcgcgggccaatgagcagatagagctgctgcaagcgctgctggatcagcaaaagcggcagaatgcgctgttacgtcgcctgtgcgaagctaatgcgccagagaaagaggatgtggctgagccgaccgtcgccggcaaggcgaaaggggaggatgagtttatccgcctggtagctgaacgttaaggtgcccgacaggtgtgcatcataagatgcgcacctgcatgatagcgggcggtaatatcttattcttattccattattcctttcttagtgcaatatcctctttattacacgctgtaaataaagtcattctcgccgcgtttattgttgggtaacgtgacactgtcatctttttttcattattaaggtgcagaattagcactatttttagcgtgacgactaacaggttttattatcactacactggcacggcttagcgatttttagcctggagttataacgaattatgcgcatcaatattcaccgttgcccaccagacgcttacattacagcagttcgtgtacggacatacctggacgaagcgaagttgttgagctatggtaaaaaagttgcagtaatgaggcaacgaatgggcgatattggctgatgctgtagcgccttgccaggggcggcaaagacgcataaatgtgcaggcgatcaaatgattaccttataatttgtgcgaacgatcgagacacgtttaaaaatggcttgccattatttacgtagtgtgtgataacacgtttcgggttaaacgaggtacagttctgtttatgtgtggcattttcagtaaagaagtcctgagtaaacacgttgtcgttgaataccgcttctctgccgaaccttaaattagtgcctcatgcagttatgtgtcagttttatctaggtaaacgccagcaggcgaagaaaacagtctaaggaattttgcaaatggcaaagattaaaggtcaagttaagtggttcaacgagtctaaaggttttggtttcattactccggctgatggcagcaaagacgtgttcgtacacttctccgctatccagggtaacggcttcaaaactctggctgaaggccagaacgttgagttcgaaattcaggacggccagaaaggtccggctgcagttaacgtaactgctatctgatacaagaccactcttcttgtataaaagcctcgcctgcgcggggcttttgcatttttattgcaaagcatgtcatttttccccctcccgtcgcgtcttgttgcaaatactcatctttattagcattgtgtagcagtctgttttgctaattttctgttaaatcagttggttgcaaaacaatgccggagctatggtgctaaagaaaaaaacgaagtccgccgccagtttcaccccgattcgcttcgggttactgtgtgtggccattctcggttgtctggggctgctgctggtccgcgtgggctggctacaaattatctcccccgataacctggtaaaacaagaagatatgcgctccctgcgcgaagaacccgtagcggttgagcgggggatgatcagcgaccgggaaggacggccgctggcggtgagcgttccggtcagtgctatctggatcgacccgcagaccactatggagaagggcggtgtgggctatggaccccgctggcaggcgatggccgaagcgctgcacctcaacctcggagagctggcccagcgggtacagagtcatccccacgctcgctttctctatctggcgcgtcagatcaatcccgagcaggcagagtggattgataaactgcatctgccgggcgtctacctgcgcgatgaatcgcgacggttctacccggcgggccacgtggctgccaatctgctgggctttaccaatgttgataatcagggcatcgaaggggtggagaaaagctttaacgcccagttgaccggtaaacccgggcgacgtctggtgcgtaaagataaacatggtaatgtcattgagaacattaccgaagtgccgccggtaccggcgcataatctgcagctgagtattgatgaacgcctgcagacggtgacggaagacgccctcgacaacgccgtccgctggaacaaagcagagtccggggcggcggtattgatcaaaattgataccggcgagatcctggcgatggccagctatccggacttcaatccgaacaatcgcgatagcgcgacgctggatgattttcgcaaccgggccatcagcgacaccttcgagcccgggtcgacggtcaaaccgctggtgatcatgactgcgctgcagcaggggattgtccagccagacagcgtggtggatacccatccgttcgtcctcgatggccatcgtattcgcgatgtgggctattatccggagctgagcctgaccgggatcctgcagaaatccagcgataccggcgtgtcccacctctcgctcgccatgccggtgcagcatctgatcgatacctataaagctttcggcttcggcgaaccgacggggctggggttgaccggcgaaagcgccgggctgatgccgcatcgccgctactgggggcaactggatcgcgccaccttcgccttcggctatggtttgatggtcaccccgctccagctcgcccacgtctacgccaccatcggcggcttcggcattgcgcgaccactgtcgattacccgcatcgatccgccggtgatgggcacgcgggtgatgccggagagtattgtgcatagcgtggaacatatgatggagagcgtggcgctcccgggcgggggcggtaccaaagcggcggtacgcgactaccgggtggcggtaaaaaccggcacggcgaagaaaatcggcccggacggcaaatatatcgataagtatgtggcctataccgccggcgtggcgcccgccagtcgaccacagttcgcgctggtggtggtgatgaacgatccgagcaatggttcctattacggcggcgctgtgtccgcgccggtcttcagccagatcatgggcgatgtcctgcggctggagaacgtcatgccggacggcatgccgcaaggggcggagaatctgatcgtaatgcacgatagccacccacaggggccggcgctgtaacagtggtctgcaggggcgaatagcgctacactttcgccctttcagcaacaccggagccgtcatgtcatacagttgccccctttgtcacgcgccgctcagccgtagcgacaaccactattcctgcccgcagcggcaccagttcgatctggcgaaagaggggtacgtcaatctgctaccggtgcagttcaagcggtcgcgcgatcccggcgatagcgccgaaatgatgcaggcccggcgggcgttcctcgacgccggacattatcggccgctacgggatgctatcgctgagcggctgcgacattacgcccctacggatttactggatatcggctgtggcgaggggtattacacccacgcgtttgccgcgatcgccagccgcagctgggggctggacgtgtcgaagccggcgatccgcgcggcggcaaaacgctacccgcaggtgaatttttgcgtggcctccagccagcgcctgccattttccgacgctagcttcgacgcggtagtgcgcatttacgcgccctgcaacgccgaagagctggcgcgggtggtgcgtcccggtggttgggtgatcaccgccacgccgggtccccgtcacctactggagctgaaagggctgatttacgatgaagttcgcctgcatgagctgaagacggaagcgatgccggggttccgcctggaggctcagcagcagctggcttacccgatgatcctgacgggaagtgaagcgcaggccctgctgcagatgacgccgttcgcatggcgggctaaagccgaagtgcacgccgcgctgcgtcagcagccgacctttggttgccagaccgattttatgatccactgctggcagcgcgaagcgtaaagcttaaccggcgaaatggctccagaggatttcgctgccgatgccaatcagcacgataccgccgagaatttcggctcgtttgccaagcagcgggccgataaagcgaccgaccatcatccccagcgtcgacatgataaaggtggcgcagccgatcgccagcgcggtggtcacaatgctgacctgcaggaaggccagaccgacgccgacggccatcgcgtcaaggctggtggcgaaggcggtggtgaccagaagccagaaaccatgtcggtgaggcgcctcgcacgcctcgtcgctgtcgccgcgaaaaccttcgacgatcattcgcccgccgagaaacaccagtaaaataaaggcaatccagtgattccactcgaggataaactggctggccagcatgccaagcccccagccgaccagcggtgtcagggtttcaatggcgccaaaaatcagcccggtgcgtactgcctctgaaaatttgggtttatgcagggtggcgcctttgccgatggaggctgcgaaggcgtccatggacatgccgaaagcgagaagaatggtagcggataaattcatgtgcgtgtcctgaccggggataatccatatgacacatcgctgcccccagtaaacatacgcggagccgctcaatggctgagcaatacgtacagcagtgatgtatctatggtctcgcctgattgaatctcttcaacccgtacgtgccacgttttgcaacgagtatgttgacacgtacatttcctggcgggcaggaaatcggctactccccaacgacgggcgcaaccttaacatatttttagaatataaaacaataacagaagagggctattttaataaccaaatgataacgattttcatttaaatttataagtgaaaaaatagttaataaaaaagataaggttaggcgggaaatatagccgtggctataatatttctccgctgctaacgggaataatatagcgctggctatatttttaagtcattgagttgtaatgagaagtttgtatatcttctccagatcgtcgatatttcgtacgcgtatcagcagccgccgttgctctaattgcatcaccagcacaccgtcctcggataaattcatctctttaatccgctgatattctatccacacgttggcgaagaaaaagccgcgcggtttaaaaatgattttcggcgtacggatccagaataaatagagccccatcagcgccagcacagataatagccaggtggtgatcgccgtgccgtgctgggtgatgttgttatagatcagaatggcggtgaggccgacaaagatcatgccgtcaacgcgactgcggcgaagcagggggatggccagcagtaccgggccgtttcgcctcggcataataaactggtcatatatcgcgtaggccagtagcgcaaggataaacaggatgatcaccaggtccgtgaaggtcattgctttgcgtttctcctgataaaaaaaagccgggggcaagcccccggcgtacagcctggaaattacagacccagcaggccgaccgcgtagccggcgataccgatgacgaagaagccaacgatgatccacagcgggttaactttcttacgcagcagccacatacaggcgaaggtcaacagcagcggcaccagaccaggcatcagctgatcaaggatagtctgcaccgtggtgacgtgaacctgtccgtcagagccggtgatttttgacaccaccatcggaatgttcacatgcgtccacttgttaaccagcgcccccatgacaaacaggccgaggattgacgccccctcagtcagtttctgcaggaagccgccgcccatatctttaacgatatccacgcctttgcgataaccataggcgacaccgtagtaacgggtcagcagacgcaccgcgttgaacaggataaagaacagcagaggaccgagcaggctaccgctcatcgcgatcccggcgcctaaggctgcaaacaccggacgcacggtaccccagaagatcgggtcgccaacgccggccagcggtcccatcagaccgactttgatgccgttgatagcgccatcgtcaatctctgcgccattggcgcgctgctcttccatcgccagggttacgcccagtaccggagcggcaacgtaagggtgggtgttgaaaaactcaaggtgacgcttaattgcctgcttacgcgcatcgttgttctccgggtacagacgacgaatcgccggaaccatagagaagcagaaccccagcgcctgcatacgttcgaagttccatgaaccctggaacaggttagaacgaatgaacacgccacgaatatcactctgtgtgagttttttctcggtggtatttttagtcatatcaaccatttcgctcacctgttagtccagttcgttatcgagatcgttgttaccagccgcctgagccggcgcaccggcgacgcggttatatttcgggctcagctggatgtagaggattgccatgaccgcaccaatcacgcccagggccaccaggttgaagttggtgaaggcggcggtgacgaagccgaggtagaagaacggcatcagatagcctgcgcgcatcatgttgatgaccattgcataaccgacaaccacgatcataccgccggcgatgttcagaccgctggtgaccacttccgggatagcattcagcaggccctgaacttcgctggtgccgacggaaatcgccacgataacggccgggatagcgatacgcatcgcctgcaggaacagggacgagacgtgcagccacgacagggcggtcaggttgccattctccgccgctttatccgccgcgtgctggaaggccacggtgatggtgcgcacgatgatggtcagcacctggcctgccgccgccagcgggatagccagcgcgataccggcgccgatgctctgatggccggcaataaccaggacggtggaaataatggacgccagcgcggcatcaggggctaccgccgcaccgatgttcatccagcccagggctatcatctccagcgtaccgccgatgataataccggttttcatatcgccgagaacggcgccgatcagcgtacaggcgatcagaggacggtggaactgaaattcatcaagtaccgactccatacccgcaatacacgcgacgatgaacaccagcacaatctgaagaagggtaatctccattgtacttctcctgttgattaagtcttaaagtgaaaactggggcgcgatccgccgggttatttatcaaccttagcgatcagatccatcattttcagtttcgggtcggtggacactttacgtgcctccagctcgataccgcgggcgttcagctttttaaacgcctcaatatctttggcatcgactgaaatcgcgttgttaacctgggttttaccctggcggaacgccataccgccgatgttgacgctggtgattttcacgccgccctcgacgatacgttcaacgtcggtcgggttagtaaacagcagcataacgcgctgtccggcatacttggggttgttgtagacgcggatcattttggccacatccaccacgtgagcggtgacgcccggcggcgcaacctgggtcagcagagttttacgcacggtatccgcggccacttcatcactgacaacgatgatgcgggtaacgttggtctctttggtccagcgggtggcgacctgaccatggatcagacggtcgtctatacgcgcaaggccaattaccatgtagtcgttcgggcccatgggtttggccggtgcggcggcttttggcgctgcggcaggcgcgggcgcaggggccgctttttccaccggtttggctttaagcgctttcacgccttcgctgccggtttcaaccgctaaggcgaccagttcatcaaaggaaggatcgtcgtcgcgggccatgaaggtttccaccagcatcgggatattgacgccggcgataacttcgtaatgctctttatcgacgacaatgcggctcgcagcgttgaaagggctgcctccccatgtatcgacgagaaacagcacgcctttactggtatccagttttgccaactgggcgttgtatttctcgatcaacgtttcggcattttcacccggaacgaaatcgatccagccaacgttttcctgctcgcccaacagcatttctgctgttttcagcagctgttctgcagcccaaccatgtgtgcctattacaatagcaatcgtcacttgctacctcctttattatcgtgaatgcatcatctgctttgatacatcctgaatcactcttgaggacaaaatcgattcagttagggtgtaagatagaaaatagttactaccgcgaattattttagacagtgaaaaaataattaatgtgatgaagatccgttaatcacgtatcgtctgcgaataattttgcagcgcaaaaaatagccttagttattgcaaattcaggtaaattatttccaatttcgatctatattttgctatgtttaacttccgtttaattactcaggagtatagggcatagcccgcagtatggaccgtcatcgacgtcttttcactttctggcatctgattgccacctctacgtatcccgcatttctttcagcacctggtgtcgcgcccctgcatggcatggcaatgactgaccttgccgcaaaccggagtcgtacatggaattgttaatggatccctcaatctgggccggcctgttgacgcttatcgttctggaaattgtgctcggtatcgacaacctggtgtttattgccatcctggcggacaaactgccgccgaagcagcgcgataaagcgcgtctgatcggcctgtcactggcgctggtgatgcgcctggggctgctgtcggtcatctcctggatggtgacgctgacgaaaccactgattaccatcgccgatttctccttttccgggcgcgatctcatcatgctgctcggcgggatcttcttgttgtttaaggcgacaaccgagctgcatgaacggctggaaaaccgccagcacgatgccggtcacggtaaaggctatgccagtttctgggtagtagtattgcagatagtggtgctggatgtcgtcttctccctggacgccgtgatcacggcggtcgggatggttaaccatctgccggtgatgatggcggcggtggtgatcgcgatgatcttgatgctgctggcctccaagccgttgacgcgctttgtcaaccagcacccgacggtggtcgtgctctgtctgagcttcctgttgatgattggccttagcctggtggcggaagggtttggcttccatattccaaaagggtatctgtacgcggcgatcggtttctcgatcattatcgagttctttaaccaggtggcgcgccgtaactttgttcgccaccagtcgacgctgccgctgcgcgctcggaccgcggatgccatcctgcgcctgatgggcggccgcaaacaggcctccgtcagccatgacgcagacagtccagccgcggtgcccgttcctgagggcgcctttgcggaagaagagcgctacatgattaacggcgtgctgaccctggcccagcgctccctgcgcagcatcatgaccccgcgcggagaaatcagctgggtcgacgctgagcagagtgaagatgaaattcgtcgtcaactgctgtcgtcgccgcacagcctcttcccggtctgccgcggagagctggatgaaatcattggtatcgtgcgggcgaaagagatgctggtggccctggagtcgggggaaaacgtcgcggcgctggcttctgcctccccggcaattgtcgttccggaaacgctggacccgatcaatctgctcggggtcctgcgtcgggcgcgcggcagcttcgtcatcgtaactaatgaatttggcgtggtgcaggggctggtcacgccgctggacgtccttgaagccatcgccggtgaattcccggacgctgatgagacgccagagattgtcatcgatggcgatggctggcttattaaggggtcgaccgacctgcatgcgctgcagcaggcgctggggctggatccactgatcaatgacgatgaggatattgccaccgttgccgggctggtgatctccgctaatggtcatatcccgcgcattggcgacgtcgtgtcgcttccgccgctgcattttaccgtagtggaagcgaatgattaccgggtcgatctggtgcgcgcggtggtcactcgtccgccgagcgacgaagaagagtaatcgccaggctcgccggccgctgcggccggcgagttattctgtcgtctcgctctcaccctcaccctcactctcactctcctccctgctggccagccacgccgggaacgcctccaccggcatcggccgcgcataataaaacccctgcagcacatcgacgccgtggctacgcaggtagttttcctgctccagcgtctccaccccttcggcaacggtaacaatatgcaggcggttggcgagggcgataataatatctgtcaccgtcgcgttcacgctatctatgccgaccgagctggtgaacgagcggtcgatcttcaggacgtccgggcgcagcttttccagccatgagagcgaagtattgccggtaccaaaatcatcgatcgccagctgtacgcctttaaagtgcagatgttcggccatatgctggtcgccatcctgcaggacatcgcgttcggttagctcgaccaccagctgctgcaccggatccacgctgaaccagtaattgtgcaggtcgcgcagcaggagtccgttagcgaaatggcgcgcggcgacattgatcgcgatgtgaaaatggcggtcgcgaggaaaagcgtccaggcggcgagcggtttcggcaatcacatagcgggtgagagggatgatcagattattgccttcggcgatggggataaatacctccggcgaaatcgtcccacggcggggattattccagcgcagcaggatctccaccccgcagcagcggccgctgcgcgcatcctgcagcggctggcaccagagggcaaactcccgggccgaaatgccaaggcttatttcccgcgagaaactcattctgccggcggtggccagccaggcgatgccggtcattagcaggctaaaaatcagcgccagcggcagctcgccgggcagctcctcaagcgcaatcgccgaggcgccagggccgttaatattgacagtaaacggaaactccgtagagcgctggcgataaatcaccgtgccctgcgggacatgcgttttttcgagaagcccatggcggctgctaaaataacgatcgccaacctgcaggctgacgtcgctgatcagggccgatttttcattaagaattaaggttcccagcagctcaatattcaccaccagcatcacgccgtccaggccgctctccgcggctggataccattggatcagtaccggcgagcctttgagcaaggagctgtcgttcgagaagagcagcagagggcggggcacaggaagcgcgggctgcaggcgatgtaagtctgcctgtcgcgggccaaaaatactggaacagtaaacgatacctgacgtgacgagggcgacggaacgaatggtttgcaacgaggccgccattttgcgcagcgtcagatggatatcagggcagggtttgcccaccagagggagcagggtggctcgctgcgcgcttagcgggcgcaagatgtcattgagcgccgccacccgttggctggcggccgtgcgaatataatcttcatttacgctgcgctgcgaaataaatcggatggctaatgtggcgcccagggtcgccagggctaccagcaggcagacaataatgcgtttgtgacgataggccgtaatgactttttgtgcagtctgcatgtgcgacaccctgtcgacaggacgagtggttaagcgtggcttattttatagagcaagtgtagtggcagaatatcgccaggtatagaaaaaagaaaatgcgccgttgaaggcgcatcagggagatttcagtcaccagggttaaccccctgcgcgctttgcaggcgcagagggacacgaatagtttagtcacactgaactttaatcgccaggccgccgcgcgaggtttcgcggtacttggcgttcatgtctttaccggtttcatacatggtctcgatcaccttatcgagcgagacgcgcggttcgctggtgcggcgcatcgccattcgcgcggcgttgatcgccttgacggaggcgatggcgttacgttcaatgcatggcacctgcacctggccggcgaccggatcacaggtcaggccgaggttgtgttccatgccgatctccgccgccacgcaaacctgttccgggctggcgccgagcagttcagccaggcccgccgccgccatcgagcaggcgacgcccacctcgccctgacagccgacttccgcgccggaaatggacgcattcatcttatacagcgcgccgatcgccccgcaggccataaagtagcgaatatagatctccgggctgacggactcgataaagtgatcgtaataggcgagtaccgccggaacgatgccgcaggcgccgttggtcggcgcggttaccacgcgaccgccggcggcgttctcttcattgaccgccagcgcgaacatattgacccagtcaacaacgttcattggatcgctggagagcttatcgctggccaccagcagacgacgcagcgccgaggcgcgacgcggtacgcgcagcgggccaggcagcacgccctcggtgttcatcccgcggtcgatacaggcgcgcatggtttgccagacgttggcgaaataatcctcgatctcttttttgctgtgcagagccagctcgttctgcatcaccatcccggagagcgacaggccagtctctttgcagtaggccagcatttcctgcgccgatttaaatgggtagggcacctgcagttcgttggcgttttccttgccgaagtgctcttcgtcgacaataaagccgccgccgatcgagtagtaggtcttgcagtagatctctttctcgccggcccaggcgtgaatggtcatgccgttttcgtgcagcggcaggttgtcgctgcgaaaacgcatgccgtcatccgccgggaagtcgacctcatgctggccgttggccagcagcagacgaccacgcgcttcgacgtcacggataaaagccgggatcgcgtcaatatcgaccgtatcgggctgattgcccgccagtcccatgataatggcgatgtccgtatggtggcctttgccggttaatgacagtgaaccgtagacgtcaaccgccacacgagtcactgcattaagcaatcctttttcgaccaggtcatcgacgaactgttttccggccttcatcgggccaacagtgtgggaagatgagggaccaatccccaccttgaacatgtcgaatagactaatcacgataatactcctgacagggttaccgcgggtgcggtaacgatgtaataactgcgcatagtgtaagagggaagcgccctgtcagttcaactattcacatgaattaaactaatggctaaccgcgattttactaataatgagagcgccctctcattatcagtatagctaaggacgtgcgccaatttgcagcgccagctcgcgaatgatcccggcggtcattccccagacaaaataatgctggtaccaggagagccagacgcggtggtcgttgccccggcggtggatatcgagcggatggtagcgcccaaggcgcagggcttcggcgagcggcatttcaaataccgcggagacttcgtcctggctggcgggatagtgcagatccgggggaataatgcccaccaccggcgtcacctgaaagccggtgacgctgtccaccggcggcaggacgccgatcacctcgaccgcctccggcgggatcgccacctcttcctgagcttcgcgcagggcggcggcgataagcgtcgcgtcggtattatctactgcgccgccgggaaaggcgacctggccggcgtgcttgcgcagcagcggcgaacgctgggtcagcagcaggccgggctgcggccggcgcacgatcggcaccagtaccgccgcctgccgctgattgagcgcatggcgcgaaggctgcgggcgcagaagctgaaagcgggacagaaaatcatccagattaagggcgcgatccgccatggtctagttctccagttgctgcaggatacgattaactttatcaaaagtttcctgatattccgccgcttcctcgctatccgccacaattccgccgccggcggagcagtacagctgtccctgccatgccgtcagggtgcgaatggtgatgctggtatccatattgccgcaatagctcaggtagccaatgctcccacaccaggcattgcgtcgctggggctccagttcatcgataatctccatcgcccgcactttcggcgcgccggtgatcgagccgccgggaaaggcggcgcgcagcaggtcgctggcgtgcagcgtcattggcaggcgggcggtgatggtgctgaccagatgatggaccgccgggaacggctccaccacgaacagctcggggacccgcacgctgcccgggacggcgacgcggccgatgtcgttgcgcatcaggtcgacaatcattaaattctcggcgcgatctttcggcgaattcgccagcttctcagcctgctgcgcatctgccagcggcgaatcgagccgcggcagggtgccttttatcggccgcgtctggatctccccctggcgcagctggataaagcgctccggcgacaggcttaaaatcgccccttcatcgaggcgaataaaggcgctaaagggggcgcggttgacggcgttcagctggcggaaggcctgccattcatcaccgacgtagctggcctgaaaacgctgggcgaggttgacctgatagcagtcgccgctgtgcagataggcctgtacctggcgaaatttttcgccgtactgctggcggctcatatttgactgccaggcagaggtcagggcgaaaggtttcatcgccggacgtgattgcgccagcagccactggaaacgccgctgaggatcgtcatagctgagcagcgatatctgttggcgctggtggtcgacgatcagcgcccagtcatagatccccaccgccatatccgccagcgcgatatcggcctgcgcgtgcgaagggagacgctcaaagcgacggcccaggtcgtaaccgaataatcccagcgcgccgccgagaaacggtagatcgtcatggggttgcggcgtgaacggctgacgatccaactgctgctgcaggagctgcagcggatcttccgctgagacaacaacggtttcgccgtcgtcgacccacgtctgttcaccgcgcgtcagcagcgtggcgcgcggggcagccaccagaatatcaaagcggttatgcggatggtcggcaaagccggaatgcagcagcatcgcccagggcagggcgcttaacggcgcaaaatagtgttcggccgcatccgggcgccagggcagggtaataatcgcgggggacaacatctttctcgatcctgaacgttgccgcccctctggcgtagttggggacggcgtgaaataattacgccccacaatgtagcaggagtaaaagatgtttgcaggtttaccttcgctgagccacgagcaacagcaaaaagcggtcgaacgtatccatgagctaatggctcaggggataagcagcggccaggcgattgccctggtggcggaagagctgcgcgcaacgcataccggcgagcagatcgtcgcgcgctttgaagatgaggatgaagatcaagacgaagatgaggacgaagaccagtaaatccgtttcgtcttgctcgggtgagaaaccttacctcctctgcaggatcacatcaggggcccgtccgggttcgtcatatagcatcacctgcgtcatgtgatgactgcgccagaaggtcactcgggttccctttggcgtgggatccacatgagcttcggtaagcgggttaccgttggccagatcccacagaccgacaaaacgcgcctgtggaagatgattgcggataaccagatagctaaggtcggttattgccgggttatcaggggcctgcccttgccaaagctcgccgtcgcccgccagccaaagcgcgatagtgctgccgtcccgcacaaagtggcgcggctgacagccattcagcgacgtcatcgttgccttcttcatatgccgcagcggtccgctgagcgaaaaaggctgcggtgtaccgttctgatccagcgcctcggcagccagatgcagcgtccagtcgagctgctggcgatgcgggttttccaccgttgagagatcgatcaaaacctcttcaagccacaacaggcggcggcgaaagcgtacgtcacgccaggactccaggtcccattcgactcgactatgactgtcgagcgcaggcggcggtttaccccagtcggtctcacaatccagccagaaaacgtcgtcagccatatgccagcccagcaccgtcgggatggcagggggttgattgctctggttaactgacagcgtattatgcgtggcgctgtttttataatagtcataatgcatttccgccccgtagccggtggtgccaggatccggcaacaaccagccgtcgcgctgccatagcatcaggctttgtctgtcgtagtggtcgtgttccccgccccagggactgtgtttaatcagcaccgccagctgttgcttcggacgtcgccacagggtcaaccccgcgcccggtgcaaaaaatgactgctgggggatcggcgttagcggtgactcaggcagcggatggtggcgccacaataacgtctcatcctcgtcaggctccgtttcggtgaattgcagcacggcggcatacagcggatcgcgccagataaaccaggcgaactcgtacagatcccggtgctgtagcttttcctgcccggcaagacagtcattcagccgcgggaatgtgccatccggcagcagcagcgacagcgggaatttcagcatcggctgataccaggggccatccagcaggctccagcgggtgccgcgcgccagcttctcaaaggcgaaaaagccctgcagcgcgtagtagtggtagtgaatcgaaccctcaaaccatagcccctctgccagcaggccattttccagttgccagcgcaagccgtacggctgaaaaacggcaaactccagtagatcctcatcttcgaggatgaagccaagtacagccagcgccgcattgattttgacttcatggttatggatctgcggcgtgcgatgctgccgcaaaaacgtggccgcacagcgcaacaagttttccctgatgtgctgctgttcgccaggcgtcaggctgtcgctaataaaatcgtaacccagcgccatgtccagaatgcagttggcttcgcacagggtctgggcattcattttacccggcccgttgttgggaatatcaccgtggacttcatagcccggataaacatccgcgtagcccatcagtaaggcgcgtactttatcgcgccaggctctctcaccggtcagttgccatagcaggccgagctgctggcatgcgctggcattacgcccgttcatttcgcgccaccacgcgctgtcccacggttcgccgcgaaaaatttcattatcgaccgggcaggcatgctggtggggcatgtccgctcgccacgttaatcgtacgccgtggtgcgggcaaaagtagtagagattccagctggcaatcccggtctgcggaatgcgtaatgcggcatgtagtaccggctgtgcatccttcacgagccgttcgagcagcccgttatgggctgcggcacgttcgacaatattgggccagagcccagtaaattgtttcattagcggttttccctgacctctgaggatggtaaaagcggggcgataagagtggtgatatcgtcggggtatttcgcccgtagccactgcgctttgttacggaacagcggatcttccggccaggcgtgggcggcagtggcgatattgcgcagtgctttttggtcatccatgttatcgatgtctttccatggccatggggtatcgctgttaataaatccggcgatgtactgatagcctttgcgcagactatggtcatcaagggtgaagttccagatatcgacgcccgctttctcgcccagtcgcccgaggcggttgtaggcttcaaggttgaaattactgtagtgccagggccgcgtacgctccagctcggccatctgacggccttcgatatcaaattgaccggcaatgcgccgtagctgggtgagatacaggcgctgtttcgcctcgtcggttttgccgctaaacagggcgaaggtgacggcctgcatgtcaaaatagctgccgtggttgttgtgccagttatcttcttcgaaaccgttctggctggtggtcatccagtgataatactcgccaaaccactgcttcaacgcactcacgtccttctcgctaagcaccgcagaggattgcagcagggcgatagcatccaccacctcaaccagcgcccggctatcaataatgccgataccgcgcccgttgttaatgccgggaatggcttgggcgtattgcagattggggttcatacgcgtctgtgggtcgagaaaccaggtcttcaactgggctgccgctttttgagcgtagcgagcgtcgtgggagaagtaccatgccagcgccagggttgatacatcctgactcatcttcaccaggcggtttttatcggtggcatcgctattggcgtccgggttggtttgcccatctttgcggatatacggcagcccgtctttggtatcgggattcggccaccagtaaggggggaaactatagtagtcgtgcttgttgccgctggcggcaacaagcgttttgtccatcactgagcgcagcggatgcgtgagcgccagatcggctttttttagcaaggccgcctgcgccagaacaaacaacggatctttggcggcaatctgctggcggctaaaggctaaatccttttcgtccagcgtgtacggctcggcggcatgcagagaagcgctaaggctggaacaaaatagcgcaacgcataaccaacctcggcgaggtattgcgttcatggtgataacccttctgcaagtgtgagaaaagataacaacggatttaagcctgtcgcgtatttaaataacgcgtaaaacaggcggtttaattaaaaagaatatatttgaatatacagtggcgagcagtgtaaaagacaaagttattttttgtgtgacgcacatcaaatttatcgctatcgattgataatgacctttttaatgttatgcacatcacggaattcagcgtttttctatattttttgattgtttcaataaaaatggtaaatttataattaattgattttaatgtatattttttcggtgtaactttcattgtcacttttccatgtgatctgattcaacttttttgtttttgaaacgcaatttctttttactgtggttgtattgatgggtgtgtttctatctaatgaatggaaatatttcttgcgtcagctgttttaacgcctgagcgatattcaaattaattcctgcgtattaattgagaatttaattacctttgtgtccaacaataaaggatatgcaatcatgtctgcgaataaattccgctcattattactactcaccgcgcttggactcggcgtgagccaaagctatgccgccacgaccctcaacgtctggatccgcgccagcaacgactcgaaaaatatatacaagcaagaggcggagaaatttgaagcaaaaaccggtatcaaaattgagtacttcaacgccactactgactttgaacagcgcctggcgcgcgccacggcgggtaacgctttgcccgatctgatttttaacgacgcggcttcgctggggcagtttatccagttgggtattgctgaggaaatagatccgcagtcgatctccggcggcgaccagctcttcccaaccgcatggaagagtacccgctatatcgacggtaagtactacggtgtgccgacctccgcccaaaccttcgccctgtttatacgcaaagactggcgggaaaagctggggctgccacagcctaaaagctgggaagatattcagaccctggcgaaagcctttaccacccaggatcctgacggcaacggtaaaaacgatacctacggctttatcgtccccgcctccacgacgcgcggctacgccagctggtttatgagcagctttatctggcaggcgggaggggatttcgtcaaagaagagggcggcaaattccgcgcggcgctcaatacgccagaagtggttcaggcgatgacctttatacgcaccatgatgtgcgaaaaagtcacccagccgggggcgatcaatgccaccaccgccgacgtcatcccgtctttccgctccgggcaaagcggcatgttctttagcggcccgtaccatatcgcgctgtttgataaagacccgggtaaagacaattttgaagtggttccggtagcagggccaaaaggtgaggccacgctcgcggagggcaccacggtctttatgatgaagagcagcaaacaaaaagacgccgcgcgtaaatttatcgaatttatgatctcggcggaaggtcaggaaatcggcatgggtaaaggcagccagcatattccggtggtgcgcctgccggtgaataagaacgtcgacgtcaaagccgtctatcaggacgcccgctgggagactttcgccaggctttacaatcaacagggacgctatgtgccgcaaattcccaactggacgccggtgcgtcaggtggccgccgagggctttaaccgtatttttgccgactgcaacagcccgatcgccggcgagctggagagtatcgacggcaaggtgaacgctgagctgaaaaaacaaaatgtgctggctaactgaggacaaccgtgatgacgctgcatgagacgaagtcctctccgatgaagcaggccgcgtcgcctgactcgatcggatggctgagcgcaaagcgtaagcgggcgctgatcccgtggttgtttttagcgcctgcgttaattatttttagctggtttaagttcatcccgatgattcagggtctggtgatgagcttttacaaggtcaactttaatcagccgaacgaatgggtaggactcgataactttacccgtgcgtttgccgacgtcgagctgcacgcggcggtggtgaatacgctgctgtatgtggtagtcacgatgttcgctgcggctatcctggcgttcttcctcgcgatgctgctggaaggcccggcgcgccacctgcgttttattcgcaccgccatctttttacccgccgtcaccagcgcggcgatcgtcgccgaaatgtggcgtattttattcaacccgacgcccaacggcgtggttaaccacattctcagctggtttggcgtcgccgaccagggctttcttgccagttccgaccaggcgctgtgggtcatcatgctgctgcacatctggaaagcggtgccttacaacatggtgatctttattgccggtctggcggggatcagccgcgatttatacgatgcggcgaacgtcgacggcgctaactggtggaaccgtctgcgctacgtcacgctgcccggcatgatcccggcgctctcggtggtgctgatgctctcctttatccgcggtttccgcgtgtttgccgaggtgtacgccaccaccggcggcgggccatctaacgcgacggaaatggtcatgacccatatctacaaactggggtttgagcagtttgactatggctacgcgtcggcggtgtcgtttctgctgttcgccttcacggttttcttaaccatctgtcatctgacgctgaaaaaacgtattgcacgttactaaggagccgcgatgttaagtcaacgttgggataccgcagggcgctggtgcatctacgcgctgctgctgatcgtttttgtcggaccgttctggggcatcgtcgccacggcattcagcggtgcgccggtgaaaccgggtgagctgctggcctggccgaatcagttctcgtttgaaaatttcatcttcgcctggcgggatatcggtgtctggcagtatctgttgaactccatcctggtggtgttcttcggcaccgttttgcaggtgtcggtcagcgcgctggcggcgtatgccctggcccgtaagaagtttcgcggcgtggcgctggtcagtctggttattttgtcgaccatgatgctgccggaagaggtgattgcgatcccgctgtacatgatcatcaactggcggctgccgctgatcgatgcctcactctacaacagctatctcgggatgatactgccggtcgttggctgggcgttttccatctttgtgctcacggaatttatgtcggcgatcccgaaagagctggaagaggcggcgcgcattgatggcgccaacgaatggcagattttctttcacgtgatcctgccgctggtgaaaccggcgcttggcacggtagtcaccttcggcttcattatgatttgggaccagtacctgctgccgctgattgtggtcaaccacgacagcctgaacaccattccggtgatcctcggcacgctgcgtaccgacgagagcatcacgccaaacatttttatcgccattacgctgctggcgatgctgcccagcatcatcgtctatctcggtctgcaaaaacatttcaatcgcgggattatgtccggcgcggtcaaaggataaggagttacccatgggatctgttgtactgaatagcgtacgtaaatcgtatggtgatgcgcacgtgataaaggatgtgtcgctgaccattccggacggcgagttctgcgtgcttgtcgggcccagcggctgcggcaagtcgacgctgctgcgcatgattgccggcctggaggagatttccggcggggaagtacatatcaatgaacgcaatgttaccgacgtcgagccgaagctgcgcgacattgccatggtgttccagagctacgccctctatccgcagatgacggtgcgggaaaatatgggctttgcgctcaagatggctaagttgccgaaagcggagattaaccagaaggtgaatgaagccgctgcgctgctggggctggatcccctgctggagcgcttaccaaaggatctctccggcggccagcggcagcgcgtggcgatgggacgtgccatcgtgcgtaaaccgcaggtgtttttgtttgatgaaccgctatccaacctcgacgccaagctgcgcacccaggtgcggggagagatccgcgaactgcatcgccggctgaaaaccacctcggtatacgtcacccacgatcagatcgaagccatgaccatggggcagatgattgtggtcctgcgcgatgggcgcatcgagcaggcgggtaccccactggagctgtacgaccagccggcgaacctgttcgttgccgggtttattggttcgccggagattaaccagctgcccggcgaggtcgtattgaacggagacgcgaccagtctgcggctgaaagatggttcgcttctggcattacctgcggggttagcggtcaccaatggtcaacaggtggtgtatgccattcgccctgagcaggtcaacgtggtgcatgaggcccacgatgatgcgctggcggcgaaggtcacggcggtagagaacaccggttcggatatgcagttgttctgcgataccggcggcggggcgtttacttcggtatttaaacagcgactggcggtgaaagagggcgacagcatctggctgcagccgaagctttctggtgtgcatctgttcgatgcgcaaagcggtcaacgtatagcctgccgggagggcgtctgacgtggcgatgaagctgtacacccttgacgaaagctgtctggaaaacgcgcgtgcgggattaaaacagccgttctcgccgctgcagctggcgctgagcaagctggtttcgcaggccgatattctgcgtcgtgaagcgccggaaagcgttgtgcataaaaaactgcggccggcgagcggcgacgcgcacgattactacagcctggggacctactggtggccgaaccctcggcgtcccaacgggctgccgtatattcgccgcgacggacatatcaatccgcagtgtgaaaataacgataccgacacctcgcgcattatccgcatgtgcgaacgctgcctgaccctggggctggcgtggtacttcactggtcagcgccactatgcccaggcggcggccgcgcagatccgctgttggttcctggatccagagacgcgaatgaacccgcatctgaactatggtcaggcaatcccggggattgtctccggtcgcggcaccgggctgatagatacccgattaatgtggatggtggtcgataccatcggcttgattagcccggcgaacgtgctggataccgacgatattatcggcctgcaccagtggttccgggattttaaccactggatgtactacagcgaaatcggccattcagagtatgtctggcacaacaaccacggcacctggtacgacgcccagcggacggttaacgcgctattctacggcgataaaggactggcggcgcggatcattgcgcaggggatcacccagcgaatggcggcgcagattgaccaggatggcaagcagaccatggagcttgagcgcaccattcctttccattactcgctgtttaatctggaggcgcatctgctgctgaatcgctatgccgagcatgtcgaattcgatcgctggaacaccatccgcgacgggcgaggagtgaagcaggggatagattacctggtgccgtttatccgtgaacccgatctctggccgtacagtgacctgcagggcattgtgtgggatagtgcgctgcgggtgctgctgcagtcagcccgtggttatgcaaaacaatccgccagctatcgcgatgtgctgaaatgcctgccgcaggagacgctgcagttgaaggaacagctgatgtggtgtccgggtttgtaggcctgataagcgcagcgccatcaggcattaggtgcacgttgccggatggcggcgtgccgccttatccggcctacagataccgtgtctcgccgacctcgggaggcacggtataacgagttacaccgcggcgataattttgatctcaactttatactgcgggttcatcagcgtcgcttccaccgtgcagcgcaccggggcgtgaccagccaccacccacgcgtcccaggctttattcatcgccgcaaagtcgcttttatcggcgaggaagatggtggcgtcaagaatacgcgacttgtcgctgccctgtttttccagcaccgcgtcaatctgcgccagggtattggcggtctgctcgaaagcgtcggcatcgagatttgccggcacgccggtgtagtacagggtctggttgtggatcaccacgtctgaccaacgggcttcggcatcaatacgcgtaattgtcattgctttttcctctttaagcattccattcggctgcggcaagactgccataatgtgccgctcgcgtcactacccggactggcgaaacgccgtcctccctgacataatcactgtccaaataaccagggggcaatgtgatcgacgattttgcagcagacggccagctagccaaagccataccgggatttaaaccgcgcgagccgcagcgccagatggcggtggcggtcagcgaagcgattgaggcctcccggccgctggtggtggaagcggggaccggaaccggtaaaacctacgcttacctggcgcctgcgctgcgggcgaaaaaaaaggtgattatctccaccggctcgaaagcgctgcaggatcagctttacagccgcgatctgcccaccgtcgccaaagcgctcaaattcaccgggaaactggcgctgctcaaagggcgctccaactacctgtgtctcgaacgtcttgagcagcaggcgctggcgggcggcgatctgccggtgcaaaccctcagcgatgtgatcctcctgcgctcctggtcgaatcaaacccaggatggcgatatcagcacctgcgccagcgtcgcggaagactctcaggcctggccgctggtgaccagcaccaacgataactgtctcggtagcgactgcccactgtataaagattgcttcgtggtgaaggcgcgtaaaaaagcgatggacgccgacgtggtggtggtcaaccatcacctgtttctggccgatatggtggtcaaagagagcggctttgccgagctgatccccgaggcggaagtgatgatcttcgatgaagcccatcagctgccggatatcgccagtcagtactttggccagtcgctctccagccgccagctgctggacctggcgaaagacatcaccattgcctaccgcaccgaactgaaagacactcagcagctgcaaaaatgcgccgaccgcctggcgcaaagcgcgcaggatttccgcctgcagctgggagacccgggctaccgcggcaatctgcgcgagctgctggcggacagccacattcagcgagcgctgctgctgctcgatgacgcgctcgagctatgctatgacgtcgccaaactttcgctgggtcgctcggcgctgctcgacgccgcttttgagcgcgccaccctctatcgcgggcgcctgaagcggttgaaagagatcaaccagccgggctacagctactggtatgagtgtacctcgcgccactttactctcgcgctgacgccgctgaccgtggccgagaagtttaaagaggtgatggcgcagaagtcggggagctggatctttacctcggcgacgctgtcggtgaacgacgatctgcaccactttaccgcccggctggggatcgacgaggcgcagactctgctgctgccgagtccctttgactatcagcaccaggcgctgctctgcgtgccgcgcaacctacccctgccgaaccagcccggcgcggcgcgacacctggcggcgatgctcaagccgctgatcgaggccaacgatggtcgctgctttatgttgtgcacctcgcacgccatgatgcgcgatctggcggagcagttccgcgccaccatgacgctaccggtgctgctgcagggcgagaccagtaaaggccaactgctgcagcagttcgtcagcgccggcaacgcgctgctggtggctaccagcagcttctgggagggagtcgatgtgcgcggcgacgcgctgtcgctggtgattatcgataagctaccgttcacctcgccggacgatccgctgctaaaagcgcggatggaagattgccggctgcgcggcggcgatcccttcgatgaagtgcagctcccggatgcggtgatcaccctcaagcagggggtgggtcgcctgatccgcgatatcgacgatcgcggggtgctggtgatctgcgacaaccggctggtgatgcgcccctacggcgcggtgttcctggccagtctgccgccggcgccgcgaacccgcgatatccgtcgggcggtgcgctttctcgccgtaccgccggcaaggtaatccgcactaaaatgtgttaagctgcgcgccattttgttaattagcggttcccaatagacttcgggcggcatggcggcgggtttgccgtttgccggaaatcaggctgcctgaaggcctgaactatgtaacgagagcgtgaccacccatgcgaattttggctatcgataccgccacagaggcctgctccgcagcgctgtggaatgatggcacccttagtgctcatttcgaaatttgtccccgcgaacatacccaacgtatcctgccgctggtgcaggaggtcctcaccgagagcggcaccaccctgagcgagctggacgcgctggcctttggccgcggtccgggcagctttaccggcgtgcgcatcggcatcggtatcgcccaggggctggcgctgggcgccgaactgccaatgattggcgtttccacgctggccaccatggcgcagggcgcctggcgcaaaaccggcgccacccgtgtgctggcggccattgatgcgcgtatgggcgaagtctactgggccgagtaccagcgcgacgagcagggcgtctggcatggcgaagagacggaagcggtgctcaaaccggacgcggtagctgaacgactggcacagctttccggcgaatgggccaccgtcggcaccggctggcaggcgtggccggatctggcgaaagcgagcggactgaccttaagcagcggcgaaattgaattgccggcggcggaggatatgctgccgttagcctgttacctgctggcggcggggaaaaccgtggccgtggagaaagcggagccggtttatttgcgaaacgaggtggcgtggaagaaacttccaggccgcgagtgaatctcagtaacaagaagactgagaaaaggagtcgcatcatggcgggtcaaaaacagggcgttcgctggctgctggccgcagcgattgccgttgcgctaagcggctgcgtatcggtgccggatgccatcaaaggcaccagcccgacgccgcagcaggatttggtgcgggtgatgaacgccccgcagctgtacgttggccaggaagcgcgctttggcggtaaggtggtcaatgtgcaaaaccagcaggggaaaacccgcttagaaatcgccaccgtaccgctggacagcggcgcgcggccagtgctgggcgagccgtcccgcggaaggatttttgctgacgtcaatggcttcctcgatccggtggatttccgcggtcaactagtgaccgtggtcggaccgatcgccggggtggttgacggcaaggtgggcagcacgccgtataaatttatgctaatgaacgccaccggctacaagcgctggaacgtagtacagcaggtggtgatgcctccgcaacctatcgacccgtggatgctgggtccgcgcccctggggctacggctatggcggctggggctggtacaatcccggccctgctgaggtgagaaacgttgtaaccgaatgattttgttgtttatgttagttcaaagaaacagcggccggtccgctgtttctttgttttcagtcgaataagaaaaaaaatagtgacgcgcttcgcaacctgctcattgcctaattaataaactggtacgctgagttaatataatgttaacaaaatgtattatccaggggctgtgatgacgacgaataactatttcagaggtgatgcagtgaaaaaggtttggctaaaccgttatcccgcagatgttccggcggagataaatcctgaccgctatcaatccctggttgaactgtttgaacatgccaccacccgttacgccgaccaaccggcgtttatcaatatgggtgaagtgatgacctaccgtaagctggaggagcgtagtcgcgccttcgccgcttatcttcaggaggggttggggttacagaagggcgatcgcgtggccctgatgatgcctaacctgctgcagtatccggtggctctgtttggcatcctgcgcgccgggatgatcgtggttaacgtcaaccccttatataccccgcgcgaactggagcatcagctcaacgacagcggcgcggcggcgatcgtcatagtctccaactttgcccataccctggaaaaagtggtggcgaaaactcaggtccagcatgtgatcctgacgcgcatgggcgaccagctttccaccgccaaaggtacgctggtgaactttgtggtcaagtacattaagcgcctggtgccgaagtaccatctgccggacgccatctcgtttcgcagcgcgttgcagcacggctatcgcatgcagtacgtcaagccggagatcgttgcggaagatctggcgtttctgcagtacaccgggggcaccaccggcgtggccaaaggtgcgatgctaacccaccgcaatatgctggctaacctcgagcaggtcaatgccacctacggcccgctgctgcatcgcggcaaagagttcgtggtgaccgcgctgccgctgtatcacattttcgccctgaccatgaactgcctgctgtttatcgaactgggcgggcaaaatttgctgatcaccaacccacgtgatatccccgggctggtgaaggagctggcgaagtatccttttaccgccatgaccggggtcaataccctgttcaacgccttgctgaacaacaaagagttccagcagcttgatttctcctcgctgcatttgtccgccggcggtgggatgccggtgcagcaggcggtggccgagcgctgggtaaaactgaccgggcaatatctgctggagggctacggcctgacagagtgttccccgctggtcagcgttaacccgcacgatattgactaccacagcggcagcattggcctgccggtgccctccaccgaagccaaactggtggatgatgatgataacgaagtggcgccgggtcagccgggcgagctctgtattaaagggccgcaggtgatgctgggctactggcagcgccctgacgcgacggatgagattatcaaagacggctggctgcacaccggggatatcgcggtgatggatgaagaggggttcctgcgcatcgtcgatcgcaaaaaagatatgatcctggtgtcgggttttaacgtctatccgaacgaaatcgaagatgtggtcatgcagcatagcggggtgctggaagtggcggccatcggcgtgccgtccggcagcagcggcgaagcggtgaagattttcgtagtcaagaaagatgctgcgttaaccgaagaggcgctgattacgttctgccgtcgccatttgaccggatacaaggtgccgaagctggtggaattccgtgacgaactgccgaaatccaacgtcgggaaaattttgcggcgagaactgcgtgacgaagcgcgcgctaaagtggacaataaaggctaagtaacgaatgagtcgcctgacgccggctacgccggcgttttttatgggcgcaagttaagagagtatgctttgaactatcagatgatcaccaccgacgatggcctgcgcgctgtctgcgaagcggcaagcacggcctccgccgtcgctctggatacggaatttgtccgcacccgcacctattacccgcagctgggcctgctgcagctgttcgacggccagcaggtctctctgatcgatcccttgacgattaacgactgggcgccgatgcgcgacctgctgctcaaccaggatgtgactaaatacctgcatgccggcagcgaagatttagaagtcttccttaatgcatttaacctgatgccgcagccgctgattgacacccagatcctggcggccttctgcggccgcccaatgtcctggggcttcgcctcgatggtggaagagtattccggggtagcgctggataaaagcgaatcccgcaccgactggctggcgcgcccgctgactgagcgtcagtgtgaatatgccgcggccgacgtctggtatctgctgccgatcgccagccagttaatggcggagaccgatcgcgctggctggctgccggcggcgctcgacgagtgccgcgtgatgcagcagcgtcgtcaggaggtggtcgacccggccgaggcctggcgcgatatcggcaacgcctggcagctgcgtacccgccagctgggttgtctgcagctgttggcggagtggcgcctgcgcaaagcgcgcgagcgcgacctggcggtaaactttgtggtgcgggaagagcatctgtggagcgtggcgcgctatatgcccaccagcctgggcgagctcgacagcctcgggttgtccggtagcgaaattcgcttccacggcaaaacgctgattagcctggtcgaaaaagcgcaggcgctgccggagtcggccctgccagcgccgctgcagaacctgatcgacatgccgggctaccgcaaagcctttaaagatattaaagcgctggtgcaggaagtgagcacggagaagggcgtaagcgcggagctgctggcgtcgcgtcggcagatcaaccagctgctgaactggcactggcagctgaaaacgcaagccggtgaacctgagctgatttccggttggcgcggggagctaatggccgagcggctgaagaggctgttaaacgactatccgcgctagttcgcggccaggttcagaccattaaaaaaccggcggcgcgtggcgtagccggttttttttcgcgatagcgcgacaggtcaggatttcgactcttccgtttcgggtagggtcacgttcagctcaagaatggatatatccccgtcccgctgctccagctgcacgctgaccatctccgggtcgatctgtacgtatttacagatcacttccaggatatctttgcgtaactgcggcaggtaatgcggctccgcgtctccgcggcggcgctcggcgacgatgatttgcaggcgttctttcgcaatattagccgtgttcttttttcgcgagagaaaaaagtcgagtaaagccataatttatcctccgaacaggcgtttgaggaatcctttcttctcttcttcaatgaagcggaaagggcgttcttctccgagcagacgttcaacggtatcggcataggctttgcctgcgtccgaggcggcatcgaggatcaccggctcaccctggttggatgcgcgcaggactgactggtcttccgggatcacgcctaccaggttgatgcgcagaatttccagcacgtcttccatgctcagcatatcgcctttattaacgcggcctggattgtagcgggtcagcagcagatgctctttgattggctcttcgccattttccgcgcggcgggatttagaggcgagaatgccaaggatacggtcggagtcgcgaacggaggagacttccgggttagtggtgatgatggcttcatcagcaaagtaaagcgccatcagcgcaccggtttcaatgcctgccggggaatcacagacgatgaaatcgaattccattttcttcagttcttcgagaaccttgtcgacgccttcgcgagtcagagcgtctttatcccgggtctgggaagccgggagaatgtagaggttttccgtgcgcttatctttaatcagcgcctggttcagtgtggcatcgccctgaatgacgttgacgaaatcataaacgacgcgacgttcgcagcccataatcaggtcgaggttacgcaggccgatgtcgaagtcgataacgacggttttctttcccttctgggccaaacctgtagcgatggccgcgctggaggtggtcttgccaacgccccctttacccgaagtcacaacaataatgcgtgccatagaaattccttgttaaaaagggattaatttaacggttgaattgccaaagcgctttcacctaaacgcaggcgcgccgctttgccataaaattcggccgggatgttatcgctcagccaatattccccggcgatggagaccagctccgccgcaaggtgggtacaaaatatctgggcgtctctgtcgccaccggcgcctgccagcgcacgtcctcgcatcatgccatatacatggatatttccgtcagcgataagttccgcaccggcactcacatgatttgtaacaataagatcacagtgtggcgcataaatgcgctgaccggaacgtaccggctgatcaatcaaacgcgtttttgtgatctgactagcaactggcggcggcggggtgggttcggacggtgccggacgagaggctttttctttcccttcggttaataacgggatgccggcgcggtcgatttcggttttcaggcgcggaattttgcatccgctaacgcccataatacgtaaaccggtcgcggcgatagcctcgttgatggcgcgccattccacctcctcctcgatgctggcgatattcaccaccaccggagcatgacgtaaaaaagcgggagcctgggcgattttgtcttctaacgcctgacgaataacctcgggatttgcatcgtgcaaatgaacgacagataacgtgaagctactgcctttaagttcgattggcgtatttgacatcctggccttactcaatttgctgtttatcaaccgccgaagtgcggtgatattccgaagactaaaaggcatgttatagtcactcatatattgaggcaagtgaccacgggtctaattccgagtaaaactatgttttgtgtgatctatcgaagtactaaacgtgaacaaacctatttatacgtcgaaaaaaaggacgatttctcgcgcgttcctgacgagctaatgcgcagctttggcacgccgcaaatggcgatgctgctgccgctggatgggcgcaaaaaactggttaacgccgatctggaaaaagtgaaacaggcgttaagcgaacagggctattacctgcaactgcctccgccgtctgaaaatctactaaagaaacacctggcggaacaggggaaacaatccgattaacccacgagggaaaataatgtaccaacatcataactggcagggtgcgcttctggattatccagtaagcaaagtggtttgcgtcggcagtaattatgcgaaacacatcaaggaaatgggcagtgcgacgccggaagagccggtgctgtttattaaacctgagactgcgctgtgcgatcttcgtcagccgttggtgctccctgaggggctgggctcggtgcatcacgaagtcgagctggcggtgcttatcggcagcacgctgcgtcaggcgacggaagagcatgtgctgaaagggattgccggctatggcgtcgcgctggatctcacgctgcgcgacctgcaggcgaaaatgaaaaaagcgggacaaccctgggagaaggccaaaggcttcgataacgcctgtccgatctccggctttatcccggccgctgagttccacggcgacccgcagaatacgtcgttaagcctgaagattaatggcgaagtgcgccagcagggcaccactgccgacatgatccataggattgtgccgctgatcgcctatatgtcgcgcttctttaccctcaaagccggggatgtgatactcaccggcaccccggaaggcgtggggccgctgcacagcggtgacgagctggaggtcggcttcaacggcctggcgctcactacccgcgtgctgtaagcgctatttgccgccttttggggcggcaaaacttgcatcggcgtgccagactggttataaggtgcacccttaactggcaacgacggacactccgatgagcgaacaacctttctggcaacaaaaaacactggatgacatgagcgacgcggagtgggaatcgctgtgtgacggctgcggccagtgctgcctgcacaagctgatggatgaagacactgacgagatctacttcaccaacgtcgcctgtcgtcagctcaatatcaaaacctgccagtgtcgtaactacgcgcgtcgctttgagtatgagccggactgcatcaagcttacccgcgaaaatctgccgaccttcgaatggctgccgccgacctgtgcctatcgcctgctggcggaaggcaagcctctgccggcctggcacccgctgctgactggctcaaaagcggcgatgcacggcgaacgcatctccgttcgccatattgcggtgcctgagtccacggtggtcgactggcaggaccatatccttaatctgcctgacagggcgcgctaagcgccgtcacgctttcttcgcgtggaacagcccgttttcaccgtcggtttcttccgccacccagaagtgaatattgaagcgggcgtcgtcactgagttcgacgcggtgccagtactgcggcggactggtagcaaactgcccggcatgaatcacgacttttttctccggctccgtcgcctgttcattggcaaaaccgtaataggtcaccgttccctccatgacgcacagctggccgaagacgccagccgcggtgttgtggtggctcagcagggcggcagggacattctctttggtaaagaatggggtggagcgtttaactttccagtctgcggggatcagtaaagatgacatgtgagctcctgtggggttttaaaagatgtatttaatatgcaccttttaatggctatggtcaaccatagaggtcaaccatagacgggaaacgattcagcgatgcgcaggaggcataaaaaaacgccccgcagggcgtttcattgtgggctgtactcgccgcggcttaacgaccaaacagatcgcgttttttcgctttgaaaggctgagcaacgatcaccagaatagcgaccagcagataggcggcgaaaatccccaccagccattgcggcatctccagcgacaggaactgccactgacgtactgagcagtctccggacgcaacgaaaacctgcggcagccatttatccagcggcagccaggttgggaagcgggcggcgaaatcgcaggtctggaacggtgaagggtgcagctggagcatcgtatgctcccacgccagctgtagtccgcgtatcgcgctgtacaaccagattgccatggcgacatagcgcagcggcgttttgggggcgatagcgcccaccagtcccgcgcccatgatgccgaacagcgcgcagcgttcgtaaatacacatgacacacggctgcagcagcatcacgtgctggaaccacagcgcgacaagttcgagaataaaagcggtcaacgccatcaggagccaggcaccgcgtcctcttgagcactggtttaaatattgcaacataatcatttccctggaagatgctaaatcatggcagtgtaaacgaaaaccgaaccgacgccagaggcgcggcggaaaatattccgtaacgggttattgatgcgcccgggcgaacccgggcaaaaactgactcagggtaggctgggcgtcaccagccagccgtgcgccagcagccagtcggtgactggcatcagggtgaactcgacgcataacaggccgaccagcgtcagtacgatggtgtagggcagcgccatccacaccatacggccataggagagcctaataagcggcgccagggcggaagtcagcaggaagagaaacgccgcctggccgttcggagtggccaccgagggcaggttggtgccggtgttgatcgctaccgccagcatctcaaactggggcaggctgatggcgccatgttcgagcgccgctttcgcttcgttgatgtagaccgtgccgacaaacacgttatccgaaatggacgacagcaggccgttgaacagataaaacagcgacagctgcgcgtgcggcgaggcctgcaggacaaactcgatcaccggcgtgaacagctgctgatcgatgataaccgcgacgatggagaagaagaccgtcagcagcgcggtaaagggcagcgcctcggtgaacgccttgccaatggcgtgctcatcggtaacgccggtaaaggtggtggcgaggatgatcaccgacaggccaatcaggccgacctcagccaggtgaaaagccagggccacgatcagccaaacgccaatgagcgcctgggcaatcagccgcagtcgctcctgacggctgcgctgggcgcggctgcgatcgtcaaactcctgcagcaccttgcgcaccgtcggcggtagcggttcgccgtagccaaacaggcgatacttttcgaccagcagacaggttaacagaccgcagaccatcaccggcagggtcacgggcgccatgcgaagaaagaactcgccaaaatgccagcccgcggctttggcgataatcaagttttgcggctcgccgaccatggtcatgacgccgccgagcgcggtcccgacgccggcgtgcatcatcaggctgcgcagaaagccgcggaactgctccagcacctcacggtagtgctgctcgatatggctgtcatcgagcaggtcgctatcgtccgggcgcgccgaggcgacgcggtgatagatgccgtagaacccgacggcgacgctgatcactaccgccaccaccgtcagcgcatcgagaaaggccgagaggaaggctgccgccaggcagaaggccagcgatagcagcattttgctgcggatccccagcagcaggcgcgtaaacacgaacagcaaaagctgtttcataaagtagatacccgccaccatgaacatcagcaggagcagcacctccagattgccggcgatctcttcccggacgtgcgccgggctggtcatgccgatcagcagcgcctcgatagccagcagaccacccggcagcagcggatagcacttcagcgccatggcgagggtaaagataaactcgaccaccagcagccagccggcgacaaacggcgccacggcgaacaccagcggatttacgattaagaaaatgattaatgccagcttgtaccagtccggcgactggccaagaaaattgcgccacagcgcgcggccataagaaatttccacgacagaatccttccccgtcaatgagtgcatggttttgtgcataacgattggcaagagtaccagttgagcaaaatgagaagcaactttcttcgcgccgcgctggcggtttgtgaagataaggaaaagcgcaaagtaaaagcggaaaatgaaacggcgatccctttttaattcacttgccatgctatctgcgctatagcggctctggtatgatgagtgcaattgtaacgctgtgtaatggaaatcttactatggtcattaaggcgcagagccctgcgggtttcgcggaagagtacatcattgagagtatctggaataaccgcttccctcccggatcgattctccccgctgaacgcgagctttctgagctgattggtgtcacccgcacaaccctgcgcgaagtattgcagcgtctggcccgtgacggctggctgaccattcagcatggtaagcccactaaagtgaataacttttgggaaacctccggcctgaatatcctcgaaacgctggcgcgcctcgatcacgacagcgtaccgcagttgattgataatctgctctccgtgcgcaccaacatttccacgatttttatccgcaccgcgtttcgccagcatccggataaagcgctggcggtcctggacagcgcccgggaggtggaggatcacgccgacgccttcgccgagcttgattataatattttccgtggtctggcgtttgcctccggcaacccgatctacggtctgatcctcaacggcatgaaggggttgtatacccgcatcggccgccactatttctccagcccggaagcgcgcagcctggcgctcggtttctatcatcagctggcgaaagtgtgtgaggctggcctgcatgaccaggtttacgagctggttcgtcgctacggccatgacagcggcgagatctggcaccggatgcagaaatcgctgcccggtgatttagccatgaatatgcgttaagcgggcttttcgcgatcgatatacagaacaagggggccaatggccccctttgttattttactcgccccgcaatgctatagcgcgttcggccgcgccgggcagcggtccaacagctcaatgctgccgtcggcgttctgttgctccagcagcacatcgaacccccacagacgatgcacatgcttcagcacttcgcgccggcctttgtccagcgggacgcggttgtgcggcacatagcgcaaggtcagcgatcggtcgccgcgcaggtcaacgttccacacctggatattcggctcaagattgctgaggttatactgcgcggagagcttattgcggatctcgcgataaccctcttcgttgtgaatcgccgagatctccagataattgttgtgatcgtcgtcgagcacggtaaagaagcggaaatcgcgcatgatcttcggcgacaggaactgactgataaagctttcatccttaaagtcgcgcatggcgaaatgcagcgtttccagccagtcagaaccggcgatatcggggaaccagtacttatcctcttccgtgggcgactgacagatgcgcttgatgtcctggaacatggcgaagcccagcgcgtaggggttaatcccgctgtaccacggactgttgtacggcggctggaacaccacgttggtatggctgtggagaaactccagcataaagcgctcagtcactttcccttcatcgtagagatggttgaggatggtgtagtgccagaaggtggcccacccctcgttcatcacctgggtctgtttctgcgggtagaaatactggctgactttacgcacgatgcgcaggatctcgcgctgccacggttcgagcagcggggcgttcttctccataaagtacagcaggttctcctgcggttcggaagggtagcgacgagcggattcaatcgctttttcttcctcgcgcttcggcagggtgcgccacagcatattcacctggctttgcagatactcttcccggcttttctgccgcgctttctcctcctgcagagagattttttgcggacgtttatagcggtcgacgccgtagttcatcagcgcgtggcaggagtcgagcagtttctctacttcgtcgacgccatagcgctcttcgcactcggtgatgtacttacgggcaaagatcagatagtcgatgatcgagctggcgtcggtccagctgcgaaacagatagttatttttaaaaaacgagttatgcccgtagcaggcatgggccatcaccagcgcctgcatggtgatggtgttttcctccatcaggtaggcgatacaggggttggagttgatgactatctcatacgccagaccctgctgaccgtgcttataggcctgctcggtctcaataaattttttgccaaacgaccagtgcggatagttgatgggcatgccgacgctggagtaggcgtccatcatttgctcggaagtaatgacttcgatctggtgcgggtaggtgtcaagacgatagagcttggcgacccggtccacttcggccaggtaggtttccagtaactcgaacgtccagtcgggtccatcgcttaaacgggtggtgtccctgttcatggagtcaatcgtagccattagcgcgccctcgttgttgttggttttctctgaacggaaaacctctaaacaagcatagaacacggtgcagcaaactgtgctgtacgccaatcgcttttcttcgcgatttccccatctcaaagccgtttttttgccttgtttgcagaatttaatgctgggtaaaaataaagcgcagcatgagatcgtaaatctcacagcgcagggctggtgcggtttgctgtgagttaagtcaccataaataaagcgtatgttgaataatattttcaactgagttatcaatttgtaattagatgattgttctttaactgttacggagtcgctatgcgtgtcgtcatactgggaagtggggtggttggggtagccagcgcgtggtatttgagtcaggcgggtcatgacgtgacggtcatcgaccgtcagcccggtccggcagaggagaccagcgcggccaacgccgggcagatttctcccggctatgcggcgccctgggcggcgccgggggtgccgctgaaggcgatcaaatggatgtttcagcgccatgcgccgcgggcgatcggtcttgacggcacctcgttccagttgaagtggatgtggcagatgctgcgcaactgcgacacccgccactatatggagaacaaaggccgtatggtgcgcctggcggagtacagccgcgactgcctgaaggcgctgcgcgacaccaccggcattcagtatgaagggcgccagggcgggacgctgcagctgttccgtaccgccaaacagtatgaaaatgccacccgcgacatcgcggtgctggaggacgccggcgtgccgtatcagctgctggaagcgaagcggttggcggaggtggagccggcgctggcggaggtcagccacaaactgaccggcggcctgcgcctgccaaatgatgaaaccggcgactgccagctgtttaccacccgtttggcggcaatggcggaacaggccggcgtgaccttccgcttcaacaccgcagtggatgcgctgctgcacgagggcgatcgcattgccggggtgaaatgcggcgatgagattattaagggcgacgcctatgtgatggccttcggctcctactcgacggcgatgcttaaagggctggtggatataccggtctacccgctgaaaggctactcattaactattccgatcgctcaggaggacggcgcgccggtttcaactatccttgatgagacttacaaaatcgccatcacccgcttcgatcagcgcattcgggtcggcggcatggcggagatcgtcggttttaacaaagcgctgctgcagccgcgtcgcgaaaccctggagatggtggtgcgcgatctgttcccgcgcggcggccacgtggagcaggcgacgttctggacgggcctgcggccgatgacgccggacggcacgccggtggtcggccgcacagcgtataaaaatctgtggctcaacaccggccacggcacgcttggctggaccatggcctgcggctccgggcagcttatcagcgatctgatctccggccgcacgccggcgatcccttacgacgatctggcggttgcccgctacagccccggttttaccccggcgcgcccgcagcacctgcacggcgcacacaactaaggagcttgcatgacccgtccggtagtggccagcatcgacctgctggccttgcggcagaatttacagatagtgcgtcgcgcggcccccgggtcgcgcctgtgggcggtggtcaaggccaacgcctacggccacggcgtggcgcgcgtatggagtgcgttaagcgcggcggatggtttcgccttgctcaacctggaagaggcgatcctgctgcgcgagcagggctggaaaggcccgatcctgctgctggagggcttcttccatgccgatgagctggcggtgctggatcaatatcgtttaaccaccagcgtccacagcaactggcagattaaggccctgcagcaggcgaagctgcgcgcgccgctggatatctatctcaaggtgaacagcggcatgaaccggctgggctttatgcctgagcgggtccacaccgtctggcagcagctgcgggcgataagcaacgtcggcgagatgacgctgatgtcgcacttcgcggaggcggagaacccgcagggaattgtcgagccgatgcgccgtatcgaacaggcggcggaggggctggattgcccgcgctcgctggccaactcggcggcgaccctctggcatccggaagcgcattttgactgggttcgtccaggcatcgtgctgtatggcgcgtcgccttccgggcagtggcaggacatcgccaacaccgggctgaagccggtcatgacgctgcgcagcgaaatcatcggcgtgcagaacctgcgccccggcgaggcgattggctatggcggcctgtaccgcaccacccaggagcagcggatcggcatcgtcgcctgcggctatgccgatggctatccgcgggtggcgccgagcggcacgccggtgctggtggatggcgtacgcaccactaccgtgggacgcgtatcgatggatatgctggcggtcgatttaacgccctgcccgcaggccgggatcggcgcgccggtcgagctgtggggcaaagagattaaaatcgacgacgtggcggccagcagcggcaccgtcggctatgagctgatgtgcgccctggcgccgcgggtgccagttgtgaccctgtaacctattccggggcggatcactccgcctcgtcttccgcgacccgcaccccaaccttcagcacgtgatcgttctctttttcagctaccgtccacaccatcccggcgaactccacctggtcgcccaccaccggcgccgcgcccagcagctgctgcaccacttccccgagcgactgctgatgctcgcggaactcctcaccgccgtcgagaccgtagatttgcgccacatcggcgaagcgggcctcagcatcaagaatgaagtcgccgaaaaagcgctgatcgagcgccaccggcggcgactggctgaacattttgccgagcgccggcaggtcgtgctcccgaccaataacgcacaggatatcgccttcccgcaggcgggtgctgccggtggggtgcagcaggacattgttgcgaaacagcgcggcaatccgcgtctccggtggcatgtgcaagtcgcgcagcgccgcgccgatgcaccacttatcggcccccagctggtagacaaactgctcccacgggttttccgggtgaatatccagcccgacgcgggagatgggccagctgatgggcggcaccaccactttggcttttttcgccgcccacgacagcgaagtgccctgcagcagcagcgacaccagcaccacgaagaaggcgacattgaagaacaggcgggcgttgtccaggccggccatcatcgggaacaccgcgagaataatgggcaccgcgccgcgcaggccaacccagctgataaacacccgttcgcgcaggttaaagccgcgaaacggcagcaggccggcaaacaccgacaggggccgggcaatgaatatcatccacatcgacagcagcagtgccgggatagcgatcggcagcaggtcggagggcgtcaccagcaggcccagcaccaggaacatggcgatctgcgccagccacgccaggccgtcgaagttctgcaggatgccgtgccggttgcggatcggccggttgcccagcagaaagccgcagagatagacggcgaggataccgctgccgtcgagggaggtggtgacggcaaaaatcatgatcccgccgctcagcgccagcagcggatagaggccggcgggcagcacgatgcggttaatcatctgcagcagcaggtagccgccgccgaggccgatggcgatcccgaggccgaactgctgaatgatatgcacggcgaacatccagctgaggccggtttggtgctgctggatcatttcgatcagggtgatggtcaggaagaccgccatcgggtcgttactgcctgactctatccccagcgtcgagccgacgcgctcgttgagccccttgccgccgagcagcgagaagaccgccgcggcgtcggtggagccgacaatggcgccgatcagcaggccttcgatcagatccagcttgaacaaccaggccgccatcatcccggtcagcgccgaggtgatcagcaccccaaccgtcgccagcgacagcgcgggccacagcgcgacgcgaaaggagctggcctgggtgcgcatcccgccgtccagtaggatcaccgccagcgccaggttactcaccatataggcgaaggggtaattgtcgaaggggatgccgccgatgccgtcaatgcctgccagcatcccgatggccagaaagatgaccagaatcgggatgccaaggcgcgaagaaaaggagctcaataagatactgcaggttactaaaacagaacccagaataaacagactaatgaccgcagcggcgtccaatgttcacgtactccctgactggcgtgaaaaaatggctaaaagtgacactattttaacaattcgcaggggatccgcctatgcgttcgggaaatttattctgtcagcaccggatggccgccgatcgtcagggtggtggccgccgcctgattcaccaggcgcgcgcgggcgcccagcggcagggtcaccgtgcgctgctcgtggccaaactccagtccgctaatcagcggcagggatagctgctggcgcagataatcaaagacctgcggcaaatcgtatcccgcgtcatagtcgttcggcgcgctgccggtgaagctgccgaagatcaccgctttctgcgccgccagcacgccgctgtgcaacagctgaagcagcatgcgctcgacgcggaacgggtgctcattgatatcctccaccaccaggatgccgtcgcggatcgccggcagccacggcgtgccgataagcgaggtcagcatcgccagatttcccccccacagggtgccttccacccggcagttcggcccttcgcccggccattcgagggtgaattccggctggcgtagcgcctgccagaaatggtgctcggtaaacgggtcgagggtctccgcgccgaagttgccggcgagcattggaccgctgaaggtgatgacgttgcccatggccagcaggcccgactggatagcggtgaaatcgctgtggccgcaaatcagcagcgggtcgcgctgctggcgggcaaccagcccctgccagtcgatatgcggcagcaggcgactggcgccgtagccgccgcgtacggcgaggacgatccggttgcggccgggcaactgggccagctggttaatatcggccagccgttcatgttcagtcccggcgaaacgctgctgccggcggggaatgacctgctggtgggccacctcgtgtccggcctgctgcagacgctcgacgccgcgggctgccgcctgctggttgatgcaatacccggatggcgcgaccagataaaactgagacatgataattccttgctatgaatgaaagggttatgatgccgcctggaatggcgattgtcatctccaggtggctaacttcagtccgcacccgtcatccttcaggttgtcggcaggcgggagacgtaccgcggccgtcgttctgtagcatgatggcgtttgggtagataaggatagatgtgtgaaattgagatggttgcttattttagtcgtttttctggccggttgtagttcgaaacatgattacactaacccgccgtggaaccccgaggtcccggtgaagcgggcgatgcagtggatgccgatcagtgaaaaagccggcgccgcctggggcgtggatccgcagctgattacggcgatcatcgccatcgagtcgggtggtaatcctgcggtggtgagtaaatccggcgctgtcgggctgatgcagctcaagccctcgacctccggacgcgatgtctatcggcggatggggtggcgcggcgagccgtcggtcagtgagctgaaaaacccggaacgtaatatctcgatgggggccgcctatctgagcattctggagaacggtccgctggcggggatcaaagacccgcaggtgatgcgctatgcggtggtggtctcctatgccaacggcgctggcgcgctgctgcgtaccttctcctcgaaccgccaggacgccatcgaggagattaacgatctcgacgccgatgagttcttcgaacatgtggtgaaaaaacacccggcaccgcaggcgccgcgctatatctggaaactacagaaagcgctggacgccatgtaatccctcgtttggcctccggtagtctcccggaggccacgtcctcagaaatcgtagcccacggtggctataacgctgcgctctgctccccagtaacagttgccggtgccatagcagccggaaatatactcgcggtcgccgatattgttggcgttaacctgcacataagcgcctttcagcgttggcgaccagacgctgaggtcggcccgcatcatggcgtccatcagcgtgaccgacggcagccgcgcggtgttggcatcatccgcccactgtttaccgatgtagcggacgccggcgccaacggagatccccgccgggaactgatagcgcgcccagaaggaggccatctgatccggggtcagctgcggcgtgttattgtcggtcccgtctttggtgtcctggaaacgcagacgattccaggtatacgaggcgatagtactcagctgcggggtgatctggtggtgcgcttccagctcaacgccctgggaatggaccttacccgccggaatataggtggcggtggcgatgttcgggtcgcgagtggcgacatccttttgcgtcaggtcgtaaatcgcgatgctatagagatcgctgctgcccggcggctggaacttcaggccggcttcaacctgttcggcggtggtcggtttcaacggtttgccgtccgcgcccggcagcatcgccggagtgatcgcctggctgtagctcaggtagggcgacagaccgttgtccagggcgtacaacagcgaggcgcggccgctgatatggtcgtctgaacggcggtttgaggtcccctgggtatcgctgacctgctgggaaacgatgcggtcgtagcgggcggaaacatccacatgccagcggttccagaccatctcatcctgcagatacagcccggtctggtaatagcggcgattattgtcgtcgctgtaggtaacggtatgtccggtctgcgcggtatagccgctaaacgggttaaggggcgccgcgccgccggcgccggtccacaggtcgttacggaagcgatgatattcggcgccgaggatcagggtgtgtgccaggtcgcctgtattgaaatcggcgcgcaggcggttatcggttgaccagccgtccagcgaaccgcgcgaaccgctgtagccgcgggccagcatgtcgctgtcatctatccagccgacctggtagacctgatcgagggagacgttggtatgggtgtagctcccggcggaatagaccgaccagacgtcggtgaactggtggtcaaactcatagctgtagatctgctggcggcgttgatagccatctcccggatcgccttcgttggtgctgggggagagcttacggccattgtgcgcgtagcgggtgccgtccagcggcaaagagccgtggtagccgccggaaggatctttttgcagataggcgcgcagcagcagcgaggtgtcgctgtccggctgccacagcagggaaggcgaaatcgcgtagcgctcttcgcgggtatggtcatactgcgtgtcgctgctgcgggtcatcccgatcagccgccatgcccactggtcattgatggcgtcggtgtaatcgaaggccgcgcctttggtattttgcgtgccgccggtcaggcggatgtggccctgctgactgaactgcggacgtttggaagtcaggttgaccacgccgcccggcacgctctgcccgtagagcgcggaggaggggccgcggatcacatccacgcgttcgataaaccacgggtcgatttgcaatacgttatggctgccgccgtcgctcatcaggcgcatgccgtcgaggaacaggttatcgacgtcgccgccgtggtagccgcgcagggagatggcgtcgaaccgggtggcgccgccgccgaagctggagtagacccccggggtatattccagcgcctggctgatggtattcgccccctgatccgccatctgctggcgggtgaccaccgacaccgactgggcggtagtgattaacggttggtcggttttcgtcgccccgagcgaggtgctggcgctgtagccctccgtcggcgcgctggcggacgccggcggggtggcagtgaccaccaccgtctcttcggcttgcgtggtgaaggggagtgcgaccgcaagggcatacagcagccccgggcgttttcgagaaatagccacgttcataagatcatcctgaaccaacgcggtctggtactcctgtacgccgccgcgtgaaaaacgaatctgtcattattcgttaaaaagtaatgcgaattattattgtttgtatttgtgcgatcaagcgaaaaggtgacctgttcaacgcgagggggtggggaagtgtttcccgcgagccgcagaatgggtctgcgcgggacgatagtgaccagggagaccgcttccccccctaccgattttggtagggggcggcgaagcgtcaggagccggtcttttgcggttccgcaggggcggggtcgttagccgcgggcgccgcaacaggtttgtcctgcggtgaaggggttgtcgccggacgggtagcgggcagcgcatcgcagggtttctcctgcgggcagatcagatccaacatcttcagggtgacgccgttggtccagccaaagccgtcctgcagcggatattccccgccgccgccgccggtgccggtcgagctcacgtcatacttctccaccagcttttgcttactgtcataggtatgctgcacgttggtcaggaagcgccaggtgacctccatggcgatcttctgctgaccatagttttgcagcccctcgaccgccacccactgcagcggcgcccagccgttgggggcgtcccactgctggccgctgttgacggtggtggtggtcagcccgccgggtttaagcaggcgcgactcggcggcggcggccactttcgtcgcccgctcgcgtgacgcggcattgacgtacagcgggaacagcgccgccgcggtcaactgattgcgcaccttgtggcttttcagatcgtagtcggcgtaccatccctctttatcattccacaggtatttctcgatggcctgctggcgggcgttagccagcgcatcgtactgcgtagcgccagcgctgtccccggatgccttgctggcgcgggcgagggttttctccagatggaacatcagggcattgagatcgaccgggacaatcgaggtggtgcgaatggtggcgagctgctgcggattgtccatccagcgggagctgaaatcccagccggaggcggcggcggagcgcaggtcgcgatagatctcggttgccggacgattcgggttgcttttggcggttttgacgtcgtcaagccaggactcgggacgcggggtgtcgttatcgtcccagtagcggttgagcagcgcgccgtccgccatccgcaccgcccgtttgtcggcgctgccgggagccagcgcgtccgctccggccatccagtagcgatactctttctccagctgcggctggtaggttttcagcacctggtcgccatcgtgcgtcgccagcaggctcaccataaaggagaagaaggggggctgcgaacggctgagataataggtgcggttgccgttggggatatggccccaggcgtcaatttccgcggcgaagttggcgaccatatcctcgactttatcccagtgaccgctttcggcaagacccagcatggtgaaatagctgtcccagtaatagacttcgcggaaacgtcctccgggcaccacgtagggcttaggcagcggcagcagcgagtcccatttttccacctcgacggtgctgcgggtcaggaccggccacaggccatcgatatgttgacgcagagtttgccctttgggcggcacataggtgtcgttctctttcggcagcgtgaagttcagttcgacgaagtggcgcaggtcgaagctggcctggtttttttgcatccggtaatcggcaaggatcatcagcggatcgctgttagggatagcgtcggcgaaggttttctgatcggcaaacagcttcgcgctctggacatcattgaacagcgggcccagcagaatatccggcgaggggggcggcgcggttttgccgtcttccgcctgagcgttcaggctcatcagggcgatcagagcgccgccgatcgccaggcgcagggaacagggcaaagcagcgggacgacgtgcatcagtactcgtcatggggagttctccttatcattatcgactgcgggccacgacgtttggccatccaaaaaccttagacgaatatctgccgctgcgcgtgtcaggggtaacattttgcgcgaaaacagaggatttacctgccaggtctcctgagaccgccgcgggctgggccgcctggctgagggcgctggcgtccacgatggcgcaaaaaacgtcgccctgcctcacgacggtgcagccgccgccgggcgcgggcggctgttttgacgattttttgcacaaccagacggcggggctgaaccgatttgcacaacgccgcggcggcagaggacctggcataattaatgcttatctcttagcgggattaccacaaagtgagtacaaccggaggggatagccatgattaaaattacgctacctgacgggcattattatgacgagatgctgaccgcgcagggtgaacagcggccgcactataatgcctggtggcaatggtttcgcaacaccgatcaattctctatccggcagaaaaaagcgcaagcggaactgctttttcaccgtatcggcatcacctttaacgtttacggcgaggatgaggggaccgagcggctgatcccgtttgatagcgtgccgcggatcatacctgccggggagtggcagcgcattgaccgcggcatacgccagcgggtgaacgcgctgaacgccttcctctatgacatctatcatgagcagaatatcctgcgcgcggggctgatcccggccgagcaggtgctggccaacgagcagtatcagccgtgcatgcagggcatcaacctgccaaacaacacctatgcccatatcaccggcgtcgatatggtgcgcaataacgacggtcagtactacgtgctggaggataatctgcgcacgccgtccggcgtctcctacatgctcgaaaaccgtaagatgatgatgcgcctctatccggagatgttcgagcagcatcacattgcgccggtggagcgctacccgagctacctcctgcagaccctgcgcgaaagctcgctggtggatgatccctgcgtcgtggtgatgaccccgggtcgcttcaacagcgcctacttcgagcacagcttcctggcgcagcagatgggggtcgagctggtggagagcgccgatctgtttattaaaaacggcgcggtgtatatgcgcaccaccgaggggccgcggcgggtggatgtgatttatcgccgcatcgacgacgcctggctcgacccgctggccttccgcgccgattcgatgctcggcgtcccggggctgctgtccgtctatcgcgccggcggcgtagtgctggccaacgccatcggcaccggggtggctgacgacaaatcgatctatccgtacgtcccggagatgatccgcttttacctcggcgaacagccgatcctcagcaatatccccacctggcagtgccggaaagcggaggacctgcgctacgtgctgagcaatctcgagctgatggtggtcaaggaggtccatggcgccgggggctacggcatgctggtcggcccgcgttcgactaaagaggagcgagaggccttccgccagcgcctgctggccaatccggccaactatatcgcccaggacacccttgcgctgtcgacctgccccaccttcgttgaggaaggtctgtcgccgcgacatatcgatttacggccctacgtgctgtccgggcaggagatgcggctggtgcccggcggcctgacccgcgtggccctcaccgaagggtcgctggtggtcaactcgtcgcagggcggcggaaccaaggatacctgggtgatggaggatgacgcatcatgctaagtcgtacggcgagtgaactgttctggatggcccgctatctcgagcgggcggagagctacgcccgggtgctggacgtgacctggaaattatcaatgatcccccgccacagccagcagtcgcgggatctggcgctgccgctgaatttgtcgatgacccacgagttgtttcaggcgcgccatgcccgctttaccatgagcaatctgctcaacttttttgcccttgatggcaacaacccctgcagtatttacagctgcgtggagatggcgtggaacaacgcgcacgcggtgcgcggcagtctgtcggccgaagtgtgggagagcatcaatgccacccgcattgaactgcggaccctccgccagcaagggctgggcgagctggggagcgacggcttttttgagtgggtgaaagagcgggtgcatctgtttcgcggagcggtgataggcacgctgctgcgcaacgacgccctgagctttatcggtatcggcaccctgattgagcgcgccttcgccaccacccagctgctgctgattaaggatcaacagctgaccaacgatccggacccggtgcgggaatactaccggctggataccctgctcaatgcggtcagcgcccgcgaagcctacaacagcctctaccgccagccggtcagtcgcgaaacggtgatggagctgctgatcctgcgcaacgatattccgcgttcgctgcgcgccagcattgccgatctggtgggcgagctggagaagatcgccaacgaccgctcctatcaaccgctgcgcctcgcccatcagcttaacgttgatctgcgcttcagcacccgtgacgacctggcgcaggcggacctgcagaccacccttaacgggctgctggcgagaattaacgcgctgtccgacagcatcagacaaacctatctggaggccttatgaaactggtcatcgatcatctcacccgctatggctacgatgaagaagtgaagttttccacccagtatctgcgcctgacgccgcgcagtaccggccggcagacgatcaccgcctggacgctgaccctgccggacggcgcggcggtgaccactaccgacggctggggcaatgtgctgcatgtgctgacgctggataacccgcacaaggagatcaccatccgcgccagcgggattgtcgatatcgccgacgaaggggaggagacgcgtgatgaagaggccgagctgctgtcgccgctggtttttctgcgctgtacgccgctaacccgcgccgatacggcgatccgtgagtttgcccagcgcctctatcgtcccgatgcggcggaagagagtctgaatcaactgatggcggatctgctgttaagaatgccatactcccccggcgcgacccaggtgcaggactccgccgccgacgccttcgcccgcgcgaagggggtgtgccaggatcatacccatgtttttctcgcctgctgccgcgcgctggagatcccggcgcgctacgtcagcggctatgtctacagcgataacgcccagcatgtggcgatgcatgcctgggcggaagtctggctcgacggccgctggctgtcgtttgatatcaccaataatacccgtcgcctgaatcagcatttacggctggcgaccgggctggattatctcgacgcctgcccggtacggggcacccggctgggtgggggcggggagattatgttaactaacgctgaagtgcgcgaacacagccagcaggcgcagcagcaataatacgggaataaccgcaatgacctactgtgtggccatgtgcctggcggatggactggtgtttgcttccgactcccgcaccaacgcgggcgtcgaccatattgccacttttaaaaagctgcacgttttccatcaggagggggaacgggtgctggtgctgcaatccgccggcaatctggccaccacccagagcgtgataagcctgctcagcgcgcgcatccgtacccagcaggagccgaatctgatgcaggtcacttccctctacgacgccgcgatgctgatcggtaaaacgctgctggaggtgatccagcgcgacagcagcaaccagcagacctgcagtaacaccaacttcaactgcaacctgctgcttggcggccagatcgccggcgaaacccatcgtctgttccatatttatccggagggcaactttattgaagccacccgcgacacgccttatttccagattggcgaaagcaaatacggcaaaccgatcatcgatcgggtgctgaccatcgacacgccgctggagcaggcgatgtgctgcgtgttgatctccattgattcgacgctgcgcagtaatctgtccgtcggcctgccgctggatacgctgctctaccgcagcggcagcttcagcagtgccgggcagcatcgcatcaccgacagcgatccctacttcaaccgcattcgcaaggcgtggtccgaagggctgttgcacaccttccagactctgccgacctggacgccagcggagcgggaagaggagtagtcgctgtgacgctccgccggtatcgtcggcgcgaaggcgggtaaggcgctggagtcctttagtatcctcgacctggcggtaaaatttcagcaacagcggtaaataaattaacgacaggccgcacggattgtaggccgggcaaggcgtcgccgccgcccggcacaaaagcgacgccgctgtccttgtccggcctgggaaaggggcttccgggctgtggtaagcattttcctgcgttgtatctgactacgtggcgcgtctggcgaggttctctgcatttaattgtggtgcgaaggccaacaggaggtcagcccgcgaacgaaacgtgatatacaaccgaaacgcaggttcggtgaaacgtaataagaaatatgtgataccaggataattaaagcattcatgccataccgtattctgttgtaactgaggagaatatgttgcaggaggcagtatgaataatgaaaatacgtatggctacgtatatatactggtatcagataaaacaccgtatattaaaattggtggcacggattatttgccagagaagcggtgtaaggagattaatacccagccaccctattgtttatatgccccatggcgggtagcagactaccgtagcgtacctgactggcataatgtcgaaacctggctgcactatctttttcgagattctcgcgtgcggactattgcaaatcagaaagagctatttaatgtcacgcctgaactggctgcccatcatcttgccagccttgatcaacaaccgttgacgactaaacctaaaatcgaccgactttttcatcaccaggggttgagagattacctggtaaaactattcgctatcgccggttgtgaaaaatggcgacataaagaaggggtttgggtgtttagtctgttcccaggggcgcatagcggatggtcccggtattttacgcttagtatccatagccacgaagtcgcttattcaacgcggtcccgcgattgtcaaattcatatgttattagcagatgagcttatcatggactatcccgatattgttcggtgggtgacggaccataaaggagggattgaaaaaccaatttataaaacagctttatcacacgcgcagcaaatctggtttgagggtgagtttgaagagtgtcttcagttactctcgttccctgaagtccagctggccgttgctacctactgggaccgcgcattaacaaaatacgattatagtcttcaggcgaagtatcataaccggatggcagttgaggagatcttcaaacagttacaagtacaacggcagcgagaatcgagcgcaatgtaaacaccgccaacctgttgcgccatggacggtattctctttgtcctgctgaatacaaacgcgctttttggcaaagctaagtcaattaaatactttgttatttaacgtgttatctcacatcttcggtgggaatgaggcaacacggcaaggtatcggaagtgacggaaaagaagacggctgtctatgtggatgaccaacagcgcatcctgatccgccagctggcgcgcagctggctgtggcgcagcgagctgccgacctggctgctgattgtgacggtttacggcggctggtttgcctgcgtggcgggctggcggacgctgggactgtttccggccacgctgctgttgatctggtttaccgcctggtatatgtccttacagcatgagctgatccatgggcatcccacccggctggcatggtttaaccagctgttggggacgctgccgctggcggtctggtatccctatggcgtctaccgcgacagccacctggcgcaccatcgcaaccatctgctgacgcaccctgaggatgaccccgaatcgtactacgtaacggcggaaagctggcagcgcttctcagcctggcagcgccgccttatccacctgcgcaacaccttctgggggcgtctgctgctggcgccgatgatggatattattcacaccctgaacagcgcgctgtgggctttccgcgagggcgaccgccgcgctatctccatgtggagtctgcatctgttgctgctgacgggtctgctgacctggatggcggcgcagggtttttctccgctgtggtttgtgctggcggtgagctacccggcgctggccctgaccaaagtacgctcttttctcgaacaccgcgccgcggatgacccgctggcccgctcggtgatcaacgaggccgggctcccctggcgggtgctgttcctcaatctcaactaccatgcggtgcatcatgatctgccaggggtcccctggtacgctttacgtcaactgtatctgcatcgccaggcggcgtatctgcagcgtaatcaggggttcctggtgcgcgggtacggcgagtggcgacgccattttagccgccgggcggtagcggtgaacgcccatccgggctttggcgagcaggcgcaggcgggaggagaatatggctgaacgcatgacttttccgatgtatgccatccaccgtcaacagacccaggccctgtggcaggcggtgcagtcgctgctggacgaacgcggcgtgatggtggcgggggaccctccggcggctgaccccggggatctgctggctcactggcgccagccgacgctgttgctgagccagacctgtggctacccgctggtgacccaattgccggaggtgcagacggtgggctgcttccactacgctgcgcccggttgcgaagggcgccgctatcgcagcctgctggtggtccgcgaagcggatagtcaccggatgctgggggacttttttggccgtcgggcggtgtgcaatgccgagcactcgcagtccggctacaacgtactgcgtaaaatggtcgcgccgctctcccgggaggggcgttttttttcagcggtgatgttcagcggcagccatcggcaatcgctgcgcgaactgcagcaggaaaacgccgatatcgccgccatcgactgcgtgacctacgctctgctgcagcgccatcagccgcaggctctggctggcctggtggcgatcggctggagcccggccgtgccagggctgccgctgatcaccgccggcgccaccccggcggcaacgctgaatagcctgcgcgaggcgctccagcagctggtaagcgatgatcgctatcgttccctgtgcgacgccttgctgatctgcggctatagcgatatgtcgcgggaggcctatgcgccgctgctggcgtggcgggatgaggccgcggcgctgggggtcagccagctataggcgaaatgcccgggccagcgatctgcgccggggcgggctatagcggctggtcccacggctgggcgctgagatccattcgcagataggaagagagcaggtcgacagccagctggtcgctcatcagctgctcgttaagctgctggcgcagccgcgggatcatctcttcacgataggccgggtcgttgttttatggatttgtgatcggcaacacaaatgactctccaatggccgtcgtaaaagataaattaccagggttgattttaatcaaagtatgaccaactgcgctatggcggaaaaaagatcgctgcctatcgcgacccaaaagaaaaattgtgaatttaatgtttctttggtgtaaataatgaccgtgcattttccccaaccgccggggataaaatgtgatgcccgaccggcttgtcgttaaataatggcgtttattacgtctgctttttattctttacagcattaatttaattttcggctttcttctcaccctgatagcgcgggtcgaataacgtacaaaaggcgtattttttatcgccatttcgccgtcgatgttatcgccatcaattatttttatccccgcattcggccacggcaaaaggcgcgcaaatagcgttcatgatgcttttaatgtattgattttactttacttattctggctcgtggatcctgcttatccgccgcggcggagcctttgtgagagctctcacataacccggcaattgcgatttgttacactttccgccgtcaacaaaggaatgaaagtgagacgcgatgaatactttttctctgcctaaaacacagcatctggtagttttccaggaagtgatccgcagcgggtcaatcggggccggagcaaaagcgttaggactcactcagccggcggtcagtaaaattattggcgacatggagagttattttggcagcgaattaatcgtccggcgaaataccggcgtctcgctcaccgaggccgggcaggtatttctcaactggtcagaagcgatcacccgtgaaatgaaaaatatggtcaatgaaatgaatgctctgaccaacagcgcggtggtggatgtctcctttggtttcccttcgctggtcgggtttacctttatgtcggagatggtgcatcagtttaaaatgactttccccaaggcgcgggtctcgatgtatgaggcgcagctctccgcctttttgccggcaatccgcgacgggcgcctcgacttcgccatcgggacgctgagcgatgagatgaaactgcaggacctgcacgtcgagccgctgtttgagtctgagtttgtgctggtggcgaaccgggcgcggatcggcaacggcaccgtccgcctggcctcgctccagcacgagcagtgggtgctgccggagaccaatatgggctactacagcgaactgctgaccaccctgcagcgcagcggtatccgccgtgaaaatatcgttaataccgattcggtggtgacgatctataacctggtgctcaatgccgatttcctgacggtgatcccctgcgacatgaccacgccgtttggctcgagccagtttgtcaccatccccattaaagaggccttgccggtggcgcgctatgcggcggtatggtcgaaaaattaccggttaaaaaccgccgcggcgtcgctggtggagatggcgaaacactattcctcggggcagggcaaccgccactggcagccattacaaattattgcgtaactgaaagtcgttaaataatccaacacacgtcctcgctgttatcagcaggatgacgcccggtcattgactttatattaagatacagaggccataatgcatattacctacgatcttccggtatctattgacgatattctcgaagcgaaacaacgcctcgcgggaaaaatatataaaacaggcatgccccgttcgaattattttagcgagcgctgccagggcgaaatatttcttaaattcgaaaatatgcagcgcacgggttcatttaaaattcgcggcgcctttaataaactgtgcggtttaaccgcggcggaaaaacgcaaaggggtggtggcctgctcagcgggcaaccacgcccagggcgtctcgctctcctgcgccatgctcggcattgacgggaaagtggtgatgccgaaaggggcgccgaaatcgaaagttgccgccacctgtgattattcggcggaagtggtgctacatggcgataactttaacgataccctcgccaaagccagcgatattgttgaacttgagggccgcatttttattcccccctatgacgacccgcaggttatcgccgggcaggggactattggactcgaaatattagaagatctgtatgacgtggataatgtcatcgtgcccattggcggcggcggcttaattgccggtatcgcgatcgcgattaaatccattaacccgacaatccgcattatcggcgtgcagtcggagaatgttcacggcatggccgcctcctggtatgccggggaaatcaccagccatcgccacgccggcaccttagccgatggttgcgacgtcgcccgcccggggaaactgacctatgaaatcgcccgccagctggtggatgacatcgtcctggtgagtgaggatgacattcgccagagcatggtcgccttaattcagcgcaataaagtgatcaccgaaggggccggggcgttagcctgcgccgcgttattaagcggcaaactcgacagctatatccagaaccgcaaaacggtcagcctgatttccgggggcaatatcgatctctcccgggtatcgcaaattaccggttttgttgacgcttaattcaatacataagtgaggacaggatatgagtacgactgagagcattgcatccagccagacaagcctttcgtcctggcgtaaatctgacaccacctggaccctgggcctgtttggcaccgctatcggcgccggggtgctgtttttcccgatccgcgccggcttcggcgggctgatcccgatcctggtgatgctggtgctggcctatcccatcgccttttattgccatcgggccctggcccggctatgcctgtcgggggctaacccctccggcaatatcaccgaaacggtggaagagcattttggcaaaaccggcggggtggtgatcacctttctgtacttcttcgccatctgcccactgctgtggatttatggcgtcacgatcaccaatacctttatgactttctgggagaaccagctgcagatgccggctctcaaccgcggggtggtggcgctgctcctgctgctgctgatggcgtttgtcatctggtttggtaaagacctgatggtcaaggtgatgagctatctggtgtggccgtttatcgccagcctggtggtgatctccctgtccctgatcccctactggaatagcgcggtgattgaccaggtcaacctcagcgatatcgccttaaccggtcacgacggcattctggtgacggtatggctgggcatctccatcatggtgttctccttcaacttctcgccgatcgtctcctcgtttgtggtctccaaacgcgaagagtatgaagcgcagtttggccgcgagtataccgaacgcaaatgctcacagatcatctcccgggccagcatgctgatggtggcggtggtgatgttcttcgccttcagctgcctgtttaccctctcaccgcagaacatggcggacgccaaggcgcagaatatcccggtgctctcctatctggcgaaccactttgcctcgatgtcgggcaccaaatccacctttgccaccctgctggagtatggcgcgtcgatcatcgccctggtggccatcttcaaatcgtttttcggccactatctcggcacgctcgaagggctgaacggtctgatcctgcgctttggctataaaggggataaaacccgggtctccagcggcaagctcaataccctgagcatggtgttcatcatgggctcgacctgggtggtggcgtatgccaaccccaatatcctcgacctgattgaggcgatgggcgcgccgattatcgcctcgctgctgtgcctgctgccgatgtacgccattcgtaaagcgccttcgctggccaaataccgtggccgtctcgacaacctctttgtgaccgctatcggtctgctgaccatcctcaacattgcttacaaactgttctaatccggctcaggccacgcggagtacaacatgactgaatttccggtagtactggtgattaactgcggctcgtcgtcaatcaaattttccgtcctggacgccgccagctgcgactgcctgctcaacggcgtggccgagggcatcaacgcggaacgggcgtctctctcgctcaacggcggcgagccggtggcgctggcgcagcgcggctacgaaggcgccctgcaggcgattgccggggcattagcccaacgcgacctcatcgacagcgtggccctgattggccaccgcgtcgcccacggcggcgacctgttcaccgagtcggtcattattagcgaggaggttatcaataacattcgccaggtatcgtccctggccccgctgcataactacgccagtctcagcggcatcgcctcggcgcagcggctgttcccggaggtgatgcaggtggcggtctttgataccagctttcaccagaccctggccccggaagcttttctctatggtctgccgtgggagtattaccagaatctcggggtacgccgctacggtttccacggcacctcgcaccgctatgtgtcccagcgcgccctggcgctgctcgggttgccggagcaggagagcggcctggtgatcgcccacctgggcaatggcgcctcgatctgcgcggtgcgtaacggccgcagcgtggacacctcgatggggatgacgccgctggaggggctgatgatgggcacccgcagcggtgatgtcgacttcggcgccatggcgtggattgccggggaaacccggcagaccctcagcgacctggagcgggtagccaacaccgcctccggcctgctggggatctccggtctttcctccgacctgcgggtgctggagcaggcgtggcatgagggccatgcccgcgcccgcctggcgattaaaacctttgtccatcgtatcgcccgccatattgccggccacgccgcggcgctgcagcgtctcgacggcattattttcaccggcgggattggcgagaactcggtgctgatccgtcggctggtgagcgagcggctggcggtctttggccttgcgatggacgccgcccgcaatcagcagcccaattcggccggcgagcgcctgatctccgccgacggcagccgggtgcgctgcgcggttattcctaccaatgaagagcgcatgattgccctcgatgcgatccgcttaggccggatccacaccgcggcggcgctggcctgactttttattctgtagagagacgatgttcatgaaagtagatatcgatacccaggatgtacgatacgccgacgcctggcagggctttcgcggtacggcgtggcaaacgcagatcgacgttcgcgactttattcagcataactacaccccttacgagggcgatgagtctttcctcgctaacgcgacgccagcgaccaccgccctctgggagcaggtgatggccgggatccgcgtcgagaacgccacccatgcgccggtggatttcgacaccaatgtcgccacctccatcaccgcccacgcggcgggctatatcaaccagccgctggaaaagatcgtcggcctgcaaacggaccagccgctgaagcgcgccctgcatccttttggcggcatcaagatgatcaaaagcgccttcgaggcctatggtcgcgaaatggatcctgactttgagtatcagtttacggcgctgcgtaagacccacaatcagggcgtttttgacgtctattccccggatatgctgcgctgccgcaaatccggggtgctgaccgggctaccggacggctatggccgcggacggatcatcggcgattaccgccgcgtggcgctgtacggcattcgctatctggtccgcgaacgtgagctgcagtttgccgacctgcagccggcccttgagcgcggcgaggcgctggaggccaccctgcgcctgcgcgaggagctggccgaacagcggcgcgcgctgctgcagatgcaggagatggcggcccgctacggctgcgatatcgcccacccggcgcgcactgcccgggaggcggtgcagtggctctacttcgcctacctggcggcggtgaagtcgcagaacggcggcgccatgtcgctggggcgcacggccaccttcctcgacatctatatcgaacgcgatctgcgcgccggtttattgaatgaggagcaggcccaggagctcattgatcacttcatcatgaagatccgcatggtgcgtttcctgcgcaccccggaatttgattcgctgttctccggggatcccatctgggcgacggaggtgctgggcggcatggggctggatggtcgcaccctggtcagcaaaaccaccttccgctatctgcatactctgcacaccatgggcccggcgccggagccgaacctgaccgtgctctggtcgcaagcgctgccggcggcgtttaaaaaatatgccgcccgggtctctatcgccacctcgtcgctgcagtatgagaacgacgatctgatgcgcagcgattttcacagcgacgactacgccatcgcctgctgcgtcagcccgatggtgatcggcaagcagatgcagttcttcggcgcccgcgccaatctcgccaaaacgctgctctacgcgattaacggcggggtggatgagaaactgaagatccaggtagggccgaaaaccgaccctctgcgtgatgaggtgctggactacgacaccgtgatggccagcctcgaccactttatggactggctggcggtgcagtacatcagcgcgctgaacatcatccattgcatgcatgataagtacagctacgaggcggcgctgatggccctgcacgaccgcgacgtctaccgcacgatggcctgcggcatcgccggcctgtcggtagcggcggattcgttgtcggcgataaagtacgcccgggtgaagccggtgcgcgatcaccacgggctggcggtggactttgtcattgaaggcgactatccgcagtacggcaacaacgacgatcgggtcgatgccatcgcctgcgacctggtggagcgctttatgcgcaaaattcaggcgctccccacctggcggcaggcggtgccgacccagtcgatcctgaccatcacctccaacgtggtatacggccagaaaaccggcaacaccccggacggacgtcgggcggggacgccgttcgctccgggggccaatccgatgcatggccgcgaccggaaaggggcggtggcgtcgctgacctcggtggcgaaactgccgtttacctacgccaaagatggcatctcgtataccttctccatcgtgctggcggcgctcggcaaagccccgtcagcgcaggaaaacaacctggtgggcctgctggacggctacttccaccacgaggagacggtggaggggggacagcatctcaacgtcaatgtgctgaaccgggaaaagctgctcgatgcgatagaacacccggagcagtatccgaatctgacgatccgcgtctccggctatgcggtccgctttaacgcgctgacccgcgaacagcagcaggatgtgatctcccgaacgttcaccagtcaactctgagcggccaccgggtcacaggagagcctttaacgggctctcctgttatcatcttcacattaccgcaacaaaataatcaccactgttgatcatattcgcatttttgcaccacgctggcgcgcagcgaccgctaactgcatctatgtttagctcacgggccggtacggataccgcgttgtccggctcgccacgtgatggcaaccgatctcctgacctgaaagggaatgcgcccttgccggatgcggcacgggttgccgtcgcgtgcgtaccgaccggggcgactgttctccggtgttccactccttcctggcgggatttttgcttcttccaccctggccgtcctggcgctgcgccaacgtcggcaccacacggtaagtgatattttctgcgtcattccatgacgccaggctttacatcgctgaggaatatccgaatgtctttgaaactgaaaacaatgacgcttcatgttgtgatagcaggttgtatgagcatggccttttacgcccaggcagacgtgaagatcggcgtcgccgggccctttaccggccccaacgccacctacggcgcccagtactggaagggggcctcgcaggcggtggccgatatcaatgccgccggcggcatcaaaggcgaaaagattgtgctggtgcagggggatgacgcgtgcgaaccgaagcaggcggtggcggtggccaaccggctggtggatgaagcgaaagtctccgccgtggtggggcacttttgctcttcctcaacgatgccggcctccgaggtatatgacgaagccgggatcctgaccattacccccggctcgaccaacccgcagatcaccgagcgcggcatgaaagatctcttccgcatgtgtggtcgtgacgatcagcagggggcgatcgccgccaactatatgctggacgtgctgaaggcgaagaaaatcgccgtcatccacgataaagacacctatggtcaggggctggccgatgccacccgcgcggcgctggcgaagcggggtaccaaagaagtgttgtacgaaggcctttcccgcggtgaaaaagactttaacgccctggtgaccaagatcggcgccctcaagccggacgtggtctactttggcggctgccatcctgaagcgggcccgctggtgcgccagatgcgcgagcagggggtgcaggccaaattcttctccggcgactgtatcgtcaccgaggagctggtcacggccgccggcgggccgcagttcaccaacggcgtgctgatgacctttggtcaggatccgcgcaccctccccgacggcaaagcggtgatcgagaagttccgcgccagcggctttgagccggaaggttataccctctacgcctacgcctccattcaggctatcgccgcggcctggaacgccgtcggtaccgataacgccaaagccagcgactggctgaagagccacgacgtcgagacggtgatgggcaagaaagcctgggatggcaaaggcgacctcaaggtgtccgactacgtggtctatcagtgggacgacaagggcaaatatcaccagctctgatcggccacgacctgaggacgctctgtccttttgacttgcgaattgtcacatgacggcggttgaccgagaacggaacccggcggccgtctgcctggcggctggagggactatgacggcgttttttctgcaacaactgatcaatgggctgacgctgggcgcagtgtacggcttaatcgccatcggctacaccatggtgtatgggatcatcggcatgatcaacttcgcccacggcgaggtgtatatggtctccgcctacctgtgcgccatcggcctggcgctgctctctttcttcgggatccactccttcccgctgctgattttcgccaccctggtgttcaccatcgtggtcaccggcgtatacggctgggcgatcgagcgcatcgcctaccggccgctgcgcaactcgacgcggctggcgccgctgatctcggctatcgggatgtcgctgatcctgcagaactatgtccagctgagccaggggccgaaccagcaggggatcccgacgctgcttagcggcgcgttgcgcatgacggtgggcgatggggtggtgcagatcacctggaccaaggtgtttattctcgtcgcggcgctggtggggatgcttatcctgacctggattattcagtatacccggctggggcgcatctgccgcgccacccagcaggaccggcgcatggcggcgatccttggcatcaataccgaccgggtgatctccctggtgtttgtcatcggcgcggcgatggccggtctggccggcgtgctggtgaccatgaactacggcaccttcgacttctatatcggatttattatcggcatcaaagccttcaccgccgcggtgctgggcgggatcggctcgctgcctggcgcgatgctgggtggtctgctgcttggggtggccgaagcccagttcgccgggctggtgaattcggattacaaagatgtcttttcctttgcgctgctggtggcgatcctgatttttcgcccgcaggggctgctgggacgtccgctggtggccaaggtctaaggaggctttatgggtgaaattacgcgccagcctgcgcgggctatccaaaacgcgctgatcgacagcgtactggccggcctttgcgcgttaattgtctttggcccgatcgtcggcgtggtgctcaaagggtatggttttaccctcgcgcctgcgcgggtggcgattctggtggcggtggtgatggccggcaggctggcgctcagtctgctgctgcagagccacaggggaaaagcctttattgcccgctttgagggggcggatgacggggtgtacgtccggccgccgggctaccgctcgcggctgcgctggataataccgctgctggtggggctggccattgtctttccgtttctcgccacaaaatatctgctgaccgtggccattcttgggctgatctacgttctgcttggcctggggttgaatattgtggtgggcctcgcgggcctgctcgatctgggctatgtggcgttttacgccatcggcgcctacggcctggcgctgggctaccagtacctgggacttggcttctgggcgatgctgccgctgggggcggtgatggcggctctcgccggggcgttgcttggctttccggtgctgcgtatgcatggcgactatctggccatcgtcaccctcggctttggcgaaattatccgcctggtgctcaacaactgggtgagcttcaccggcggccctaacggcgtaccggtgccatcccccacgctgtttggcctcgagtttacccgccgggccaaggatggcggcatccccatccatgagtttttccacgtcagctacaaccccaacctgaaattcatctttctctacgccgtgctgtgcctggtggtgatgctggtgctgctggtgaagcatcgcctgacgcggatgcccatcggccgcgcctgggaggcgctgcgagaggatgagatcgcctgtcgggcgatggggctcaaccacgtgctggtgaagctctcggcgtttatgctcggcgcgtcgacggccggcatcgccggggtgttcttcgccagctatcaggggtttgttaacccgacgtcgttcaccttttttgagtcggcgctgatcctggcgattgtggtgctcgggggaatgggctccaccctgggtgtggtactggcggcgtttgttctgacggtcaccccggagctgctgcgcggttttgacgaatatcgggtgctgctgttcggcgtgctgatggtgatgatgatgatctggcggccgcgcggcctggtgcgcaccagccgcagcggggttgcgttgcgaaaaggagtcgcgccatgaccgacagcatcttacgcgttgagcatctgatgatgcatttcggcggcatcaaagcgctgaatgatgtcaatctggaggtggagcgggggtcgatcaccgccctgatcggccccaacggcgcgggcaagaccacggtgtttaattgcctgaccggtttttatcgggcgacggggggcagtatcgtgctgcgggcgcgggaaaaggtcaccgatgttattcaggtgctggggcagaagcttcacccggacgattttctccacccggcgcagctggggaggcggatctattacaagatgttcggtggcacccatctggtgaaccgcgctggcctggcgcgcaccttccagaatatacgtttattccgcgagatgtcggtgatcgagaacctgctggtggcccagcatacccaggtcaaccgccatctgctggccgggatcctcaatacccgtgggtatcggcaggcggagagtcaggcgctggatcgcgctttttactggctggaggtggtggagatggtggactgcgccaaccgtctggcggggaccctctcctacggacagcagcggcggctggagatcgcccgcgccatgtgcacccgtccggagatgatctgtctggacgagccggccgccggcctcaacccggtggaaacccaggcgctgagccggattattcgctttctgcgccagcagcacggcattacggtgctactgatcgagcatgatatggggatggtgatggagatttcggatcatatcatcgtcctcgatcacggggacgtcatcgcccgcggcgcgccgcaggcgatccaggccaacgccagtgtgattgccgcctatcttggcgctgaggaagaggagacgcgccgatgagccagcctttgcttgcctttaatgaggtggatgtcttctacgggccgatccaggccctgaagcaggtctccctcaccgtcaacgagggggagacggtggcgctgatcggcgccaacggcgccggtaaatcaacgctgctgatgtcggtcttcggccagccgcgcattgccggcggggagattttctatcgcggggaggcgatcagccggaaatcgacccactttatcgccagcaacggcatcgcccaggccccggaagggcggcgcatctttcccgatatgaccgtcgaggaaaatctgctgatggggaccattgccattggcaaccgctatcaggccgaggacaaggcgcgaatgtaccagctgttcccccggctggaagagcggcggggacagcgggcgatgaccctctccggcggcgagcagcagatgctggccatcgcccgggcgctgatgagccgaccgcgcctgctgctgctggatgagccgagcctggggctggcgccgctggtggtgaagcagattttccagatcctgcgcgagctgacggctcaggggatgacgctgtttctggtggagcagaatgcccgccatgccctcaacctgtcggaccgcgcctacgtgatggtgaacggccagatccgcctgagcggtagcggccagacgctgctcaacgacccggaggtgcgtaaggcatatctggggatcagcggctgagggggttattcccgcggttcgttacgggttttaatgtgctgccagaaacgttcggcggcctggttaagccgcgagccggagcggtagagccaggcgccgatcggcagcgacaggctctcatcgaggatcgtcagccggccttcgtccagctcgcgctgaatggagtactgcggcagccagcccacgccgtcgccattgaggatcatgcgcttgagcagctcgctcatggaagagacaaaggtgagagagaaggtgatctccggcgtgcggtcgatcacctggttcacctggcgccccatatagctgtcgttggcgtatttcatcagcggcagcacgccgcgatgtaaatgaaacagcgggcggccatgttcgtcgcagggggagaccaggtgcagataagaatcaaaaattttatgattaataaacggatagttcatcaattcttcattatagaaggagaggataaaatcgctttttccctctttcaggttaaatacggcgtcgttgacgttaatcgattcaacatgaaaagtcttatttttacggtcggtgtaaccggcgatgatctcgggcagtaataacaccgacagcgaaggggcggcgtcgatccttattttctgggtagtgttatttaagcctttaatacggctgatctgaaaatccatgtcatcgagcatatttcgcgcatagccgacaaaaattttcccgcggttggtcagctgcagagggttggcgctacgatcgaagatgctgaatccgagggaagcctccagcgactggatgcgtcgactgaacgaggactgagagatgttgcgggctttggccgccagggtaaagctgcgcgactcctcgagggcaatcacatcatacagccattttacttccagatttgccaacaccgatccagtcctcaaaaacgcaataaaggctatgcaattttagcatagcgcatagaaactatgcaattaacataattatcgacaggtgttaacattttttggaaagttgagatttatgaatgcatatcggcgaccctacatgagcacgatatgaaatcgcgactcacggttatttattgctttatttcattgtccaggacttatcttattaaatagccggcgacgatgacgaaagcaatgaataacccaggcctcttaccttaaatagtttgtcaggagttccatgtcacaacaaattgaatcagtaaaaatggctctgcaggagctggggattaatgcaagcggcgaattctattacaaccctgattacgatttgcttattgcacatgaaacctctcctgagctgaccggcgcggcccgcggcgtgatgaccgactctggcgctgtggctgttgataccgggatcttcaccggccgttcgccgcgcgataaatacatcgtccgcgacgaacagactcgcgacaccgtctggtgggcagactccggcctcggccgtaatgacaataagccgttatcgccagacgtgtggcgcagcctgaaaagcctggtcgcgggccagctgagcggcaaaaaactgtacgtcatcgacgcctggtgcggcgccagcccggacacccgtcttggcgtacgcttcgtcaccgaggtggcgtggcaggcccactttgtcaaaaacatgttcatcgtgccaagcgccgacgagctggccagctttacgccagacttcgtggtgctcaacggcgcgggctgcaccaatgccaactggcaggcgcaggggatgaactccgagaactttgtcgcctttaatctcagcgagcgtattcagctcatcggcggcacctggtacggcggcgaaatgaagaaagggctgttctcggtcatgaactacctgctgccgcagaaaggcatcgcgtcgatgcactgctcggccaaccgtggcgaagcaggggacgtggcgctgttcttcggcctctccgggaccgggaaaaccaccctgtcgaccgatccgcatcgtcagctgatcggcgatgatgagcacggttgggacgatgacggcgtgtttaacttcgaaggcggctgctacgctaagaccatcaatctcgatccgcaggcggagccggagatttatggcgccatccgccgcaatgcgctgctggaaaacgtggtggtgcgcgctgacggcagcgtggattatgccgacggcagcaaaaccgaaaacacccgcgtctcctatccgctgtcgcatatcgacaatatcgtcaagccggtgtcccgcgcgggccatccgtcgaaggtgattttccttgccgccgatgcgtttggcgtcctgccgccggtctcccgtctgaccaccgagcagatgcagtaccatttcctgtcgggtttcacctcgaagctggcgggcaccgagcgcggcattacccagccgacgccgaccttctccgcctgctatggcgcggcgttcctgctgcttcacccgacccagtacgccagcgtcctggcggcgaagatggcggaatccggtgccgaagcctggctggtcaacaccggctggaacggcgagggcaaacgcctgtcgctgcgcgatacccgcagcatcattagcgcgatcctcaacggcactaccggcccgctgcgcgaggagaccatcccggtgttcggtcttgcgatcccgcagagcattccaggggtagacagcgcggtgctggatccgcgtaatggctggagttcagcggataaatggcaggagaaggccgagagcctggctcagctgtttatagataacttcaagcagtacagcgataccgaagcgggtgcgcgtctggcgctggccggtccgcagctgcagaagagcgcggtcgaagcctgatccgcggccagcaggtcgacgcctggcgccgacctgctggcgagccgctttactccgcaaaggcccgcagcgcatcgccagtgaggcgataacgcacccactcatcctgcggctgcgcgccaatgctcagatagaaatcaatcgccggctggttccagtcgagcacgctccactccagacgcccgcactgacgttgtacagcatattgcgcgatggttttcagcagcgcttttccggcgccgatcccgcgatagtcgggggtgacgtacagatcctccatatagataccattgcgtccaagccaggtggagtagctggtgaagaacaccgcgtagcccaccgctttgcccgccacctcgcagatcagcgcttcggttttgctgccgctggcaaacagtgtctctctgatctcctctggcgtcgtcactacctcttggggggctttctcgtagaccgcgagttcataaatcatgtcgtagatagcggtggcgtcgtccggggtggcctggcggattgtgatgctcatgggttgtcctgtatccatagtcaaaagagagcaaaattgctgaccctgaggataagcggtattgtgaaaagaattaagtgcaatgaaatcagcaaacgatgaatattatgcatcctgtcctgcgccggattgacctcaacctgttgccggtctttgacgcggtctatcgctcccgctcggtacgcctggcggcggaagagctggcgatgagcacctcggcgctgagccatgcgctttcccggctgcgcagcgccctcaacgatccgctgttctaccgcgaaggccaccggatgtgccccagcgtctatgccagccagctggcgccctctatcgcttcggcgctgaagtttctcaaccaggagctgacgccgccggcggcgtttgtgccggccgccagcaccgactgcatgcagattgcgatcaccgatttcaccgcgttctgcgtctttccgacgctgatgcatcacctgcagcgtgaggcgcccgggctgcggtttgagctccgttatctgccccacagcccggcgctgaccgagctgctggcgggcgaggtcgacctggccctcgggttcaatacccctgacgagccagcccatcccgatcttgaggagattaactggctgcgggacgaatatgtggtcatcagccaggccaaccggacggcgctgaccctggacgcctaccttgcggcccgtcatctggtggtgaccccgtggaatgagcggcagggggtgctggactgtgagctggagcgacagggctattcgcggcaggtggcgatgaaaaccccctcgatgctgagcgcgccctttattattgagcagagcgacctgttgatggcgctgccccggcgggcggcggagacgatggcccgcgccgcccggctgaccattttcccgctgccgtttccggttccgccgtttgacgtcaagatttacgcccaccaacgcagcgggaaacgcgaggctacccgctggcttatctccctgttgcagacgctggtgggggagtccaccgcttcctgacgcgctttccagccggcagggtatttcgttaccccaggccaggttttatgccttcaacccacggcgacatatcctggccccggtcacaaaacggaaaactgactttttcgccgtcacccgcggcgtggttaggacggtgtgtgttaaatgattgtatgtaaaagtaatgttaattagttaaatgttattcatgcgtaaaatgcattagtggatgcgtttattacgcttatttcgttcccggttctgtttcagtcttcagcgacaggcgcgcgacaacgcgtggataacaaactggagacctgcatgcattcaacaacctcacagatgagtacccgtgaccggatcggcgccattctgcgcgtcacgtccggtaactttctcgaacagttcgacttttttctgttcgggttttatgccacctacatcgcccataccttttttccggcgagcagtgaattcgcctcgctgatgatgaccttcgcggtctttggcgccggctttttgatgcgccccatcggcgctatcgtacttggcgcctatatcgacaaggtggggcggcgcaaggggctgatcgtcaccctgtcgatcatggccaccggcaccttcctgatcgtgctgatcccctcttatcagaccattggcctgtgggcgccgctgctggtgctgatcggccgtctgctgcagggcttttccgccggcgccgagctgggcggggtgtcggtctatctggccgagatcgccacctcgggccgcaaaggcttttacaccagctggcagtcgggcagtcagcagattgccatcatggtggcagccgcgatgggctttgccctcaacgcggtactggagccgagcgctatcagcgactggggctggcgtattccgttccttttcggctgcctgattgttccgttcatttttatcctgcgccgtaagctggaggagacccaggagtttactgcccgccgccatcatctggcgatgcgccaggtattcgccaccctgctggcgaactggcaggtggttatcgccgggatgatgatggtggcgatgaccaccaccgcgttctacctgatcaccgtctatgccccgacctttggtaaaaaggtgctgatgctcagcgcctctgacagcctgctggtcacgctgctggtggcgatttccaacttcttctggctgccggtgggcggggcgctgtccgaccgctttggccgccggtcggtgctgatcgccatgaccctgctggcgctggctaccgcctggcctgcgctgaccatgctggcgaacgccccgagctttttgatgatgctgagcgtgctgctgtggctgtcgtttatctacggcatgtacaacggggcgatgatcccggcgctgaccgaaattatgcccgccgaagtgcgcgtggcaggtttctcgctggcctacagcctggcgaccgcggtgtttggcggcttcacgccggtgatttccacagcgctgattgagtataccggtgataaagcgtctcccggctactggatgagctttgccgccatctgcggcctgctggccacttgctacctctatcgccgtagcgccgttgcgctgcagacggcacgttaatcagggagaagatgatgcgtaaaacgacaggaaccctgctggccacgctgctgctggccgccaccggcggcagcgcgttgtccgctgaggtcaccgtgatgatctccggcggcttcaaagcggcgctggaaaagctggccccggcgtgggaaaaacaaaccggcaaccacctcgtggtgatccctggcccgtcgatgggaaaaacgccgcaggcgatccctaaccgtctggcgcgcggcgaacacgcggacgtggtgatcatggtcggggacgcgctgaccagcctcgagaaagcgggccgtacgcaaccggattcgcgccgggagctggccgactcgccgatcggcgtggtggtgaaggcgggggcgccgctgccggctatccacagcgcagaccagctgcgggcgacgctgctggcggcgccatcggtcgcgtactccgacagcgccagcggacgctatgtcagctcgacgctgttccacaccctgggcattgatgacgcgatgcagagtaaagcgcagatggtggagcgcattccggtggcctcggaagtggccaagggacggtatgcgatcggttttcagcaggtgagcgaactgctgccggtgcccggcgtaaccttcgtcggcgaactgccggataacctgcagtacatcacccgctttgccggggcggtgaccatcagcgccgaccacccgcaggaaggcaaggcgctgctgacgtatctggcgtcaccggcggcgcaggagaccatccacgccaccggtatgcgaagcgtggccgccgccgcgccggtcagccagaaggatactgttcaataatcagcttctccagctctgccgccacgtaggactgaatacggccgctgaggcggatcaggcctaccgtacgcgtgaccaccgggtcggtgagcggcacagcgcggagaacggaatgctccccggcgggcatcgacatcgcgggcacggcggcaatgccgatgcccgcttccaccatccccagcatcgtggtgacgtggcgggtttcgcagatacttggccgcgccggcgtcagatgcgccagctcccggtcaagcagcgtccggttgccggagacccgatccaggccaatataatcctgttcaaaatacgcctgccagcttaggtgcgtcttgcgcgccagcggatgatcgtgccgacaggcggccacatagcggtcgtcggcaagaggggtgaattcgatactggctggcaggtttttggcaaagcagaggccaaagtcagcctgtccgctgctgaccgcctcgatcacattcccgacgctgctgtcaatcaaccggatgcgcacctggggataacgcgcctgaaagctgcggatgatttccggcataaagtagtaggcggcggaaggcaccgtcgccaccgtcaccagcccggtgcgcgccttgctgacctggctgatatccgccagcaccgtctcgacatgggccagcagctgctccgaacgttcggcaaaattttgcccatacagcgtgagggtcacccgccgggtggtgcgatcgaacagccggttgcccagcgccgtctccagcttttcgatgcgtcggctaagggccgactgcgacaggcagatggattcggccgccagccgaaaactgccatattccatcagggcgcgaaaggcgtagagatcgttgaagtcaaaatttacgggcatggcggcatccttatcggctctctggcgccatcgccccgtccggcgaggggcgatggcgggtagcatatcgggcaggacttcgggcgtgcgggaaaccgcgcgccagggcttacaccttaagcagttttaccgtggcatcgatatcgatttcgtcttccgaaaagatcagggttgtcccctgaaaggtggtgatcgccagctttttcaccgagcgcatctctcccggctgcaccgtggcttttggccggatgctgttcatcagcagcccgaccgacagcacggcgttttctttatcgacgcgggtctcgaccggctcttcttcccggtacaccacataggatttgatggaggtcagcttcaaccgctcgccggcaatatagatatatttgctttccggaatgaccttcaccgcgtaggccgacagccctttattgttggtggtaggttcgaaagtcaccgccgcgtctttcttgataagatcaggattggcgaccttaatcacgtgaaaataacgattttcgccgttttcatctttgataaatccaaaacctttatctttaaaccacgttgtgattgttccgttcatcgccattaccgtattactcgttggttaacacaaattttgcagcgcgcagtgtaaagcacattgcctgtacaggccatgcctttgcgataagtgtgggtgataaatgacgccgccgcgagggcggattgtgcgccagcatcgtgccgctgggcaaaatggggtactatcgccagccactccttcttcgggccgcctgatgtccaccattatcgatacctttgtcgcgccgccgtgccgcgaacagatcaccctcttgtatcaggacgaacacctggtgctgatcaataagcccgccgggctgctgagcctgtcgggcaaagatccgcgcaacctcgactccgtgcatcaccggctggttcagcgctttccgggctgcaccctggtgcaccgcctggacttcggcacctccggcctgatggtgatcgcccgcaacaagggcattaacgccttgctgtgccaacagttcagccagcgcacggtggacaaggtctatacggcgctgctgagcggccacctggcggaagacgaggggatagtggaggcggcaatcgccaaagatccggcccgtttcccgcgcatggcgctctgcgcccgccacggcaaaccggcgcgttcgcgctatcgggtcatagaccgcctgtatcaggcgcgagaaggcgagagggcgctggcgttaacccgggtgacgctcaccccggagaccggacggacccatcagctgcgtattcactgccagctgctgggctatccgatccttggctgcgatctgtacggtggccgggagctgcccggcacggaatgcgctccgcggctgatgctgcacgccagcgaactgcgttttgtccaccccgtcagccatgagccgatgcatatccagcaggcgagcccgttttgatcgcccgcggcgggaaagcccggggttaccacatcagatcgtcgggcaccttaaagtcggcgtacggatcgtcttcatcctgctcatcctgactcagggcgctgtgcaacacgatgctgctggcgtcgcgctgggcaattttctcagccactaccgccggaataatcgcatattcaccttcgggcttgttatccaccgccaggcgggcaatcgccagacggccgttaatcagctgggtctgggtgggcttgtcgaccatgatttttttgatcagattattatcggtaaagttaaagccgatatcgccccgggcgaccgtaatgcggttcatctcgatcagctgcttcacctgggctttatactctttcgccagcaccgcctgcttttgctgctcgctaagctgtttatcacgctccagctgggcttttttattttcttccaccgcttcccgggcctcacgggcctgaacgcgggattttttcgccgttctctggactttagccatttttttgctgctgaccaggccggctttgagcatctgctcttgtaaggtgagttttgtcatctgcgtgtctgaaactgaggaaacatctggcaagtatacctgcattggcagaaacgacgccagactcgcgatcgcgctgggctgctgtaccatgccgcgcagcgcggcgggggattacccccggggctgaagctgataaatccaggcgctgatctgctgtccatcgtcggtggtcacttccaccggcacccgatcgtacccttcctcaaagtcgtccagcatgggccagtgcgccgccagccgatcggacaggaacagatagccgttgacccgtgggccgtgagcgtcgaggacgatccccgggaaatcggcggctgcgccccagccgcgcgcgtaaaaggtgccggtgacgtagccgggacgccactcgcccccgatcgcctccagaatatgcgcattgctgcgaccgggacagagcgtcccatagacaaatagtggtttcattttctctctctcgttcgccctgatacccgcccacagcggagcgggaaaccaaaatacggggtaatgcagcgcctggcaatggccgggtgggggcggggcactcctccgggtatctggcagttgccgggggagattctggactcagcgctactgagggtatatcgattgcggtgatatttttattattatttatatttaaggtaaatataaatattcctgacggagggattaattcgctaattaatattcaacaggaaaataataaaagggtcgcttatggaatattccttctacatgtgatgaccgagagcaataaagctaccttgggttgaattcagatattatttagggccaggcgttacctccccctgactctttcgctttatgataaacatcccttgaccaaaaaatatcatctgacttcgaaactctcgcgggcaggggagatatttcctttccctgaagcggcaggtaataaatccagccgaacacacggcggatgagggatatccgtccgggcatttggtcctgtctgcagaccaatgaaagtgaaaggcacaggaggtgcaatgaagattttccgcccattatggcgcgacggggcttttctggtcccgcagcagtttcagcaacaggcccgctgggacgcgcacgtcgccgatacggtctcccgcatggcgctcgcccacccgtggggggtattgcgcgcggagtttgacgtgagcgcgctcaccctttcccggctcaacgctacccggctgatcgtgcgtttcgccgacggaacgctgattgacaccgagctggcggatattttgccaccggtccgcgatgtatcggacgtgatgcaggacagcgtggaggttctgctcgctctgccgctgctcagcgccagcggcggcaatcttgatgacggccaggagagcgcccgcccgcgccgctggcgcgccgagcaggtgaccgtccaggagctggccggccatgaacgcagcgagctggccgttctgcggcacgcgctaacgctgcgtctctccaccgaggaaaatgcagccttcctcacctgcccggtagcgcgtctggtgcgcgacgcccaggggcagtggatcgttgacccggaattcatcccgccgctgctgtcgctggcggcaagcccgacgctggttagcgagctgggcgagctgttacatcgcctgcaggcccgacgcagacgcctgatggccatgcgtcgtgaaagcaatgcgcggatggctgattttgccgtggcggatgtttccctgttctggctgctcaacgcgctgaacagcgctgaaccggtgctcagcgagctgcatcaggacccttcgcgccatccggagctgctctatcgcgaactggccaggctggccggcagtctgctgactttctcccttgaacatcatctggaagcaatcccccgctaccgacatgcctcgccagagcaggtattcccgccgctgtttgccctgctggatatgctgctcgaagtcagcctgccctcaagggtgatcgccatcgctctggagcagggcgccgaccgggagatctggcggggcaggctacacgatgcgcggctgcgcgagggggcggatttttatctgtcggtgcgctcttcactcccccctcaccagctacagagccgctttccgcagctctgtaaggcgggtagccatgatgatgtcgccgaggtcgtcaatattgccctcagcggcatcgcgatcaaaccgctgagccatgtgccggcggccattccgctacgtctggaaaaccaatatttcgctctggatctctccaccgatgccgcccgcgcgatgctggaggccggcaactgcaccttctataccccggaatcgcttggcgacgtgaaacttgaactctttgcggtactgcgctcatgaatagctctgaaagcgatctgatcaacaaaactttttacccgggctggctgatggtcagccagttacgctgcggccagccggtgacggatggcgaggcgctctatcgccaggcctgtcgatgggtgaccgaggcgcgcgaggcgctgacggcggggggagtcagtgaagccagcgctgagcagatgctctatgcctactgcgcgctgctcgatgagagcgtcctcaaccgcgccagtcaggatgatggctaccgcaggtggcgcaaggatccgctgcaggcgcgctttttcagcactctcaacgccggggaagagctctgggaacggatccgccagctgctgcgagagcccacggcggatgcggcagtgctgacctgcttctttcgtactttacagctgggatttgtcggacagtaccgcgccgaggatgacgaacggcgtgaggacgtggcgcaagcgcttggcgcgcgggtcccgccgttcagcatgacccaggaggcgccggtggtggttcgtgcctcccggctgcgcagcggacggcggatgtactggtgcggctgggcggctggcattgtggcgctggcggcgctgtggttgaccttctcctccgtgctgtcacagatggtggcgcagatagcagggcagggataagagatgcgtgataacgcccgtcgtctgcttacgatactgaccgtcatcctggccctgtggctggtgctgggcttctggccgctgtccatcggcaaccaggtgatcttcagtctgtgcatcctgctggcgggcggcgcggcgctctggcgtcagcgtcgccgggcagtcagccgtcagcgatcggaaatcgtcctgccgcccgaggattttcagggggcggtggttctggtctgcggggataccgacggtctgtttcccgggcgttcggcgcacggcgaaacccgtcacggctggtatctccggggtgacagcgcggagcagttgccgcggctggcgcagtacctggcggcggcgcgtccggcgctggtatcgcaggtttccgtgctgctggcggtggtaccggagcaccacccctccggggagcatctggcgcagtcgctgcgcgactggcggcggagtatcgttcagtgccgaacctggctaaacggtctgccgcctgtgtggagcgtgttctgggtgacgccgccaggcggccaggccgcggaaagccgctggtttaccatcacgccggagagggctggtctccaggtgcagcagaagggacaagcgccccagtcggttgccgggtggcagcgggagggcagctctgcctcacgcctgcatcagacgctgtggctggagagcattctgaccttggccgaaaacgctcttttccggccattccgcgcccggcaggcagaacttcctccgctgaacctgtgtgccgcgggcatctgccttacgccggtggcggcggtggcgaataacctctggcaacagcaaatcgccgggatcaccacgctctccccgggcaacgacgcggcgccaggtcctcacccgctgccggatcttcttctgtcgtcactgccgcaccgccacggggtcagccgccggatgcgcgatgccggtcttgccgctggggtgggcttcctctttctggcgctggcgatgctggcttcctttatcaacaaccagcgcctggtgcgcagcgtcggcgatcatctggcggtgtatcaccgcctcagcggcacgccgccgacgccgaagctgcaggcgcagcagcgtctgcgtgccgacagccgcctgctggatgactggttgcgccggggggagccgctgcgttatcggctggggctgtatcagggggggcggctgatccccttcgttgaagccgctatcaatgactgggcgccgcccccgccgccgcgtccggtcattaagcaggttgtgcaggggccgcagacgatccgcctcgatagcatggcgctgttcgataccggcaaatcggcgctgaaaccgggttcgacaaagctgctggtgaactcgctgctgggcattaaggccaaacccggctggctgatcgtggtggcaggccataccgacagcatcggcaacgatagatccaatcaacaactctccctgaagcgtgccgaggcggtccgcgactggatgcgcgataccggcgatgtgccggagagctgttttgcggtgcagggctacggcgcaagccgtcctgtcgccagcaacgagacgccagagggacgggcgcaaaatcgccgggtggagatcagtctggtcccgcagaaggacgcctgtctgacgccgggcacggccaatacctcaggagcagagactaacggattaaaaagcgaaaccgagtaatcagcgaccccgatcgcggaggttgaacaacaatctgcctgcctgaccctgtgcgctacgggtccctgataaacaggaaacagcgatgggcggtagcgtgcctgcagccagtcaatcttgtcggctaagcgaagcctctgcggggatgaagctcgggaaaggggatggataaaggagatcagtatggatagcgctaaagacagtgccagagaaatgctggcggcgataaacgttgaaggctccggtttctggctgctttttttatttctcagtcagtgaatataaatatccctggggttaccttttagttacgaaactcctggtggggtatctgatatatcgatatgcacataaatatatttatgatgaatgagatgattgtcattaaacaaaattaaacagggcgtcctgtgaattgatttttgatagtcattacagcggagtaaaacaggaatataatggatacctcttcaataattaccggcaccacccttaaccgttaccagctgggtattccttcatgtaccgcatcgctggatgtggaagaattcagtggggcagaaaaactgagtgaactttattattacactattacgtttaccagcgcagagaaaaatattgatgccgcacagctcctgagcaaacccgccatgctgacgatgggcggcggcgcactgcagcagttggcggactgcaaacgcgtccatggtgtgattaccaccttccggcgcgtcaatcgttctgaagatcagtcgacctatcagataaccctccagccgtttctctccctgctggataaacagtttcgcagccaccgttttttcgtcaacaaatcggtgccggaggtggtggagcaggtattgcaggaacatcacctgcatgactgggagtatgagtttaatctcaagcaacactatccgcggcgcgagcaaattaatcagtatcaggagagcgacctggcatttatccagcgcctgctggcagaggtggggatattttatttcttcaccctgcaggaagaggcgcagagcgaagtggttcacttcgccgacgcgcagcgggcgctgatgttcgataaaacacttcctgtaaacagcccgtccgggatgagcgacagcggtacggaatcgatttggggtctgaacatcacgcacaacgtcgtagaggcgaacgtcactacccgggattataacccccgcgatgcgcagagcgttctccagtcggcaacagcggatatgacccggggaaatggtgaaggcatcacttacggtgaggtataccactataagcttcgccaccgggagcgtggcgataaaatcgagccgcagacggagaccgccaacttttatgcccgcctcgaccatgagcgttttctggctcaccagacgcttattaccgcgagcagtactgcagcctggctggcgccggcccaggtgctgaccgttaccgacagcctgccgtcgaccctgcctgcgcccgtacaggatccgctgttaatcaccggcaccggttttaccgccagccgccgggaggcgctgcgggtgtccctgctggcggtgccctacagcgaaacattgtgctggcgtccgccgctgctgccgcgcccgaaggtgactggcaccatgacggcgcgggtgaccagcgcgaaagcgaatgatatctacgcctggcaggatgcgtccggcctgtaccgggtgaaatttgacgctgacagagaggataaagggcagggtcaggaaagcatgccggtgcgtctcgccaaaccctacggcggcgacgtgtacggctttcacttcccgctgatccagggcacggaggtggcgattgctttccacgaaggcgaccctgaccggccgtatattgcgcatgcgctgcacgactcgcggcatgtcgatcctgtgacggagaaaaacagcacccgcaatgtgattcgtactccggccaacaataagctgcgaatggaggataagcgcggcgaggagcatatcaagctcagcaccgagtacggcggcaagacgcagctgaacctggggcataacgtgaatgcgcaaagggagttgcggggcgaggggtttgagctccggacggataaatggggggcgatacgggcggggaaagggatctttatcaccgcagataaacagtcaaccgccagcggcaagatacttgcaatgcaggataccctggacaggcttaagcaggcaggtgatgagatggactcgctatcgcgtgatgcccagtcggctaaagccgacccagcccaggttgaacaacagttagcttttatgcgtgagcaaattgatcagctacgggaggcggttgccgtgctcagcgcaccaaatggtgtggctctcgccagtggcaagcatctgcaactaaccgcacgtcgcaatctgatgctcaatgccggggcagatgccgatatgggcgttatgaaacggctgtttattggtgtgggggaagggctgagcctgtttgtccgcaagctggggatgaaattaatcgccaatcaggggcccgtggcgattcaggcgcaaaacgatcagttgcagctcctggcgcgcaaggatctggagattgtcagtactgatagcgaaattcacattgtggcaaagaaaaaaatcatcattaacgctggaggaagctatatcaccctcgatccctatcggattgagctcggtactggcggtgatgtcgacgtcaaagccgcggatttttcctatagcggacccgccagcatgaaggccgatcatccggattatccgccacttcagtccaccgtaaggcaatcgctgaaactgaacgtggcacagtcgccaaatgcgtcggacagcagctgggccggaatgccatataccctgtatgccgatggcgcattgttgaaacaaggggtgctggatgaaagaggtcagatatcagtcgatcaccaggtcgtgaccagaagttacaagctggagatggctaatggcgtcagctatcagatacccgttgccgaagcgtacagtcgccctgagcagggggaactcgctaatcgcggctttcaccaccatacctcgcaggctgcatctgatattaaccccccctcctcacatacggagcaccgtaatacttacgcggatttgctcgatggccatattgaacaggacgaaagtcaatgagtcacaatgatattgttaccccggttgctacggttgataccagccaatgtatgatcacctcgccctggtttgttcagaatacggaatacccaccggcagtggcaacgtataagccgctggtaaacggcgaggaggcctttgcggcggtatatcgagccatcgaaaaggcacaaaaatcggtggatattatctgctgggggtttcaaccatccatgtattttattcgtgacggacaggcgctgcgcatcggggaattgctctgtctgcttgcggaaaaacaggttcaggtgcgtatactggggtgggaggcgccctttaataccgccggggttgtcggcgaggcaaaccttcccggaaaggggatcctgcatcttcaggatcgcgccgggcagagtgcgacagacgaacaatatgcttttgaccgcgattggtttacccgtcattcatatagtgacgatctgctggattccagcaactttttagccagcacaatcaataagcagttcaatcagtggactgtcaatcccctatttgtgggccgcgggtttaataaagtagaacgtgcggaaatcgcctggcgggcgagatatcaggctctcgataaagggctcagtgccagcgcggtggggataatgacgctagcgccgtcccaccatcagaaaacggtgctggtggattatgaattacctgaaagcgccatcggttttgtcatgggacataatatgctcgatgagtattgggataccgatgcgcactcttcccagaatcggttcgggggcccggccccctggggacctgatcaaggcgctcgcggctttttaccccggcaggatatttccagtcaggtgacgggacccattcttgaacatctgcacgaaaattttgccaaagcatggcgtaaggaaaccggggaggaccttatcaaaaagcgtcaggcccgtgagatggcgaaacgccttaaaccgcggaaagagtgtggtaccctgatacttgcccagttcctgcgcacgcagtcgcaggaaaataaacgtgatatcgaaaaactctatctgcaggcagtcaacaatagcacgcagtttatctatattgagaaccagtactttcgttggccaccgttggcggaagttataaaaaaagcggcgcacttgcagattgataaaggacgaacgccagaaaaagacggatcgttacatttatttgttatcaccaatgtcacggaaggggggattggggcgggtacggtaaatacccagcgtatgctggaaagcctggggcgcgccaatacgattccaggcgtgacccgggcccgaatgatagagaagatcagggaggaagacccaggcaaattcgcctctctcgcctggtcccgcaatccggccacccaggcgcagattaatgaagagtttatccgccggcagaaagaatatgaagcacagctaaaacaagcagaagagttaaaagatagcgatattccaatggtaccaatacccggcctgaaaatacatatctgctcactggtggctcaggactctcccgtggataactgggtgccagtttatatccactccaagctgatgatcgttaatgacgttttcacaacacatggttcggcgaatattaatacccgcagtatgcaggtggacagtgaaatgaatattgcacatgagtggggcagtgtgacccgggatttaagacgacggctgtgggggttgcataccagtgggaaaggcgtgcaggacaatgcttctgatgcatttgatgcatgggaatatattattagtaaaaataaagaacgccagcaaaaccatcagaagcctattgccccgctgattgctttttattatgccaacaacgaactcaaggatctggattgatgcgccagttaatattattcctgtcgctgatggcatgtctcctgcacagcgcatcgtctgctaaaaaggacttatttgtgaatcctctttccgatactcacgccgccctggcgtttacctgcgcacatcagataattcctgaggcgtctgctgataccgatgtcctgtttaaatacgcccgctggctgcagaaaaataacctgctgaagcaggataaaagcgtcgatgcgcaaaccgaacggctgtaccggatagcggctgagaacgggcactataaggccagcattactctgcagaacggcgccctgcgcgggcagttttcgctgagcagccatgagcagttccggctgagccagcagcttatcgctgccggggtggcgaccgggtactatctgaccgctatctatctggaacggggcgtcgcggggctgcagcaggatccggcgcttgccctgcgctattaccgcaaggcggcggatgagggcaatccgcaggcgcaggcatatgtgggggataagctggcgccggtggacagggcgcccgatattgcacaccagatgcgtcgttgcgccgcggaacagggagagggaaaggcggcggtaatgctgggggttaacttacagggaaaaggttattatcggagagcaattgaagctttccagttaggtgtggcggctggagacacttcctcagcgcttgctttaagtcatgggtttgatggccccgaatcttcagatgaactttattatctggctcagcagaaggatccggaacgtgcccggcgctataaactgataacgaagatcctgagcaattattcctacgccagccccacggttccggaaatcaacgatatcgtgccgctgccgccggccccgctgccggaatgggacggcaagctgaagtggctggaggaatgggaggcaaatatcccgccgccagtgcctgatgcagcgctgatagaga

SEQ ID NO: 62 - DNA, 179748 bp, Unknown
  source: /note="Description of Unknown: KP2-Mcoc1 Bacteria Sequence"
ggcccgctcggggccgggggggcctggggtgggtaggagaggccggcggtactcggcgcgggactgatgggcgtcggtatcgcctgccatttcgcccgtcacggtcacgccgtccgcctgtatgacaccgacccgcagcgtctcgctgaggttccggcggtggccagcgccatcctgcgcgagctggaggccagcggtcaacaggatcccgccgaccgcgacgcggtgctggcccgtctgacccccaccccgacgctgaatgccctggccgatgccacgctgctgattgaagcgatccccgagcggctggcgctgaagcacgccctgtacgccgagctggaaacgctgatcgccgacgagacgattatcgccagcaacaccagcggcctgccgccggatcggctggcgcagggcatgcgccaccctgaacggttgctgatcgcccatttctggcatccgccgcacctgatcccgctggtggaagtggtgcccgggagcgccacgctgcctcatctggcacgccaggtgagcgacttttgcgccgcctgcgcgctggaggcggtggtgctcaaccgcgccgcgccgggctttgtcggcaaccggctgcagttcgccctgctgcgcgaagcactgcatatcgtccacagcggcatcgcttccccggaggtggtggaccaggtgatgcgcgcctcgctgggccgccgctatgcgatggtcggcccgctggaggctgcggacatgaccggcctggcgacggtccaggatatctgccagcacctgctgccggagctggccagcggcacggagatgatgtcgctggtggcggagaaagtggcgcgaggcgacaccggcgcccgcagcgggcaaggcttttaccgctgggacgaggcccggcaccagcgcatccagtcgcgccgggaacaccagctgcgcttcgccctgaaaccctagtatcgcgttctgtacccctacaataacaatgagagtgagacgtcgtgatgagtgtgataatagccctggccgcgctggcgttactgatgctggcagcctaccgtggatacagcgtgatcctctttgcgccgatcgccgccctcggcgcggtgctcctcaccgacccgggcgcggtcggcccggcctttaccggcctgtttatggaaaaaatggtcggctttgtgaagctctatttcccggtgtttctgctgggcgcggtattcggcaagctgattgagctgtcgggattctcacgttcgattgtcgccgccgccatccgcatccttgggcgccgccacgcgatcccggtgatcgtgctggtgtgcgccctgctgacctacggcggggtgtcgctgtttgtggtggcctttgccgtctaccctttcgccgccgaactatttcgccagagcgggatccccaaacggctgatccccgccaccgtcgccctcggggcattctcgtttaccatggacgccctgcccggcacgccgcagatccagaatattattcccaccagcttcttcggcaccaacgcctgggcggccccctggctggggcttatcggctcgctgttcattatcatcttcggtttgctgtggctggagcgtcagcgccgcaaagcgcaggcccgcggcgaaggctatgggaccgacctgcaaaatgagccgcagaccccggatgacatcgatctgccgcatccgctaatcgctatcgccccgttgctgctggtgggggtgctgaatttgctgttcacccactggatcccgcagtggtacggcgccagccatgagctcaacctgccgggcctggcgaagcctgtcgtcaccgaagtggggaaaatcaccgccatctgggcggtgcaggcggcgctgctctccggcattgtgctggtgctggtttgcggctatcgcaatatccgcggccggctggcggagggaagtcggacggcggtgggcggggctattctcgcggcgatgaacaccgcctctgagtatggcttcggcgcggttatcgccgccctgccgggtttcctggtgctgtcaaaagccctcgcggccattcccaatccgctgttaaacgaggcgatcagcgtcacggtgctggccgggatcactggctcggcctccgggggaatgagcatcgccctggcggcgatgtccgagacctttgtcgccgccgcccacgccgccaatattccgctcgaggtactgcaccgtgtcgccgccatggccagcggcggcatggacaccctgccgcacaacggggcggtgatcaccctgctggcgatcaccggcctgagccatcgccaggcctacggcggcattttcgccatcacggtgatcaaaagcctcgcggtactgtttgtcattgccacgttctatgtgaccggcattgtctgataccagattgaaggagtaatacaatgaacttacacggtaaaacggcgctggtcaccggctccaccagcggcatcggtttagggatcgccaaagtgctggcgcaggcaggcgcccagctggtgctcaatggcttcggcgacagcagccacgcccgggctgaagtcgccgcgctgggcaagatccccggctatcacgacgccgacctgcgcgacgtcgggcagatcgaggcgatgatgcactatgccgaaagcaccttcggcggcgtcgatatcgtgatcaataacgccggcatccagcacgtggccccggtggagcagttcccggtggacaaatggaacgatattctcgccatcaatctctccagcgtcttccacaccacccgcctggcgctgccgggtatgcgccagcgcaactgggggcgcatcatcaacattgcctcagtgcatggcctggtggcgtcgaaagagaaatcggcctacgtcgccgccaagcacgcggtggtcgggctgaccaaaaccgtggccctggaaaccgcgcgcagcggcatcacctgcaacgccatctgcccgggctgggtgctaaccccgctggtgcagcagcagatcgataagcgcatcgccgagggggtcgacccggagcaggccagcgcccagctgctggcggaaaaacagccctccggggagtttgtcaccccgcaacagctgggcgaaatggcgctgtttctgtgcagcgacgccgccgcccaggtgcgcggcgccgcatggaacatggatggcggctgggtggcgcagtaagccgctggcgccgcgaagatcagaacatcgccagaaagcgtttcaccgtacgcgagcgctcgaagcgccgccaggcgatggcgatatcggtcttcagcggcgccccgctaagcgggtgatagctgacgttcggctgctggatgcaggtcatcgactgcggaaccagcgcgaagccgaagcctgcattgaccatgctcagcgacgatgaaatttgcgacgactgccaggcgcgctccatatcgatcccggcgcgcaggcaactgttatacaccagctcatacagcccgggggccacctcccgcgggaagaggatcggcgccacgtcgcgcagctgctccagggccagggtcggctgcgtcgccagcggattatcgcgcggcagcgcgataaccatcggctcctcatcgataatccgcagattaaaggctttactgctctcgcacggcaggcggacgaaggcgatatccagctcggcctcgctcagggcggtcatcagattggccatattgtcttccatctggtgcagggtcaccccggggtggtcgagctgaaaacggtgcagcagcgtgaagatttgcggatggaaagcatcagaactggtaatgcctagcgacaggctgccgttcatcccgcgcgcaatgcccttggccttctccagcgccgcatcgctcatggcgaggatctggcgggcatcctcatagaaagactctcccgcttccgtcagctccaccccgcgggttaaacgccggaacagcggggtccccacttcgcgctcaagccgctgaatttgctgacttaacggaggctgtgaaatacccagctccttggcggcctgggtgaagtgccgcgtcctggcgacggcgacaaaatagcgaagataacgaagttccatatcgaaaacgtctcaaaccagcatggtttctatattggaactgtgagctgaatcgggtcaacatttatttaacctttcttatatttgttgaacgaggaagtggtatatgaatcattctgctgaatgcacctgcgaagagagtttatgcgaaaccctgcgggcgttttccgcgcagcatcccgagagcgtgctctatcagacatcgctcatgagcgccctgctgagcggggtttacgaaggcagcaccaccatcgcggacctgctgaaacacggcgatttcggcctcggcacctttaatgagctggacggggagctgatcgccttcagcagtcaggtctatcagctgcgcgccgacggcagcgcgcgcaaagcccagccggagcagaaaacgccgttcgcggtgatgacctggttccagccgcagtaccggaaaacctttgaccatccggtgagccgccagcaactgcacgcggtgatcgaccagcaaatcccctctgacaacctgttctgcgccctgcgcatcgacggccatttccgccatgcccatacccgcaccgtgccgcgccagacaccgccgtaccgggcgatgaccgacgtcctcgacgatcagccggtgttccgctttaaccagcgcgaaggggtgctggtcggcttccggaccccgcagcatatgcaggggatcaacgtcgccgggtatcacgagcattttattaccgatgaccgcaaaggcggcggtcacctgctggattaccagctcgaccacggggtgctgaccttcggcgaaattcacaagctgatgatcgacctgcccgccgacagcgcgttcctgcaggctaatctgcatcccgataatctcgatgccgccatccgttccgtagaaagttaagggggtcacatggacaaacagtatccggtacgccagtgggcgcacggcgccgatctcgtcgtcagtcagctggaagctcagggggtacgccaggtgttcggcatccccggcgccaaaatcgacaaggtcttcgattcactgctggattcctcgattcgcattattccggtacgccacgaagccaacgccgcatttatggccgccgccgtcggacgtattaccggcaaagcgggcgtggcgctggtcacctccggtccgggttgttctaacctgatcaccggcatggccaccgcgaacagcgaaggcgacccggtggtggccctgggcggcgcggtaaaacgcgccgataaagcgaagcaggtccaccagagtatggatacggtggcgatgttcagcccggtcaccaaatacgccgtcgaggtgacggcgccggatgcgctggcggaagtggtctccaacgccttccgcgcggccgagcagggccggccgggcagcgcgttcgttagcctgccgcaggatgtggtcgatggcccggtcagcggcaaagtgctgccggccagcggggccccgcagatgggcgccgcgccggatgatgccatcgaccaggtggcgaagcttatcgcccaggcgaagaacccgatcttcctgctcggcctgatggccagccagccggaaaacagcaaggcgctgcgccgtttgctggagaccagccatattccagtcaccagcacctatcaggccgccggagcggtgaatcaggataacttctctcgcttcgccggccgggttgggctgtttaacaaccaggccggggaccgtctgctgcagctcgccgacctggtgatctgcatcggctacagcccggtggaatacgaaccggcgatgtggaacagcggcaacgcgacgctggtgcacatcgacgtgctgcccgcctatgaagagcgcaactataccccggatgtcgagctggtgggcgatatcgccggcactctcaacaagctggcgcaaaatatcgatcatcggctggtgctctccccgcaggcggcggagatcctccgcgaccgccagcaccagcgcgagctgctggaccgccgcggcgcgcagctcaaccagtttgccctgcatcccctgcgcatcgttcgcgccatgcaggacatcgtcaacagcgacgtcacgctgaccgtggacatgggcagcttccatatctggattgcccgctacctgtacagcttccgcgcccgccaggtgatgatctccaacggccagcagaccatgggcgtcgccctgccctgggccatcggcgcctggctggtcaatcctgagcgcaaagtggtctccgtctccggcgacggaggcttcctgcagtcgagcatggagctggagaccgccgtccgcctgaaagccaacgtgctgcacctgatctgggtcgataacggctacaacatggtcgctatccaggaagagaaaaaataccagcgcctgtccggcgtcgagttcgggccgatggattttaaagcctatgccgaatccttcggcgcgaaagggtttgccgtggaaagcgccgaggcgctggagccgaccctgcgcgcggcgatggacgtcgacggcccggcggtagtggccatcccggtggattatcgcgataacccgctgctgatgggccagctgcatctgagtcagattctgtaagtcatcacaataaggaaaggaaaatgaaaaaagtcgcacttgttaccggcgccggccaggggattggtaaagctatcgcccttcgtctggtgaaggatggatttgccgtggccattgccgattataacgacgccaccgccaaagcggtcgcctccgaaatcaaccaggccggcggccgcgccatggcggtgaaagtggatgtctccgaccgcgaccaggtatttgccgccgtcgaacagtcgcgcaaaacgctgggcggcttcgacgtcatcgtcaacaacgccggcgtggcgccatccacgccgatcgagtccattaccccggagattgtcgataaagtctacaatatcaacgttaaaggggtgatctggggcattcaggcggcggtcgaggcctttaagaaagagggtcacggcgggaaaatcatcaacgcctgttcccaggccggccacgtcggcaacccggagctggcggtatatagctcgagtaaattcgccgtacgcggcttaacccagaccgccgctcgcgacctcgcgccgctgggcatcacggtcaacggctactgcccggggattgtcaaaacgccgatgtgggccgaaattgaccgccaggtgtccgaagccgccggtaacccgctgggctacggtaccgccgagttcgccaaacgcatcaccctcggccgcctgtccgagccggaagatgtcgccgcctgcgtctcctatcttgccagcccggattctgattatatgaccggtcagtcattgctgatcgacggcgggatggtgtttaactaataaaaaaagctctgacatggcttgcccctgctttcgcgcaggggcttttttttggtttgggtgtgagcttcgtgcaaaacacagcaacgatatttgaaagtctctggcgttgtcacttacgcttcagcacaacgtggcaatctggctgggatgaaagtatgctttgagcgaagagctacctgtcactgtgtgcgattgaatattttgtcacacgagcataacaaccctgttgagaaatctggatctaacatctatatatcagcaatatactccactttataaaccgtagatcaggagattactttgcaaccagatcgctcaagactttatcttcgccgcgtaaacgcatcagatatagatgatctcttcaggatttatgacgaccctgcaacaaatacgttcaatccagcaggcccgtatcccgatattagtcacgcacgtaatgtaatggcccgctggcttaaccactgggagaattataggttcggaaactgggctatctcactgaaagagaatcccgatagaattatcggttttggagggcttagcattatcagttatgacgatacaccgataatgaacctggggtatcgtttctctacagaatcatgggggaaaggtctggcgacagagttcgctaaatatgcggtcgggtacgggtttgatgttttaaaactggctgagatttctgcggtagtaagaccaaaccatctggcatcccaaaagatcctgacgaaagcaggtctccggttttcacgaaatattcatgacgtgaaaaatgagcccgcaagcatgctttttactgtgactctggatgagtggaacaacgcgctaagtaggggaactaccccacccattgatcattagagttcatgcgtaacgtccgctgctgacgcggatcggacgagcgactgagttgtaggtccgctatgagcgatcttcggacattgcaaatctcgcagtttgatttcatgcgaagcagcccaaggctgctctgttttataacaggtgtcaggctttaattaatgcaatcacagagagaatagtcttaccgggctcctgagaaaaatctggagcaaactgcgctgcaagagtgcttaaagaagtaatcacacctccagcctgctcagcctgcctgagcgctgcgtcttctgttctcgaagagcggctaccgatgcagtctactggaatgaatacattgtaaccagcctgaattccacccagggttgtaagtaagacagccacttcagcagtgtagccagccactataagggtttttcggccagaacgtttaatggcgtcagtaatctcagaaacctggaatggatcggctattttacgaaaaatggtgttgtgcgtatcggcatactccctgagcgaaggtaccagctcgcccggtttaccattttgagtaaccgtcagaaagtaagaaggggcggaaacaacttttgcacattttgcaagcccccctacatttgcagtcaaagactcgggagatatcgtattacatgtacttaccaggccgggatgtaaatcagcaaagataaaaacggcatcatctttttcaacgctgaacctgttatccattttgctgcttcctgataatccgggattattagattcttttatttcgttatctgcgtttgcagttgcggacatacctaaagctattgcgcccagcattgcgctacctgcattaataaaatctctacgctgcattttaactttctccattggccagtttgagaaggagcggatgggtatgatattttcactgtaaattctgctgaaaatgatactggtgtgtgctgtccaggcctctggagtggaggaaattctctacaatatctgctatctgctgattattcttatccgcaaacgcaaaatgagtgttcccgtgtattccatgctcgggaagaataaagagcgtagcctgcccaccatgtcggttgagagtatcaacgaattgccgcgcacgtatttcattaacgcgccagagttcctcaccaaaactcgcactctcagaccgtacaacgttgtccccaatgatgaccataacggggatggctgttaatgctctgaatcgctcaggggaaacaacctgcggggctgttgcttttcctacaaatgacagtgaggttttaacatttttagggaggtcattcgaaggaaacgcaaacgcccctggctcgaaagcaataatgcttcgaaccaacttcggagactccattgcagtctcccatccatactgtccgctcagtgaatgagtcatcagaatggcaggtcccgtttgtttcaacaaagcagtcatggatttcgccataaattgcctttcctgaatatccggtgagggctcaggcccggtattcggggtctgccatcttaaaaattgctcaatggcacgctcgttttgaggaaattgagagtcgctgaaaaaaaccggtttttgtggcgggagccatttacccagtctgaacgtattccatgcgatggattctttatggtcggtgggaatatctgatactgcggagcccggctctgttcttcctgccctcccacggcgcggctggtcaattataaaaaccggccagtgtgcacgggtgaacatttgccagaaaccgtcacgtccatcaggcgttgtttcccatgatttgcctgattgacctccaccatgccacatcactacaggcaggctgtgactgctctgaggaataaaatactgagcataaccatgatcgtaatgaaaagtattaccttcctcatccatatcggtttttcccgcaaacatcaggctacccatgtctgtcagcacaatggggggccgtgctgctttatcgtagcgggagatatctgctgcgttgctgaccgatggcagcagcagagctgctgccatcaatggcaagattgacgcatcaaatttttttttcatgataaggcgcttattctcggagaattaaaaatcaggtattaaagatttttgtgccaacggttttaattcgctcaggatcggtatgtgctgtaaacaacgttttaccggtatcaagctggctgattttctccatatcagcatcgctgattgagaaatcaaatacgttaaagttctcacggatgcgcggcagattaactgacttaggtataacgataacattacgctggatcagccagcgcagaacaacctgggctacgcttttattataaacctgtgcgatcgaggcaagcagtggattgctgaacaggttgttttttccttcggcaaatgatgcccaggattgtgcctgcacgttcatactctgcatgaactcaacgttttgtccctgctgcaagaaagggtgcatttcaatctgattgacagctggcgtaatacgattaaacgttgccaaatcggtcaatcggtccggagcaaaattactcacgccgatagccttgatcaggccttcatcatataactcttccatggcgcgccatgcaccgtgtacatcagagtaaggctgatggataaggtataaatccagataatccagcttaagacgatcaagtgctcgcaggaacgcgctgcgggctttttcataacccgcgtcctgtacccataatttggtagtgataaacaattcatctcgcgcgatcccgctttgctgaatggccgcgccaacggcggtttcattctcataagcagcagcagtatcaataagacgataacccgtctgaagagcaccaagaacggcttcctgacattctttcaagtcctgcatctgatagacgccaaacccgagtataggcatctgaacgccattattgagggtagtaaatttcatgagcattgtcctgtcagtccagaaagatgagataaattcccggccaatatagtttccgtttatcaaccagaagcattgctattttacaagggctcgattagcattttaataacgtatagtctaaaaaactttatctggagtctaatggatcccttttctgatgttttgaatctgctgtctgcccgcagctatgccactgcaggtctttccgccggcaatcactgggctatgtcttttcccggatataacggactcaagttcatttttataaaaaaagggatgttctggttcagactggaagcggaacctgaatggacccagctgagtgaggggcaaggcctcgtgctgacccgatatgcccgctttttaatggcgacggacgttaacatcccgccagctgagtcctctgagaaaaaaaggcctcgcgttaacgagaccgtcaactatggaggtgacgaaaacctgttactggctggaaagatggaaattgatcttacttcttcagatattctgcttaacggcctgccgcttgttcttcattttaatacgcagaccgatgacagttctgcgctgtgcacgcttatgtcgctgttctttagggaaaaggtagctaataagccaggctctgttcaggcctgtgactaccttatgcacctgatcatgattgaagtgctgagaagtggatacgaaaagtcatctgaaggctgcgtagtcatcgacaaatttagcgatgcccgtataaacaaggtacttagcgcaattcatcaggaaccagaaaacaactggagtttgcttgagctggcaacaatatctggtatgtcacgagctggcttttcaaaaaaattcagggaggtaacgggactcacgcctcttctgtatctgacaaactggcgtatgcggcttgcgagtaaatccctgagatatacccgtgagtctgtaaagctgatttgttttaagctgggctacagttcagaaagtaccttcagtagtgccttcaagcgcgtttatggcgtcgcccccagaatttatcgtgatcaacactttcaggcaggcttaaaaaaagacgattaaagcctaatcctttcgcacacaggcgattcattagttaacgaaacctcatcgctttttattagattttatctagtcaggctgtgggtatatttcatggttacatcccagcgccccgaatgacatctcacccggagggcgtgactgaaattattgaagtggttactaagttatacaatggcgctaaaaatttgtgactggcacctgctcaaccagaatacattgatgtaagccacgtccgcttttggcactcagcagacatgaaattctggaatagcattcgtacacttagaacatcgagaagcttttgaaagccgcgtcagcggcatgacagcgccagcagagaaaaacccggatggcggcgtatggcgccttatccgggctacgctctggtgccgtatttttgccgggtggcagctacgccttacccgacccggtgatttggcgctcaattcgcgcccttcgcaggcccgcgcaagcgtagcgccgccgggcaagggcagcgggtgcggagccgcttttgtgccgggtggcggctgcgacttacccggcctacggtccgtgcgacttgtcgttaatttattcaccattgttgctgaaactgccggtgctggcggcctcaaaatcgctgagacgttcccggaaggccggggcagcccgcatggatgcgggctgagggccgtgttttgcacggacgctgcctcggcccgacccgaagcctgcggggataagtcgaagggaccgcgtagcggcgattttgctggccggagcccgggggtacagggggcggcggcgactggccgccccctgtgcgctccctgcgccatgccaggcataacgcagaagattaaccgggagcgcaaaatacgctgaagccacagataacataaaagacttcccggcagtgctttccctcacccaggccttcttccggagggagagagaaccgtacggcagtcgttgccgttccatgacgctccctgcgccacggagaaccaggtgcagcaccacgaagcgggagcacagagtacgctgaagtcacgcgtgagaaacgctttcccgggctgagaaccaggaaaccaataatagtctccaccaccgccggcaagaaatcaggctccgagcccaacatgttgccgggtggcggctggcgccttacccggcctacaaaggccacccgcgatttggcgctctattcgcgcccttcgtaggcccgcgcaagcgtagcgccgccgggcaaggacagcgggcacggagccgattttgtgccgggtggcggctgcgccttacccggcctacaaaactcttctggtggcatgcccaggcccgcgcctgcgcagcgccgccgggcagttactgcgcctgctgctgcgcctgcgccagctggcggacgatcgcctcgcgccgcgcatccccttccggtagccgggccagcaacgcctgcagggccgccacggcctcggggtaatcttcattgcgcaccgcgctcagggccagcatctccagcaccggcaggctgttcggctgccgctgatgcaggtcacgcagcagcagctcgcccatccgaacctgaccgctatctcccgcccgcaccagcgcgctggcgtaatcgaaagccgccgccgggtcgtccgccgccagagcatgcgcccggccaaaggcgccgatcgccgtctcgccatcgtttaacaacaggcccagccgcccaagcagctgccagccggcgaggtcgttcggagtatcctgcaggtggctgcgcaggccaagccgcagctccgccagctcatccattcgcagcggcgccgccgtcgggtccttaacctgctgcaacagcgcaggaaaatgtcgttcagcctgctgccagagcagcacctggccaatatcgctggttttcagatacaggcccagactcaggaccaccagcagcagcgcgcccggaagcagcgcccagcggcgtagcggccgttcgccagactgtgcctggggcggaatatccgtcagcagcgtgcgctgcagctcgacgaccagcgccgggttgtcctcgccgcgctcctgcgccagctcctgcaggcgcgactggtacagggcgcggttgagggcatcgcggtctaccgcccctttgcccgaccacgggaagtacagcagccccagcgcgccagccagcagcagcgcgacgataaccaccaacaggctcatcgttcttttccttcttgcaataatgccgccagccgctggcgctcttcggcgctgagcgccgcgtcaggaatgtcgcgacggcgggcgcgggcgataatcactcccgcgcccgccagcacgaacaaccccggtcccagccacagcagcaccgtgcccgcggtcagcggcggctcatagctgacaaaatgaccgtagcgggccaccatatagtcaacgatctgccctttcgttttcccctgctgcatcagctcgtacaccttctgccgcatatcagcggcaatcatcgcgtttgagtcggcgatgctgttgttctggcatttagggcagcgtagttgggaggtgatctcgcggaaggcctgctcctgggcctcatccttaaactgccaggtatcgatggcggcccacgcctggccggtcagcatcagcgccagcaggatgaccattacccctctcatcaacccgccctccggttgtattgatcccacagcggctggagctcctcgcgccacacccgttcgttcaggtcgccggcgtgccgccagcggataatgccctgaccgtcgataagaaacgtctccggcgcgccatagaccccgagatccaggccaagcatgccgttgccgtcgtagaggctcagcctgtagggattacccaggcgctgcagccagctcatcgccttctggcgatcgtctttgtagttcatccccaccacccgcacgccctgctgcgccaggccgttgagaaactgatgctcggcgcgacaggttggacaccaggtggcccagacgttgagcagcagcggcttgccgtcaatcagcgtccgtcggtccagcgtctgatcgggggtattcagcgcttcaaggcgaaattccggcagcggtttgccaatcagcgccgactcgagggtcgtcgggtcatcgccctcggcgttgcgcatcagttgccagaacagcgcggcggccagcgccagaaacagcgccagcgggataaacagcagcttccggttcatgaggcctcctgcagcttcttacgcatccgatagcgcgggtcgagcatgcagcacagaccgccgagggccatcagcaccccgccgtaccagatccagcgaacgaacggtttgtagtacagacgtaccgcccagctgccgtcgctcagctcttcccccagcgcggcgtacagatcgcgggtcagcccgccgctgatcgccgcctcggtcatcatcatccggctggcggtgtaaaagcgtttctcggcatacagcgtcgcttccgggcgtccgctatgggtcacggcgataatgccttcgccgccggtccagttggggccgacgatattgcgcacaccgttaaacacaaagtgatagcggtggatatcgatgctgtcgccggggcgcatccgtacatcgcgctccacgctgtagttctggctaaaagtgatgccgataacggtcaccgccacgccgacgtgaccgagcaccatcccccactggctgcgggtcagcgtccgcaggccgcgccagaagccgtggcgatgagtggcccgttcgtgaacctccagcagggcgaagatcagcacccacagggccatcatcaggccaatgaccgccatggcggtgatacgatcctgcagcagccacggcagcgccagagaaagtgacaacgtcaccaccagagcgataatcaggcgcttaatctgtctggcgatgtcatcgcgccgccagcggatcagcggtcccagccccagcagcagcgcaaacggcgccatcagggcggtgaacatggtattgaagaacggctcgccgatggagatgctgccgaggcccagctccttatgcaccagcggcaacagcgtcccgaggagcaccaccagcatcgcggccatcagcaaaatattgttgccaagcaggaacgactcgcgcgaccacagggtatgttccacccgcgcccgcacccggccgcccttcagggcgtacagcagcagcgacccgccgatggcgacaatcagcagcgccagaataaacagcccgcgcgacggatccgaggcgaaggcatgcaccgagaccagcaccccggagcgcaccaggaaggtgcccagcaggcacagggagaaggcggcgatggccagcagcaccgtccaggcgcggaagctgccccgcttctcggtcaccgccagggagtgcagcagcgcggttcccaccagccacggcataaacgaggcgttttccaccgggtcccagaaccaccagccgccccagcccagttcgtagtatgcccacgccgagcccagcacgatgccgagggtgaggaacatccatgccgcctgggtccagggacgcgaccagcgcgcccaggcagtatccagccggcccgccagcagcgaggcgatggcgaaggcaaaggccaccgagaagccgacataacccatatagaggatcggcggatggaaaatcatgccgatatcctgcagcagcggattgaggtcgcggccatcaatggggtactgcggcaggccgcggctgaacggattggaggtgaagaggataaacagcaggaaaccaaaggcgatcatccccatcaccgccagcacccgggcgacggcgtcgagcggcatccggcggctgaagagggcgacggcgaaggtccagacgctgagcagcagaacccacagcagcagcgagccctcgtgcgccccccaggtcgccgctacccgataccacaccggcagcgcgctgttggagttttccgccacgtagcggacggtaaagtcattgaccacaaaggcgtgcaccagcagcaggaaggcgccgccgatacaggcgaataggccacaggccagcggccgcgccagggccatcagccgccggtcctgccgcgccgcgccccacaggggataaacgctcaggagcagcgccagccccgccgccagacacaataaaaagttgcccagctccggcatcatggctgcgcccccgttttctccggcgtcatggcgtttttcacctccggcggcgtgtaattttcatcatgtttggccagcacctgctgggcggtaatatgccgctcgccgtccagcacgccctgggccaccacgccctgcccttcacgaaacaggtccggcaaaatgcccttatagctgacgtccacgaccccgcgggcgtcatacagcttaaagcgcacgtcgagggtttgcgggtcacgctgcagggagcccggctgaacgtagccccccacccgcaggcgctgaccggtatggggcagcgcccgggtttccgttttaccgtagataatttcccccggggtgtagaacagatcgatattgctgctcagggcgtacagcgtcaggctgacggttagcccgaggccggcgagcaccgccagcacgatatacagccgggttttacgacgcgcttgcatccgcggcctccttgtcatgttcgcgggcggcagcgatccgccgctcgcgcgcctgctggcgtcgcacctcatggaacagcgcccgccgcgcccacagagtgtgcaccgtcagcaggccaaaggcggcgacggtcacggccaccgccagccagacgtacacggcatagccgcccatattcaggaaggcggcgaaagacgaaaaggcggggctcatcgggcggctcctttattcaccagcgccaccacccacggtcgacggcgctccagttgcaggatcaggttacgcaggcgcatcagggtcagggtgaccgacagcgtgaggaaggcaaagatgcagatccgcagcggcagacgcatgcttgggtcgatggtttgctgcaggttggtcgagccctggtgcagggtgttccaccagtagaccgagtaatgaatgatgggcagattgaccaccccgaccagcacgaggatcccggccgcgcgcccggccagccgccggtcgtcaaaggcgtgccacaaggcgatgaccccggcatacagaaacagcagcaccagctccgaggtcagacgggcatcccagatccaccaggtcccccacatcggcttgccccatgccgcgccgctgaccagcgccaccagggtgcagaccgcccccaccggcgccagggcggcgatcgccaggtcggccattttgatctgccagaccaccccgacgaaggccgcgacggccatcgccaggtacagccccatcgaccacatcgccgtcggaacgtgaaggtacatgatccggtagctttccccctgctgatagtccgcgggggcgaagccaaagccccaccccaggccgatgaccagcaacagcgcgctcaacgccgccagccaggggatccagcatccgcacaggcggtacagccgctcggggatcgccagttgatgtaacgctttccacatagacgcttactcacacggttatgatggccgcgcccgcaggcgcagcgagttatcgcacggtcagccgcagcgcagcggcggtggcgaacggacacagggtggcgctggcggttaagaacgccgccagcatcgccagatagccgctgaccgggagcccggcggccgccgccgggcaggccgcggtggcgaaaatcagcagcggcaccgccagcggcagcaccagcaggctcagcaggacgccgccgcgcttcaggccgaccgtcaggccaacccccaccgcgccgagaaaactgagcgtcggggtgccgagcagcaaggtcagcgccagcacaccggcgtcatgcagactcatccccagcagcagcgccgccagcggcgagacgatcagcagcggcaggccgctcatcatccagtgggcaaccaccttcaccagcaccaccgccaccaggggcgtcggcaggagcatcagttgctccagggaaccgtcctgccagtcgtcgcgaaacaaccgatccatcaccagcagcgccgccagcagcgcggcgacccacaccacgcccggcgcaatctgcgccagcagctgcggcgcggcgccgacgccgaacggaaacagggtgatgacgatcagaaagaaccagagcggattgaggatctccgccccgctgcgccacgccaggcgcagttcccgggccaacagcgcacgcatcattgcccgcctccagcctcgccgccgaggcgcagggtgcgcaacggacagcccagcggccgcagcggctggtgggtggtgaggatggcgcatcccccctgccgggcgtgctgctccaggcgacgggtcagggtttccatcgccgtggcgtcgagggcggtgaacggctcatcgaggatccacagcggcgcgtcggttaaccacaggcgggtgagcgccacccgacgctgctgcccggcggagagctggctcaaggggagatcttcatagcccgccagaccgacggcggcgagggcgctttcccgctgctgaaggcggctggccggaaagaagaaacgcaggttttcatcggcggtcagcgccgcgttaacgccgggtttatggcccagccacagcagctgacggtgaaatgactcccggaccttcgccagcggctggccctgccagctcaccaccccgctttccgggcgcgccaggccgcagaggatccgcagcagcgaggttttccccgcgccgttatcaccggcgacctgcagcagctcgccggcagcgagggacagcgtcagcgccgcaaacagcggtcgatcgtcaacgatgcaggtcagtcgctctgcatgcagcatgaaggcaaactccttgattcagacagtattttacgtcgtcgctaagtatgggttgcaccgcgcgggcgacgcaaccctgacggttactgtccggcctccggcagcttcgagatatcggcgttgcctaacgccttctcatcgtgcgccgcggtctccttacgcaccttcgccacatcgctggcgctgaccgccggcgcgttgttgccccagctggtgcggatgaaattgaccacatccgccacctgctggtcgtccaggcgccagccgaacgacggcatggtcaggttggagaccgcatctttcaccgccggcgtggtgctcccggtcagaacgatgtggataagcgaagtggcatcttcggtctggaccaccggattgcccttcagcgacgggaaggcgcgcttatagcctacgccgtcggtgcggtggcaggcggcgcagttatcgacgtacagcgcggcgccggttttactgtcgttacccttccacagatctttcgccacgctgtcttccaccggggctggggtctgtttgccgccgcgcggcgggagcgatttcaggtagcgggcgatggcggtgatgtcgtcatcagagagatactgcagactatgctccaccacatcgctcatgccgccgaagaccaccgatttatcgttgcgtccggttttgaggaactcggccagctcggcttcgctccaggtccccagaccgtcgcggttttcgccgcgcaggctggaggcgacccagccgtcaatcggcgcattgctgcccgccaggtaatcatcgccttcgctttcgctgagcgctttttcctgcatcgtcaggctacgcggggtatgacaggcgccgcagtggcccagaccttccaccagatagcggccgcgctcgagcaccgggtcaacctgcgggttggcgacaaagtcgctcggcgtcggggcgaagatgccgcgccagaacgccagcggccagcgcatcgacagcggccatgggatgtcggtgtccttgttggcgacattcaccggctccacgccgtgcataaagtaggcgtacatggcgcgcatgtccgcttcgctgatccgcgcgaacgagggatacggcatcgccggatagagcgtggaaccgtctttccgcacgcccttgcgcaccgcgtcgtcgaactcttcgaaggtgtacccgccaatgccgtgttctttatccggcgtgatattggtggagtagatggtgccgatcggcgtctccatcggcaaaccgccggcgaaaggtttccccgctttgccgttggtgtggcaggcgacacagtcccccgcccgcgccagatactccccctgcttaatcagattgctgtccgcaggcgcctcttcggcgaaggccgcgcagctcaatgccccaagcaccagggccgataaccattgcattttcatcatctgccttcctttatgcctgcaccaggggacccggatttttcagatactgctcacggatcgccttcgctgaccagtaggccagcgcggccaccgtgccggttgggttgtagcccagcccctgcgggaacgcggaggcgccgatgacgaagacgttatgcacgtcccagctttgcagataacggttaacggcgctggttttcggatcttcccccatcaccgccccaccgttcatatgggtggtctggtaggtggtggtatcaaagtggctgttggcgttttttgggctgccgaggatatatttcggcttcatcgctttagcgatcggcgccatcttatcgaacataaactgcgccatcttgatgtcgttttcctgccagtcgaaggtcatgcgcagcagcggctggccaaagacgtttttgtagttcggatcaagatcgaggtagttctgccgataggactggtgcgcgccgtgggcatccatcgacaggtgatgggtgtaggtatcggccaccgccgctttccacttgctgccccacgccggggtgcccggcggtaccgggaaaccggagatgggcttggtcccggcctggttgacccagaacggcgaaccgccgacaaagcccgccgcaccgtggtcgaagttgtcggcgttgaagtcgtcgacgccgacgccgttgccgcccgcaccgataaacggattggtataggtgtctttgtcgaaaatggccttgatggtggtcatgttctggtaggcgaagttacgccctaccaccccttcgccggtctccggattgtacggtttgccgatcccggagagcagcatcaggtgcacgttgtggaactggaaggcgccgataatcaccaggtccgccggctgttccatttcgcgcccctggccgtcgacgtaggtcacgccggtggcgcgggatttgtcgttggtcaggttgaccttcagcacgttggcgttagtccgcagctcaaagcgtttttcctggcgcagcgccggcagaatgttcacgttcggcgaggctttagagtacatgtagcaggcgtagccgctgcagaaaccgcaaaagttgcacgggcccatctgcgcgccgtaggggttggtataggagtcggaggtgttggccgacggcaggttataggggtgataccccacttccagcgccgctttttcaaacagctgcgccgaccaggtgtttttctgcgccggcagcgggaagtcgtccgagcggtccggggcgaaggcgttgccgccgcggcctttgccgacgaccttgcctttgatcgaccaggcggtcccggaagtaccgaatactttttccgctttatcgaagaacggttccagctcgtcgtaggtgacgccgaaatcctggatgatcatatcctgggggatgaagtttttgccgtagcgttcttcatagtggctgcgcatccgcagctcaatgggatcgacgcggaaatggacgccggaccagtgcagcccggcgccgcccacgccggtacccggcaggaaggccgccagctggcgatagggcaccgcctgttggctggtgttatgccggatggtgacggtgcttttcgacagatcctggaacagcttgcggcggatgttgtaggtcagctcatcaatcacctgcgggtaggcgccgtccggccaggtgtcgcgcatcgggccgcgctccagcgcgacgacgttgagccccgcttcggtcagctctttggccatgatcgccccaacccagccgaagccgacgatcgcgacatcggtttttttcaatacggtggccatgattacgccctctccccattaattgataccggcgggaaggggtagcgttcgccccgttcaacccagtccagaaagtcggcgcgcgcgccgggaaaattaatcagcgtccagccgaccatgcctttattgccgccatggatcgggtcgctgaagaacccttcgcgggtgttttgcagcagataggtgaagaacagcgaggccggcagctgtttgaactcggctttacccgattcccacaggccgagcgcctcgtcctgttgctcgctgctcagttcagcgaaggttttatgatatttgtcctgacaccacgcctcggcgtcggcgatcccgaggttatagatctgtttgggcaccagcggcagctgataacccatctctttcggcacgtcgggattgaagggcccctgcatataccagatggagccggtggcgtaaggggtattgagctggcggtcgataaactccggcacgccggcctctttggcgccgggaccgagttcatccgccgggattaagcgagcgacggcggcgttgataaacgcccactcacgatcgttgaagaactgcggcttccagtcgctggccgccgcggtgttcccggaggctggctctgaagcgggggccgcctgcgcggtcgcgctggtggccacgccaatagcccctgctcccgcgccgccgatcaccaccgtcgggatcagcgccatcgatttcaccaggaaatcacgcctggaattgttggttttctcgctcgacatcatcacattcctgtcattgaaaattactgtttttgtcgctgacaaaaccagtgaatgtcgtgctggaaccgataccattgcgcttttaaaccgcttagcgtctggcccggcccggcaagtcggataaaacatcgccagaggcgatatcatttatagggttatcgtttggatagtagacgattctcaacgaaacgcgggaaatcggagagaaattcaccggtctgtcatcgtgagaagagtgctgccataaccttgaggcggtaaaccagcggcattcacaccgcgctgagcttacccatgcgccaaaaaagagtgacttgtatcacaaatgttattttttgtttatggtacatggcagattaaacgtctgtaaatactcgtattaggaataattaaacattttgagctgttaaaaaagttaataaccgttgttaactatcttgtatctattgtccggctagcgccttcagctggcgatatcccatccacaggagaagagaagatatgttcgatcatgtgaaattcggcgttagcgactatgccgccagcaaagcgttctttttgcaggccctggccccgcttggcgtaacgttggttggcgaaggcgaaccgagctacggcgcagagctggccggcagcggcgatgcttctctatgcctctatcaaagtgcggaaaaaccggcgccgctgcacattgcctttcgcgccgacagccgcgagcaggtcgatgccttctggcaggcagcgctggccgccggaggaaaggacaacggtgcgccggggctacggccaaactaccacgccagttactacgccgcgtttgtgattgcgccagacgggcacaatattgaagccgtgtgccatctggcggggtaacgggcggctaccgctgcggaaaaatccacacatcctccgccgggagcgtcagatggcagtgttcggcatcgcgcagcgccgttccgtaggcgcgcagcggaaagtcgtcgccttcggtacggaacaggtactcccagcggtcgccgaggtacatgctggtcagcagcggtagctggaggctgttatcctgcgctgcgccgtcgagtcgcaggcgctcgacgcggatcaccgccgtcgccggctcgccgacgctgaccccctcgcccgctcgcccccacagcgtccagctggcgccttcaaccctcgcacgaccgttttccagcgccgtcaccttaccgtgcagacggttattgctgcccataaactcggcggcgaacagcgtcgccgggctgccgtacatctcctgcggcgtcccctgttgctcaatgacgccattgttcagcagcagaatacgatcggagatggccattgcttcattctgatcgtgggtgaccatcagcgccgacaggcccagcttaatgatcagctcgcgcagaaacacccgcgcctcttcgcgcagcttggcgtcaaggttggagagcggttcatccagcaggatcaccggcgggttgtaaaccagcgcccgaccgatggccacccgctgctgctggccaccggagagctggtgcggatggcggttgccaaggtgccccagccccagctgatccagcacacgctgcacccgctcttttatctccccggcggccactttacgcagcttcagcggataggccacattgtcgaacaccgttttgtgcggccacagggcataggactggaacaccaggccgaggttacgctcttcggccgggatctcgctgcgcggcgtgccgtcgtacaccgtgcggttgccgatggcgatccgtccgctcgtcggtttttccagcccggccaccgcccgcagtagcgtggttttcccacttcccgcaggccccagcaacgacaccacctctccccggccaagcgtcatggaaacccccttcagcaccgggttgtcgccataggtgagatgcagattttctaccgataactcaatcatgtaatttcactccaaagcgcagggcgatacccaggccaatcaccaccagcagaatattgataaaggagagcgccgcgacgatatcgatggcccccgccgcccacagcgacaccagcatcgagccgatggtttcggtacccggcgacagcagatagacgccggtggaatactcgcgctcaaagatcaggaacatcagcagccaggagccaatcagcccatagcgcgacagcggaacggtcacgtggcgggtgatctgcccccccgaggcgccggtgctacgcgccgcctcctccagctccgggcccacctgcagcagcgtcgaggagatgagccgcaggccgtaggccatccacaccacggtgtaggccagccagacgctgaagatggtgttgcgcagggcgcgcagctgcacgataaggtgctcccgcagccagtcggccaccggcagcgccgagagccagccgtgcttcagcgactgatcgagccacatcggcacaaacaggaatacccacaggaatgccagcccggccagcagccccggtacagcgcgcgggaccagcacgctgtagtcgagaaagcgggtgacgttgtccgctttgcggtgcatggcgatgccgacaaacagatagcagatcaccgccagcgcgccgccgatgatgccgatagccatcgagttgacgatcgcccgcagcaggttgggctgctgccagatattgtggaacgtcgccagcgacagctcatcccacagcgacacgccgacgccccagttggagataaaagcgcgcagcgccacgccgagcagcggtacgccgatggtcaccgtcagccaggccactaccaccgccccggcgacccagcgccatttgcccagcggcagcgcccgcgcctgggacgccttgcccttcatggtgacaaagcggttggcggtgcgcatcagccgccgctggagcatcaccagcgggatggtgatgcagatcagcactaccgccaccgccgccatcagatggtaggagggggtgccgagcttgttagtcagcttgtagagataggtcgccagcaccatgttgccctcggggtcgcccagcaccagcatcagaccgaagacttccagaccgaggaaaaagagcaacacgcaggcgtaaagaatggatggccgcaccatcggcagactcaccgaggtcatcacctgcagcggcgtggcgccgacggtgcgcgccgcctcttccacgtcggagccgacgctgcgcagcgccgaagagatatagagataggcatgcggaacgtgagttaagccggcgatgaccacaatgctgaacatcgagtagatattccacggcacaaagccgatcagctgctgcgcccactgggaaaagaagcctaccggcccggcggccaccacgtagccaaagcccagcaccatcggcgagacgaagatcggcaccaaaatcagcggctcaatgatccgccggccgggtaaatcggtgcgcaccatcagaaacgccaaaataccgcccagcggaatggcgataatcaccaggccaaaggccagaataaaacctgaccttaatgccagataaaaatccgggtcggtaaaaataaaggcgaaggcttccagactccacgatttggagcgggaaaagaacggtgccgaaagaaaactctgcaccacaataaataacagcgggacataaatcaccagcgccgtgatgcacaccaccacgccgcgcggcagcccctgccactttctgcgtaatacgttcatggttcatcccttcggtcaggtgaataaacccgccgggtgtgaataggggcatcggcgatgcccctgaggaggattatttcgcggcggcgctgcgccattgtttaataaactgcagacgtttttgcggctgtaaataatcgagcagcgtttcgttgaccgggatcggttttaacgctttgcccagcagcgcggtcataccatcgatatcatttttacctgcaatatcgcgacgaattgagggaatatccgcctggctggcgaggatctgctggcctttttccgacaagacatagtcgagccacaattttgccgcattgggatgttcgctctcctggctaataaacgagacgcgggagagcaccagcacgtaatctttcggataggcaatacctaaagagggatcgtttttcgcccgcgcttcggcataagagccaagaatgttatagccgatcaggttttcgccggaggagacgcgctccatcattgtgccggtggaagactgcaccgtcaggccgcctttggcgatattcgccaggtcggcaaaatagttcgcgtcggcctggctgtcctgtaccgccagcataaagccgaggcccgatttttcgatatcgtaggtggtgactttgcctttaaatttatcggcctggctggcgataagttttgccagcgcggtatgcgaatccggaacctcattctgcgggatcagccgtttgttatagataaacaccaccggctcataggtagtgccataggctttttgctgccagaccgcccagtcgggtaattgcttcacctccggcgaggcatattgttccgcgtattcggtggctaatttcagcgcggtatccatcgatgagctccacaccacatccccgctgccgcccccggcggcctgttcgctgatatagcggttatacagctcggtactgttcatgtcgttatattcgactttgacgcctgggtattgcgcttcaaatcccttaattaacggcccggccgctttggtatcggtcgtggaatagaccaccaccttgccctcttttacggcggcatcaatcgttttttgataatccgcgggatagcccgcaggcacctccgcccaggcggcacaggcgaaaacggccgtcagtgaaaccactaaaccacttattttcttatacatgataccaacctttaatcatcaattaataaacacaaatttaacatatagtggtatcagctccccttgcaacgacggggatggcttttttctggcttttgtgacactggcagaatttaaaaatgtggtgtttatggcgttaattaaaacgcgatcccggcccggttttttatcgtgtgtcgtatacgcaggcgctggcgcagcggcatgtcgccgggagacgccgcccttgaccttctgcgccgggcggcgcagcataaaacggcaaacataacaaaataacaacagactacaggagagaatcagtgcctacaggacaccgctttctggcgacggatctgcatcagtttgtcgtctcactgtttacccatctcggcagtaccccaggggaagccaccctcgtcgcggaccatctgatcgccgccaatcttgccgggcatgactcccacggcgtcgggatgatccccagctacgtcaaatcccacgccggtggttttctgcagctcaaccgccacgccacggtgaccaaagacgccggcgccgtggtcaccctcgacggcaacgccggcttcggccaggtggtcgcccacgaagcgatgcagttaggcattgaaaaggcgaagcagcacggtatggcggctatcgccctgcgcaatgcgcatcacgtcggacgcatcggctactgggccgaacagtgcgccgccgccgggctgatctccattcacttcgtcagcgtcatcggcgacccgatggtcgccccgttccgcgggaaggacagccgcttcggcaccaacccgctgtgcgtggtgtttccccgcgcgggccatccgccgctgctgctggactacgccaccagcgccatcgcctttggtaaaacccgcgtcgcctggcataaaggcgaagccgtggcccccggctgcctgattgacgccgagggtcgacccactaccgacccggcggtgatgcagacctcgccgctgggcgccctgctcaccttcgcccagcacaaaggctatgccctggcgacgctgtgcgaagtgctcggcggcgcgctctccggcgggcaaaccacccatcaggagagcctgcagaccagcgtcgacgccatctttaactgcatgaccacggtgatcctgcgcccggacgcgttcgatgccccggacagccaggcgcagacggaggcctttatcgcatggtgtaagcagtcgccgcacgatgccgatgccccggtgctggcgcccggcgaatgggaggccgccaaccgcgaagcgcggctggcgcaggggatcccgctggatgccggcagctggcaggctatctgcgccgccgcgcgcgacgtcggcctgagcgaatcgcacttcgaccgctgccgccctctcgcctagccgcgttttactcccgcagagcgtctgacgtcggcgctctgcgtcatcgtcattagtgacgaggtcatgctcccgtcatcaatctcttttcatttttcaatacagatcaagagtttaaattctggcacaagacctgcatagcgcaacaggcctgcgtctgcatcaccaccaggcgataccgcgatcgttgcccgtcgggcccggcgcgacagcgatcctcagttcactgttaacaggtctgttactgatgaaaaaaatcacgagcgtgtgcccctactgcggggcgggttgcaaacttaaactggttgtcgacaacaataaaatcattcgcgcggaggccgccgacggcgtcaccaaccagaaccagctgtgcctgaaaggctactacggctgggattttcttaacgatacgcagctcctgacgccccgtcttaaacaaccgatgatccgctaccagaaaggcggcgccttcacgccggtcagctggcaggaggcgattcgctataccgccagcaagctcagggagatcaaagagaagcatggcccacgtgccatcatgaccaccggctcctcgcgcggcaccggcaacgaaaccaactatgtgatgcaaaagttcgcccgcgcggtgctgaacaccaataacgtcgactgctgcgcccgcgtctgccacggcccctccgtcgccgggctacagcaggcgctgggcaacggggcgatgagcaactcgattagcgacatcgaaaactcgaagtgcctgctggtttttggctacaactgcgccgactcccatcccatcgtcgcccgccgggtaatcaaggcccgggacaacggcgccaaaatcattgtctgcgatccgcggcgcattgaaaccgcgcgcattgccgatcgtcatctgcagctcaacaacggcagcaacatggcgctggtaaatgccttcggctatgtgctgctggaggaggagctgtacaacaaaacctatgtcgaacgctataccgaagggctggatgcttaccgcgaggcggtgaaggattacgccccggaagcggtggaagggattgtcggggtcagcgcgcgggaaatccgggaggcgatgcgcatgttcgccgccgccccatccgccaccatcatgtggggcatgggggtcactcagtttggccaggcggtggacgtggtgcgcggcctggcaagcctggcgctgctcaccggcaacctgggacggcccaacgtcggcgtggggccggtccgcgggcaaaacaacgtacagggcgcctgcgatatgggcgtgctgccgaacctgtttcccggctatcaggaggtcaccgaccccgccgtgcgggcgaaattcgccgccgcctggggcatcgacccggcgctgatggacgaccaggtcggcacccgcatcaccgaggtgccgcataaagcgctgaccggcgagatcaaagcctattatattatgggcgaagatccgctgcagaccgaagccgacctcggcctggtgcgcaaaggcatcgaggcgctggactttgtcgtcgtgcaggacatcttcatgaccaaaacagcggaaatggccgatgtcctgctgccggccacctcctggggcgagcacggcggcgtcttcacctgcgccgaccgcgggttccagcggtttgaacaggcgatccctccggcggggaatgtgaagcgcgactgggagatcatcagcctgctggccagcgaattgggctatccgatgcactatgagaacaaccagcagatctgggacgagatgcgcgagctctgcccgctgttctacggcgtgacctgggagaaaatgggcgatatgggccatgtccagtggccgtgcccgaccctcgatcatcccggcacgccgtggctgtatcaagacaaccgcttcgacaccccctcgggtaaagggcagctgttcgccaccgcctggcgcgcgccggcggagcgcccggatgacgagtggccgctggtgctctgcaccgtgcgggaagtcgggcattattcctgccgctcgatgaccggcaactgcgccgcgctgcagtcgctggctgacgagccgggacgggtgcagatgaatcctgcggatgcgcaacgactggggatcaccgacaaacagctggtgtgggtcagctcccggcgcgggaaggtgatctcccgcgccgacctcagcgatcgcatcaatccgggggcggtctatatgacctatcagtggtgggtgggcgcctgcaatgagctgacccaggataacctcgatccgatctccaaaacgccggaaaccaaatactgtgcggtgaaagtggaagcgattgccgaccagcaatgggcggagcgctatgcctggacggcctacagcgacatgaaagcgcgactgaaagccgctgccgacgtctgacctcagggagcgcagcgcgctccctctgccgctgccggtgggttacgccgccggcagctgtttctccaccagccccacccacatggcgacgccggggccgatcagcgcatcgttaaagtcatagctggcgttatgcagcggcttcgacggggtttcgccgtcggtgcctatccagaaataggcccccggacaggcctccagcatgcaggcaaaatcttcggaggccatcgacggcgcctgattccagcgcaccgcttgcgcgccgagagtggcgacggccacctcgcgcacctgctgcgcctgcagcgcatggtttttggtcaccggataacccgggaaccagctaatctcgccctgcacatcggacacctgcggctgggtcgccacatagctttcgatgagctcccgcacgcgggcgcgaacgcgattgctcagacagcggaaggtaccgcgcagcaccacggtgtccggcaggacgttgatcgcctcgccgccgtttatctgggtgatgctgaccaccgcggaatcctgcggcgacaagcggcgggaaggaatggtctgcagcgccattatcagttgcgccgccgcgacgatcggatcggccccgctctccggcatcgccgcatgacagctctttccgcgcagggtgatctcgaaggcgtccagcgaggccatcatcgcgccatcgctgagcgccacttcgccaagagggatccccggccagttatgcagcgcgtagatggcgtccatcgggaagcgctcaaacaacccctcctccaccattttgcgcgcaccgccgaggttctcttccgccggctgaaagacaaagtggacggtgccgctgaaatggcgggtctgcgccagatgggcggcggccgccagcagcatcgcggtatggccatcgtggccgcaggcgtgcatcaccccgggacggcgtgaacggtagctgacgctccccagctcggtgattggcagggcgtccatatcggcgcgcaggccgataaccggcccggggccgttctccagcgtcgccacgacgccggtgccggccagcccgcgatgcacctgcagcccaaacgaggccagtagctccgcaacgcggcgcgaggtctcctgttcctgatatccgagctcaggcgcggcgtgaaattcacgtcgccagccaacggcttcggcgatcagtgacggcgatacggccatgtattactcctttcctgcatagcgtaatgctgaataatcggtcatgcgtcgcgtttttccccgtcgctcaccggcgtcggggcgctgccgctccctccgttatatcctgtcgttaccacgctgacaacgtcacgaaatgcggcggcggcgcggcgtacagcccacctgccgccctgcggcccttttttggtagtgatttcaacggtgacaacggccagtcgattaattattatgcaactcaggacggcaatttgccgaaggatccactactgacctctccgtcatcggaaataaaatgtttaacccagaccagaatcgtcttgcccccacgctggcgatgatcatggccgcgtcgcttgtgggatttatcaccggctatacggtgccgttaatcagtcttgagctggcgcagcagcagatcgcgccgctgtacgtcggcctgctggccgctctgccgcccgccggcatgatgatctcctctttcctctctcctgcgctgtgccggcgcattgaaatgggcgtgctgctgagcggcagtctgatcctgctggcgctggcgaccatcgcctcatgcatgactaccgatatgacgctgcttttgctgccgcgcctgctgaccggcctggcctccggggtcattatcgtactcggcgaaagctggatcaccggcggcgcggcgggcagccagcgcgctaccctcaccggtctctacgcctcggcctttaccggctgccagctggccgggccgctgctgatctccgtcggccccgcctggcagacatcagcgctgatcgcgattgtcgcggtcaccgccgtctgcctgctgatgctgcgccatctgcccaccggcactcgtgaaagcctcggggagcgcgccagctggcgcagcctcggcgcctttctgccggtactggcctccggggtcttctgcttcgccttctttgacgccagcatcctcgccctgctgccgctgtacggcatggacaaagggctgaatgaagggctggcggtgctgctggtcaccgtggtgctgaccggagatgcgatgttccagaccccgctcggctggctggccgaccgggtcgggattcgccgcgtgcatctgagctgcgcggtggttttcagcctgtcgctgctggccctgccgctgatgctcggctcgcgcattcagctgatggccatttgtctgctgctgggcgccgcggcgggcgcactttataccctgtcgctggtgcgggcggggaaaaccttcaatgggcagaagctgattatgattaacgccctgttcggctttttctggtccgccggcagcgttgccgggccggtagtcagcggcatgctgatcggcatcactggttacgatggcctgatcgtcaccctggtggccagcggcgtgctgttcctgttgattcagtgtctgtgcaaaaacgagaaaaccctgcttgccagtgagcaggaagatgacatggacgaggcgacggagtccgcacggtagtcctcacgggctggcctggcgccagcccttttttatggccctcaccggagggtatcctgttcttgctggctcactgctgttaaccattgccggccccccagccgagaggaaatcccatggaaagtaataccttacatcgtggcagattgatcgatcatattctgctggttgtcgaagactttgaggcaagcaaaaacttctataccgccgtactgtcggcgctggagatcccggttatcaccacctccaacgaatacttgctggccgacgaactggtggtggcctcacgccacagcccggaggctgccgggaaactgactgggcgccaccacctggcattccaggccagagatcgtgacatggtggacgctttttaccatgcggcactgacccatggcggacgtgataacggcgcgcctggcgaacgacactatcatcctggttactatgccgcttttgtgctggatccgcaggggaataatattgaggtggtgtaccatggcaaggctgagcgcagcgccgggtctgttgcgatcagcttcacgcagtaagcgggcgaaagtcacattttcttacctgcgcaattcccataataaatgtgggtgttatcatttccttgataaataattcatacccatagctgaggcgtcgatgctggaaaacctaatcatctgataatcagacttccgaccatcactggccggactgattatcactgcgctgaaatcgaatgcggacactggcgagtgttcgcctattttgcccatgatgatgacacaggtttcccggtatgaatgtttcccctcaggagcaagcgactttattcattctcgtcccctgcggacaaacgctccacatccacgcgatggcagcgagacccctccctcgcataagaaacgtcacccccagccagttaacccggtgcgttatccctctgccatgctcgatcactccctctgcatgccgttgcgttgccttacccaatgaccgtcgtcaggcgaattttatctttcgatttgtcattccgcggccagcctgtgacgacagtcgcaagggatccacatcaaccaggccccgataccagggaaaccgtcaccgaccagggagtcttcgcgtatgaaattagcgttgggaccgtacatccgttttagcagaatcttgttatttccgctggcgatggttatctatgatttttctgcttatctgactaccgatctcattcagccgggtattatccacatcatccgggaatttgaggctgatgttgcgttagccccggcctctgtcagcctctatttagccggggggctggcattacagtggctgctggggccgctctccgaccgcattggtcgccgccccgtactactgaccggagccatcatctttgctttggcctgcttcagcatgatctttgtcacgtcgattgatcaatatcttatcgcccgttttatccagggaaccagtatctgcttcatttcgacagtcggttatgtctccatccaggaggcttttgatgaaaaagagtctatccgcattatggcggcgctgacatccatcgttttgctggcgccggtaatcgggcccctggcgggcgctggcctgatgaatttcctgcactggaagttattgtttgcgatcatcggcgccatgagcttgctgccctgggcgttactgatttttaacatgccagaaacggtcacctctcagggccgggggtttcgtccgggagaggtattttccgagtttgtccgcgcctttaaacagccggtggtgctcacgggcgcgctggccttgtcattcagtaacctgccgataatcacctgggtagcactctctccggtgatcctgatcgatgacggcgggatgtcgcgcggcgtctatgcctggacccaggtgcctgtctttggcggcgttattattgccagcatcatagtggcccgttttatcaaggatccgacctctccccgctttatctggcgcactatcccgatacagctgaccgggttgttggtattactggcgggaaatattgcatggccccatacctggtggtggtccgtttcaggaacgagtctctatgccctcggaacaggcctgttgttccccgtattattccgttttgcgcttttttcccactccctgccgaaagggacggtttcagccaccatcaacattgtggcgctcagttttatggcggcctcggtggaagtagcgcgctgggtttacttccaggctggcggcagaattgcttttcactgcctggcgctgatagcgggaatcgtcgtcatcatgctggtctcgcgcttgttaaaactccgtcagcaacatctccttcagccagcctgaaggtttaggcctttttgcccgcaacaggagaacactatgttttcatacattatgctgggaacgaacgatctgccacgcgccatcaagttctatgacccgttaatggcgctgctggggcacgtcaaagccggccgtaacgaacagggggcgtcctggggcacctacaacggcaatcacacctgcgggctgtgcgtgggcgttccttttgaccaacagcctgccggggtgggtaatggaacgatggtggcgcttaacgcccgctccgtcgcacatattgcggaactgcatgccctcgccctgcaactcggcggacgtgatgaaggcggtcccggtcaccggccgcagtatggcgacggttttcacagcgcctacgtccgcgatcccgacggcaataagctggcgtttgtttactatgcgtctgcagattgaatggctgcagcggaggtggcttttgcaggcggagaaaagggtgtcaggacggccaacttcgccgtccttattcaccgaggaataaaaaagccagcagctcaagcgctgcggcttatcttcccggcaagttatctaccgcaaagtgataacgtaatccggcgtcgcgcatacagcgtttccgccgccagctgaaaatcatattccatcgccttcagctttttcgtcttgagctgttttagtgaaataccctcgatatgccctgtcgcgaccaaccaccggatttcagccgtactcagcttgagctgttttttcagtattgatagcaggctgatgcgaaatggctgactgactctgacgcgcaccgttatccgctgacatgccatcaacgtaaccgaccattgctcgtgaatacgaaaatcaggttgccccgacggctcggcgcggttgcgcttcagcgtcgcgaggtcagcggcataatagtgaaccatggctgcatcgttctgcagcaggcgctgaagcagttcacggtttatcttgctgacgtgctgcctggaaaacagggcgatattccaggtgtaatcgcagcgcgtgcatttatagatgctccagatatccagcagcttcttttgcgaattcacccggatggcgccggaaggcgcgaagtcgcgttttacattgcaggcggggcagcgtttggcaatgtgctgataccccacgggcgtgaccgtccatgtaactgtcataacgtaccttttttaacccatacgaaaccgagtccgtcattaacggaccatgatttttggcgtatgaaaaatagttaatcgctatttttcagtgggttaaaaaaagatttccaacgttattttcctggagaagtcctaatcgacaccctgagattaacaaaggggttatcgcgggatatatgagcccagtcaatgtttgcgcggatgattaaaagcttcgtcaatacacccggaatgctcagcgggctggcatcgcgccagcccgcccggtttacagcaccttgctgaggaacgcggcggtgcgtgggttggtcggcgcgctaaagatctgccccggcttgccctcttcctgaatcacgccctggtcgatgaagatcacccggtcggccacttcgcgggcaaagcccatttcgtgggtcacgatcaccatggtcatcccctcgctggcgaggtttttcatcacctccagcacgtcgcccaccagctccggatccagcgccgaagtgggctcatcgaacagcattatcgacggcttcatcgccagcgcgcgggcgatggctacccgctgctgctggccgccggacaggctcgagggccaggcgtcgcgcttatcgcttaagcccaccttcgccagcaaggcttccgccaggtcgaccgcctgctggcgcggcatattgcgcagattcatcggcgccatgatcaggttttccagcaccgtcatgtgcgggaacaggttaaagcgctggaacaccatgccgacgctttcgcgcatcttgttgaggtcggtggtccggtcgtgggcggcaaagccgttaaccaccacctcgccttcgctgaccgtctccagggcgttcatgcagcgcaggaaggtgcttttccccgagccggatgggccgatgatgcacaccacttcctgcggtttaatatcgcagctgatgccgcgcagcacgtggctgtcgccgaagcgcttatgtaagttattaatgtgaatcacttttgccaaacctcttttccagacggttaaccagctgcgccagcaggaaggtgatcacccagtagaccagagagatggtcaggtagggttcccagtaggtggcgtaggcgccggagacggtgcgcgcggcataggccagatcggccaggccgatcgccgaggccagcgacgagtctttgacaatggcgatggcgttattgcccagcggcggcagaatgcggcgaaacgcctgcggcaggatcaccttgcgcatggttttccaccacggcatgcccagcgcgcgggaggcctccatctgccctttgtcgatcgactggatgccggcgcggaaaatctccgacacataggctccggcgttaagggtgatcgccacgatgcaggagaggaacgccccgtagctggcgcgcagttcgcgggcaaagtcggcgctcatcaggccgctggtcaccagcaggccgtcgcgcggattgataaacagcggcaccagcgcaaagtgcaccaccataatctgcacgaacagcggcgtgccgcggaaggcgctgacgtaaaagcgcaccggaaactgcaccaggtagcggagaatatatttccacggcccgtgctcggccttcgccatccgcccgagaccgagagttaacccccacagcgtcccgaggatcacgcagataatggtacatttaatcgtcatcagggcgccgtccacaaacagcgggccgtactcctcgatgatctcccaacggaatcccgtcatagtccttccctaaaaaatacggctatcgcctgggcgatagccgtggtcactgaaaaaggtggattattgcgctggcagcgtcggcacgttgtcgtcgaaccaggttttatagattttggcgtaagtcccgtcagcaacgatcttttgcagcccggcgttgattttgcccagcagttcactgttgcctttcgccaccgcaataccgaaatactgacgctcaaatttggcatccggcaccagcttgaactgcttctccgggtgctgtttgatgtagtacttcaccaccccgacgtcgcctaccgcggcgctgacgccgtcctcaaacagctcctggagcatcagcggggtattgtcgaagcgcttgatcgcggtgctgtttttacccagcacctcagaaaccacgatatcgccggtgctggagttcaccaccccgaccttctcgtttttcagggccgccagtgaatccacctgcgagtcctgagcgacgacgatagactgttcggccgggaagtacggcgcggagaaatcgaccatctgtttgcgtttatcggtgatggtgatcccggagatgatgatgtcgcggtcgccggtgttcagcgtggcgaagatgccttcccatggggtattgaccagcttaacgtcaaagccttcggctttggcgatggctttgatgatgtcgatgtcgaaaccttccagctgtttctggctgttttcaaattcaaacggccggtaggtgccgccggagccgacggtataggtttccgcagccgcctgtccggcagccgtcagcgcggctatcatgcaacacgctttgagcaaattcttgaccatgagatttcctttttatgcatttattttgcataaaaatacacacactcacttttatatgcaaccggaaaccttcccgctggtgaattatcttctcaatggccccgtttaccgccggatttaccgatagcccgatgcagatcgttgattcgtttcagggatttcaccgttttttgtggcgtggtagaggccaccgacaggacaattatctcgagacagaccagcaccgtaccgtgcagcggcatccggctactgtccccgccgcgcgggacgtcgatcaccacctgcgcctcctggctgaagcgcgagtccaccgcctgggtcagcaggatggtcggaatacccagccgcttcgcctcgcgcagggtggtcaacccttcgcgatggggggatttttgccccatcatgatcagcacatcgccgcgctgcaggccgataagctgttcggcaaggctaaagcccgtgcggttcatcacgtacgccggcaggccaatacggctgaacaaccgggcggtgtattcggcgaggatccccgaggcgccgataccgaagatccccacctggcgcgcgtcgctgagcaataccaccgcctgagccaccgccgcgcggttgtcggcccgcgacaggacctcgcatacccgctgatggccttcaagcacaaaatcaatactggagttgacgtcgctggagagcgcggtaaccgtcgagcgcatcttttccgccgaggtgaccgaggtgccgaaccagcgctccatggtctgcttaagctcgcgcagcccggcgaagcccagcgcctggatggcacgcaccaccgtggcgtcggaggtctgggtcgcggtggcgatctccatcgccgtatgctccagcaccacctcgcggttgtcgttgatatagctgaccaccgcccgcagccggggggagagctggtgcgcccgggcgcgatagcgttcgccgaacagatcgactttgcccttctctttttttaccgcgcttttcatttggcctccgccgggatcggcctgccggcaatatgcgactgcacctgggccaccatcagggacagcgcggcgtaggagttagagatcacctcttcccgcggcagcaaaatatagtgcccggtgcggcaggcgcgcataaagtcgcaccagccgggcatcacgccttccatcgcctgcagctcatcctgcggcttaccgccggtatccgaccgccaggtggcgaagacaaaatcagcgtctagctccggcagctgttccgcgctgacgtcaatgcgctgaccatcggggatccgctcaatcagcggcggaaagcggaacccggcgtcgcgcagcacccggcccagcgcatgatacgaatgatgcaccgtgaccttgccgttgttcgcctggatcactgagacgctgtactgcggtgggttgaccatcgctttcagctgcttgatttgctcctgatagcggcgctcgaggatcgccagccgcggctgggtgccggtcagctgcgccagcttgcggtaaatctccggggcgctgccctgcagatggtcgatgctcaccgtcggggcaatcttctccagttgctctaccgacacatggcggctgggctcagtgatgattagatccggcctggcggcggctaccgcttccagatcgatatcggcggtgccaataaagcggatatcgctgttgtcgatatcgacgccggtgagctgggcgctggatcgcaggtagtggctgccgtccgggcgcgtccggccgtggctggcgatcggcggcgccccgagctcaatcagcggaatggtaatgtcgagatcgtgcatcgaaacgatacgctgcggatgcagcggcacggtgaccgtgcggcctaaatcatcggtgaaagtttgagtttgtggggcggcggcgctgacggcccccgtcagcaacagcagcaatgagacgaaccaacgcatactaccttcctggttaaagggcatcacggcgacgccagagcaagataacgaagaacgggcaccccaccagggcaatgacaatccccgccgggatctgcagcggggcaaacgccagccggccaagggtatcggtcgccagcaccagcaaggcgccaatcagcgcgctgccccacagcagcgatacctggccgccgcgcagcacaaaacgcgccatatgcggcgccatcaggcccacaaaacccaggctgccgacgcaggagacgctggccgaggtcagcagcaccggcgcaaaaaagcgcagcaccgtcagctgctgcagacgtacgccgaggccgatggcggtccggtcgcccagcagcgccacgtccgccgcccgggcggtacagaacaggatgatggccccgggcagcgcccagcaaaaagccaccgccagcagcggccaggtggcggcctgcaggctgcccgccagccagatcatcgccgtctgcacgtcgcgtacgtcggcggtggtcataaagatgccgaccgcggccgccaggctccaggagacgccgatgccaattaaaataaagcgcggccgcgaacagtcgcgggccagcgtcaggaccagcagggccaccgctatgccgccgaccatccccgccagcggccgccagaccaggcctaccgccgggaaaaacagcaccagcgccagaaccacgatgcttgccccctctttgacgccgatcagccccgggtcggccagcccgttacgggtgatgctctgcatcgccgcgccggccagccccagcatggccccgcacagcagcgccatcaggatccgcggcaggcggatatcaaacagaataaagcgcggctgctcgcccatctcctggggcgccagcagggctcgcgccagcgtcgacgcgggcagcggatagctgccgcggctaaggctgtacagccccagcgccagcagcgtcagcactatgctggcggcaatttttaacgccgcaggacgcagcagcagatgacgggaggcgaaagccagcggccgaaaaccggcccggtgaacggcgcgcgtcatttaaaaaacctcgcggcgataaagataaacaacggcgcgcccaccagggcggtcatcgctccggtggccagctcctgcggcgcgaccagcgtccgggcggcgatatccgccagcaccagcgccagcgctcccaccggcgcggccaggggcagcgccaggcggatgtcttccgtcaccagacggcgcaccatgtgcggcaccaccagcccgacgaagccgatcggcccggccaccgccaccgccgcgccgcacagcagcgcaatcgccagcaggcccagcagccgggtctggacgagattaacgccaaggcccagcgccaccttatcccccagcgccagcacgttgaggcgtggggcaatgagcagcgcgacgccaaggccgatcagcgctggaaccagcgccgtctgcagcgtgctccagttcagtccggccaggtcgccggccagccaggtgcgcatcgccagcagcgtctgttcatcgagaattaatatcgccgccgtcaccgccgacgcaaaccctgacagcgccactccgcacaatgtgatgcgcagcggcgtcgccccgccgcgcccggcagaggccagcgccatcacgccaccgaacagcagccccgcgccgcaggcggcggtcagcgggcgcccggcggggaaagcgccgaaggacaggcccagcgccgaggtcgccaccaccgccagcgaggcgccggcgttaagcccgagaatatgcggctcgccaagcgggttacggatcaccgtctgcagcagcagcccggcgacgccgagcgccgcgccggtcagcagcgccgccgccagccgcaccagacgcagatcgacgataatccgctgctcaaagttacgcggatcgtactccagcagcgctcgcagcaccgtctgcggggcgatccagcgggcgcctaagccaagatgcaccagcgaggcggcgataagcagcagcgttagcagaagcagcgccagcagggggcggtggcgacgccgcgcggaaagcaggatggccacgctcattgtgccgctgcctggcggtcgcgaaacggcataaagaagggtttgccggtttgcgggttgatcgacatctgcacgtcaacgtcaaacacgcgtttaatcagctcagggctacagacatcgttgtcgctaatcgtgccggcgatgcgcccctgtttaaggaataccagcagatcggcgtagttcaccgcaaagttaaggtcatggagcactgtcaccaccgtgcggccatgttcgcgggtgagggtctggagcagctcaaggatatcgacctgatagcgcagatcgagccaggtggtcggctcatcgagcagaatggtggccgtttgctgggccagcgccatggcgatccagcagcgctgacgctggccgccggagaggctgtccaccggcagatgggcgaattcggcggtaccggttaagcgcagcgcctcctctaccgccagctcatcggcctcggaccactggcgcatcagcccctgccacgggtagcgcccgcgcgagaccagctcgaaaacggtcaatccttccggggtcaacggcgattgcgggaggatgcccagctggcgcgagacggctttcgtcggcatctggtgaatggcttgcccgtccagacgcacgcagccgccgagcggtttcagcattctggcgatggtcgagagcagcgtggatttgccggatccgttcgccccggccagcaccgtcattttgccggtgggaatggtcaggttgatatcgtcaacgatcagggtctggccgtagccggccgacagggcatccagtacgatcccctgctctgcaggtttcacccgctgtggcataactcgctcctgcgccgcagcgttccagacgatagctggacattctgcagttaaatcaaaataaatctcattctcttttgatcatgacggggatgaatgtagtagtcaatactcgccatcgtcttcagacggggacgctgactacagcgaggctgtgccaacgcaatataatttaaataaaataatatcagatagataactacagaacattccctactggaggtgtttaaaacgtcctgttcctcgccgctgaatttttatcttgcataacgtttactactacatcccttcatgattgaatgattctcaattacacatctgaaggcgcattcagacgctaaacagagtgcttttattattcagggcaatgattttattggcttaatctgaccgcaaaggcagattcgttcacgagaaacagataatgactcaaccccatgtcgcctgcaggacgttgccagggcgcgcgcttttttcgcttctttttttagcctcaccgggattaatggccgccgacaatcgcgcggcgaaaagtactaacgacgcggaagagactatcaccgtagtggccgacggcgcgcagcaaagcgccaccagcggctatcagccgctcagctccgccaccgcgacgctaacctcgatgccgctgttggatattccccaggtggtcaataccgtcagcgatcgggttctcgaagatcagcacgccacctcactcgatgaggcgctgtataacgtcgctaacgtggtgcagaccaacaccctcggcggtacccaggacgcctttacccgccgcggcttcggcgccaaccgcgacggctcgatcatgaccaacggcctgcgcaccgtgctgccgcgcagctttaacgccgccaccgaacgggtggaagtcctgaaggggcccgcctcgacgctgtacggtatcctcgaccccggcgggctgatcaacgtcatcactaaacggccggagcggcagttctccggttcggtttccgggacctccaccagctttggcggcggcaccggcagtttcgacgtcaccggccccatcgaaggcacaaatctggcgtaccgactgatcggcgaatatcagaatgaggattactggcgcaatttcggtaaaaacaaaagcagctttatcgccccttccctgacctggtttggcgagcgggcaacggtgaccgcgtcctattcgcaccgcgactacagcgcgccctttgatcgcggcactatcttcgatctgaataccggccatgcggtgaacgtcgatcgcaaaacccgcttcgatgaagcgtttaatattaccgatggctattccgatctcgctcagctcaacgccgagtatcgccttaacgacgcctggaccgcgcgcttcgattacagctacagccaggatcactataacgataaccaggcgcgggtgatggcctatgattcggcgaccggcaacctcacccgccgggtcgatggtacccacggttcaacgcagaagatgcactccacccgcgccgacctgcagggcaacgtggtagtgggcggcttttataacgagctgctgaccggcgtcgcctatgagaattacgatctgctgcgcaccgatatgctgcgctgtaagaacgttaaaggctttaacatctatcatccggtctacggcactctcgacacctgtaataccgtctccgcctccgacagcgaccagcgcattcagcaggagagctatgccgcatacgtgcaggacgcgctgtacctgaccgacaactggatcgccgtcgccggcgtgcgctaccagtactacacccagtacgccggtaaaggccgaccgtttaacgtcaataccgacagccgcgacgagaattggacgccgaaagccggcctggtctacaaggtcacgccgaacgtctctctgttcgccaacgtcgcccagtcgtttatgccgcagtcgtcgatcgccagctatatcggcgagctgccgccggaagagtccacctcttacgaagtgggcgccaaatttgacctgttaaacggcattaccgccaatatcgcgctgtttgatattcataagcgtaacgtgctgtacaccgagagcattggcgatgagacggtggccaaaacggcgggcaaagtgcgttcccagggcggggaagtggatctggcggggtccatcaccgataacctcagcgtgatcgccagctacggctacaccgacgccaaagtgctggaagatccggattacgccgggaaaccgctgccaaacgtaccgaaacataccggttcgctgttcctgacctatgatattcataacgtctataacagcgataccctgaccgtcggcggcggcggccatgcggtcagcaagcgttccggcaccaacggcgcggattattatctgcaggggtatgcggtggcggatgtgtttgccgcctataagatgaagctgcagtatccggtgacgctgcaggtgaatgtgaagaacctgtttgataagacctattacacttcctcgatcggcaccaataacctcggcaaccagattggcgacccgcgcgaagtgcagttcacggtgaagatggatttttaagccggaccatggcgtcgcgccggatattcattgccgggcggcgctgcgcttgcaccggcctacctttccgtgacatttgtcgcagttcgtaggcccggcaaggcgcagccgccaccgggcaaaaacaggcgtctggcgccggatgcccattgccgggcggcgctgcgcttgcgccggcctacgtttccgtgacatttgtcgcagcgccaccggggaatgcgttcagcttaccagtccgcctcctggccgaggatgcgcaatatatcctgacgatgctgcagcagctgcgggttatcgcgatgacggggaaaagccagcggcagcgcaaactcggcgataatccgccctggacgcggcgacatcaccagcacccgctcgcacagcagcagcgcctcttcgatatcgtgggtcaccagcaggctggtatacccctgctgctgccagagggcgatcagctcccgctgcatactgatgcgggtcagcgaatcgagtttgcccaacggctcgtcgagcagcagcagacgcggttcgttcaacaaggcgcgcgccagcgccgcacgctgtgccatccctccggacagctgccgcggccacgcctcgctgaaggcctgcagcccgatgcggtcaatcagcgcgtctgccttcgcctccagcccctttttgccctgcgcctgcgggcccagcagcacgttctgccgcaccgtcagccacggatagagcgtcggatcctgaaacacaaggatccgctccggccccggggcgccgggcgccgcgccgtcgatctgcatctgtccgctctgcggcgcttccagccccgccagcagccgcagcagagttgatttaccgcagccggaagggcccagcagcgccacgctttcccccgggcgcagctgcaggctaatattctccagcaccggtaccgtctgtttgccaagcgtaaacgcatgatgaagatggctgatggataccgccgcgccgcgcgctatcgtctcggttaccattgcatccctcctcgctgccagctcagcagccggtcacgcagcataaataatccgcttatcaggccggagcataacaaggccatcaccagcagcgcggcatacatattcggataggccgcccagccctgggcccactggaggtaaaagccgatccccgacttcaccccgaccatttcggcgacaatcagcaccgaaaacgacgcgccgagccccataaacaggccgacaaagacgttcggcaacgcggcggggatcgccacccgcaggatcaggaaacgctggctggcgccgagggtccgcgccacgtcgtaccacgccttatcaatgcccatcactccggaccaggtcagcaccgtgaccgggaaccaggtgctcagcgcgatcaaaaacacgctggcgccgaagctcgagggaaaaataaacaggcacagcggcagcagcgcggtggacggcaccggccccagcagacgtaacaccggatgcacccagtagccaatccgttgcgaccagccgatggccagaccggtgatgaacccgctgctggtacccagcagcacaccgagccccagcagccccagggagtgcagcaggctgtcgagcaggcgcggccagtcgtcgtgtagcacctcgatcagcgcctgcggcggcgcaaagaatggtaccggcaacacggcagttttggcggtcagcccttcccagacagcaaacagcaccggcagcagcgccagccacttgccggcatgccgcacacgcgcgccgcgcgcccgccagtagcgatagctcagccccagcagcagcaagccgccgccgagggtgaattgcgccagcgcccagccttcgctaaacggccagcgccgcccagcgtcgggccaggtaagagtaaacagaccgcccagcagccacagcgcggcggccagcagcccttctccccacagcggcgcgcggccggtggggcgcgccagagcctgctcaggcgaatacgttggcatagatactctccgcgaactgatggggatcggtacccggcttgatcacctgcacccgctgcaggtcgaccgcatactgcgtcagctctttcacgaacgcttcgcccaccgcgtgatggccgtggccctgcccgtgcaggatgccgctcacctccgcttcactggtattcagggcatgggcgaggaaggattgcgccacgctttccggatgcgcagcggcatagctgtgcgcctcaaggatcgcctgggtgagcgccgcggcggccggtttatggtcccgcgccaggctcccgctcacccccagcacgcagcagctgaggttggcataatccccggtcatattgctggcgatcagctgatacttaccggtctccagcagacgatagctgaacggctcgctgccgctgatggcggcgatttcgcgcttgtccagcgccacgctgagcagatccgccgggtagactttccactgcacgtcgctgatcgggtcgataccgtggcgcttaagcagaatggcgaagaagtttttatccggtccggccatgtcggtgacgccgatggtttgacccttcaggctctcgaggccgccgaacggcgagtctttagccgtcagcaggttcagacagccgccgtgggtcccggcggtgagcttgacgtcaaagccctgctccagcgccttcagccagcgcagcgccatccccaccccggcgtcggccttaccggtggcgatcgcctccagcagcacatcggtggagttgccgaagttaacaaactcaacgtcgaggttgtatttactgaatatcttctgctgctcggcgacggcgaccggcgcgaggcataccgcgcttttgttgatcgccagcttgatcttgtagggctctggcaggcgcagcgccggatgggcatcgccgccggccatgtccgccatatcatgagcccacagcggcagagagaccccggccagcgccaggccgccgctgagctgtaaaaaacggcggcgggaaaaagtggttctggtcatggcgtcacctcggcggcgggcacgctaaaacggcggtcaaaggtcggcttcacgtccagccgggtgcggatcaggccgttggcgagataaaagtccgccgttgcctgctgctgggccactgtttcctcggccagcggctgccactgcgactggcggttggcaaactgcgcgcgggcgatctccgccgggaagcggatgatctcccccaacgttttgccgtagctgtcgagattggcgtaggcccagcgctcggcgccggccaggcgctggagataatcctgcagcgcggcgcgtttttgcggatcgttaagcgcggaatccgttgccgcgaggaaggtattccccggcagcagccctttgccgctcaccaggatctgcccctcgttggtcttcaccatttgggtggtgtagggctcccaggtcgcccaggcgtccaccgaaccgtttagcaacgccactttggcgtccaccgggccgaggaacacccactgcacctccttcggtgaaatccccgcctgctccagcgctttcagcgccacgaaatgaccaatcgaccctttaccggtggcgatgcgtttgccttttaaatcagcgccgctttttaacgtgctgccgggggataccagcaccgcggtccccgccgggttgcttttatccacggcaatagctttgaccggcgcaccgttggccagggcgaagagcaacggcgcatcgccaatgatccccgcgtccacggcgcccgcgttgagggcttccgccagcggcgcggcggccgggaactcggcccacttaatgtcgtaagggagattttgcagggcgttggccgcctccagctgcgaacgcatgccgcctttttgatcggcgatacgcagggtaagccgctcctgcgctgtcgcgtagccgcccagcgccagcagcatcagcgcggccgccacccggcctgaaaatgatagacgcatcgtgattatccttgtgattgaaagacgaagttgccggctgccagccaggcgctgtcgctctgtggggtatgtacccgtccgcagagcacattgcggtagtggcgttccagcgggttctgtcgactcaggccatgattgccggtcagctcgagcgcaatattcaccgcctgaatggcgttgtcggtgatggtgactttcgccagattggcttcgatagcggaaaagcgcagcgcggcggcctgctccagcaggctgcggttgaccagcagcagcccggcgatctgcccgactttctcctgcacccgtggcagacgagagagcggatggccgagaccggcgggcacccgccccgccagccacctcaccagccagtcgtgagcggcgtgggcaatgctgtcatagatcgccgccagcagcgccgtctgccggttggcgaacaggcgaaacggttcggcctgggcggcgggtggcgcatcggtcggccagacatccaccgcgtgctctgccgccacccgcacgtggttaaaaataacttcatggctgccggtggcccgcatcccggcgtgatcccagcttttcaccacgctgatgcccgggctgtcgccaggcaccagccaggtgcccaccagaggcgggttatcatcgcttctggcccacaccgccagccagcgcagcccttcaatgccggtggtataaattttatggccgctgatgtcccagccctccgcgcgacgggtcgccacggtgtccggcaggccgccccgcgctggggagcccagctccggctcgacgcgcaggctgttgatgaggccaccgtgttcgacagcatcgtgaaaaacctgctggcgcagcggcgcgtgccaggcgtcattttccgccagccgcaaatggtggagatactgcatgcagacgatcagcgctgtcgccggctctccccaggcgatggcggcgatgacctgctgcagctgggccagactggcgcccgcgccgccgcaggatggcggcacggcgagacttaaccagccccccgcacgcagatggtcgatattacgccagggaaactcgccgctggcgtcaaggctggccgcctgctccgccatctgctggcgaagcgccgtcagctgccgggcccagtcgtcgcgctcaggatggatcacgatgcgcgctccgccactgcacgccgggcggctttttcccgggcgatcggcaacagcgcccggccatagtcggccgcgtcgttcagcggatcgaagccgcggatcaggaagttacgcacgccgaggtcgtagtaatcgagcagcgcatccgccacctgctccggggtgcccaccagcgcggtggagttatgtccgccgcccaccagctgggcgatgccggtccacagacgtttgtccaccactctgccctgcgccgcagtagcccgcagccgctgggcgccgatgctgtccggtttggctttgaacccgcctccgcgctgcgccgcctgctcggtggcgacgtgcaggatatgctcggctttctcccaggcttcggcttcgctgtcggcgataatcggccggaacgagacgctgaagccgatatcacgctggtgtttcgccgcttcggcgcgcacccgctggatggtctcgccggtttgcgccagcgactcgccccacagcgcgaagacgtcggcatgtttgccggcgacggcgatggccgcttccgacgagccgccgaagtagatgggaagatgcggcttttgcagcgggcgaatggcggaccaggcctgctcggcctgatagaaatcgttgtgaatatccaccggctgctcgctggtccacacctggcgcacggtgtcgaggaaggcgtcggtgcgggcgtagcgctggtcgtggtcgagataatcgccatcccggcgctgctcggcatcgttgccgccgctgatgatatgcaccgccaagcggccccccagcaggtgctcaagggtagcgaatttgcgcgcggcaagggttggggaaacaaaaccgggacgatgggccagcaggtactgaattttctgcgtcgacagtcccgccagggccgtcaccagaaagccgtcgggttgatcggaccagtggccgaccagcagacgatcaaacccggcggcttcatgggtttgcgcaaagcgaacgatatagtcgcggtcaaagatcggccccaccggggcaatcgtttcggaagagaggcggtggccaatcatgccgagaaactgaatgctcatgaacaactccttgcgtcagggtaatggagtggccgcgacagcggcgctggtcattaccctatacagagcgtgttaatgagcaaaatgcatttttatcatatcttaatatgcttaattagcattaaacaaaaatgcattttgctttcagtcggatacggtcagctgctgcatcactttgctggcaaaaaaggccagcggcggctgcaggttcgccagatactgggcgtggatcagccacagtgagaccgcaggctgaaaatcgctgaggctgaggaccgcgacctcgtcccgccacgggctgctggccagcgccgccctcggcaccagacccagccccagcccctgcgccaccagcgctatctgcagctgcgcgcccgcgctctcgacgttgagcgtcaaccgcaatccctggctctgcagctcgcgaatgagcccggcgcgcaggccacagccgtcggggttaaggatccagccccgttcggcgcactcccgcagggatgacgcgcgcaaattcaaacgccggccgacgatcggcaccacctccaggggacacagcaggcgcccgctgtagccctcggcgaagctttgctgggcgggccccatcgccagcatgccgtccagctcgccgttttccagccggcgctgcagctgtccgctccagccgcaggtgatctgcggcgacagtccgggaaactgctggctcagcgccgacagcgccgccggcagggcaatctcgctgagactctgcggcacgccgagacgcagcgcgccgcgcggctcgccttccggatccaacaggctgtagagttttttcgtctcacgcttaatgctcagacactgctcgtacacccggtgtccggcggcggtcagggtcagcgggcgggtctggcgctctaacagcgtgacgttcagctcctgttccagacgctgcaggcgccgggtgatggccgactgggtgatccccagatattccgcggcctgattgagggaggaaaactgcaccgtggccagcaaagcgtcgatatcgtcaatgcgcataggatccttatgttaaatttgcatattaatatatgcgtaaattgcatttaaataatattaacgcctctgttagcgttttgaccagtccctctgacaggaaccgcacatgactgcaccacgactggaaaaattacgccatttcattcatgaggtagaccgcctgcaccgcgaacaccaccagaccgccccgctgcttgacgccgtggcgcagcggctggcggcgctggtgcgttacgacgactggctgccggaagagtacaccctgccgcatccgcaccattatcagcagtatctgctgcatgccgactccggggagcgcttctcgattgtcagcttcgtctggggaccggggcaagcgacgccgatccatgatcaccgggtgtggggggccattgggatgctgcgcggcgcggaggaaaaccagcgttaccagctggatgccgatggcataccgcgcgcgctgggcgccgccacgcttctggaagcaggccaggtggagaaagtctccgctgacgatggcgatattcatcgcgtcagcaatgcgctggcggatcgcgtctccatcagcattcatgtctacggcggcaatatcggcgcggtgaagcgcgccgtgtataccccggaagggcagcagaaaccgtttatctccggctactctaaccgccatttacccaatatctgggattcctcccgcgaacatcaaggataaccactatgtccacctacgcttatcgccaggccgccgggatccgccaggcgctgctcgaccgtcgtgaactggcgctgatcgacgtccgtgaagaggccgatttcgccaccgctcatccgctgtttgccgtcaatctgccgctcagcaaactggagctggaggtccgccggcggataccgcgcttcaccaccccgctcaccgtctacgacaacggcgagggtctggcggagatcgccatcgaacggctgcggtcctggggctatcaggatgtggccctgctggccgagggtctcgccggctggcgccgcagcggcggcgagctgtttcaggacgtcaactccgccagtaaagcctttggcgagctggtggaaagcgtgcgtcacacaccgtcgctcagcgcccaggaggttcaggcgctcatcgacagccggcaggaggtggtgatcgtcgacgcccggcgcttcgatgagtaccagaccatgagcatccccggcagcatcagcgtgcccggcggcgagctggccctgcgggtagagagcctgacgccctccccgcagacgccggttatcgtcaactgcgccggacgcacccgcagcatcatcggcacccagtcgctgatcaacgccggcgtgccaaacccggtccatgccctgcgcaatggcactatcggctggacgctggccggccagacgctggcgcaccagcaacagcggcaatacgatccctccgcccgcgcctccggcgcccgggccgctgaggtggcgcattttgccgaacgggccggggtggcggtcatcgatgaggccacgctgcaacgctggcagcagcagagcgaccgcaccaccttcctgtttgatgtccgcagccccgaagagtacgcggcgggtcactatcccggcagcctgagcgcgccaggcggccagctggtgcaggagaccgaccacttcgccagcgtacgaggggcgcgcattgtgctgctggatgacgatggcatccgggcggcgataaccggctcgtggctggcgcagatgggctgggagacggcgcggctgagcgcgctgtcgaccagccagttgagcgaacgcggggtgcctgccgccgaggtgccgcccggcccgcaggcggaggagataagcccgacgcagctggcgcaacagctggaagaacccggtacggtggtgctcgattttaccaccagcgccaactttgtcgctcgccatatccccggcgcgtggtggctaacgcgctcgcagctgcgccaggccctggaagcaatccctcccgcccaacgttacgtggtgacctgcggcagcagtctgctggcccgctacgcggtgccggaggtggcggccttgaccggtaaaccggtgcagttgcttaccggcgggacgctggcgtggatcgccgccggtctgccgctggcgcatggcgacagcggcctcgccgtcgagcgccgtgaccgctatcgtcgtccgtacgaaggaaccgataattccgcccaggccatgcaggcctatctggagtgggagtatggcctggtggatcagctggcccgcgacggcacccacggttttcgggtgctctagcgcgagcccgcctcaggcttcgcgcatgatccacgaatactgaaagctcttcggcgccggaaaatgggtccggcgccggtaggagcccagcgactgcggggtgcagtaggtacaactccccagccattcaacgctcgccggcaccacccccgcctctgcgaagagcgcttcggcaaaggcgcgcagatcaaaccacagattatcgctgccacgcgcggcggctttgagcggatcgctgaccgggcccgaacgggaatggaacagccgctggcgatggcgggccacccggtcaccgccgggctggtccagcagttgctgatagaatccggcggagacttcgtaacagcaggggtgaatatgcggccccacggcgatgaccagatcggccaatgccaccccctgctggcgaaaacaggccagactgttgtcgacaataccgctgaccagcccctgccagccggcatgcacgctgcagacgtagcgaccgtcgcgcgaggcgatcagcagcggcagacagtcggcggtcaccacccccaccttttgcccggctaccgcggtaaacaccgcgtcggcgtgcgggcgcgtcggcagcggctgctgataatgatgaacctcattaccatgcaccagcttcaccggagccagctcggcatagggaaaggcggcggtttcatggacatcaagaaaagcgtggcggatgccagggatcgcattgagcaaacgggaggtgtaagccatagggacgataagcgtcagggaatgatgtcttaccttaggccaggggacgcggacaggcaaggcggcggcccggcatttttttaccagaccgccggatgcatatcagaccatggccgcgcgctgctggcgatgcatcagccagaacaccgccacgccggccagcacaatgcccggcgccgaggccgccatcaccccgacggcgccggtgccgagggccagcatcttgccggccagcagcgggccgctcatcgccccaagacgccccaccgccacggcggtgcccaccccggtggcgcggatggccgcgggataaaaaagcggcgccagagcgtaaagcacactttgtccgccggtggcgaacagcccggcgacaaaccccgccagcagcatgccagtcagcgacgacgcgctgcccagcgccagcagcgacgccagaatgccgctgtagatcaggagcgacatccgcagcggggtgagcttatccattagcgcccccagcagcagcgtgccgcaggcggcgccgatctgcagagagaacatcacccccgccgcctggctggcgcggaatccctggcccaccagcagcatcggcagccagttgatcagcatatagaccaccagcagggtgaaaaaataacccagccacaacagcagcgtagcggcggcctggcccggggcaaacagggtgcgcagcggcacgctggcctccgcgcgctgaaacgcctgcgactccggcagccagcgcatcagcaacgggatcagcagcagcgggaccacgccgccaatccagaaaataatctgccaggccgcggcgagaccggaaaagcccagcgctgccgccagcgcggcgccaatgggtacgccgcagtacatcaggcttaccgcccggccgcggaaacgtgagccagcggcttccgaggttaaggcaatcaggttcggcaatgccgccccgagcccgacgccggtgagcaggcgcgccagcagcagcgtcgggaagctccatgccagcgcggtggccagcgagaacaggccaaacagcagcaccgaccccaacagaatgcgcttacgcccgtggcggtccgccagcatgccgcccaccagcgcgccgggcagcaggccgaggatcccggcgctgaagatccagcccatctgcattttatccagcgcaaaggcctgcgccatgccgacggcggcgatccccgccgcctgcagatccagcccttccatcagggccaccataaaacagagcccgatggtgaccaccaggcgcgagggggttgcagtcgttatcttggtcatagggtaccttggcgatagccgaacaaacggagcaggtgactggcggctgatgctttgtcagccgcacgttcttagttatttattgcggttaagcagatccagcgcgacgtcgacgatcatatcctcctggccgccgaccatccgccgcttgcccagctcgacgagaatatccaccgcgctgaggccatagcgcttggccgccgcttcgctgtggcgcaggaagctggagtagactccggcgtagcccagcgccagcgtttcgcggtcgacacgcaccgggcgatcctgcagcggccgcaccagctcatcggccgcgttcatcagggcgtagagatcggtgccatgctgccagccgagcttgtcggcggcggcaataaacacctccagcggcgcattgcccgcccccgcccccatcccggccaggctggcgtcaatgcgatcgcacccctcttccaccgcgacgatcgagttcgccaccccgaggctcagattatgatgggcatgcatcccggtggcggtctccggcttcagcaccgccttcagggcgcggaagcggtcgcgaatgtcgttcatgttcatcgccccgccggaatccaccacatagatacaggtcgcgccataagattccatcttcagcgcctgctgcgccagcgcctgcggggagatcatatggctcatcatcagaaaaccgacggtgtccatccccagctcgcgggcaaaggcaatatgctgcgcggcgacgtccgcttcgctgcagtgggtggcgacccgcaccacccgcgccccggcctgatacgctgctttcagatcgtgcagcgtgccgatgcccggcagcagtaaggtggcgattttcgcctggctcacgacatccgctgccgcttcaatccaggcgatgtcgctgtgggcgccaaagccatagttgaagctggatccctgcaggccatcgccatgggccacttcgatggagtcgaccccggccttatccagcgcgctggcgatctgctgcacctgcgccagggaatactggtgacgaatggcgtgcataccatcgcgcagcgtcacgtccgagatataaagttttttaccgttcatgctgtcgctcccgccgcgctgtgcattgccccggccatttgctccgccgtcgccagcgccgccgaggtcataatatcgaggttgcccgcgtacgctggcagatagtgcgccgccccttccacttcgaggtacaccgcggttttcaggccggaaaaacagccgacgccgggcaggttgaccggcctgtcctcggggataacctcaaactgaacctgctgcttcagccggtagcccgggacgtaagcctgcaccgctgccgccatttcggcgatcgaggcggcaatcgcctcctgcgacgccagctcgctcaggatgtagacggtatcgcgcatcatcagcggcggctccgcagggttcagtacaataatcgctttgcccttgcccgccccaccgactttttcaatcgcctgcgaggtggtttcggtgaattcgtcaatattggcccgcgtgcccggcccggcggattggctggcgatcgaggccacaatctccgcgtaatgcaccttcgccactcgcgagaccgcggcgatcatcgggatggtcgcttgcccgccgcaggtcaccatattgacgttgccctgatggagattgtccgcgaggttgaccaccggtacgcagtacgggccaatcgccgccggcgtcaggtcgataacgcggatccccggcttcgcttcgcgcagcgcggcatcgtttttgatgtgcgccccggcgctggtggcgtcaaaaacaaaatcgatgtcggcaaattccgccatctgcatcaggccgcccaccccttcgtgagtggtcgcaacgcccaggcgccgggcgcgggccaggccatccgactgcgggtcgatgccgaccatcaccgccatctccagatgctggccgtggcgcaggattttaatcattaaatcggtgccgatattcccggagccgataatggcgactttacgtttacgcatcacgatctccttctccggcggcaacgaagcgtgccgcgactgagccaataccttcgatatgggcgacaaagctgtccccctcgttaatcgtcaccatcgggcctaacgccccggtcagcacgatatccccggcccgcagcggttcgccgagactcgccagcttgcgcgccagccagactgcggcgttcagcggatgccccaaacactcgctgccgcggccgctggagaccagctcctggttgcgggtcatgtgcatggcgcactgcttcagatccagtcccgccggacgctgcgccgggccgccaatgacgtacaggccgcaggaggcgttatcggcgacggtgtcgacaaagccgattgaccagtcgcgaatccggctgcccaccacctccagcgccggcaatacccattcgatggcgttatacagttcatcaaaagtggtatcggcatgcggcagatcctgcttcagcaccagggcgatctcggcctccaccttcggctgcagcacgcggccaaacggcaccccggcgttgtcgccgtagcacatgtcggcaaacagggtgccgaagtccggctgattgacgcccagctgctgctgcactttgggatgggtcaggcccactttgcggcccaccacccgccggccatgggccacgtggtgctggacgttcagacgctggatggcataggcggcgtcggcattgtcgacgccgagaatatcgcgcagcggggcgatcgcctggccgctctgttccgcgtcgcgcagctgccgggccagcgcgtcaagagaaaaagtcatcatttactccttaagcccgtgcgaggaaattgagcaccagctgattaaaactgtcggcatgttcccactgcgcccagtggccgcagtcgcggtaaatatgcagttccgaaccggcgatcccggcgagcaggcgcaacccggcgtccatcggcacgaagcggtcattgcgtccccagacgatcagagttggcgcgctgatttcgcccagccgcgggccaaagtcaggaaactgcttcgggttggcttccaggctcttgacgaagttgtccagatggtcgcggcgtgacagcatattgttgagacgcgcctcgaacagcgcctcggtgaggtcgcgggtgtcgaagacgaagatgctcatcatctttttgaggttttcaatggtcggctcgcggtacagggcgttcagcagcttgatgccctcggtcggcatcggcgtgaacaggctcatgccgccggtccccccgcccatcagcaccagcttagccacccgctccggccagctcaaggtgaaggccaccgcgctatggccgcccatcgagttgcccagcagatggactttatcgatccccagctgatcgaccacgcttttcagaatgcgggcgttgagatccgaacgcgagccgctgttgacgatagcatcgcttttgccccaccccggacagtcgaggagcagcacgcgatagcccgcctcgaccagcgggtcaatattgcggctgaagttggcccagccggtggcccccggcccggagccgtgcagcatgaccacggtctctttcccgtcgccgcagtcattgatatggatacgcagcgtgcggcccccctcgtcgacattgaggaatcggctggtggcggcttcagtttgcggttgatagctcatgttagtctcccggtcaatcaaatctcggtggtggcgctcagcgagccgaatccggcgatccactcggggatcggccggtaatagcggccttcactgcgccagcggccaaaagcggatagcgcggcaaaagcggccacccaggtcttaatttcgtgcgtcgatttgccggccatcgccgacagctcgtcattgccgatcgcgtccagttcgctcagccgcccctgctccagcaggctcataaagcggttgtcccagaccggattgaggggatggagcgagtgcgggtcttcggtaaaccgtcgggcggcattgatcacccgctgctggcgccgttcgcgttcgtccggcggcagctgttttccgccgccgagcaggcgatcgcgcagatgagcgtcggccttcgccagctccggcaccggcggctggtgcgagagtccgcccgagccgaggatcagcacccgcttattgagggtattgagaaagcggcccatcgcctcacccagcagccgggtgcgttgaaaacccggcagcggcgcggcgacgccgttaataaacaccggcagcaccggcacgcggtccaggccacccagcagaaactccagcggctgggcgaagccatggtccacctgcatgttgtacgacaccgccaggtcgataccgctgttgatcacggcgtgggcgcaggcttccgccagctcggcgggcaccggcaggtcgccggcggcgctggcgaagtcgccaatcgcagtggcgccgacgccgaggcagaacggcggcatcacgtcatagaaaaaaccgttgtagtgatcgggggcgaagagcaccaccagctcgggatcgaattcagcaatccaccgccgggcgtcggcaatcaccccgttcacttcatcgaggaccgcctgctccgggtccacgaatcccaccagcggagtgtgggagagacagtgcaaataggcatgcatatcaggccaccttctcttcagcgtgggcggtatccccggttgcgagggccattttttccgccagagcggtcagctgcgcgccgagggtttgcgggatggcgagagcggcgacaaagcggtccggcctgaccacggcgatggcggtgttatgcagtgcaaaccagcttttgaggcggttttgcgtatcgcccacccgcagcgtgccgggggcgttatcctgctcgcgatggatctgcacctcgggcaccacctggataaagcgcacgccaatcgcgcgccagcgggcgatctgcccggcgtcgagcccccactgcgggttgcagccccagccgataatggcgaaattcgcgccgatgacgtcgtcgagcagcacgctctcgccgctctccagcgtcacctgcggttgaataaacattttgcccaccggcgaggttttgctggcgccgtcggtcagcagcgccccctcgcggtactgcggcatcggcttaaagcgcatttcgaggaagtagcgcttcaccggcggcaggtagttcagcagccaggagaggccgtcgcgcgcggccccctgccagcgcttcggcggcgccagcacatggccggcggtaaccgacaggtcaatcatcgctttcgcgtggtcgcggcgctcctgctggtagctgtcgagcagcgtctctcccgctttgccattgaccaccagcgccagcttccacgccaggttgaaggcgtcgcgcatgccgctgttatatccctgcccctgccagaccggcatgatgtgcgccgcatcgccagccagcagcacgcggtcgatgcgaaagcgctcggcaaggcgggcgttatgcgtatagacccgctggcggatcagctcgacgcgatccgggtccggcagcactttgctcagcaggcggcgcatattgtgcggttcgctgagctgagcttcggtttcgccgggcatcaccataaattcaaagcggcgcacgccgtggggcagcgcggcggaaacgtagggtcgcaccgggtcgcagcacaggtaaacgtgcggggtggccagcgggtcgttagcgatatcgatgacgatccactgattcggcgcggttttaccttcgaaggggatgttcagcgtacggcgaataaagctggcgccgccgtcgcaggccaccagccagtccgcgcgcaccgtctcccgctcgccgtccggtcctttaagatttaacgtgacaccgtcaccggtctggctaaaggcttccacttcgcgggagaagaggcagcggacctgcgggaaacgctgcagaccgtgatacatcaccgcatcgacctgcggctgaatgaaggcgttgcgccgcgaccagccaaattcatcggtcatcggctggatatcggcaaagcagcggccttttggggtgagaaaacgcatggcgtgccacggcgtggtatgcggcagcacgtcattcaccagccccaccgcctgcatcgcccgcagggattcatcgtcaatgccgatggcccgcgggtaatcgatcagtgtggcgagcttttccaccaccagcacgctgatgcccatctggccaaagtagttggccatcatcagaccaaccggaccggcgccaacgatggcgacctgagcggtatgctgcacggcgggttgaatatcgggtgtagatgttgtcattctcagcgacctcacgactcggaaactgcccggctgacaggcaatttgttaatcatgtgtaaacgtatttttataatgggctgagtatagggcgggggttttcggctacaatcaaaacatcatcgaatgtgcaccaggtgcacaacgctgtttttaaagcattttaatggaggatttatgcgtgacgatgggtccgcagcgtacaaaacggtgcgcggattaagccggggtttattgttattaaaattgttaaataaattcgacggcggcgcgacgccgggcctgctggcggagtttagcggcctgcatcgcaccaccgtgcgccggctgctggagacgctacaggaggagggttttgtccgccgcagccgctccgatgacagcttccggttgaccattaacgtccgccagctgagcgatggatttcgtgacgaacattggatttctgccctcgccacgccgctgctcggcgagctgctgcgcgaggtgcagtggccaacggacatcaccaccctcgacgtcgacgccatggtggtgcgcgagactacccaccgcttcagccgactgtcgtttcaccgcgcgatggtcggacggcggctgccgctgctgctcaccgcctccggactgacgtggctggcctttgcccccgacgcggaacgcgacgccatcgtcagcatgctggccgcccgtccggaagctgagtatcagctggcccgcgaaccggaacggctggcggcgatcctcgcccgcacccgccagaacggctatggcgaaaacttccgcggctggcggcaggaggagaaaatcgcctcgatcgccgtgccggtctgcagtcagctgcgggttatcggctgcctgaacctggtctatatcgccagcgcaatgaccattgagcaggcggcgcagaagcatctccctgcgctgcagagggtggcgggacagatagaagcccgcatggaggatgaagaagtgtggtacgaaatgccctgatcgcgatgagggtaaccgcgatcaaccattgcgcccggcttcgttatataatttaatacacaacgaattttcacgccattcgggccacaccatgtcaaaacaccccttactgctgggcctgacgctgctcagcgccagcctgttcaccggccaggccttcgccgaccgcaccgtcaccgaccagctgggtcgccaggtcaccctccccgaccacgtcacccgcgttgtggttctgcagcatcagacgctcaacctgctggtacaactgcatgccgccgaggatatcgtcggcgtcttaagcagctggcagaaacagctcgggccgcagttcgcccgctttatgccgaagatcgcgcagctggcgacgccgggcgatcttacccaggtcaatattgaaagcctgctggcgctgcgtccgcaggtggttttcgtcgccaactatgcgccgccggcgatgatcgcgcagatccaacaggccgggatcccggtggtggccatctcgctgcgtcacgatgccgccggggaaaaaaataaaatgaaccccaccatggctgacgaagagcaagcctataacgccgggctgatggaggggatccgccttatcggcgaggtggtcgagcgccagcccgaggccgaggcgctgattcactacaccttcgaggcgcgcaagcaagccaatgcgccggtggccgatattccccagaaccagcgggtgcgggtgtacatggccaaccccgatctgaatacctatggcgctggcaaatacaccgggctgatgatggcgcacgccggggcgctgaacgtggcggccgccagcgtaaaaggcgcccgccaggtgtcgctggcgcaggtgctggagtggaacccccaggtgatcttcgtccaggaccgttatccgcaggtggtcaaacagatagagaacgacccgcagtggcagacgatcgatgcggtgaaacatcaccgcgtgtggctgatgccggagtatgccaaagcctggggctatcccatgccagaggccctggcgctgggtgagctgtggatggcgaaaaaactctatcctgcgcgctaccagagcatcgatgtggacagtaaagccagggattattatcagcgtttttaccgcgtggcgtggacgccagatgcccgctaactctcagccctggctggtgcagggaagcctggcgctggcgacgctggcgatcgcggtcgcctcgctctgtttcggccagtacccgttaagcctgagcgccgttggccacaccctggtccatctgccgccaggagaaggggtgatcgggcagatcgtctggtcggttcgcctgccgcgcgtggtgatggccctgctggccgggggcgcgctggggctgtgcggcgccaccttgcagggcgtgttccagaacccgctggtggacccgcacatcatcggggtgaccgccggctccgcctttggcggcacgctggcgatcctgttgggcgtcggcagtctgctgatgatggcctcgacctttttcttcggcctcgtcgcgctggggctgatttacgccctcgccgccctgcaggggcgggacagcacgcttgggctgattctgtccgggatcattctcagcggcttcttcgccgcgctggtcagcctgatgcagtacctcgccgacagcgaagagacgttaccgaacatcgttttctggctgctcggcagcttcgcgaccgccagctggcataaggtactgcttatgtccctgcccctggcggtggctgccggggcgctgtggaagctgcgctggcgtatcaacctgctggcgctggaggaacgggatgcccgcagtcttggcgttccggtggccgcgctgcgtcgcggcgtgctggtttgctgcgcggtgctggtggcagcccaggtggcggtcagcggcagcatcgcctggatgggtctggtggtcccgcacctcgcccgtctgctggtaggggctgaccatcgtcgcctgctgcccaccgccttctggctcggcgccgcgctgatgctggtggtggacgatctggcgcgcacgctgacccaggcggagatcccgatcgggatcgtcaccgccctgctcggggcgccgctgtttaccgtgttgctggtgcaatcccgacgccggagtacgacctgatgaacagctcattatcgctgcaagcgctacgctacggccaccgtcagccgctcttcgccccgctcacgctggcctgccggcccggtgagatctgggcggtgctgggcgccaatggccggggaaaaagtaccctgctggataccctgaccggcgtgttgccgccgctgggcggcgagatgcagtgcgagggcggcgtggccctggttccgcagtcgtttcgtcccgcttttcgctggcgcgtgagcgatgtggtgctgatgggccgggcccggcacgtggatctctttgcccagccggacgaggaggatgcccggcgggttgagcaggcgctggcgcagctggggattgccgccctggccgaagatgacttcggcgccctctccggcggccagcagcagctggtgctgattgcccgcgcgctggtcagcgccagccagaatatcctgctggatgagccctgctcggcgctggacctcggtaaccagcaggtggtgctgcagctgatcggcgacctcgcccaccgccaggcgcgcaccgtcctgttcaccacccatgatcccaaccacgccctacaggtggccagccatacgctgcttctgctgccggagggccggtggctggcgggtgagaccgccgacgtgctgagcgaaacgcatctccggcaagcgtacggcctgccggtacgcctgatccgccatgccgcctccgcgttccctctgctggcgccggggtttacgctgcgtcgctgaacggcataaaacccgcctgccggagatacccctgaccaacgtcgccgaggataaagcgatacagggccagcgcggcgggatcggccctgagacgcgccagctggtaatcgcagcgaatattccacggcgccgcgatggtcagggtacgcagatcgtcgcaggcggccagcgcggggccatagtgcgcatagccgataaacagatccgccagattctggcgaataagccacgcgccggctatctctcccggcggcacgctcagtgagtctctgccgccgaccagctgctgcgcccgcccggccatcgcgttgcccaaccctggatagcgtgcctcaattcgggcgaacagctgccaggtataatctcccgacggatcgcagcccggcgtggaggtcgccaaccgcaggcggggcgtgctgagcagcgccagccagtccaggccatcgttgtccggcgaccgccgggcggtcagcatcagctggttgctggcaaatccctggcattcctgcgccagacccgcctgcagcagcgcctgcgggtgcgccgcgttggcggaagcaaaaaccgcgcacggcgacccggcttcgatccgctcgcgcagcaggccggcagggccaaactgcgcatcgaccgccaggccagtgtgctgccgaaagtgcgccaccagcggcaggaaggcgcttctcaggcttcccgccgccagcagcgtgagagtggtatttgccataggatatcgctataaaccggataatatagcgctatattacccggtttgccgtcgcgtcagtagcgaatttctgccagcgcccgcagctgctcgggggtggctaccggtaggtcaaaaaagcgcagataggcagggatcatttcaaacagcatgtcggtcccgcgctggatgtggcactgtcgtgcctgagcggccctcagcagcggggtgtactcctgagtcatgacgacttcccccacccaggcgccaggcgccagacggtcaacgtccagcggcagcggatcgctggccttcatccccagcggggtggcattgaccaccagctcgtgtccggcaggatcgggctgcatcagggtgatatcgagctgcggatagtgctgatgcagccgcccggcgagggcgtgcgccaccttgggccgggtatcgtacagggtcagggcgctgacccccgccgccgcgagggaggcggcgatagccgatcccaccccgccgctgccaaccaccagcgcccgcgtcccctgcgggttaaaccctttacgacgcaggcccagcacaaatccctcgccatcgaacatgtctccgctcaggctaccgtcagcctcgcggcggatggcattgcaggcgccagcgatggccgccgtcgggctcaggcgctgcaccagatcgcaggtggcgattttatgcggcatcgtcaccagcgcgccgatgatgttggtcatcgtaaacagcggcggaataaacgcggcgtagtcctccggcctgacccccatcggcaccaccttcacgtccacctgctggtcaacgaaccacgggttgtagatcatcggcgccttaaaactggcggtcggatagccaaggtgcgctatcagccgcgtatgcccactaatcaccatgccttgctcctttgcttactgcgataactcgatacgtttgacgtcgccgaggataaacagataggccaccacgcccaacagcgcggcgccgccgatgtagatcaaggcgtagaagaaattgccgaacccggcaacgataaagccgatcaccagcggggtgaggatccccgcgaggttggcgcagaagttaaacaggccgccggtcagaccgcccagccccttcggggcgatatcggagatcagcgtccagccgagacccaccatcccctggccaaaaaaggcaaacgacatcaccaggatcaccgccaggtcgctctccagccagttggcggtgatgatgcagctggccatcagcaggccggcaacgatcggcagcttacgaccgaggttggctgacccggtggctttcagcagcttgtcggagagccagccgccaaacatcaccccgccggcggcggcgacaaacggcaggatggagaaaaagccgaccttcagccagggcatatgccgctcggtggccagccaggtggggaaccaggtgagaaagaacaccagcacggtattgccggcaaactggccgatactggcgccgatgatctgccgtttgctcagcagctggcggaccagcggccagctgaacgccacctgctggtcggtcggggcgctgaggccgccgccgttttcgatatgctcgcgctcctgctggctaaggcgcggatcttcatgcggttcgcggtagcagcgccaccacaccagggcaaacagaatgccgacggcgccaacgctgacgaacagcacccgccagccgaaaccgtccatgatccagaacagcagcggcgcaaagcaggccagcccgagatactcccccacggtgtacaccgccgtggccttcgcccgctcctgctgtgggaaccaggcgctgaccacccggctgttgaccggaaagcacggcgcttcgctaatgccgagcccgaagcggcacagcagcagcgtcttcagccccaccgccatgccgtggaacagggtaaacagcgaccacagggtcagtgacaaaaagtaggtcactttgttgccaaagcggtcgagaaacaatccgccgggtatctgcgccagagcataggtccaggcgaaggcggagaagaggattcccatgatcgccgggtcgatccccagctcagcggtgagctttggggcggcgatccccagtacggtgcgatcgagatagttgatcatggtgccaatggccaacagcgcaagaatgccgatacgccgccgggagcggcgcacggtgacggctggctgggcggcagccgtcgggttagggctatatgagctcatagtcggttcctgtctcgggtacagaggatgttgttattgtgtttaacgcataatgaaccatttgattcaggctaacaatactgcatcgccgccagacggacggccgcattcgctgcgccatagagcgcatagccagcccggcgctcggttaactcaaagaaaaagcggccggcggtaaacggccgggtgtaaagatgcaggaaatctcccccctgcggatcgcggtcatagaggagctgctggcgctgaagctgcccgacgtccagctcgccgccaaagcgcgccagcagatcgtcataataattggccgggatcggcagcgtatggcgggcaacctcggcaagctggtcgcaggcggccggcagatcgcggcaggcaaaggcggcatgctgcagccccgccccctggtagcaggcgacggagcgggcgatctgcgtcgcccggctctgcgaaatattcagcgccagacggatatcgccctgcgggctgcgcaccgccaggctgcgcaccagtccatacgggtccggcagcgtctgctcatgctcaagggaaaaaccaaacaccgtacggaagaacatcacccagttatcgcggctgtcggcctccattcccagcgccagatgatcgataccgagatagtcctcgcgcaccgtcacgccatcacgcagatgaaaatcgcgctcgtagatagcctccccggcgtcgatgagatagataaggctgccgtcgggggcgcagatcgccgggatcggcgtttcgttcggcccggcgtcgccctgccaggtggcataccccagcgcgcgggcgcgggcgacaagcgacgcgctgtgctcgacccgcagcgccatcgcgcagagcgataccccgtggcgttgataaaaatggtcggcccagctgtgcggctgatggttgatgacgatccgcgccccgccgttgcgccacagcgtcacctgtctggagcggtggcttccctcgtgctgaaaacccagcgcctgcagatgttgccccaggcgctgcgcctcggcggcgctggcggcaaactcgataaactccagcccgtgatagaccggcagcggcggcggtgaaaacagatcggcatcgcacgtcgggagccgacggcgggtttgctcctccagccacagcagcgaacgataaccatctttggccgtcgcgccgttcggcgaggcgcgaaaaccgtcattgaagatctccagcgaccaggggccgcggtagccacagcgggtgatctgctcggcaaacgcctccagcggcagctccccctgtccgggaaagcagcggaagtggcggctccactccagcaaatccattttcatatacggcgcatcggcgagctgtacaaaggtgattttctccaccggcaccgacggtagcgcgtccagcgtgtcgccgcgggccagaatatggaagctgtcgagcaccaggcccaacgccgggctgtccacccgccgcacccgctcccaggcctgctgccagcggttcacatgggttccccaggccagggcctcatagccgatagcgatcccctcctcttccgccagcgtggccagcgcccgcaggtccgcgacctgcaattcgctatccgccgagcagtccggctgtacattgctgcacaacagcagcgtttcgcagcccagctcgcgcatcagagcaaacttgcgccgagcgcgggccatattcgccgcaaactgcgcccgactggcgccttcaaaatcgcgaaagggttgaaaaagcgtgatttttaaccctaaatcggcggcaagctggcggatttccgccggcgtccccgtataatagagcagatcgttctcgaaaatttccaccccctgataccccgccgccgcaatagcgtgcagcttctcaggcagggtgccggaaatcgaaacggtggcgatagagcgcagcataaggtcctcgggtcaacagctgacgtaagccttgaatatgtatcatttggttcatttgcgccataccaggttgctaaattgtgatcattatgtgtattttttgtcacccaagaaaaaggagttgccatgaccgtcgttgcccatgatgaagcacaatccctgaaggcgcggatcttcagcgccgctatcgctgtctttgctgaacacgggctgtcaggcgcccgcatggagcagatcgccaccgaggcgcagaccaccaaacgcatggtggtttactacttcaaaagcaaagaacagctctatcaggaggtgctgcagcatgtgtatgcgcggatccgcgaaaccgagcagcagctggggctggagaatgtgccgccggtggaggcgctggtgcggctggtgcgctggagcgtgcgctatcacgccacccatgcggactatatgcgcgtcatttgcatggagaatatgcagcgcggcaagtggttaaaaagctcgggtgaactgaagccgctgaatcgtaccgccctgtcgattctggaagacattttactgcgcggccagcagcagggcgtctttcaggcggggctcgacgcgcgcgatgtccaccggttaatcagcagcttcagcttttatcaggtgtcgaacttctacaccttcagcagcctgtatcttgacgatccgctacccgccatcgacgatgaagcgatggtggctcaccattgtgacattgccgtcagggcggtgatccgcttcgtgatttcctgacccgccggcgcaagagatcagtgcccggaaagcgcatgaatgactttctccatagcctccacggtgagcggcgaacgctggattttgcggttcgccagcgaggtgcgcagcacaccggcaatgacaatgtgtttcggctcctgacccaggtcacgcatttccagcacgactttacccaccacgcggcacatttcctggtacaggtcgtcgtctttcgctttatttcccatagaatttagctcgtattttatcattatcaatcaaatcattattgatagatttcccgcacaacgcaaaccatcgccactttaaaggttcaatgacgcattttaccggctcatgatggcgaaataatccatttcttttactctttttcatagccggtgacgaaaaagtgtgttgcgtagatttttgcataacgtgccggttttgttacgcgttttgtccataatttgaaacgaggtttttattttcctttttgatttcggcagcgtataatgcgcttcgattctttcttgaatggtttcagcgcattggactgcatgataaaacgcataacaccttgccacatttcatgggctgaaccgccagcacacattcttctgcacgcttcagggttgtcacctatccttagggcgtggcttagcaactttcgtaatacaggtttggctccccggcagtgcgcccgcggagcgagaattccatatccttcacaacttaaagactaaaactgtcatgaaaaagaccaaaattgtttgcaccatcggtccgaaaaccgaatctgaagagatgctgaccaaaatgctggaagccggcatgaatgtgatgcgtctgaacttctcccacggtgactatgcggaacacggtcagcgcatccagaacctgcgcaatgtgatgagcaaaaccggtaagaaagccgctattctgctggacaccaaagggccggaaatccgtaccatcaagctggaaggcggcaacgacgtctccctgaaagcaggccagaccttcaccttcactaccgataaatccgtcatcggcaacaacgaaatcgttgcggtaacctatgaaggcttcacctccgacctcgccgtcggcaacaccgtcctggtggacgatggcctgatcggcatggaagttacggctatcgaaggcaacaaagttatctgtaaagtgctgaacaatggcgacctcggcgagaacaaaggcgttaacctgccgggcgtctccatcgccctgccggcgctggctgagaaagacaaacaggatctgatcttcggttgcgaacagggcgtggacttcgtcgcggcctccttcatccgtaaacgttccgacgtcgtcgagatccgtgagcacctgaaagcccacggcggcgaaaacatccagatcatctccaaaatcgaaaaccaggaaggcctgaacaacttcgacgaaatcctcgaagcgtctgacggcatcatggttgcgcgtggcgacatgggcgtggagatcccggttgaagaagttatcttcgcccagaaaatgatcatcgaaaaatgtatccgcgcgcgtaaagtggttatcaccgccacccagatgctggactccatgatcaagaatccgcgtccgacccgcgctgaagccggcgacgtggctaacgccatcctcgacggcaccgatgcggtgatgctgtccggcgaatccgcgaaaggtaaatacccgctggaagcggtcaccatcatggcgaccatttgcgaacgtaccgaccgcgtgatgaccagccgtctggacttcaacaacgacaaccgtaaactgcgcatcaccgaagcggtgtgccgcggcgcggtagaaaccgctgagaaactggaagcgccgctgatcgtggtcgccacccagggcggtaaatccgcacgcgctgtgcgcaaatacttcccggatgccaccatcctggcgctgaccaccaacgaaaccaccgctcgtcagctggtgctgagcaaaggcgtggtaccgcagctggtggaagagattgcctctaccgatgatttctatcatctgggcaaagacctggcgctgaagagcggcctcgcgcgtaaaggcgacgtagtggtgatggtttccggcgcattagtgccgagcggcacgactaataccgcttccgtacacgtgctgtaataatttacaggttaattggttttttttaataaagcgcctcgcggggcgcttttttttattcattgattagctcttcctattaaaaatgcaaatcggaatttactatttaataagggattatctaagatgaatccgatggaagcgcgctgttttcactcgcctttttcagcgattctgagcaattcgatgcttctttgagcgaacgatcaaaaataagtgcgttcaggtaaaaaaaatattctcatcccaaaaaactttgtgtaatacttgtaacgctacatggagattaactcaatctagagggtattaataatgaatcgtactaaactggtactgggcgcggtaatcctgggttctactctgctggctggttgctccagcaatgctaaaatcgatcagctgtcttctgacgttcagactctgaacgctaaagttgaccagctgagcaacgacgtgaacgcaatgcgttccgacgttcaggctgctaaagacgacgcagctcgcgctaaccagcgtctggacaaccaggctcactcttaccgtaagtaagagttctggtaataaaaatggcgcactctgtgcgccattttttttgccctcagcatgagggctattgggtaagcagaccgttgtcagacgaactattctgcgccgacagcgacgtcgccgtgctacctgccccagccgacaccaccaccggataccccgcccttctcgacatcgcttttttcaactgcaggtcatccactgctttatcctctgcgaaggcgtgaaacgccgctggcagcgtgtaagcgatggtccgggtgttttccccttcggtctgcgaaagcggcctgtggacttcgacatagcgtttaccatccggctcgacggcaaacttcaccggctgattgataatccgtaccggcgtcccggttttcacctggctgaacagcgctttgatgtcatcagcgttcatccgcatacagcccgagctgacgcgcagaccaacgctgtctggggcgttagttccgtggatgagatattcaccgttaccgtaggccagacgcagcgcatagcggcccaggggattgttcggtccggccgggaccaccgctggcagcgtcacccctttctccagcgagcgcgcgcggatgccggcggtaggcgtccaggtagggttagggatcttctgccccacgcgggtggtcatctccggcgtttccagacctaactggccaatgcccagcggatagacctgcacctgattctctcccggcgggaagtaatacagccgcagttcggcgaggttgacgacaatgccctccctcggcacgtcgggcagcagcatctgagaagggataaggacctgagtgccgggcttcggctgcaccggcgcaatcgtatcgttggcttcgaggatcagcatcgccgcggtatcgaaatggcgcgcaatcgcctgcaggttgcgatctccctcctggaccgtccagtactgattctgaccaatcagccgactgttggcgggaggaagcgggtaatcaacggcccaggcggccgtggaggcgccaagggcgctgagaagggctaaggtgatcatcgttttgcgtttcatactgagattccttctttcgctgataaaacgccaggagactgaacggcggcagggtcagcgccctgccggacgtaacagaatgaaatctacctgtttattctagctaatatttgccgctttcgcgcgtatcgcgcggatcatggcttcgaggccttgcgagcgggagggggtgagatgctgggtgagcgccattttttcaaaccacggacgcacgtcgaactcggtgatgtcctgagcggtcatccggtcatagaggataaacaccaccgctatcagacccttgacgatcgccgcatcgctatcgccgcgcagggtgatcacgcctgtgggatcctggtccatcacgatccagacctggctttgacagccctgaataatgttctgcacgctatgttcttccgggcttagcggcgccatacgctggccaagctcgatgatatagagatacttctcttcccagttggcgcaacggctaaagttacgcaacagtttgtctttgtccggtagtgccgccattgtcccgtcctttaccctaacagtttgcggatccgctggaggccggccaccaggcggtccacctcttccgtggtattgtacatcgccagcgatgcccgacacatagccggtacctgataccgggccatcaacggcatcgcacagtggtgtccggtgcgcacggcgatcccgtagttatcgaggaagctgccgacgtcataggcgtgatgctgaccgaggttgaaagcaattacccctttacgctgcgccgggccgtaaaggatcagatccggtaccgcgcgcagggcatcgagcgcgtagcgcatcagcgtctgctcatactcggcaatctgcgttagtcccagctggctgacgtaggtcagcgccgcgccgaggccaatgatccccccggtattcggcgtgccggcctcaaagcgccacggcgcctgattccaggtggtgccctccgtcaggctgacggtggcgatcatcgacccgcccccttcccaaggcgccatcgtctgcagcagctcggaccgggcgtagagcacgccgatcccggtcggcccatacagcttgtgggcggagaaaacataaaaatcgcagcccagcgcctggacgtccaccgggtggtgcatcaccgcctgggcgccatccaccagcactttcgcgccatgctgatgcgcaagagcaatcagcgccgccagcgggttttccgtccccagcacgttggagacctcggttatcgccagcaggcgggtgcgcgggtcaaacagtcccgggacaacatccagttgcagcgtaccgtccgggttcagggggatcacccgcagctcagccccgacgcgggcgcagagcatctgccacggcacaatattggcgtggtgctccatttcgctgatgatgatgttatccccggcgccgacgttggcgtttccccagctgttggccaccaggttgataccctcggtggtgccgcggacgaacaccacttcctccgccgatccggcgttaaggaaggtggccgcctgctgacgcacggcttccatccgcgcggtggcttccgcgctgagggtatggatgccgcggtgcaccgccgcgtagccgtggcgatagaattccgcttctgcgccgatcactgcctccggcttctgggcgctggcggcgctgtcgagatagaccagcggctgaccgttgacctcccggttcagtaccggaaaatcggcgcgaacctgttctactgaaaatgtcatactgtgcctcccggcaaacgctgtccaatacgcgccagcacctgctctctgagcgcgtcgctgcggatagcctcggtgagctcggcggcgaaggcgtagaggatcatctgctgcgccgcctgctgttcgataccgcgcgagcgcagatagaacagctgctcttcgtcaatgcgccccaccgtcgccccgtggctgcatttcacgtcatcggcgtaaatttccagctgcggtttggtgtcgacctccgccagccgcccgagcagcagattattgttggtcatctgaccgtcggttttcagcgcgagcggcgcgacgttgatcagcccgttaaacaccgcccgccccttatcgctgacgatggttttgtgcagctggcggctggtgcagtagccgacctgatggtcgagccaggtgcggctatcgcagacctcatttttcaccggcatcgccagcgaattgaggcgcaggttgctgttttcgccgcccaggcgggtgctggtctggtgacgcagcacctggccgccaagcaggaaactgctgctgaaggccgaggcgtcgcggcccagcagcaggtcgttatgggcgaagtgatagctgcgggcattctcaaatgccagcttgatatgctggaggtgcgcgttatcggccaccgtcatggtcaatcgcccgccggtgaaatgcggctgctcattgaggctcaggtaatgctcgacaatcgtcgcctccgccccgctctccagcgccaggtgatggcgatagtgggcggtattcagcgcatcgccggccaggccactggtgatatgcatcagcagcagcggtttatccaggcggcggttgcgcggcacgcgaatgcgggtcaccgtctgggccaggctttcggtcagatggagaaacacctccggctgcagggcatccggcagatgctggcgctgattatcgacactgacctccacgccgctggcggcaagatcgtcgctcagctgaggatgatagcggccatcgataaacaccagccgccaggcgtccagcggcagcgccagcgcatcacgctgttcagcactgagagaggccccctcatcggcgacaaagcgaccgttaagtagggcatccagcggagtgtatttccagtcctcgtgcttgcgcgtcggcagcccaaggcgcagcagctgctgcagatgctgactggcctccggggtacgcgggccgccctgcgcttcaaacagatggtgccactgctgcagcgcgttactgctgttcggtaagccagccatagccctgctcctccagctgtttgaccagagagaaatcgcccgacttcacaatccgcccctgatacagcacatggacatagtccggcttgatatagtcaaggatgcgctgatagtgggtgacaatgataaaggcgcgtttgccgtcgcgcagggcattcactccctgcgagacgattttcagggcatcgatatccaaccccgaatccgattcatcgagaatgcacagctccggctcaagcaccgccatttgcagaatatcgttgcgctttttctcaccgccggagaagccaacgttcaccgagcgggtcaggagatcttccggcatctgcagcagcttgatcttttcttccattaagtcctggaaatcgaaacgatccagcgcctcctggccacgatagttgcgcacggcattcagcgcagtctgcaggaaaaactggttgctgacgccggggatctctaccggatactggaaggccataaagataccttccccggcgcgatcttccgcagcgagttcgagcaggtttttgcccttaaattcgacgcgaccgccagtcacctcataatcttcacgcccggccagggtggccgaaagcgtacttttgcctgagccgttcggccccataatggcgtggacctctcccgggcgcacctctaggttcagcccgcgcaggatcgctttatcttcgacggcgacgtgtaaatcttgaatacttaacatcttttttccttaattatcagccgacgctatgttcaaggctaatggccagcaatttttgcgcctctacagcgaactccagcggcagctcggagaagacgtctttacagaaaccgttgacgatcatcgagatggcatcgtcttcgctgatcccgcgctgcaggcagtagaacaattgatcttcgccaatccgcgaggtggtcgcctcgtgctccagctgggcgctgttgttgcggcattcaacatacgggaaggtatgcgccccgcagtccgggccgatcagcatcgaatcgcactgggtatagttgcgggcgttggtggcggtcggcatgattttgaccagcccgcgatagctgttctgactgtgtccggcggagatccctttcgagatgatggtcgagcgggtgttcttgccgatatggatcattttggtgccggtgtccgcctgctgatggccgctggtcagcgccaccgaaaagaattcgccgatcgagttatcgccgcgcaggatgcagctggggtatttccaggtgatggccgagccggtttccgactgggtccatgacattttgctgttctccccttcacacagggcgcgcttggtgacgaagttgaggatcccgccggtgttgttatcgccggggaaccagttctgcaccgtggagtatttcacttccgcgtctttatggatgatgacttcaacgaccgcggcatgcagctgatagctgtcgcgcaccggcgccgagcagccttcaatatagctgacgtagctgccttcatcggccaccagaatggtgcgttcaaactgcccggtcttttcggcgttgatgcggaaataggtcgacagctccatcgggcagcggacgcccttcggcacatagataaaggtgccgtccgaagccaccgcggcgttcagcgcggcaaagaagttgtcattccccggcactacggtgcccagatactttttcaccagttccggatggtcgtggatcgcctcgccgaaagaacagaagatgatcccctgctcggccagcttttctcggtaggtggtcgccaccgacaccgagtcaaatatcgcgtccaccgccacctcgcgcccttcgcgtaccggcacgcccagctggttaaaggcttcttccacctcgctggtcagaaaggtattggccccggtctgctgcaccgcgccaggctcggaggcgcaggtctcatcgcagttgccgcaggagggcgcggaatagtagctgtaatcctgataattcagcttatcgtaatgcgctttcagccagtgcggctcctccatttccagccacgcccggtaggcattcagacgaaactccaacatccactgcggctcattgcggcgagccgagatagcccgaacgacttcttcattaatgcctttggccagctcatcggtttgcaggcgagtaaaaaagccctctttgtagttgagcgggccgccggtccaggttttgacatcgtcagttgcttcagtattacgcgacatagttactccgcctgcaccccaaaactttcgccgcagccgcactcatgctgcgctttcgggttatgaaatttaaagatttcatttaaaccttcccggacataatccagctcggtgccgtcgatgaacggcatcgcctgcagcggcgcaaacagcttcgccccgtcagattcaaagagcagatcgtcgggcgccggctcggcaatcatttcgagcacatagccaaaaccagcgcagccgctggttttaatgcccagccgcagccctttcttatccggctgcttgcgcatcagatcgcgaatatgcgcggcagcggccggcgtcatggtcagtccctgccagctgaaatcggcgggattaaaagttcctgcttgtacttccatcgatagacctccaggttggcgccatcaaggcataccgccatgttagtgataatgattatcacttcaacccttctgcagcaggggtattgcctcatttagtgctttttataagcatagaccctcgcccggggattatcagggcgtgcaaatagaacttaatcgattgatttataatatgttattttgaaatcattctatctccgcacgcaatggcaaagatgtatcgaaaataccgatttatgcaatagcggcagaccaccttgctggttatcctttgcagacgagcataaagtgacaacgtaacagaaagaccatgccagcgcggggcgcggccccggccatgcgctagcaaaaagcgggtagtgaaagcgcccgccggtaacgcttcaggaaaggaataagcgccgctcgcctggccgcgttcgggaaataaaaaccaaaataaaacgggcaaacggggctgccaggcgggataccggctggctaggtgcctttactcaccagccgggcggcctggacaaagacctcatcctctaccccgtcccccttctgtctgcccagcctcaccagttcatccacgatactcccctgattaatctgcttttgggtcgccactaagctaatgaccgccgcgccgatggccatgccaatcaatgccgtttgttcatctttatctttcatggtgtcgctccgtctgtcctcctcagaaaggctagcaaaagataccatctgctcaatttcaaattcaccttctttacgtctgacgcaaagcctgcggcagggcacctggcaggagaaaaagaaactaagcggctgattgcaatggcataacactaatgaacaattaacagacttgtgagtcttgaaattattttttagactcattggtctgttaattatcaattgcgtaaaatcttatgcctaattcgaccttatttttcatcaccctttgtctctctcgcgtcctggtgaccttcttcttctggatggcaggcatctacggcgtctttcatttcgcggagatcgttcaggagatggtaaccgtcggcctgccgtggccggtcttgttcgcggcgggcacgattttttgccagctggcgggttcggcgctgatcgtttttaatcctgccggctacggctggattggatcggggatgctgattgtgtttacattactcactattccgctgggacacgccttctgggccttcagtgaaccccggcgcactgaggaattccatattgcgcttgaacacattaccgtggtcggaggattaattatgagcgcgctgtttgcaggctatcggcgatgagcgaaacccctcgtcagaaaggtcggccaaaagatccattgaaaacgcaggcgatacttcaggccgcccgtaagctgtttctggaacagggcctggaggtgacaacggccgaaatcgcccgcgtagccggggtggcgaaagccaccctgtatgccaatttcagcgataaagaacatctgatagaggcggtcttacgccaggaatcggatctcaccatcagcgaccatgatttcgcccagcgccatcatctgccgctgatcgaggtactgacggcgtttggctatcgctttgtccgctttatcaaccagcgggaactgaccggctgggaccgactgatcgcctcggctgccgtgcgtcaccccgatctccccggccgcttttacgccgccgggccggggcgcgcgcagcagatgctggaagcgatcatcgccgaggcgatcgaagccggtactttacgagcctgcgatccgcaggaggctgccgacgaactggccggtttatggctgggaatgaccagcctggcgataaaacttggcgcaagacctccgctgtccgacgacgaaatcaaacagcgggttgagcgcgccctggacgtctttctgcgcgcgtattccctggcgccgggctgatctctccttgaccttttcagcgctgtcgtctggcgtaaggctgatttattgtgcccaatccgcgcccggcgcaaaaaataatgtccttgccggttagcattaaaagaaaataacaaccacagagtgcaacgcagattattccatgagggaatagtgggaatgctaatatttcatttcctcgccggtttttagaggcctatagtttttttacctgcagaacatccactaaggttaaaaaacataaggacataataatgattgtttcagcccccagcgattatcgcgaagccgctcgtcgtcgtctgccccgcttccttttcgattatattgacggtggcgcggtggcggaaaacaccatgaacgccaacgccgccgagcttgcctcggtagctcttcgccagcgcgtactgtgcggggccggcgaaccgacgctggcgaccacgatccttgatgccccatgggcgatgcccgtggcgctggggcccgtcggcgccaccgggatgtacgcccgccgcggcgaagtccaggcggcccgcgccgcctcccgcgccgggatcccgtacaccttatccaccgtgtcggtctgctcgattgaagaggtggcgagccacgccagcggcgcgctctggtcccagctgtacgtactgaaagatcgcggctatatgcgtaacgcgctggagcgcgcctgggccgctggcatgaaaaccctggtatttaccgtcgatatgccaatccccggctcgcggtatcgcgataaccgctcagggatgtccgggccgcacgccaccctgcgacaatatctccaggcttgcacccatccgcgctgggcgatgaacgtcgggctggcgggcagacccctgtcgtttggtaatatcgaagcctacaccggccacaaaatgaccatggacgactatatggggttcatcagcaacaacttcgacccgtccatcgcctggcacgatctggagtggatccgcgacagctggcaagggaaattaatcatcaaagggatcctcgatgccgacgatgcgcgcaatgccgtgcggctgggcgccgatggtattgtggtgtcaaatcatggcggcagacagctcgatggcgccatccccaccgcccgggcgctgcccagggtggtggatgcggtcggcgacgatctgacagtgcttgccgattccggggtgcgctccggcgtggacgttatacgtctgctggccctcggcgcgaaaggcgtgctgctcggtcgggcctatatttatgccctggccgcggcgggcgaagcgggcgtggcgcatctgctgcgcttatttgccgaggatatgaaggttaccatgaccctcaccggcgcgacctcgccatcggccatcagcctcgattgccttgatcgcctcgaacaggatcaacaccacactcatgcggtgccggtatccttacccgcctgaccctgcccgggacctggcctggccatgtgcctcgcccaggtccggcaaagtggaattacctctgaaggtgcaactctgtctgttgtaccgtgttcgccgggcggatgcggaaccagatcgcgtacatggccggcaggaagataagggtcatgatggttccccccagcgtcccgccaatcagcgtataggcgagcgttccccagaagaccgaatgagtgagcggaatgaacgccaggatcgccgccagcgccgtcagcagaaccgggcgggcgcgctgcaccgtcgcctccaccaccgcgtggaacggatcgagccccgcctgttggttatgatggatttggccaatcaggatcagcgtattgcgcatcaggatccccgacagggcgatcaggcccaccagggcattgatgccaaacggctgattgaacagcagcagcgtcgggaccacgccaatcagccccagcggcgcggtcaggaaaaccatgaccatcgccgacagcgaacgcacctgcaggataatgatcagcagcgtgagggcgatcattatcggaaataacggcaccatcgcccgggtggccttgccggattcctcaatcgaccccgccgtctcgatgcgatagccaggcggcagcgagtcgataatgggctgcagcggcttcatcagcgcggtggagacatccggcggctgcaggttctccgcaacatctccgcggacggtgatggtcggcgtgcggtcgcgacggcgaagcagcgggtcctccatcctgatcgacacgtcgccaatctgtgacaagggaacccgctgcccgccgctgcccaccagggtgaagtcggcgattttcgccggatccagacggatgtcgcccgccgcgcggccgatcacctgcacggcgcgaatatcttcccggacggtggtgatcgggatccctgacagcaggaactgcagctgctgggcgacggactgggagctgagtccgctcgcctgcagccggtcctgattgaggctgaaatgcatcaccggtacccgcgaaccccagtcggtattgacggtgcgcatcagcggactggcctgcagcaccgatttaacccgctcggcgatgtcgagcagagcgtgcggatccggccccatcacccgccaggcgaccggataaggcgaataagggccaaacaccagctgagtgacgcgcacccgcgcctccggcgccaggccattggccaccgcctcccgcagccgccgcttgagcgcctcgcgggcaccctgcccgtcggtcaacaccaccagtttggcgaaggagggatcgggcaattccggagccatcgccaggtaaaagcgcggcgcgccctggccgatatagctggtgacaatcttcgcctccggctgccgctgcagccagtgctcaattttcgccgccgcggcgctggtctggctaatcgacgacccgtaaggcagctgcacttcaaccagcacttccggacgatcggaggtggggaaaaactgctttttcaccacgctcatgcccaggatcgccacgataaacagcgccaccaccccggcggccacgcgccatttgtgagcaataacccgggtcagcagccgacggaagcgctgatagcgcggggtgtcatacagcgcggcgtggccggccgccgcgggctttctgtccggcaacaggtgcacccccagccagggggtaaaaatcaccgccacaatccaggaggcaatcagcgcgataccgacgatccagaacacattgctggcgtactccccggcggtggactgcgcaaatccattgggcataaagcccacggccgtcaccagggtaccggccagcatgggcgcggcggtatggctccaggcataggccgaggctttgaggcggtcatacccctcctccattttgaccaccatcatttcgatggcaatgatggcatcatccaccagcagccccagggcgaggatcagcgagccgagagtgatgcggtcgaagtttttgccggtcgccgccatcaccacaaacaccacggcgagggttaaaggcaccgccgccgcgaccaccacgcccacgcgccaccccatgctgacaaagcacaccgccatcaccaccagcagggcgacaaagaatttgatcatgaactcatcgaccgcggcgctgatattcaccgactgatcggtcaccttggtcaacgacatgccgagcggcaggctctgattgatgctggccgtttcggcatccagcgctttccccagcgccagaccattccagccctcacgcatcaccacgcccagcagcagcgccggttcgccctgatagcggatcaggaaggtggcgggatcttcataccctcgctcaaccgtggcgacatcggccagtttcagcgttctgcccccggcaataatcggcgtgtcgcggatctgctgcaggcggtcaaacgccccatcgaggcggataaagatctgcccgccccgggtctcaatggccccggcggcggtcagcacattctggctgttcagcgcggcaaaaatcgcctctggcgagagacccagagtggcgagacgatcatgagaaaacgagagataaatgcgttcagcctgttcgccgaggatattcacttttttcaccccggatacatgcagcagctgctggcgcagggcttcagcgtcacgcaccagctgccgcggcggctctccccgcgccttcagggcaaagatcgcaaaggtgacgtcggcgaattcgtcattcatcatcgggccggagacgccggcaggcagatttttcgcctcgtcgccgagcttcttgcgcgcctgataaaactgctccggcacctcggaaggcggggtctgatcctgcagcgacagggtgatcaacgccatgccagggcgggtataggtctccgtgcgatcgtaccactttaactcctggagccgtttttccagcggctcggcgacctgatcctgcatctcctgcgcggtggcgccgggccagacggtaatgaccgtcatttgcttgaccgtaaagggcggatcttccgctcgcccgagtccgaagaacgccaccagcccggcgacggagataaggataatcaaaaacagggtcaccgaccgctcgcggacggccagcgcggagagattaaaacgcccggcgctcatggctggctcccggcggcattatgctcgcgtcgttccgccagacgcaccgcctcgccctggtgcagaagatgggcgcccagggcgacgatcggctcgccgggcttcagcgggccggtcacccgcgcggtttcatcatccaggccgagcacagttaccggttgccaggagacggtggtcggacgagaggcaatgcgccagacgccagggccgttacccggatcgtagaccgacgccaggggcaccgccagcacctggcctggcgcctggtcgttgccgatgcgcagggtcacggtagaccccagcggggcattcgccagcgcgccgttcagtacatagcgcgcttcaaaggtgcgggtggtggcgtcagccgcgtccgaaagcaggcgcagggtcgccgtgaccggctgagattcgctgccatagcgtgtcgccagcgcctcgctgccgaccgccgggcgcagcgtctccggcagttgcacccgcgcttcgcgctgccccgcccgcgccaggcggatcaccacctgcccggcgctgaccacctgtcccggctcagcgagggtttccaccaccacgccgtcagcatccgccagcagtccggcatagccggtggcgttttgcgccacattggcctgcgcctgggccgcgctgaggtcggctctcgccgcctctgctgccgcgttaatctggtcgaattccgcggcagagatggcgccgctcgccaccaggccgcgatagcgggccagatcgttggccgcctttttggctcgcgcccgcgcggcatctacggcccgctgttgggactgcgcctgcaaggctagatcagccggatccaggcgcagcagcagctgaccgcgcttgacgctctgcccggtttccacccgccgttcaagcacttttcccgccaccctgaagccgaggtcgctttgggttcgggccactaccacgccggtaaaggcccgcgagccgacctccgcgcgctcgacggtcgccacccggaccagcggcggccggatgcgggggtcgtcatgatcggcaggttcgccgcagcccgcgagggccagcggcaggaggcagacggcaagatggacggcgttgagcctgagcatgggtcaccttaatgaaaagaccggatggtgaccgcattctcagactagtgactaataaagtcaatagtcactaatcagggggagagacttctcaggatcagggaggcaagcagcaccgccgcggtgggcgcggtgtcgagattgtattgcaactgcaccggattgatgaaaggacacatcaccatatacaccgccagggtcgcttcatccagcggggttttgcgctcgaactcacccgcctggcggccttcgacaaggatttgaccaatcagctgctgcagatgaccggcatactgttccgttgaaggccatttatcgcgcgccgcgacggcggcgatgtcgtacagtttgcgatcctcaaaaaacagttcactgccggcctcggtcagcgcccggaacaggcggcgcagtttctcgctggcggacggcgcatcggcgatggcctcgctgacggccaccatgatcttctccagccggctggcgcaaatcgcctcgccaatcgcctgcttggagtcatagaatttatagatataggctttggaaaagcctatcgctttggcgagatcggtgaccgtcgttttctcatagccatagcgactaaagtgcgccatggccgcgtcaagaatctggtcccgaacgctgtggtcatggggaccacggcttgcaggggtgggggtatttttcgtcatccgtttagcttaatgcgatcgttatcgtttgacaacgagtgacgttattatgatttggtcacaataacgccccggtttgcgatccgcttcgccgcgtcacgcctcggtgtttatcgcgccggcgggcagacaacccaggccttgcagcgtctgatacaccgcgctgtcgagcggggtatgcggttccgcgcctaaaaaatcaaccagtttatcgttgcgcaggcgtaccggcagacgccagagatagtgcatctcgaccatttcgcgcagggtggcgttgaagggcgccgccagcttcaccagccaccagggaaaagacttcactaccgccctgccgccatagcgggcgaccacccgctggatcgcctgactcatttcgctgccgtccgggtcccagtggccctgcatatgaaagcgggcgaacggctcaagctcgcgcctgcgggcgagcagcgcggcgatggtggcggcgacgtcgggcagccaggcccactgatgccccacgccgatcgcccccgggtagctaatgatgcggggaagctgaccaggcttgaccagcccctgagaaaaccagttatttccggcgcgtggaccaaaaaaatcgcccgcccgaacaatcaacgcccggccgccgcgctgcacgtaatccttcagcgccagctccatcgccacccggatggcgcctttgcgggtcaccggctgttgtgcggcctcttcagcaatcagtggaaaggaatccggtccatagttgtagaccgtgccgggcaggactacaagcgcccgctgccgttcggcagcctgcagggtgttgcgcagcataggcagtacctgttgccgccagtgccggtagcccggcggattcaccgcatggacgatgacgtcgcaaccggcagccgccgccgcgacctggccgccatccagcgcgtcgccggctatccactgcatgccatctgcgggaccgcaaatctgagcgccgcgcttcagcgcccgaacctgccagttgtctgccaccagccggcgcgccacttccccgccgatgcccccgcttgctcccagaataagtaccttgccgctgctgttcatcctctttccccgttcgctaatggatgcttgacagcctacctgcggctcatatcaaatgaaattgcataccatcgtcgagcggctatacatatttgtatgaatacctctattccctgggagtggtaccgaacctttctcgccgtcctgcaggaaggctctttatcgggcgcatcgcgtaccctgaacatcactcagccgacggcggggcgccatattgccgggctggaaaacgccctcggccaggccttatttacccgctcgcaaaccggcctgctggcgaccgacgcggcgctggcgctgcgggtgcacgccgaggcgatggacaataccgcccgggcgctggaacgcacggcggctaacttcagtcgcgacagagccgagctgcgtggcgtggtgcgggtggccgccagcgaggtggtcggcgccgaggtgctgccgccgctggttgcccggctcaggcaggcgtgcccgaatatcgtcatcgaactgatgctctccaatcggtttcaggatctgcttcaccgggaggcggatattgcggtgcggatggtcgccccgcagcaggagcagcttatcgcccgccgtctcggcaggatcgagcttgggttacatgccaccgccgcctacctgacgcggcagggcctgcccgcgactctcgacgatctggccagccacgcgctaattggttttgatagcgccacccctctcgtgcgccgggcgctgcaggcttacccccgttttcagcgcgaggcgttcgcgatgcggaccgatagcgacctcgcccagttgagcctgatccgcgccggagcggggatcggcatctgccaggtgcctcttgcggatggcattattcccctgcagcgagtgctggcggccgacttttctctgtatcttgatacctggctggtaatgcatgaggatctgcgccacagccctgcctgtaagcgggtatttgattttctcgcccaggggttgcaggcgtatattcgtggcccactggcgagctgacccaccccatcgcgcggtcatttcattgcctgcggaaatagtcactcattgacactgtaaatatggcattgtataaaaccccgccccaataatgagtttcatttgcattactcccatttgctggtcatccactcgcctgtttacaaggatagcgtttaatgaagaaggtcctttgcgcgttaggcttgatgttcaccgccgtcagttccgcgctggcaacaacctaccccctgacgattgaaaactgcggctatcaggagaccttcacccggccgccggagcgcgtggtcgcgctggggcaaaatacggtcgaaattctgctgctgctcgggctgcaaaagcaggtggtcgccagcgccttttggccgaccagcgttttaccgcagctggctgagcaaaacgcgaagattaaaaccttgacggtggaaattccgagcctggaatcggtgctggcgcaaaatcccgatttcgttcccgcccagttgccgctgctgctggggccggaaagcaaagtcgccaggcgtgaagatctcgccaccgtcggcgtgaacagctacgtctcaccggggatgtgcgccaccaaaaaggccaccggcgatatgtacggcagccggcaaaagctgtgggatatgacctggctgtatcaggagattagcgatttttcccgcattttcaacgtcgaagatcgtggtcaggcgctgattgccgatttcaaaaaacgtgaagccgacctgcgccaggagtttggtaaaagcaaaaaggatctctccttcgtcttctggttctccagcgcctcaccttcggccgatgcctatgtcggcggcaaaaacagcgcctccggatttatcgccagcgtgctgggcggacataatgcgattacctccgaaaccgagtggcccacggtgagctgggagagcattattgccgccaacccggatgtgatcgtggtcgccagcctggatcgtaaccgctgggcgctggataaggccgaggagaagatcaaattcctcaaaagcgatcccgccgtcagccagctggaggcggtgaaaaaaggccatatcgtggtcatggacggtcaggcgatgaatccgaccattcgcacgctttacggcgcggaacaggtgggcgagcagctgagaaaaatggggctgaactgatgagcgtcgccgcgattgagacgcgccgcagcatactgctcaccggctggtgtgtactggcagcgatcgtgctggcgctggtgatcgctgttggcgtcagcgttggcgagctggccatcccgctgcagcatgtcttttatgctatcagcaacagaaccggcttaaccgctgagccgctcaaccgtatctatgagagcgttatctgggatttccgcctcagccgcgcgctggtcgccgcctgctgcggcgcaggcctcgctatctgcggcgtcgtgctgcaaagcctgctgaagaatgccctcgcggaaccctacgtcctcggcgtctccgccggggcctccaccggtgcggtgtcgatcgtggtgctgggccttggcgctggcgcaatttccctctcggccggggcctttgccggggccttcgccgccttcgcctttgtcgccttgctgactaacggcgcgcgcggcggcaatgagcgtacgattcttgcgggcgtcgccgcctcgcagttatttaacgccatcacggcctataccatcagcacctccgccagcgcgcagcaggcgcgcgatgtgatgttctggctgctgggcagcttcagcggcgtccgctggcccgaattccagttggtcatcgtggtggtgctcgcgggtctggcggtctgcctgtggtatgcccgggcgctggacgcgttcaccttcggcgacgatgccgccgcctcgctggggattgctgtgccgcgcgtgcgcctgatcctcttcaccactgcggcgctgatcaccgccaccatcgtcagcatggccggctcaatcggctttgttggcctggtggtgccccacgtgatgcgtttcttctttggcccgctgcaccgaacgttgctgatcgccagcgcgctggcaggggcgatattgatggtactggcggacattgcgtcgcgcctgctgattgccccgcaaagtctgcccgttggggtagtaaccgccctggttggggtgcctttctttgccgtgattatctaccgctcaaggaataagtgatgagtatttgcgctgaaaatatcacctggaaggcaggcaaaaaggtcatcgtcaataatgtctcgctgcgggtgccgcgaggcgaaacggtcggactactggggcccaacggctgcggcaaatcctccctgctgcgcgttctggcgggcctgcgccgcccggatgcaggtcgcgtcaccctcgacggccaggatatcgcccggatggcgaaaaagcagctcgcccgccgcgtggctttcgtcgagcaacacggcatgaccgaggccaatatgcgggtgcgcgacgtcgtgcgcctgggacgcattccccaccactctccgttctcaaactggagcgctcaggatgacgaggcgattgccgccgcgctgcagcgggtagcgatgctggagaaaagcgaacagggatggttaagcctctccggcggcgagcggcagcgggtgcatatcgcccgcgcgctggcgcagagtccgagcgaaatcctgctggatgagccgaccaaccatctggatatacaccatcagatgcagttaatgcagttgatcagcgagctgccggtaaccagcattgtggccattcacgatcttaaccatgccgcgatgttctgcgattcgctgatcgtgatgcagcaggggcagatcctcgccagcgggacgccggaggagattttgtccgaagcgctgctgtgggacgttttccgggtgaaaaccaaaatcgagatctccccttaccacggcaaaaagcacattcatttcatcgtttaggttgggcggatatgcctcttttctccctgcgccctgcggcaaccctctggcctccggtgttactgggaagccagttcgtttttaatattggcttttacgcggtcgttcctttcctcgccctcttcctgcgcgacgacatgctgctctcaggcggacttatcggcctgatcctcgggctgcgtaccttctcccaacaggggatgtttatcctcggcgggacgctggccgaccgctatggcgctaaggcgatcattctcgccggctgcgtcgttcgcgtcgccggttttctcctgctggcgtgcggggcgtcgctgtggcccattatcctcggcgcctgcctgaccggcgtcggcggcgccctgttctccccgtcgatagaggccctgctggcgcgggccggcaccctcagccaggccaacgggaaacgcagccgcgccgagtggtttgcgctgtttgcggtatgcggtgaactgggagcggtgatcggcccggtggccggaggcgtgctgagcgggatcggctttcggcatatcgccctcgccggcgcgggaatatttcttctggcgctggcggtgctctttttctgtctgcccgccgacgggcacacgacaacaacgcgcagacgagtcccatggtggacgcctttgcgccagccgcgctttgtcgcgtttattctcgcctacagctcatggctgttgagctacaaccaactgtacctcgccctgccggtggagatccaacgttccggcggccgcgagcaggatctggcgccgctctttatgctggcctcgctgttgattatcaccctccagctccctctcgcccgcttcgcccggcgaatgggcgccgtgcgcatcctgccggtgggctttctgctgctgtcggcttcctttgccagcgtggcgttattcgccgccgccccacccgccgaaggttggctgcggttaatgccggcggctggttttgtcacgctgctcaccctcggccagatgctgttagtgcccgcagccaaggatctgatcccgctgttcgccgaggagtcgacgctgggcgcccactacggagcgctcgccaccgcaggagggtgcgcggtgttagccgggaatttactgctcggtcatttacttgaccaggcgctcattccctcgccgcaggcggtttatccctggcttctgctggcgctgtttccgctgtgcagcgccgtcgccctgcgggcaatctgtcgcccgctggcggcaacatgacgcagagcgggcaacagcccgctctggaagtgaaccgacgataaagtacatcgcctggggaagataacgggcgcgccccgccttactttgccgccagctcgcgacgaataatctcggcgccggcgctcagggcgtgcagtttgccggtcgcgacatggcgcggcagcggcgccataccgcagttggtggacgggtagagtttgtcggcatcgacgaacgccagcgccttgcgcagggttccagccacctcttccggggtttcgatcgcatggctggcgacatcgatcgccccgaccatcacctttttaccgcggatcaactccagcagatccatcggcacgcgcgagttgtggcactcgagagagataatatcaagggacgatttctgcagctgcgggaaagcctcttcatactgtcgccactcggagcccagcgtctttttccagtcggtattggccttgatgccatagccgtaacagatatgcaccgctgtctcacacttcagcccttcggtggctcgttctaaggcggcgatcccccagtcgttgacctcatcgaagaagacgttaaaggccggctcatcgaactgaataatatcaacccccgcagcctctaactctttcgcttcctgattgaggattttggcaaattcccaggccagcttttcccggcttttgtagtggttgtcatacagcgtgtcgatcatggtcatcgggcccggaagcgcccatttgatcggctgactggtgagctgccgcagatagcgagcgtcctccacgaagaccggtttctggcgctccacggcgcccaccaccgttggaacactggcctcatagcggttacgaattttcacgatctcgcgtttggcaaaatccaccccgctgaggtgctcgatgaaggtggtgacaaagtgctgccgcgtttgctcgccgtcgctgacaatatcgatcccggcccgcagctggtcgtcgagggataaccgcaaggcgtcgcgcttgccggccagtaattcttcgctggacagtttccagggcgaccacagggtctctggctgcgccagccaggaaggtttcggtaaactgccggcggtcgatgtcggaagccatgttttcatagtcattagccttttatatgggtttagcaaagcgcgaaattagcagaccattgctcaagcaacgtcttgtgcgggttgataaaatgttgttgtgtaaatttcccctgctcaatcgccaacaggctgcgctcttcccggtcatagacgatttttgttaatgaatgatccaggtggctgagattgggctgatagtattgccccgccggggagttggcattgtagatctccgggcgatatattttctgaaacgtctccatcgtgctgatggtggcgatcagttccaggctggtgtaatcgctgagcagatcgccggtaaaataaaaggccaacggcgcgacgctgttttttggcataaaatagcgtacctgcagacccattttgctgaaatagcgctcggtcagcgagacgccttcctgagcatattcaatgccgaggaccggatgttcgttaccggtgcgatggtaaacatctttactggagacgctcaggcaaatcaccggcgccttgctgaagttggcgcgccaggcgctggattgcacaaaatccttaaagatattgccgtgcagctcgccaaagttttccggtacgctgaagcgactctggtccttattatgttccagaagcagtacgctaaaatcgtaatcccgcacataggaggagaagttattgccgacgataccggcatgacgctccccgctctttttatcgacaatatgcgtttgcaggatctcaatcaccgggaagctggcgctatcctgagcaatattcatctcgacagaaataatatccagttccaccgcatagcgatcgttatggggattatcccagtgggccaggctattaaaacggttattcatcatgattaacgtattgcgcagattttcctcacggttcacccctctggctaaattagcgaagttggtggtaatacgcgtattttccgcagggttataattttcatcaaaccgggtgcgcttaatcgtataggtaaatttattattcatggcgattgtccatcctgatggcgggcataaagcgaacccggcggaatactctccaccagcctggcgacgcggagtcaggccgggcgcgcttcaaccggtaaatgttgttgattcgttaatgaacctatttttgccagagtcagcgctggagggaaagcgacttaaattcaatgcaacatgagccatcctcatgttgctccaggcggtggccgatggccgacgcaggccgacaatattagtcaataaacgtttgttcaatggaagtaggcagggtacactctttaaccactataagatgggcttacctgcccgccgtacccgtttagctggagcttttgtcgtacagaatgattgttgatatcagtattatgtcgatgtgcatggccgtactgctgattatgagcgtactgctgaattaagaggctcccgaacgcaatgacactcgctctcatctgacctccacattcgcgaggaaaaaagaagattcagaggattcgcgccgcctgggattgttccgcctgccggcaccctctactcttttgggacttgcttattgaggaatcccggatgaaaaaagctctgcttgccctgttcgctatcgccaccgttaccgccgccagcgcctttgcggctgataaaaccgacgtcccggcgcctgtcgtcgataacggagtccgcccgccgatggagagggatcgtggccccctgccgccgttcccgccgcagcttccgccgcacagaccggtgctgttttcagccacggtagcaaccgatacgccagcggaaacaattaacaaactgaccgcgctgatccccgccggccaggcgaaacactacgaagtgcacgttgaggtggtgccggttggcgagggaaccgacagacaatagcccaggggatatctacgctgtcatctgtcagcaataaaaaagctgccgcatttcgcggcagcttttatgtacttatttacagctgagcagctgaaaattagctacgcactttccggtaaataaacagtaccaccagcgcaccgataaccgctaccacgaagctgccgaaattaaacccatcgaccttaccaaaaccaaacagggtactgatccagccgccgaccacggcgccgatgatccccaaaataacggtcacgataaatccgccgccatcttttcccggcataatccacttggctaaaataccggcaataagtccaaaaatgatccaggaaagaatacccatggttaaccgtcctcttgttacctttaagcatttagtattgaaaagagtagcataaataacgagagtggatcggtaataatataaatattagataattccctgccgacgcccggctgatcttgtgacaacctctctggctctggcaggccggctctcgcttattaccttaaaaaaagggaggctattcgcctcccgccatgcggcttatattaccgcggtggttagtcgtgatgaacaacataaccgcgactgttcgtcgaagatttcaatttgccagacctgatggcgcgtcccgacgtgcagcgctttgcagacgccgcgcacccggcccccgcgcgccgaacggatgtggttggcgttaacctccagccccaccaccttttgttcgccttcgctgcacagatagcctgccaccgaccccagggtctccgccagcaccaccgacgctccgccgtgcagcaggccaaacggctgctgtgtgcggctatcgaccggcatagtggcctccagcgtatcgtcggtaacggtctcaaagcgaatatcgagcagccctaccatgttcccctcaccgagccggttgagctgctccagcgtggcctgacgtttccaaatcatccgattatctccagtaacgcctgcagcgggtggcgaacgccgctgccttcaatacgcttcacctgactgcggcaggagtagcccgtcaccagacagcggtttcgcggcagccgctgcatcgcctgctgccaggagagcgcgtaaatggccaacgagttggcgtggtttttcacttcatgaccataggtgccagccatcccgcaacacccaacgctgacgttttccagcttcgcgccgaagtgggcaaaaatatctgcccactgctttgtcgccgccggtagcgcggtcacttcggtacagtgaccgaacaggtaccagggctcaccgcccagatcgggacgggcgtcgctggttagggccttcggcaaccactcatggactaacagcacctggaaatcgccgcgcttgtcgccgagcgtctgcttgtactcatcgcggtagcagagcaccagcgccggatcgacgcccaccagcggcatgcccagctgcgccacgcggttgaggaagtccgccgtcttctgcgcggtgcgcgcgaagcgggtgaggaagcctttgatatgctgcgccttgccgttcggcgagaacggcaggagcaccggctgatagcctaaggcctcgaccagacggataaagtcggccaccacctgggcgtcgtagtagctggtgaagggatcctgcaccaccagcaccatcttcgctttctgctcggcgctcagcgcttcgagctgctcaagggtcatattggcggaacggtggccggccatctgctgcttcagcgacggcgccgagagcagcggcagatcgaccatcccgatatgcttctccgacagctttttcagccaaggctggttaataaaaaagttaaaggtcttcggcgcctgcgccatcagcggcgcataagattcgaccgaggccaccagatgatcgcgcaccggccgcagatagcggctgtggtacagctgcaggaagcgcgagcggaactcgggaacatcgattttgatcgggcactgggtcgaacaggctttacaggccagacagccggacatcgcctctttgacctcatgcgagaagtcatattcgcctttgcgcgcatgccagctgttgcgcgtgcgcgccaccagcgagcgcaggctgacgccctgctccggcagcgccttctccagctggttgggatcgacgccgcggtcggccagcaggcgcagccattcccgcaccagcgtcgcccgccctttcggcgagtggatgcgctggttgctgactttcatcgacggacacatcgggctcttgacgtcaaagttgaagcacagcccgttgccattacactccatcgccccacgccagctgctgcgcaccgcgatggggatctgccgatcccaggtgccgcgcttcgccgcatcgactttcatcatcggcgcgtcgataccttccggaggacagattttccccggattcaggcggttatcgggatcgaagaccgctttgatcttgcgcagctcggcatacagcgtctcgccaaagaaggccgggctgtactccgcgcggaaccctttgccatgttcgccccacagcaggccgccatacttcgccgtcagcgccaccacatcgtcggagatctgcttcatcagcacctcctgctgcggatcgcacatgtccagcgccgggcgcacgtgcagcaccccggcatcaacgtggccaaacatgccgtagctcaggccgtggctgtcgagcagcgcgcggaactcgacgatgtaatccgccagatgttcgggcggtacgcaggtgtcctcggcgaaaggaataggcttggcggcgcctttggcattgcccaacaggccgacggccttcttgcgcatggcatagatgcgctccacgccttcaagatcgtgacagacctgccagccaatgacgcccgcctcgctggcggccatcagctcgtccagccgctggcacagggtagcaacctgctggtcaatcagcgccgcgtcatcgccggcgaattcgacgatattgagcccgagcatctctttatccggtacgtcggtgatcagttcgcttaccgagtgccagacgatatcctcgcgcgccagattgagaactttagaatcgacggtctccaccgacagggctttcgcttcgaccataaagggcgcattgcgcagcgcagagtcgaaggagtcatatttgacgttgaccagacggcgcaccttcggcaggcgggtgatatccagccgcgcttcggtaataaacgccagcgtcccttccgaaccggttaaaatacgggtcaggtcgaactcgctcatctcatcgttaaagacgtgacgcagatcgtatccggtgaggaagcggttgagtttgggaaacttatcaatgatcaggtcacgctgcgccttgcagcgctggtagaccgtgttgtagatccggccaaccgtcgagggggtattgcccagcgtctccgccagcgccaccggcaccgcctgggtatcgaggatatccccgcccatcagcaccgcccgcaggccgagcacgtgatccgacgttttgccgtacaccagcgatccctggccggacgcgtcggtgttaatcatcccccccagcgtggcgcggttgctggtggatagctcaggcgcaaaaaagtaaccatagggtttaagaaactggttcagctgatctttgatgaccccggcttcaacgcgcacccagccctcttcggggttgatttcgataatgcggttcatatagcgggacatatcaacgataatcccgccgttcagcgcctggccattagtgccggtgccgccgccacgcggggtgaaaatcagcgatttaaaacgcggttcggcggcgacgcgcgccagcagcgccacgtccgccgtggatcgaggaaaaatgaccgcatccggcagcagctgatagacgctgttgtcggtggccatcgttagcctgtcggcatagctggtggcggtatcgccggtaaaaccctgttgctccagtacctgcaaaaaattcagcaccagttgaactacccctggcgcctgagaaatttgtgggatcatcacgcttgaccctgcctgactatgttgtgtttgaaaatattgtgttggtgctaactaaacgtttgcgtagcgcattcaactttttatcacatttttttcatatgcgcccacgtgttttctgtgcaaaatcagcccggcaaaattattgatattattatcagtatatggatttacgcggcgccagctgtttggcgcgactggaaaggtaaaatttctctatgattaatccccatcagcctcgggacattccgcaaatactgctgtcggtgctgttcctggccctgattatcatatcctgcctgtgggttgtgcagccgtttattctgtccttcgcctgggccggtacggtggtgatcgccacctggccggtgctgctgcgtctgcagcgtgtgctgttcggcaaacgactgctggcggtgctggcgatgaccctgttgctgtttctgctattcgttattcctatcgctctgctggtcaacagcctggtggataacagcgttccgctgatcaaactcatcagcagcggaaatgtgacgctgccggatttcgcctggctcaacagcgtaccgctggtcggcgataaactgtactccgcctggcacggtctgctggatatgggcggctcggcgattatggccaaggttcgtccctatattggcaccaccaccagctggtttgtcggtcaggcggcgcacatcggcaagctgctggtctactgcggtttgatgctgctgttcagcgcgctgctctactggcgcggcgagcaggtggcctatggtttccgctacttcgccacgcgcctcgcggccaaacgcggcgacgccgcggtgctgctggccggccaggccgtgcgcgccgtggcgctgggcgtggtggtcactgccctcactcaggcggtactgggcgggattggccttgctgtctccggcgtgccctacgccgctctgctgaccgtggtgatgatctttacctgtctggttcagctcggccctttactggttttggtgccgtcgattatctggctttactggagcggggacaccacctggggcaccgtgctgctggtgtggagctgcgtagtcggcaccatggacaacgttattcgtccggtgctcatccgcatgggcgccgacctgccaatgatccttatcctcaccggcgtcattggcggcctgatcgccttcggcatgatcggcctgtttatcggtccggtgctgctcgccgtctcctggcgactgtatgacgcctgggtgcatgaggtgccgccgccgccgaaagaccctgacgtcgtccttgaagagctcagtgagctggaggccggtcgcaagtaatgcctggcaggcggggagacccgcctgtttctttgcccgcatattgttaagcaaaatttattgatcgccggcaatgcgctggccccgcgtgcccttcacctcgctttcctcccccggtccttcacaacaatttaactattgagaggaatctgatcgacggcaaaggccccgctgcctactattagctcacggttataaatcaacaccttgatttataagcatggaaatcccctgagtgaaacaacgaattgctgtgtgtagtctttgcccatctcccacgatgggcttttttttgccctgcgcatcacgacaccagatagcctgacaccggtaaaaaaaatccccggcatcgctgccggggatcggtcctgtcagggcgaacttattttttcagttccgccagacctaaccaggtttgtaccacggtatccgggttcagggacaagctatcaatcccctcttccatcagccaggcggcgaaatcctcatggtcagacggcccctggccgcagatgccgacgtatttaccctgtttcttcgccgcgcggatggccatcgacagcagggctttcaccgcgtcattgcgttcatcaaacagctcagaaaccacaccggaatcgcggtccagaccgagcgccagttgggtcatgtcgttcgaaccgatggagaagccgtcgaagtactcgaggaactgctccgccagcaaggcgttcgacgggatctcgcacatcataatgatcttcagcccgttctcgccgcgcttcagcccctgacgctccagctcttcgaccaccgctttcgcctgggcgacggtacggacgaacgggaccatcacttcaacgttggtcagtcccatgtcgttacgcacgcgcttcatcgcttcgcattcaagggcgaaacagtcgcggaagctttcggaaacgtagcgtccggcgccgcggaagccgagcatcgggttctcttcttccggctcatagcgctcgccgcccaccaggttggcgtattcgttcgatttgaagtccgacagacgcacgatcacccgtttcggatagaaagcggcgccgagggtggcgatcccttcggtcaggcggccaacgtagaactctctcggcgaatcgtagcctttcatcagctcgcggatttcgttctgcaggcccggctcctggtcgtcaaactccagcagcgcgcgcggatgaacgccaatcatgcggttgatgataaattccagccgcgccagaccgacgccttcgttcggcaggcaggcgaagtcgaacgcgcgatccgggttgccgacgttcatcatcaccttcagcggcagatccggcatgtcgccgacgctggagctcttgacgctgaagtcgagcagctcggcgtagacatagccggtgtcgccttcggcgcaggagacggtgacattctgattttcctgaatgcgatcggtagcatcgccgcagccgaccactgccgggatccccagctcacgggcgataatcgccgcgtgacaggtacgcccgccgcggttggtgacaatcgccgaggcttttttcatgatcggttcccagtccgggtcggtcatatcggtaaccagtacgtcgcctggctcaatgcgattcatctcgctgatatcgtggatcaccttgaccggaccggcgccaatgcggtggccgatggcgcgcccttcggcgatgatctgcccctgagcgtggagggtataacgctccatcacctggccgcgggaacgcacggtttcaggacgcgcctggacgataaacagcttaccggtgtggccatctttcgcccactcgatatccatcggacggccgtagtgcttctcgatctgcaccgcctgcttcgccagctcctgcacctcctcgttgcttaacgagaaaatatcgcgctgcgcctgcggcacatcttcgatacgcacctgtttaccgtgctcctgggtcggcgcgtaaaccatacggatctttttcgaccccatggtgcggcgcacgatcgccggacggccagcggccagcgtcggtttgtggacgtagaattcgtccgggttcaccgcgccctgcaccaccatctcgcccaaaccccacgccgaggtgataaacaccacctggtcaaagccggattcggtatcgatggagaacatgacgccggaggaggccagatcggagcggaccatcctctgcaccccggcggagagcgccacgccgcggtgatcgtaaccctgatgcacgcggtaggagattgcgcgatcgttaaacagcgaagcaaacacgtgcttcacggcaacgagcacggcgtcaaagccctgcacgttgaggaatgtctcttgctgcccggcgaaggaggcgtccggcatatcttccgcggtggcggaagagcgcacggcgaatgaggcctcggcgtcatcggcggacagcaggtcataagcatcgcgaatcgcgttttccagttcgctctggaagggggtatcgatgatccactgtcggatctgcgcgcccgctttcgctaatgcggaaacgtcgtcaatgtcggtttcatccagcagcgcatagatgcgctggttaacaccgctttggtccaggaactgattgaaagcatcagcggtggtggcaaacccgttaggtacggaaacacccataccggacagattcgtaatcatttcaccaagggaggcatttttgcccccaactctgtctacatcattcatgccgagttggttataccaaagcaccagcggtgacgagccattgttggacatcgagacaatccttttgtgatttaataccagtgaaaaaaatttcacgatcgactgcaggattatcctgacatatttatgaagctgaaaaaaacggtgaatcgttcaagcaaattattttttcatttttcggactgttcccccgatattgctaacttgatgatttttaggaattctgatggaaaacgctggaaataacggcgacaaaaagaaaatgaaccacccttttcataaaaaacaaaaatagcgtttcaattttaacaagagacaaatcaaacagggatatgcttaaatttaatatccgctttcaggcaattaaactcattataccggatggtcaaaatggaaagtgctgtagatcgccacgtattttatatttctgacggtaccgccattacggcggaggtgctggggcatgccgtgatgtcgcaattcccggtcgccatcagcagcgtaaccctgccgtttgtggaaaatatcagccgcgcgcgggcggtaaaggagcagatcgacgccatttatcagcaaacgggtattcgcccgctggtgttctactccatcgtcatcccggaaatacgcgacattattctgcaaagtgaaggcttttgtcaggatatcgtacaggcgctggtggccccgctgcagcaggagctcaacctcgacccgacgccggtggcccaccgcacccacggcctcaaccccggcaacctgattaaatacgatgcgcgtatcgccgccatcgattataccctcgcccatgacgatggcatctcgctgcgcaaccttgaccaggcgcaggtgatcctcctcggcgtctcgcgctgcggcaaaacacccaccagtctgtatctcgccatgcagtacggtattcgcgccgccaactatccgtttatcgccgacgatatggacaatctggtgctgccggcctcgctgaaacccctgcagcataagatgttcggcctgaccatcaatccggagcgtctggcggcgatccgcgaggagcgccgggagaacagccgctacgcctcgctgcgccagtgtcggatggaagtgaccgaagtggaggccctgtatcgcaagaataaaatcccctgcctgaacagcaccaactattccgttgaggaaatagcgacaaaaatcatggacatcatggggctgaatcgcagaatgtactaacacactagtacattattaaaaatttgtttatgctatcacccgtggcctatacaggatcatgccctgctcttgcaataagcagggattggtttatcgtgatgcgcatcacttcccggcattttcgccgcggaagaaacagatttttgagaccccaatgaataaaacagacgaattgcgtaccgcgcgcattgagagcctggtaacgcccgcggagctggcccagcgccatcccgtgacggccgacgtggctgcccacgtctcggcctcccgccgccgaattgaaaaaatcctcaacggcgaagaccgccgactgctggtgattatcggcccctgctccattcacgacaccgacgcggcgctggagtatgcccgccgcctgcagaccatgcgcgagcgctatcagccgcagctggagatcgtgatgcgcacctactttgaaaaaccgcgtaccgtggtgggctggaaaggcttaatctccgatccggacctcaacggcagctaccgggtcaaccacggaattgagctggcgcggcgcctgctgctgcaggttaatgagctgggggtaccgacggccaccgagtttctcgatatggtgaccggtcagtttatcgccgatctcatcagctggggggccatcggggcgcgcaccactgaaagccagatccaccgtgaaatggcctcagcgctctcctgcccggttggatttaaaaacggcaccgacggcaatacgcgcatcgcggtggacgccatccgcgcctcccgcgccagccatatgttcctctctccggacaagcaggggcagatgacgatttaccagaccagcggcaacccgtacgggcacatcattatgcgcggcggcaaacggccaaactatcacgccgaggatatcgccgccgccggcgaggcgctgcgtgaattcgatctgccggaacagctggtcgttgatttcagccatggcaactgccagaagcagcaccgccgtcagctggaggtgtgcgccgatatctgtcagcaaattcgcgcgggctccaccgccatcgccgggattatggccgaaagcttcctgcaggaaggcactcagaaagtggtccccggccagccgttgacctggggccagtcgatcaccgacccctgcctgagctgggaagacagcgaaagattattgagcgagctggctgcggccaccgccacccgcctgtaaccgctccgcccgccgcgcctgcggcgggcaattctcttcgctgactcccctaccaaatccggtaacacgataaataacgcttgccgtcaaaaacaacattattgataatgattatcattgttgccttgatttttattctgagagctatgacgcgtatggataacactgccacagctgaaaaaccaaaagacaatgccccttatcccgtggcgacggacagagagatcagcagtcgggttctgttaggcagcgaaggacgagtagtgattgagcatggcggccagcgctatctgctgcgccagacccacgccgggaagttaattctgaccaagtaagcgccccgctgaacgcggggcgaggcaagttagctcgagcagctgacttccagacgtttcccccagtccggcgggcggcggacgtagtcgtcctcgcgatcggtaaaggggtctgccagcgcggcatgcaggcgctccagctcgtccatatcgcccgcctcagcctgctcgatcgcccgctgcgccagccagttacgtaacaccagcgccggattcacgccctgcatcctctgctggcgctgcgcgtcgtccacctgttcatcacgcagccgcgcacgatacccggcaaaccagctgtcaaaggccgcgcggtcgataaactcatcgcgcagcggcgatgcggcgctgagctgttcgctgtggctcagcaggcggaacgtccgggtatagtcgctcttctcgcggatcatcagggcaaacagcccgtccagcaggtcgttatcccctttctgctggctgaacaggccgagtttatcgcgcatccgctggccataagcggtcagcaaggcgtgctgatactcatccagcgccgcgtttaacgcttcagcgctgataaacggcgacagcgattgggcgagacgctgcagattccacagccccaccgccggctggttttcaaaactgtagcgcccctgataatcggagtggttgcagatgaagtccggttggaaatcgtcaaggaagccatacgggccgtagtcgatggtcagaccgagaatcgacatgttgtcggtattcatcaccccatgggcaaagcccacggtttgccagctggcgatagtctgcgcggtacgcatgacaatgtcacggaaccataacaggtacttatccgcctcatcctgcagctgcggccagtggtggcgaataacatagtcggccagttgctggaccttctgcggctcacggcgatagtaaaaatgttcgaaatggccgaagcgcacatggctctcggccacccgcatcagcatcgcgccgggctccacgcgctcgcggtagaccggggtatcgctggtcaccatcgccagggcgcgcgtcgtcgggatccccagagcgtgcatcgcctccgacgccagactttcccggatcgtcgagcgcagcacggcgcggccgtcccccatccgcgaataaggagtcaggccggcgcctttcagatgccagtcgtaacggcggccatccgccagctgctgctcgccgagcaggatcccgcgtccgtcgcccagctggccggcccaggcgccaaactgatggccgctatatacctgcgccagcggcgacatgcccggaagcagcgcttcgccgccccagacaccggccccgctttcaggcgcaaacagggcgtcgggcacccccagctgttgcgccagcggggcgttgcgccagatgagtcgggcgttatccaacggcgttggtgacagggaagtgtaaaagtccggcagttcatcccgccagtgggtggtaaaagaaagggtcatggttcctcctctctccagtgtagtgcctggaacagcggattaacacgggcggagtgcagggttatcggcataaaaaagggaagcgttcgcttccctcttgcttctgaatgacgtcagattcgccgcgcctgccagaactttttgttccagtagacgttgtccagcgaggaacgggtgacgccctggctggtggaggcgtgaataaattggttgtcggtatcgtagatgccaacgtgcaggccgctctcccctgagccggttttgaagaacaccagatcgccgggcagcagatcgcgcttatcgatgcgggtgccgatttccgcctgctcgcgggtttcacgcggcagctggagggcaaatttatcgcgaaacgtgcgcaccacgaagccggagcagtcaacgccgcgcggcgtcatgccgccgtagcgatacggcgcgccgcgccagctgcgcagctgctcgttcagattcgccaccaccgtaatggagtctgccagccgaggattcggcggcggtgcccgatggctgctgcagccggctaaaattaacgccgccgccaacatgaaccagaagcgcatttcagatgatccctctgtccctagtctctttatcgcaataatttagcttgtttatcaataaagtgacaagataactgcgtgctactgtgacgcgatgagcataatatgaccggccacctcaacgcgctggaacgggatcgcataggcagcggttaaattttcctcattcagcacctcggcggtctccccgcaggcgatggcttccccctggcagagcagccagctctgaccggcgtggcgcagggtatggttgagatcgtggctgctcatcaccaccgcaatccccgcagcgctcagctcgtgtaacagccgatccagcgccgcctgctgggccacatccagactgttcatcggctcatccagcagcagcagctgacccgcggaattactcaagggatcgatctgcaggatcactgccgccagccgcacgcgctgccactcgccgcccgacagctgattgaccggacggcccagcttattgtccagaccaagcctggccgcgatatcgctcagacgggcgctatcaccctgctgctgcatatgcagcgccaggtagtgccataccggcatggcgaacggcggggtctggtgttgacacagatatccgcgacggcgcgccagctccctcgccggccactcgtcaagcagccggccgttaaaatgaaccgtgccggggccgtcggacagccccgccatgcgggtcagcagcgtgctcttccctgcgccgttcggccccaccagatggacaatctccccggcgcgaaaggccgcagaaaacggggccaggcgccccgccgcttctacatcctgtagctgcatcagaaacgacattattgcgccagcgctcctttaatcgccgccaccagctgcggatcgtccggcgtcatatccggagagaagcgctgaatgacgttgccctggcgatcgacgaggaatttttcgaagttccacagaatgtcgtccacatacagcggtgcccggcctttgctggccatccgctcataaaaaccgctgccttccggggccaccgctttcggcgcggcggcaatcagtttttgatagagcggcgcgcgatgttcaccgttgacgtcaattttgctaaacagcgggaaggtgacgccgtaggtagtgctgcagaaggtcttaatctcctcttcactgcccggctcctggccgaggaactggttgcaggggaaccccagcacgctgaagccctcggcggcaaactgcttttgtagatcctcgagttgctcatactgcggcgtcaggccgcatttcgaggctacattgacgatcagcagcaccttgccggcaaaggatgccagggtggttttctcgccatcaatggtcgtcacttcggtattcagaatgtcatgttgcatagcctgtcctcaatggataaaccggtttccggtgaaggtgatccctttctactgtagcggattcagcgcccgccattctactgccattccccccgagttgtcgcatgatgtaacagcgcttcgctggccgccggcaacatgaaatcctctcaattgggccgtcgaccatttccgtgtacagtgttccatgaatgtaatatggtttcgttaattgttaatttaagagagttttagtgatgaagaagttgtttagcctggcgttaatcgccacctctgtcgccctgctgagcgcctgctccccggatgaagataataaagtaaaagtcgctatcaataccgggccggacgaagccatctggaaagtggtggagcaggtggcgaaggataaataccacctcgacgtcgaagtggtctccttcaatgattatgtgctgcccaacgaagcgctgaacaacaaagatgtcgatgccaacgccttccagaccctgccgtaccttgaggcgcagtcgaaagaacgcggctataaatttgcggtggtcggtaaaacctttgtcttccctatcgccgcctattctcaccggatcaaaaatatcagcgaactgcccgaaggggcgacggtgaccatctctaatgaaaccaccaccctgggccgcagcctgctgctgcttcaggcgcaggggttactcaagctgaaaccgggcgtcggctatttacccaccacgctggatatcatcgacaatccgaaacagctgaaaattgttgaagtggataccccgcagctgacccgtacccttgacgatccgaacgtcagcctgtcaatcattaacaccaacttctccgcccaggcgggcctgtcggccgcccgcgacggtctgtttatggaggggccggattccccatacgtgaatgcgatagtcgcccgcgaggataataaggacagcaagaaaattcaggaattaaaagccgccttccagaccagcgaagtcgcggaaaaagcgaaggaagtctacaaaggcgacgcgatcaaaggctggtaagcctgaaccggcgccgtccctgccgacggcgccgcgctatccccgcccccgcgaacgcagcagcaaccagataaagaccggcgcgcccagggtcgccgtcaccacgccaatcggcagctctgcggcggaaagcgccagccgggcaatgatatccgcccccagcaaggcgcttgccccggccagcatacaggccgggagcaacacccggtgatcgctcaagccgcatagccgcagaatatgcgggatcaccagaccgataaagccaatcgcccccgccagcgccacgctaacgccgaccatccagccggtcgccaccaccagtaatttgcgccacagccacagcggcagcccaagctgacgagcggagacttcgcccagcgccagtaaattcaggggttgcgactgcagacagacccagcagagcaccggcaggagggctatcatcagccacagctgttgccagtcgacgccgccaaacccgcccatcatccagtacattagctgacgcaggtcaaaagaggtggagaagtagactgcccaggtcatcagggcgctgcagatgatccccagcgccacccccgccagcagcagacggctggtagacagatggcggcgggcgaaacgcagcagaataaaagtgatcagcagcgcgccaaagatggcacacaggccgagcgcccagccgggcaagactcctttgcccagcaggacggcggcaatcagcccgacgcccgcgccgttggagacccccagcagccccggctccgccagcggattttcaaacaacgcctgcataatcgccccggagagcgccagcgccgcccccaccagcagcaccgccagggttcgcggcaggcggatctgccagataaacagctgacctttggcgctgagccactcgccgggcgggatccattgctcccccgcgcacaggctgatcagcagggtgaccagcagcaacagcgttaatccgaagagccaacgccggctgcggcgctgttgaagatgggcgagagtcagcatagattccattacgcagtgggaacaagaggctgattttacggtggctgtcgcggtgagaaaaggaaaacctcacgaccaaacgtcgacgcggaggaggctcccccgcgtcgaccatcccgctttacaccagaatctgaaacagcagcgcaaagagaatgatgttcgccaccacgattgcccagccgttatagagcatatatttcagatgagtagactgcgccagccccatctggccgaacatatctgatgagggaaacggcccgaaccagtccacctgggatgaggccagcagcacggcggtggtcccctggggcggcacgccggcggccatcagcatcgggccaaagattttatgagtaaaggtcatctgggccaccgccgcaccgggcacatggccgataatattgaacgcgaagatgctaaagcacagccaggccggggagatcccctccagcagcggttgggtatactccagcagcccctgataggcgtgcaggccatccatcagctcaaggatcgggttgtacagccagtagagaataaacatccacaccagacggccgcagccgtgatacagggcctgaaggatctgcgtcggtcgcaggccgcctaccaggccggtcatcagggccaccagcaacatcacgattatcgcgaagctgaagccggctttaatcaccacgccaacgatcgccatcacgatgatggtcgccgcgaaggccagcgcgcttaatttacgccgacgctgctgcgcggcgctgagatcctcttgcggcttttccgcgagatcgacgtcatagcgcagtttgccttcggtcatcttctggatccgtcccgccattacccagccggccagcagcgtgaccgcgctcatcggcagaccaacgtacagcagatagtccggatagctcaacccaccgaggctgaggatcgtcacggtgctgggggtgaaaggcccggtaaacagcccaacggaaccggcggtcatcatcagcgcggcgaccgttggcggcgtcaagcgtaccgctgccgccaccggaatgattactgccacgataatggcattgccaccggccatagtgcccagcgaaccgcaaattaaaatcgatgacgccacaatgccgaatttcacccgcgtctgactcgacaacccgatgcgatggacgacaaattttaccagctcaaccgctgcgccggtgcgggtggccacttcccccacgccggcgccgagcataatgataagcccaacggtggcaataaatgacccggtggatttcgccagcatcgtgcccatttccggcaggccggtcgaggtcattatcatggcgataataatcgaggagatgaccgccagcacaatatcaacgccgatcagcgataatatcgctagcgccaccagcggcgtaaatcccagcaggccaagctcactgcctggtcgaccgtggcaccacagcgcgatcaacacgaacagcagcaataacagaccaataataacgtttttccgcgtgatatttcgtctgacaggcgcattgcctgtgagcgttgagtcactcataacactccttaatgccaatcaatccgaccatgatggtcagatggtgtatgggggcctgctcagaaaatatcctccctctttttcattattgattggccgcggcctgagggtttgtttgggtacaaaggaaacgattctgagagcgtaatatgccgccattgggcggggtctacagcacaagatgtaaccaatgcgctgattggtgattaaatctatgttaacttagtgttagtagaaaatgactttttatcggtaggctataaccctgagttaactgttcatgaaactgcgtcatctggaaatcttctatgccgtcatgacctgcggctctttatcgcgggcggcggaagcgctcaatatctcccagcccgcggccagcaaagcgttaaaaagcgccgaaatgaagctgggttttaccctgtttcagcgggtgcgcggcaagctactgccgaccagcgaggcgatcacacttttcgaaaaagcgcagagcatttatcaggacctggacaacctgcgcctgctggccgacaacctggctcgcgatccgcgcgccaagatcactttaggctgtctgccaagcctggggttaagcctggtgccggagctggtgaccgacttttatcagcaaaacagcaacctggtgatgacgctcactaccgagcacaccgagacgctggtcaaaaaactggatttgcgcgagatagatttggcgctgacgctacagccggtgcagcagggggagatcctgaccaccctgattgccgaagtaccgctggtgtacatcgaccgtcattatcgtcagggggcggtggagatcgatcagatcgaccagcagcgctggatctcgccgggaccgcactcgctctctgccgccatcgccacccgtcgcgacttttccaccacccggctaaacgtccagacctactatatggccaccgagttcgtgaagcgcggcatgggctgcagcatcactgatatcttctccgcccagcacaatctggccccggagatgatccatcccattacgccgccgatggcgattaacctctgtctgttacgccgggccgacgtttccctgagcccgatggcgcaaaagttcgtcgattttctctgccagcgtctgcgccagcagctcaaggagattaacctgcggttataccctgaccataaaaagtcaattgcgccgctggggtaaatgctttgacataacccgataaatttatcagcggtggatatatcgggttatgaacaaacgcattgtcattatcggcggcggcgtggtcggtctggccacggcatgggaactgatcaagcgcggccatcaggtgcaattactggagcgcaatgccgaaccgggcagcgccaccagttttgccaacggcggacaattaagttaccgctacgtcgccccccttgccgacagcggcgttcccctgcagggaatgaaatggatgggcaaagccgattcgccgctgaatatgcgtctcaggatgtctctccagcagtggcgctggctgctgcagtttctgcgcgcctgtaataaccagaccaataaaatgaatggcgaccatattttacgcctgtcgctgctcagccgtcaggtcatgcaggcgtggcgggatgaggataatcttgccgatttccactggcggcgcagcggaaaattaattatccatcgtcgcgaatatgattttaataaagcagcaaaagggattgatcctcagtatcagcaggcgctgaatgctgaagcctgcctgcagctggagccggcgctcaaacatattagtccttctctgcagggcggaatctattcgccaggcgatgaaacggcagattgtcatcagttctgccttgccctgctcgacaagctcaatgccagcagcgactttagcctgctgacccagtgtgaggtgcggcgactccataagcgcgggggacgcatcagcagcctggagaccagtcaggggaccctcaccggcgatgagtatgtcgtcgccgccggtaacggcagtggttctctgcttgggcatctgggggttcgcgtgccgctgtgcgccctgaaggggtacagcctgaccctgccctatcctgaaaaagcaggtattgcccctgacatcagcgtcaccgactacgggcacaaaatcgtttatgcccgccttggccaacagctgcgtatcgcggcgatggtggacatcggctacgacggcgacgaactgcgcgaaagccgcattcaggcgctgaaaaacatcgtcgcccgcagctttcctgaactggaggggctggacgaggccgaagtctggaccggcatgcgcccgtcaacgccagccggcccgccgatgctggggcgcgccggctaccccaacctgtggatgaacctcggccagggtagcctcggctttactctcgccgccggcagcgcggtggtgctgggcgcgttaatcgacaatcagatgccagacatttctttagaaggtctcacatggaaacaaaccgcatgacaattattcgtaataatccacaacctcgtcttgccgccagcgttgcgtatggcgatctgctgttcctctccgggcagacgccaaaaagcaatgaagacgatatcgttttacaaacccgtgaagtactggagaagatcgacgcgctgctggccgcagccgggagcgataagcagcacattctctccgcgcagatctggttgaaaaatatcgagcgtgactttgccgcattcaatgaggtgtgggtgcaatggatgccggaaggctatagcccggcgcgagcggccgtgcaggcggagatggcgcgaccagaaatcctggtggagatcatgctcaccgccgtcaaagcgtaaagattgacagaaaagaaaaaggccgcaatgcggcctttttaattagttcagattatttgtctttcggcgacgcgttttcgacacggcttttcagcttctgaccgggtctgaaggtcaccacgcgccgggctgtaatgggaatatcctcccccgtcttcgggttacgtcccgggcgttggtttttatcccgcaaatcgaagttgccgaacccggagagtttgacctgttctccgttttccagagcacgacggagctcttcgaaaaacaactcgaccagttctttggcatcccgcttgctaagcccaagcttatcaaacagatattctgacatttcagcttttgtaagcgccataggttcaatccctcaatgatgcctggaatcgctcttttaatgcctctacacatctggcaacggtagcggcaatctcctcttcttcgagtgtacggctggtatcctgcaggatcaggctaatcgcaaggctcttatacccttccgccacacccttaccacggtacacgtcaaataagtttacgccaactacctgatttacgccaactttcttacattcggctaaaacatcggcggcagccacgttttccgcgaccagcaccgcgatgtcgcgacggttcgccgggaagcgggaaatatcgcgcgcctgaggcaccacgcggtctgcgagcttgttccactccagttcgaacaccagagtgcgaccgttcagatccagtttacgttccagctcaggatgaacaaccccaatgaaaccaatgcgttcacctttaagataaatcgctgcggattgtcccggatgcagcgcggtggtcgcttcagcacggaattcgatatccgctaattttccggttaaatccagaacggcttccagatcgcctttcagatcatagaaatcgaccgtctctttcgccagtgtccagtgctcttcgtagcggttgccgcagatcgccccggccagcatcacatcctgacgaatgcccagcggcgcattggtgtccggcacaaagcgcaggccgctctcaaagatgcgcacccggctctgctgacggttctggttgtagaccacggtgcccagcaggccggtccacagcgacaggcgcatcgccgacatttcgctggagatcgggcttggcaggatcagcgcctcttccccggcgtggatcagctgctggactttcgggtcgacgaagctgtaggtgagcacttcctgatagcctttgtcgttcagcagcgttttcacgcgcttcagcgacaggtccgcttcgcggtgggttcccatgatcagacccgcctgcaccggctcgtcaggaatgttgttgtagccgtaaacgcgagccacttcttcaaccagatcttcttcgatctccatgtcgaaacgccagctcggcgcaaccgcctgccattcgccctcgccaaccgtcacttcgcagccgaggcgctgcagaatgtcggtgacctgcgcgtcagcgatatggtggccaatcaggcgatccagcttgctgcgacgcagcgtaatggtggcgcgtgttggtagattctctttgctggtaacgtcaatgaccgggccggcttcaccgccgcagaggtcgatcagcagacgggttgcacgctccagcgctttatactgcagggccggatcgacgccgcgttcatagcggtgagaggcatcggtgtgcaggccatgacggcgcgcgcggccggtaatggacagcgggctgaagaacgcgcattccagcagcacgttctgggtttcgtcgttaacgccggagtgttccccgccgaagatcccccccatcgccagcgctttgttatggtctgcaatgaccagcgtatcgctgtcgagctttgcttcagagccatcgagcaggaccagggtttccccttctttcgccatgcgcaccacgatcccgccttcaatacggtcgcggtcaaaggcgtgcatcggctggcccagctcaagcagcacatagttggtcacgtcaaccaccgcgtcgatggagcggatcccgcagcggcgcagcttctctttcatccacagcggcgtcggcgctttgacgttgatacctttcaccacgcgccccagatagcgcgggcaagcctgcggcgcgtcaacctgaatcggcagcacgtcgtcaatcgtcgcggcaaccggcgtgatttccggcgcgttcagcggcgctttgttcaggacagcgacatcgcgcgccacgccaatgatgcccaggcagtcggcgcggtttggcgtgacgctgatttcgatggtgttatcgtcaagcttgaggtattcgcgaatatcggtgccgatgggcgcatctgccggcagctcgatgataccgctatggtcgtcggaaatacccagctcggagaaggagcacagcatcccctcagacggctcgccgcgcagcttcgcggccttgattttgaaatcgcccggcagcacggcgccgatggtggctaccgcgacctttagcccctgacggcagtttggcgcgccgcagacgatgtccagcaggcgttcgccgccgacgttgactttggtgacgcgcagtttgtcggcgttcgggtgctgaccgcactccaccacttccccgactacgacgccgttgaagctgccggcgaccggctcaacgccatctacttcgaggcccgccatggtgatctgatcggaaagcgcttcgctgtcgatcgccgggttaacccattcgcgtaaccacagttcactgaatttcattgttctgtcctgcccttatttaaactgtttgaggaaacgcagatcgttttcgaagaacgcgcgcagatcggtgacgccatagcgcagcatggtcagacgctccatgcccatgccgaaggcgaagccggagtagacttccggatcgatacccacgttacgcagcacgttcgggtgcaccatcccgcagcccagcacttccagccatttgccgtttttacccatcacgtcaacttccgcagacggttcggtgaacgggaagtaggacggacggaagcggacctgcagatcttcttcaaagaagttgttcaggaagtcgtgcagcgtccctttcaggttggtgaagctgatatttttatcaacgatcagaccttccatctgatggaacatcggggtgtgggtctgatcgtagtcgttacgatagacgcggcccggcgcgataatacggataggcggctgctggttttccatggtgcggatctgcacgccggaggtctgcgtacgcagcaggcgagtggcatcgaaccagaaagtgtcgtggtcagcgcgcgccggatggtgacccggaatattcagcgcatcgaagttgtggtaatcgtcttcgatttccgggcccgtcgccacggtaaagccgagctcaccgaagaaactttcaatacggtcgatggtgcgagtaaccggatgcaggccgccgttttcaatgcggcgacccggcagcgagacgtcaatggtctctgcggccagacgcgcattcagcgctgcgccttccagttcagctttacgcgcgttcagcgcctgctgcacctgctctttcgcctcgttgatgaccgcaccggctgccggacgctcttccggcggcagctcacgcagggtggtcatttgcagggtcagatgcccttttttacccaggtattccacgcggacgttgtccagcgcagcaacatctgatgcctcgttaatggctgccttggcactggcaaccagctctgcgagatgtgacatggttttcctcattatgtcggtgcagacaccggttatagtgaaattaatattccgaatccatatacgaaaaaagcctccacaggggaggctttctggcgctgttttccgtttcttctttcacgcgcaagccccctgagttcaggtgctaaagtaaaaaaagaagcggaaaatagcagcattcatgcttgcattaccttgtctggtaagaaacgtcagagctgtattgaaaagcctgcgccgataaaagtcaatgtattgatggtgttgaaacgaaaagagggagacaagctccctctttcaactggcttatgccagagctgctttcgctttttcgaccagagcggtgaacgctactttgtcgaatacagcgatgtcagccaggatcttacggtcgatttcaacagaggcttttttcaggccattgatgaatttgctgtaagaaataccgttctgacgtgctgctgcgttgatacgtgcaatccacagttgacggaactgacgtttacgttgacgacggtcacggtaagcgtactgaccagctttgataacagcctggaaggcaacgcggtatacgcgagaacgcgcaccgtagtagcctttagcttgtttcaaaattttcttgtgacgtgcacgtgcaattacaccacgttttacgcgagccatgtgtgctctcctgtatctattctaagttaaaaaagttaaacgttaacgacttatgcgtacggcaggcacgcgataaccaggcccagatcgcctttggaaaccatggctttcggacgcaggtgacgtttacgcttggtagcttttttagtcagaatgtgacgcaggttagcgtgcttgtgcttaaaaccacctttaccggtttttttgaagcgcttagcagcaccgcgtacggtcttaatttttggcattttaataacttccacttcgcattgttaataaacgaaacaaaggcgaacaaaaccagtgagccgaagcccaccggaaatgtttcttgatggccttactgtttcttcttaggagcgagcaccatgatcatctggcggccttcgatcttcgttgggaaggattcgactactgccagttcaaccagatcgtctttcacgcggttaagcacttccataccgatctgctggtgggccatctcacgaccgcggaaacgcagcgtgatcttggccttatcgccatcttcgagaaagcgaatcaggctgcggagttttacctgatagtcaccttcatcagtaccagggcggaatttaatttccttaacctggataactttctgcttcttcttctgttccttagaagacttactcttttcataaaggaacttgccgtagtccatgatacgacaaactggcggctcggcgttagggctgatttcaactaaatctactccagcctcttcagccttttcgatagcttctctcagactcacaattcccagctgctcaccttccagacctgttaagcgaacttcctgggcgcgaatctcgccattaatacgattcggacgtgccgtttgaactcgttttccgcctttaataccttattcctccagttgttgaagactgcggctgcgaatctcttgttgcagcttctcgatcacttcatttacgtccatgctgccgaggtctttcccgcgacgggtgcgcacggccactttgccggcttcgacttctttgtcgccacagaccaacatatacgggacacgacgtaaagtgtgctcgcggattttaaagccaatcttctcatttctcaagtctgcttttacacgaatgcccgcattttgtagtttacgcgtcaattcgttaacgtattcagcctgagaatcggtaatattcatgaccactacctgcactggtgcaatccaggttgggaagaagcctgcgaactcttcggtcaggatgccaatgaagcgctccagagaaccgagaatcgcacggtgaatcatgaccggcacctgacgctcgttgttttcgcccacataggaggcgcttaaacgctgcggcagagagaagtccagctgtacggtaccgcactgccatgcacgatcgaggcagtcatacagggtaaattcaattttcgggccgtagaacgccccttcacccagttgatattcaaatgggatgttattttcttccagcgccaccgccagatccgcttccgcgcgatcccaggtctcgtcgctaccgatacgtttttccgggcgagtcgacagtttgacgacgatcttctcgaagccaaaggtgctatacatatcgtagaccatacgaatacaggcgttcacttcatcgcgaacctgatcttcagtacagaagatatgcgcatcatcctgggtaaagccgcgaacgcgcatcagaccatgcagcgcgccagacggttcgttacggtggcagctaccgaattccgccatacgcagcggcaggtcgcggtaggatttcagcccctggttgaagatctgcacgtgacccgggcagttcatcggcttgatacagtattcacggttctcagaagaggtggtgaacatcgcatctttgtagttgtcccagtggccggttttttcccacagcacacggtccatcatgaacggaccttttacttcctgatactggtactctttcagtttagaacgaacaaacgtttccagttcacggaagatggtccagccgtcattgtgccagaacaccatccccggcgcctcttcctgcatgtgatacaggtcgagctgcttaccgattttacggtggtcacgcttggcggcttcttccagacgctgcaggtaggcattcagcgcttttttatctgcccacgcggtgccgtagatacgctgcaacattttattgttgctgtcgccgcgccagtaggctccggcggttttcatcagcttaaagtgatggcagaagcgcatgttcggtacgtgcggaccgcggcacatatcgatatattcttcatgatgatacaggccaggcttgtcatcatgggcaatgttttcatcaagaatagaaactttatagctttcgccgcgtttcacgaaggtttcacgcgcttcatgccagctcactttcttcttgataacgtcgtagtttttctcggcgagctcatgcatacgtttttcgagcgcgtcgatatcttcctgggtcagggtgtggtcgaggtctacgtcatagtagaaaccattatcgacaaccggaccgatagccattttggtgttgggccacagctgtttgatggcatggcctaacaggtgcgcgcaggagtgacgaatgatctccagcccttcttcatctttcgcggtgatgatagagagagtggaatcggattcgatcgggtcacaggcgtctaccagttcaccgtttacccgcccggcaatggtggctttcgccaggcctggaccgatatccagcgcgacatccatcggactaactgcgtggtcaaaatggcgttggctgccatcaggaagcgtaattacaggcattttatgtccttatttgcagtggtgccccgcacgaaagagcacatacaaaactatataatcataattatcatcaggttaaggcgcagttcccgcttcactctgcgaaaataggagcacgaccggaacgatcgctcccccctgcagccgcctgctgataacaccggggagtagtttacacatcattggtacgtgattaaagccgcaacagcataaatgatggcggaatgcggagaaaacaagaggtccacggataaaaagcagaatataagcgatgtggcgcggtaatattggccaatggcgccggacgatattattcggatatgataaaagagacgtggagatattgcctgctgaatgtataccgcgggccattaaaccggtaccacttaacccggcttattagaccgctcgcgaaacgatagcctgcaatattaagaccactcgccggcaaccagcgtatgcacattaaaggcgtcgttcatggattttccggtggtaggggcgccgggcgcaatattcgaaccagcctcaacgtcagaggctttggcgatacctacctgggtatgatcctgatgacccgatggcggaacgggcgtggcggctgatgcgccaaaagaaagcacgcacagcgccagggctgcgatggtataacgattgtttttcatgatgttaattctcttattacggaaaacagaccgggcaatgtcgccctccggtcagtggttgttagtatagatccagatcacatatttgtccgtcgaatatttagctatttgtgtcaaatagaatgaatatttgtcaggcgctcgtgaataatggagaaaaaatggagggctatttcctttttacaaaaagtaaaacgaacggccagaaaaaataatatcactaattgctaaaaccaaaacgaacaggccggggaaaacccggcctgaaatattacatcttatacccgagggagagcgaggtccggcgatcggtatgctccggcgcggacgcaggcggctcagagttccaggtcacgttgtaggcgaccttcagggcgaaatgggcgttaatcgccacgtttaacgcgctctctgagttgaccgtggtgtcctcggcgccgaacaccgataccccttgcgaaaatttggcgttatcggtcatctgccaggcccaggtacccgaagcataacccagcggttgggtatcagtatccccgtcggtatattcgtcatagcgaacgccaggaccgaattcaaaccgcagactgtgcaccggcccgttgaggatctgacgaccatagcccgccgtcacaacatcgcgctgttgatagccgttgtagcggtcagttagccagctaccctgaccaaaaacatagttcatatcggtcaggttgtagcggctacgtccgccgactgcatatttttctgaggatcgctcatcattggacgacgtgttgctggcgttgccccacagcgaccaggcggtggtattaccataccaggtcagggtggaatccgccgtcatcgaagagctcttggtgttgccggactgcgccaggtagcctgcgttaaccaccccttcgaacggttttttggcagcggaagggtcatccctgacggtaaatacagaatcatcggccattgcgccaacagacgcaaaaagcccccccgccagcataaccgctgcgggtactgtctttaaaagcttcattataactctctaaaatacatttttttaggacagtacaaatgatgaacaggcataatctcgccggctcattgaatttagcgtccgtacaacataaaagagacctgagggtcccggaaactttcgcgaggatcgcggagtgcaggtcctaagaaaggtagcaaattataaaaaagcacgaataacatagcaatcacttactctttcgttttttgaataagacagctccggaaacaatctttatttcataatgaaaatagaggcatctttgcaaaactgtcaggaactggactttccctccccgagtcatcgtgccatgcttaaaataacgacagtcgccgtattaaggaggagaaggaatgaccaaaatttacacgctcacgctggccccctcgctggatagcgccacgcaaaccccacagatctacccggaaggcaaacttcgctgcagcgcgccggtatttgaacctggcggcggcgggatcaacgtggcccgcgccgtgacctttctcggcggcaaagccaccgccatttttccagtcggtggcgctaccggcgagcatcttgccgccctgctggccgatgagcaggtgccggttgagaccgtcgaaacccgcgactggacgcggcaaaacctgcacgtccacgtggccgccagcggcgaacagtatcgcttcgttatgcccggcgcggcactggcggacgatgaattccgccgtctggaagagaaggttctgactatcgaacccggctctctgctggtggtcagcggcagcctgccgccaggtattagcgtcgataatctgatgcagctggtgaaaaatgcgcaacagcagggactgcgctgcatcattgacagttccggcgatgcgctggccgccgcgctggacgtcggcaatattgagctggtaaaaccgaaccagaaagagcttagcgccctcgtgcagcgcgatctcagccaacccgatgacgtgcgccttgccgctcagtcgttgatccagtccggtaaagtgcgccgggtggtggtctccctgggtccgcagggggcattaggcgtggacgccagcggcagcgttcaggtagtgccgccaccgatgaaaagccagagcaccgtcggcgctggcgacagcatggtgggcgccatgaccttgcgtctggcggaaaacgccagccttgaagacatggtacgctttggcgtcgccgccggtagcgccgcgaccatcaaccagggcacccgcctctgctcgcgggccaatacgcaaaaaatctatgattatctctgcgggcgttgatcttccctgccccctccgcgccggcggaggggaatcacaatataagcaggatggtctatgctggaaaggccatcataacaacggggtgtagagatgagcaatgagattaccgcctgggtcgtcagcgtgaccttccatgaacaggcgctgacggagatcaatgaggtcagcaaccattttacccgtgccgggtttgtactgacgctcaatgatgaagagggcacgccccatgagctgggtaccaacaccttcggcctgctgagcggccagacggccgaggaagttaaggccctcagcgctggcctggcggaagcggcccttggccgcccggcggaaatcgctgtggccacattcgccgagtggttaaaagctcaataagtgcgtttagcgcaacggaaagcgtcagttgtgcgtcagttccaggtttacccggtagtaatgcgctaaccttatgatatggtggaaaacatggggagagacagcatgtggcaagcaatcagtactcttttacgcgattggcataccgaagacgctgaaatcgaactgaaaaccgagctgcccggtggagagatccattccgcctggcatttacgcttcggcgggaaagattacttcgtgaaatgcgacgaacgggaacttctgcctatcttcaccgccgagtccgatcagctggagctgctgtcgcgaagcaaaaccgttcgcgtaccgcaggtctttgccgtcggcagcgatcgcgactatagcttcgtggtcatggagtacctccctccccgtccgctggatgcgcacaatgcgtttctgcttggccagcagctagcccacctccatcagtggagcgatcagccgcagttcggtctggattttgataacgatctttccaccacgccgcagcccaacgcctggcagcgtcgctggtcggttttttttgccgagcagcgtatcggctggcagctggagctcgcggcggagaagggattgcactttggcgatatcgataccttagtcgatatggtacagcagcgactggccaaccatcagccgcagccttcgctgctgcacggggatctgtggtccggcaactgcgccttagggccggatggcccctatatattcgatcccgcctgctactggggcgaccgcgagtgcgatttagccatgctgccgatgcatccggaacagcccccgcaaatctatgacggctatcagtccgtttcgcctctgccgtcgggttttctcgatcgtcagccgatttatcagctttatactctgctgaacagagcgattttgtttggcggccagcacctggtaacggcccagcaggcgctggatgatgtattgatggagaaaatgcgttaaacaagcttcacggcggaccttgccggtccgccgcagcgttttatcagttaatctcgacgccgttcaggcggaatttgatggtcatcgttacgccggtacccggtcttccctgctcataacgccatctgcgcatcgcgcttttcacctcgcgttcgaacatattcgccggctgagcagagaggatctgcagattatcaatgcggccatcaggcgaaacgtcaaacttcacccgtaccgtcccttcaatgcgcagcgcctgagcgcgcgccggataggacggctgaacgcggctgatcgcccgcgggccgctcggagcagtaacggtgggtttagccgctgctgtcgaggtgcttggcgctgtacgcgccggcgccgtattgttgttttcaaacggcgaggccggacgcggctctgctgccggcttcacttcccgcttcggctgttcaacctttttctccggcttaggcttaggcttgggtttaggtttgggcttcggcttaggttccggtttatggatcaccaccggcgcctctttcggcggttcaggcactacctctggctccggctcaggttcgggttcaacaacgggctccacgacaggctgcgccgccggaggcggctcaagatcggccggcgccaccattgtgatctctatcggctgcgtcggagaaggctgttcaataacctgatgtaccgaggtataaagcagccccgccacaacggcaccgtggatagccacggacagcagcgttggccacggaaagcggcgaggtaaatcaagggtcattgcgctcatagtcgtttctgttgaaaaatgatgctccgattttaaatgcaaatagcaatcatattcaataaggcgtcttaacctgagtcaatttttgccgccatttgcagaaaaaagctgcgtcggcagtgctttccactccagagcgcatctttgcattgcagtccatcgctgtttaacttaacgtaattcgcctgattattgataaggagctttgccgtgctttacgttatctacgctgaagatatcgccgattctctggaaaagcggctgtcggttcgccccgcgcatctcgcgcgtttacaactcttacacgatgaaggccgactgcttaccgccgggccaatgccggccgttgacagtaacgaaccgggcgcagcaggattcagcggctcaacggtgattgccgagtttgaatcgctggaagcggcccaggcctgggccaatgacgatccgtatatcgccgccggggtttaccgccaggtctctgttaagccatacaaaaaggttttttgaaaataccctttcctttttctggctaaccacaaaaacacccaggtcatcagaatgaagggcgcattttggtacacgacattgaagtgtcgccctttttaacctcgcgaaagcgttgactgttatccgcctgagaagcctggaagatgagcacgcactttctcctgctaccccatcatcgaccatcgcctcgcttttttcggcaatggaaaatgctgacaaaacatcgacgccgcgcgtgatagtgaattactaataccttgtgtaaggctgttagggaggatcgcgttgttatttagcgcttgcatttaatgtcagcacatcctgatatagccctataaatctacagtgcaatagaatgaaaaaaataactgaaagatagttgcttaacgacagatatgaaagcccgaaaaaaatattattgggcatccactgcggatgccgcggaaccgaacgtagcccatcttgctatattcaggaccgtagccgcttgaaagcacgtggaaataacccccttgtagacaaaggattacctggcaggcataaagggatattaactacgctgccagcgttaagttgctgagcatcatttttaaagcctattaatttcgttgcgtaaacttcacgcagagtgatagtaggggcatcactgcttgattaaaaaatttgaaagggaataacaaatgttttcaataagccctgtatttttttgggctaacatttatgtacctgccgattttgaggattattgtgtgaataccctgaaaaaaaccgcattgctttctgtacttgccttatatattcctgtgtcgcaagccgcggctaaggaatacagtcttgatccacagcatacctcggttgtgatctcctggaaccatttcggcttctcaaaccctaccgcctatatctctgatgtttcagggaaactggcctttgataaagagaatccggagaaatcctcggtgaacgtcacgctgccagtgaaaaccattgacgctcacgtcaaggcgttaacggatgagtttttaggcaaagagtattttgatgttaaaacgtttcccgaagccactttccagagtaccaaagtggaaagcaaaggcgacaataaatatgatgtggaaggtaatttgacccttaaaggcatcaccaaaccggtggtcctgcatgccgtcctgaataagcaggatatgcacccaatggtgaaaaaagaggccattggatttgatgccaccggtgtgataaaacgttcagactttaagcttgataaatatgtgccggcggtaagtgataacgtcaccatcacgttatccacggaagcttatgcaaaataagtaaaagctggcgcaacgattgctttttattcaggatgcttattgcatggcctctctggataatataacaggctcagattattcatggtcaggatcggtcggttcatttagcttcaacgcgctggaccgcttaataacccccttgcctgtctgagtctgttttctcattccctcagctcccgcctggttaccgcagctggccggtcatatcattaagcatttaacagcgccatgcccttcctgagcggcaataaaccctgagcggcaataaatgctatctgacggttaattcctgtcgcgccgcaaacgacttggctctggatcttgtcgtccgtcattacaagccaggcgtagcatctctctttcactgaggcgggagctctgttttgtcgtcgcatcgcagcatgaaaaaccatcattgccctatggagatgtgcaacgggaatttagcgcagagagaaaaacgacaacggcaccgcgtacggtgccgtttgcctgctcgcttagctgtcagggaagataaacagcagggcatgacgctgccgtttcaccagccccttcctgatagcgaggatccgcatattgcggcgcgattgggcttccagccagcgcgctttacggcgattcacctgtctcagcatgcgccagcgccctacttccgttctactacgcttcattgcaacgactctacgagtgaaaacagcccccattataaacctctgccagcaactgactaccgctttcgctgcgtttttatttgccagaaaaatactgatgcgtaaactcatcacatatcgtcattcaaaaggattttacatctatgacaaccttttacacggtggtgaactggctggtcattctggggtactggctgttgatcgccggtgtaacattacgaattctaatgaaacgccgcgctgtcccgtccgccatggcatggttgctgatcatttatatcctgccgctggtggggattatcgcctatctctcctttggcgaactgcatctcggcaagcgtcgggccgagcgcgccagggcgatgtggccctccacggccaaatggctaaacgacctcaaagcctgcaaacatatcttcgcggaagataacagcccggtggccgaatccctgttcaagctgtgtgaacggcgtcagggcattggcggcgtaaaaggcaaccagctacagctgctgacggaatctgacgacgtgatgcaggccctgatccgcgatattcagctggcccgtcacaatatagagatggtcttttatatctggcagcccggcggcatggccgacagcgtcgctgaatcgctgatggccgccgctcgccgcggagttcactgtcggctaatgctcgactccgcgggcagcgtggcctttttccgcagcccatgggcggcgatgatgcgtaacgccggtattgaagtcgtcgaagctcttaaggttaacctgatgcgcgtgttcctgcgccggatggacctgcgtcagcatcgtaaaatggtgatgatcgataactatatcgcctacaccggcagcatgaatatggtcgatccgcgctactttaaacaggactcaggagtcggacagtggattgatctgatggcgcgaatggaaggcccggtggcgacctcgatgggcatcgtctactcctgcgactgggaaatagagactggcaagcgcattctgccgccgcccccggacgtcaatatcatgccgttcgaagaggccagcggacatactattcacacgatcgcctccggaccgggctttccggaagatctgattcatcaggctctcctcaccgccgcctatgcggcgaaagagcatctgatcatgaccaccccctacttcgtacccagcgacgacctgctgcatgcgatctgtaccgccgcccagcgcggcgttgacgtgagcattattttaccgcgcaagaacgattcgctgctggtaggctgggccagccgggccttcttcaccgagctgctggcggccggggtcaaaatctatcagtttgagggcggactgttgcataccaagagcgtgctggtcgatggcgagctaagtctggtggggaccgtcaacctggatatgcgcagcctgtggctcaacttcgagattaccctggtcatcgatgacgccggtttcggcagcgatctggcggcggttcaggatgattatatctcgcgctcgcgcctgctggatgcccgtctctggttaaaacgtccgctgtggcagcggatcgccgagcgactgttttacttcttcagcccgttgctgtaaaacgtgcccatcagataccgaatgagtagcaatcatggatatggatttaaacaaccgcctgaccgaagacgaaacgctcgagcaggcttacgatatcttcctcgaactggcggccgacaatctcgacccggcggacatcattctgtttaacctgcagtttgaggagcgcggcggcgccgaactgttcgacccttcggcagactgggaagagcatgtggattacgatctcaacccggatttcttcgccgaagtggtgattggtctggcggataccgacggcggggaaatcaatgatatcttcgcccgcgttctgctgtgccgcgagaaagatcataagctgtgccatattctgtggcgtgaataacctttaacatccagtaaaaagcctgccgcggttctcccggcaggctttttttacgtcgccagcttacttcggcaaggcatgaccgcaggcatggcagaaacgggcgttatcgtcatggtcgccctgctgacactgcggacacaggcgctgctgtcgtcgacgattcagggcgctggtcatatgcgtggtgataagtccggtcggtatggcaataatggagtagccgatcaggataagaatggaggccaggatgcgacccaacggcgtgtgcggcgtgatgtctccgtagccgacggtggtgatggtcacgatggcccaatagaccgaggcgttaagcgtggtaaagccgtattccggcccctcaatcagatacattaacgagccgaaaatcaccatcacaatggcgataaacgaataaaacaggatcagctgatggcgcgcgctgacaatcgctcgccagaacacgttgagcgaaggcataaagcgcagtagtttgagaatacgcagcgcgcggatcgcccgcattgcccgccaggcgaatacataattgaggctaatttccggccatagccacatcatatacagcggtaaaatcgtcgccaggtcaatcagcccccaaaagctgaaaatatagtggagcggattgggccaggtagcgatacgcagcaggtattccagggtaaagaccgcggtcaccagcagctccagccagacgaaaatatgccattcatctaatgtcaggtgatattgcgtgcccagtcccgactcgataaatatcaccagtacgctgagcagggcgaaaagtccgcacagcccttcaaagcggcggccggaacgtcggttctgatcgaaaagtaaatgataaagccgcagacgagcggcagaaagcatacccacttcgttaacctcgcaaaaaaaagggctgacctgcgtcagcccctgagattataacgggtctaccttaaggcaggaaaccgcatggcggaaactgccttccagcaccgggcgggttttggcgcactccggtccggcaagcggacagcgggtgcggaatacgcagcctgagggcggattaatcggcgagggtaattcgccttccagcagttggatagttttcgttttctcgagatcaggatcggggatcggcaccgccgacatcagcgctttggtatagggatgtagcggattatggtacacctcgtcgtaggtccccagctccaccgcatggcccagatacattaccagaacccgatcggagatatgcttaaccaccgccagatcgtgagcgataaatatcagcgatagccccatctcacgctgcagttgctgcagcaggttgacgacctgcgcctgaatcgacacgtcaagcgcggagaccggctcatcgcagataatcagctttggctcaaggatcagcgcccgcgcgatgccgatacgctgacactgaccgccggagaactcgtgcggatagcggttgatcaggttgggcagcaacccaactttcatcatcatcgctttgacgcgatcgcgcacttcctgacggggcatcttcggatgataggtacgcagcggttcggcgataatttctccgatggtcatgcgcgggttcagcgaggccagcggatcctggaagatcatctggatatcgctgcgcacgtcgcgccactcttcctgcttcatgcccagcagatctttacccagccaggccactttgccatcggtcgctttcaccagaccaataatggcgcgggcgaaggtcgatttgccgcagcccgactcccctaccacaccgagggtttcaccctcgtaaaggcgcagcgtcacgccatccaccgctttcagcgttttcgacggctgccagaaccactgcttgccatctttgatatcgaagtgcaccttcaggtcggcaatttcgagcaggacttttcgttgttcagttacggcgttcatagcagatcccccaccggtttaaagcaggcgcgcaggcggcctggcgcgaacgattccagcggcggcgcgctgctgcactgctccatggcatgcgggcaacgcggctggaatggacagccttttggcaatcgcagcaggttcggtgggttgccgggaatggtcaacaacgcatcgccttccgcatccagacgtggaaccgcattcaacagcccaatagagtatgggtgcgacggttgatagaagacatcgcgcgcctgaccgtactccatggtgcgcccggcgtacatcaccagcactttatcgcagatccctgccaccaccccaaggtcgtgggtgatcatgataatggccgtgttgaattcgcgtttaagctcattcaacagcgtcatgatctgcgcctgcacggtaacgtccagggcagtggtcggttcatccgcaatcagcagccggggccggcacagcagcgccatggcaatcatcacgcgctgacgcatgcccccggagaactcgtgcgggaacattttcatgcgcttacgcgcttccggcatttttaccgcgtcgagcatcttcaccgactcttcaaacgcttcggctttactcagccctttatgcagcatcaggacttccattaactgctcgcccacccgcatataggggttaagagaggtcatcggatcctggaaaatcattgagatttgttcagcgcgcagtttgttcagctcacgctcgggcaaattgaggatttgccgaccgttaaaggtggcggaacccccgatgcgaccgttggccgccagcagtcccatcagggcgaaggcggtttgcgatttaccggagccggattcgcccacaatgccgagcgtctcgcccgcctgcagggtgaagttcagatcattgacggcggtgacgtcgccatccggcgttttaaaggtgacgcgaagatctttcacgtccagcagtagcccgctgtggctctgcgcttgcggcgcttttgccgtttcaatcatggtcatggcagcgctccttagcggtctttcgggtcgagggcatcacgcagaccatcgccgataaagttgaaacagaacagggtcaccaccaggaaacccgccgggaacaacagtagccagggcgaaacttccattgagttggcgccatcgctgagcaatgccccccagctgctgagcggctcctgcgtccccagtcccaggaaactgaggaaggattcgaagaggatcatgctggggaccagcagcgaggcatacaccaccaccacccccagcacgttggggacgatatggcgcagcacgatgctcgccgtcgagaccccgccgacctgcgcggcttcgataaactctttgcgcttcaggcttagcgtctgcccgcgcacgatacgcgccatatcccgccaggacaccatgccgatggcgacaaagatcagcaggatattctgaccaaaaaaggtcaccagcaggatgacgaagaacataaacgggaaggagttgaggatctccagcagacgcatcatcaccgaatccactttgccgccgagataaccggagagcgaaccgtacagcgtgccgaggatcaccgccaccagcgccgccgccaccccgaccatcagcgaaatgcgcccgccgatcgctacgcgcaccagcagatcgcgcccggaggagtcggttccgaagtagtggccggaggccatagccggggcattggacatcatgccccagtcggtatcgaagtaggagaacgacgacaccatcggcgcgaaggtaacgaacagcgcaataagcaccagcataatcaggctggtcaccgcggcgcggttatgcataaagcgacgacgcgcatcctgccagaggctacgcccctccacttccagcttctcactgaagttttccagcgcctcgctatttttcttacttaacatcatggcgaactccggcttcagtagcgaatcttcggatcgataacggcgtacagcacgtcaacgatggcgttgaacaggatagtcagggcgccaacgaggatcgtcaggctgagcaccagcgagtagtcgcggttaagcgccccgttaacgaacagctggccgatccccggcaggccgtaaatggtttcaatgaccattgagccggtgatgatgcccacgaaagctggccccatataggagagcaccggcagcagcgccggcttcagcgcatggcgcagaataatgcgacgcatcggcagccccttcgcccgcgcggtgcggataaagttagagtgcagcacttcaatcatcgaaccgcgggtgatacgcgcgatgctggcgatataggccagggaaagcgccaccatcggcaggatcataaatttcagcgccccgccgttccagccgccgcccggcagccagtgcagggtaatggcaaagatcatcaccagcagcggcgcgaccacaaagctcggaataaccacgccggtcatggctacccccatcaccgcgtagtcccagcgggtattttgcttcagggcggctatcaccccggcggcaacgccgatcaccaccgccagtaaaaaggcggcgaagcccagtttcgctgaaaccgggaagctggcggccaccagatcgttgacggaataatctttgtatttaaaagagggaccaaaatcgccatgcgccagctgcttcagataattgaagtactgcgtcatgatagggtcgtttaaatggtattttgcttcaatattcgccatgacttccggcggtagcgtgcgttccccggtaaaaggacttcccggcgccagacgcatcatgaagaatgagatggtgataagaataaatagcgtcggaatcgcttccagacagcgacgtaagataaattttaacattgcccgtaccttctggcgtgtgcctttgcactgctctcaaataagacacgatggagcgagccgagacccgctccacgtattgccattaatgtttgataacgtagaggtctttggtatagacgttatccatcgggtctttaccggtatagccaccgacccacggtttcaccaggcgggcgttaacgtagtaatagaccggtacgatcgcgctgtctttgtccagctgctgctctgctttcgcataggccgccgtgcgctgcgcttcatcggatgcttttacggattcagccataatcttgtcgaacgccgggctcttatagtgcgcggtgttcattgaactgtcagagagcatggtgttcaggaaagaggttggctcgttatagtcggcgcaccagcccgcacgcgccacgtcataggtgccctgatgacgggtatcgaggaacgttttccactcctggttgaccagcttcacgtcaatgcccaggtttttacgccacagcgaggcggcggcaatcgccagcttcttgtgcaaatcagaggtgttatacagcaggttgaaggtcaacggtttatcagcgctatagccggcttcggccagcagtttcttcgcttcttcgttgcgtttttcctgcgaccaggtaaaccattccggctcgctcagcttcgcgccatcggtatacggtggggtgtagccgtaggccggcagatcgccctgtcctttcaccttattagcaataatatcgcgatccagacccagcttcagcgcggtacgcacgcgcacgtcggtgaacggggccttctggttgttgatttcgtaataataggtacacagataggggtcaacgtgcagctcgttggggatctcttttttcagcttctggaagagttcgatcggcagctggttataagtcatgtccagttcaccgctgcggtagcggttaacataggtcacttcggaagaggtcggcagccaggtaacggtgttaatgacggttttagcattatcccaatagtgcgggttacgctccatcacgatccgctcgttgaccacccagtctttcagagtatacgcgccgttggtaacgatattgccaggctgcgtccacttttcgccaaatttttcgatggccggtttgtagacgggagacatcgccgggttaaccagcagtttataaaaatagggtaccggttcgctgagggtgacttccagcgtgtggtcgtcaatggcttttacgcccagctcactcggcgctttcttgccgtcaatgatttcgtcgacgttaacgatatgaccatattgcggatagctggcataaggagacgcggttttcggatccaccagacgctgccagctgtatacgaagtcctgggcggtaaccggctcgccgttagaccattttgcatctttacgcagatggaaggtccagactttaaaatctttattatcccagctctccgccacgccagggatcgggtggccatctttcggcgaagtattcagcaaaccttcgaacaggtcgcggctaatattggcctctggcaccccttcgattttatttgggtccagcgattgcggctcggcgccgctattacgtaccagggtttgcttctctgccagctgcacaccagccgggacatccgctgccattgccatattgccggcgatcagtgcggatagcactcccgcggcgattaaacgctttttagtgatgatggtcattgtgttgtaactccagtcattataattactggttttttaaccagcctgtttttcccgttttcgggttctgtccaacgcaggagtttgcgattggcagattgctatcaccgacttatttattacgaccgctcgaacggcagtcttaacgtcgattcgttgccctcgctggagggtcgttctggcgaaatgagttaattaaaaataattctcatttgcgtacataattcagcagacgataacggcggaaagtaccaaaaggtaaacacctccgccaatgcaatttgcaaatatgttaccgaattctcttttattgccggttttgccagcgtgacaagcgtttgccataaaacgtcgatgtaaaaatattattatttatcagagcattacgataatttcatcagccgacatactgagcagcgaccgcaagatggttttttgtacaaaaatttaacaatagattactttttagcacattcatctgccgccttgttaaaattactaatatcatttcgatgatccgacagcaagtaccagagaatgatgtgaagaaaataacatcacaggagtgggaggcgtgaggagaatgttaagagaaatatttcatatcttaatgaaaaatatgaaattaatagcgatatcgcaaaatattatccctaccgccagttccgcgctggctaataggttttgctaataatcgcgcaggcgtgaagcgagactccccgcctgctggcgacgaactaactcagcagtcctgggaaaagcgctttaatcccggtcacaataaactcaatgccgagagccatcagcaacaggcccataatacgggtgatgacgttgattcccgtctgccccagcaaacggaccagccacggcgccatacggaaaatcccccagcagcagagggcaaataccgctatcgccagtgagaacccgaccagatgcacccaggagtggtaccgggtcccccagacgatagttgaactgattgcccctggcccggccattaatggtagcgcgagaggaacgacgccgatgctctcccggaccgccgtctccgacttttcctgcttgttctgcttatcttcgccgagcttaccgctgatcatcgacatcgcgatggtcaccaccaggatgccgccggcgatacggaaggagtcaatggagataccgaaaatctgcagaatgccatcgccgaggaacagcgacgtcaggaggatgatcgccaccgacaggttggcggtgaggttggtcttattacgcaccgcagccggctgatagctggtcatactgatgaataccggaataatgccaaccgggttaaccagggcaaataagccgatgaaaaacttgaaatatgcagaaaaatcgaacagtgattgagtcacattgggctccgcagcatcatcaaaattggcggttgactgttaacagcataaaataactgcgcgaaacatacgctttttacctgcaatattcattataaatatgcataacccggtgatatgtatcgaatgttagccatttgtatatttaatgctaatcgtttttttaatttcaaaaccctcccatcacacttgatcgaaccggtcaaaaagcagccagctgaaaggtatcagcagcgacaatacttgatctaaatcacgtaatttgtactcagaagtgagtaatcttgatgacaccaacagagtggaaggcagcagtacctgaaagcgaaagagataaagcttttttagtaaatcggtgaaacagcgccctgatttttctacataaacatttacatgcaagctgttaacggcctgtctataatgtcgaatcgagcgactgatttactaaaaaagtttaacattatcaggagagcattatggctgttactaatatcgctgaactgaacgcgcttgttgagcgtgtcaagaaagcccagcgtgaatatgccagtttcactcaagaacaagtcgacaaaatcttccgcgccgccgctctggccgctgcagatgctcgaatccctctcgccaaaatggccgtagccgaatccggcatgggcatcgttgaagacaaagtgatcaaaaaccacttcgcttccgaatacatttacaacgcttataaagacgaaaaaacctgtggcgttctgtcagaagacgacacctttggcaccatcactatcgctgagcctatcggcatcatctgcggtatcgtaccgaccactaacccgacttcaacagccattttcaaatcgctcatcagtctgaaaacgcgtaacgccatcattttctctccgcacccgcgtgcaaaagaagccaccaacaaagcggctgatagcgtgctgcaggctgccatcgcggccggcgcgccgaaggacctgattggctggatcgatcagccgtctgtagaactgtctaacgcgctgatgcatcacccggacatcaacctgatcctggcgaccggtggtccaggcatggtgaaagcagcatacagctccggtaaacctgctatcggcgtcggcgccggtaacaccccggtagtcattgatgaaaccgccgacatcaaacgtgccgtagcgtccgtactgatgtctaaaaccttcgataacggcgtgatctgtgcttctgagcagtccgttgtggtggttgattcagtctatgacgcggttcgcgaacgtttcgccagccacggcggctacctgctgcagggtaaagagctgaaagccgttcaggacattatcctgaaaaatggcgcgctgaacgcggctatcgttggtcagccagcggccaaaatcgctgaactggcaggcttcaccgtgccggccaccaccaaaattctgattggtgaagtgaccaacgttgacgagagcgagccgtttgctcacgaaaaactgtctccgacgctggctatgtaccgtgcaaaagatttcgaagacgcggtagccaaagcagaaaaactggtcgccatgggcggtatcggtcacacctcttgcctgtacaccgaccaggacaaccagccggctcgcgtggcttacttcggccaaatgatgaaaaccgcgcgtatcctgatcaacaccccggcttctcagggtggtatcggtgacctgtacaacttcaaactcgcgccttccctgactctgggttgtggttcctggggtggtaactccatctctgaaaacgttggtccgaaacacctgatcaacaagaaaaccgttgctaagcgagctgaaaacatgttgtggcacaaacttccgaaatctatctacttccgtcgtggctccctgccaatcgcactggatgaagtgattaccgatggtcacaaacgcgcgctgatcgtgactgaccgcttcctgttcaacaacggctatgccgatcagatcacttccgtactgaaagcagcgggtgttgaaacggaagtcttcttcgaagttgaagctgacccgacgctgaccatcgtacgtaaaggtgccgacctggcgaactcctttaaaccagacgtgatcatcgccctgggcggcggttccccgatggatgcggcgaaaatcatgtgggtcatgtacgaacatccggaaacccacttcgaagaactggcgctgcgctttatggatatccgtaaacgtatctacaagttcccgaaaatgggcgtcaaagccaagatggtggcgatcactaccacttccggtaccggttctgaagttacgccgttcgccgtggtgaccgatgacgcgaccggtcagaaatacccgctggcagactatgcgctgaccccggatatggccattgtcgatgccaacctggtgatggatatgccgaaatcgctgtgtgcgttcggtggtctggatgcggtgactcacgccctggaagcttacgtttccgtactggcttctgagttctctgacggccaggcgctgcaggcgctgaaactgctgaaagagtacctgccggcttcctatcacgaaggttccaagaacccggttgcccgtgagcgcgtacacagtgccgcgactatcgccggtatcgcgttcgctaacgccttcctcggcgtgtgtcactcgatggcgcacaaactgggttcccagttccatattccgcacggtctggccaacgccctgctgatctgcaacgttatccgctataacgcgaatgacaacccgaccaagcagaccgcgttcagccagtacgaccgtccgcaggctcgtcgtcgttacgctgaaatcgccgatcacctgggcctctccgcaccaggcgaccgcaccgcagcgaaaatcgagaaactgctggcatggctggaaagcattaaagctgagctgggtattccgaaatctatccgcgaagctggcgttcaggaagctgacttcctggcccacgttgataaattgtctgaagatgcattcgatgaccagtgcaccggcgctaacccgcgctacccgctgatctccgaactgaaacagatcctgctggatacctactacggccgcgaattcgtcgaaggcgaagccggtgcgaaagccgaagttgctccggtaaaggctgagaaaaaagcgaaaaaatccgcttaaccaacagcgatagcatcgcgacaagccccgtcacctgacggggctttttttatccccgctatcagccattctttatcgccagctacgcaacctatagcagacattaaaaaggcgcccacaggcgcctgtacgagcttctgagggtatcagcagggacggtgctggttttgtaccttggttaacgaaccgacgctcagcgcctctttataatgcttacggcagaccgatacgtaccgctcattaccgccgatgacgacctgctcaccctcattataaggacgcccctcctgatcgaggcgcaataccatgctggccttgcggccgcagaagcagatcgttttcagctcaaccagcttatctgaccaggccagtaaatactggctgccggtaaagagctcaccgcgaaagtccgtccgcaacccatagcaaagcaccggaatatccagcgtatcgacaacttcggacagctcatgaacctgttcacgcgtcagaaactggctttcatccaccagcacgcagtgaatcggctttagctggtgctccgccgcaatatcgtcaaataacgaggtctgtggattatacaatcgggccggcgaggagagcccgatacgcgaactgacttttccggcgccaaagcggtcatcaatctcagcggtataaacgacggtacgcatcccccgctcctggtaattgtacgaagattgcaacagagcggtcgacttacctgcattcattgcagagtagtagaaataaagttgtgccatcggctgcgtgaccccaatcaaagtgttttatcgcggcgacgattgtaccatattttatgcgcacagccgcgctttcagcaggggtattgtcgcgaagctgaagggcctgcaaaccgaaaggattaagaagatgaattgaattttcagggccactatttgtacgccccgttacgctactggcgcgctaaccattgtcttttcgtgcttatagaccggttgcccaggggctataagcagggctgccggttgttttatattaagccttgtaaccaaaaatgcgctaatactgacgagggttatttacccatgtaaaggatcatttctctcactgaacctctcaaaaagcataccgtctcaatgttttagcttgccttcgcctcatcgctataagcgatgaaagatgtgaagcggcacgggaattttaacttaaattaattaattctcgcgacaaataaccagtaattttgaattccttacattcccccctattgcacaacgcattttatcgctctattattagttcaacaaaccaccccacaatataagtttgagattactacaatgagcgaagcacttaaaattttgaacaacatccgtactcttcgtgcgcaggcaagagaatgcaccctggaaacgctcgaagaaatgctggaaaaattagaagtcgtcgttaacgagcgccgtgaagaagaaaacgctgccgcggcagaaattgaagagcgtacgcgtaagctgcagcaataccgtgaaatgctgattgctgacggtattgatccgaatgaactgctgagcaccatggctgccgttaaagccggtaccaaaaccaagcgtgctgcacgtccggctaaatatagctatgttgacgaaaatggtgaaaccaaaacctggaccggtcagggccgtaccccggctgtgatcaaaaaagcaatggatgagcaaggtaaatcactggacgatttcctgatctaatctccgttgatcgctataaaaaatcccgctgcggcgggattttttttgccctcagggccgatataaaaaaaccgggagtcgcagatgcgctcccggtttgtgctttcaaccgcgcggcggattacttcgctaccgccgtttccagccaggctttaaaatcgtcgcccagcgttttgtgacgaataccatattcgacaaacgcctgcatgtagccaagcttattaccgcagtcatggctcttgcctttcatatgataagcttcaaccgtttctttctcgatcagcatatcaatggcgtcagtcagctgaatttcatcaccagcgcccggaggggttttcgccagcagcggccagatatcggcgctgaggacataacgccccaccaccgccaggttggacggcgcaacgtcagcttttggcttctcaaccacgcccaccatcggtacgctttcgcccggcttcagggattcgcctttgcagtcaaccacgccataagcggttacgtcttcgacaggttcaaccataatctggctggcgccagtctcaacgaagcgagagatcatctcagcgaggttatcgcggctcagatcggattcatattcatccagaataacgtctggcagaataaccgcgaccggctcatctcccactaccggatgggcgcacagcaccgcgtgacctagacctttcgccaggccctgacgaacttgcataatagtcacgtgcggcgggcaaatagactgcacttcttccagcagctggcgttttacacgtttttccagcatcgcttccagctcaaaactggtatcgaaatggttttcgatagagtttttcgacgagtgcgttaccagaacaatttcagtaattcctgcagcgatacattcattaacaacgtactgaattaacggcttatctaccagcggcagcatttcttttggaatcgctttggtggccggcagcatcctggtgcctaatcccgcaaccgggataaccgcttttctgactttagaattaagggcagccattgaaatctcctggactgtttgttttttaaacttctcgttacaaataacgtgtcgagtatatcagtcaaccgcgtatttactggtctgaaaagctgccgatagcctcgaattaggacttttacgcataaaacagctcgatgttaccaccgctaaagggcaagaggtaatcccgtctgcttagatataaacgcaattgctcattccgcagacaacattaagcgtaaacgaccgccagccccccaaatttggcactgccacgaggtgcagcgttggctaatttggttaagataagcatcacccagcgtccccaaaggaacgccattactaatctgaatttgatgctcccctgtattcagcgtgccattaagtcccgctgacaccagaattaaatttttcagcccgctgtggtaataccctactaacagagggaactggcccggaagatttgcctgacgcagcagttgattcacctgttttaacaaacttcccatttctggtagccgttgtccctggtgcgccagttgctcctgcagcagaccattaaacaacgcgcgcagcaataatgctgccaacacgccattatcgcctgcgcgtgtgacatccagacaatagaaagccaaatcattttccgaaagcggcgcgatatcgagtaccagaccgggcttgtctgccgacaccagttgtcgataatgaatacggcagtgcgacatttcctgttgcaccggcggctgtaattcctgcaataatcttgaagcggcgatgggattactgaccagcgcatcccagtcctcaaataaacgctcttcctcttccacgcgcgaactgaacatcgcgggatagagacaggcgtaaacggtctcgcgcaggcgatcgaaatcttttactggctttaacagcacgtcctggacgccaagtcgcaacgctttagctatatccgccatgttttcggtggcggagatcatcaggatcggtaactgttcgccgcggttacgcagcgtttccaccagctccagaccgttcattctcggcatagaaatgtcgcaaatcatcaggtccggatgcacctccgtcattttatgcagggcatccttgccatcttccgcctggaaggttgttgctcccagcgaggtcagccatccatgcaagagtgagcggaaaacgggttcgtcttcaactatcagaatctgttttcccgccaatggctgcgtcatgatatctcccctggctgacgataattcaatagtggcacgctattctcactatcgcctgtcagaatttgcttaagtcagtaactcgtacgtcaaacggctgtacgcactaatggtaataattcatccattttcttttctaccgccagttgccccgcggcaatcgcctctccggcgcgatgaaaatcaagcgtcgaaacttgcggacagtatggctgcaacaggatatccggcgggtcacccgccatacgattgcgtttaagacggttttccagtacctggatagatgtggtcatgatctccatcgccgtcggcgtcacggccgtacggcgggaactcattcgcgtcaagcgcgcgcgcagacgagtatgccatggcccctccttctcttccgcttcctgccgcggcgtttcaagggagaacaaatcctgctgcataagatgggcatcatgttgcaggtcgacggcaatcacaatatccgctcccattgcccgggtgagcgacacaggaaccggattgaccaccgcgccatcgaccagccagtaaccattatgccttactggcgacattaaccccggcatactgcaggaggcgcgaatggctaaatgtagatcgccttcggtaaaccacagctccctaccggtgcttaaattggtggcaacagcggcaaaccggcgctcgcagcgttcaatctcggtgacgggcataatgcggcggtaatgattgaataccttttccccccgcagcagtcccccccggcgccaggagagatccatcagcttcaggacatcccagttgctgaatgagcagacccatgattcgagtgccgggagtcggttacaagcatacgccgcccctaccagcgaaccgatagaacaaccggctacgatatcaatctcaataccggcccgctggagggcgttgatgacgccaatgtgcgaccatccgcgagcggctcccgcacctagcgccagaccaattttaagctttctcattagtactaataactatccttccactctgagcgtggcaacattgtcacggctcagttaacataatgccctttggcgtagaagcgccgttactctttcttccatggaggcagttttgtcgcaattatgcccctgtggcagcgcactggagtatagctcatgttgccagcgatatctgtccggcgctgagcttgcgccgggcccgtcacagcttatgcgctcccgttatagcgcgttcgtcatgaaagacgctgactatctaatcaaaacctggcacccgtcctgtcaggcgcagcaatttcgcgccgaactggagaaagggttttcccagaccgaatggctgggcttaaccctgttcgccagtgatgaggggcgagctccaaatgaaggttttgtcagctttgtcgcccgctttaatgacaataaccgccctggcgccattattgaacgttccagattcttaaaagaaaatggacagtggtactatatcgacgggacacgaccgctgattggccgtaacgacccctgcccctgcggctcaggtaaaaaatttaaaaaatgctgcggccagtaacgctggcacagcgcttgcaaacattacaggattttcctcgcgatgcattcattacaacgtaaagtactacgcactatttgccctgatcagaaaggcctcatcgcgcgtatcaccaatatctgctacaagcatgaactcaacattgtgcagaacaatgagtttgttgaccaccgtaccggtcgtttctttatgcgcaccgaactggaaggcatttttaacgacgctactctgctggccgatctcgacagcgccctgcctgaaggctccatccgcgagctgaatccggcaggccgtcgccgggtggtgattctggtgacgaaagaggcgcattgtctgggcgatctgctgatgaaagccaactacggcgggctggatgtcgatattgccgcggttatcggcaaccatgacaccctgcgctcgttggtggagcgctttggtattccgtttgagctggtcagccatgaaggactgagccgcgaagaacacgatcagcggatgggcgatgctatcgccgcccacgaaccggattacgtggtgctggccaagtatatgcgcgtcctgacgccagaatttgtcgcccgcttcccgaacaaaatcatcaatatccaccattcgtttttgccggcgtttatcggcgcccgtccctatcatcaggcctatgagcgcggcgtgaaaatcattggcgctaccgcccactacgtgaatgacaatctggatgaaggcccgatcatcatgcaggacgtgattcacgtcgatcatacttataccgcagaagatatgatgcgcgctgggcgtgatgtcgaaaaaaacgtcttgagccgagcgctgtatcaggtactggcgcagcgcgtcttcgtttacggtaaccggacgattattctttaatcgactgagaaatgaattggttagctttacggcgttacgtgtaaaaatcaggcaaccagtttatttttgtcaaacgaatgctttacaggggcgcatcatttggtatgatgcgccccgcttcccgagaaggaagcaggccagtaccaagcattaccccgtggtggggttcccgagcggccaaagggagcagactgtaaatctgccgtcatcgacttcgaaggttcgaatccttcccccaccaccattattcactacagtgatatggtttccccgacaagcgtaaacgatgtttgcacttagcgggaagggtaagaaccttcgactaaggttcgactcgagcgccagcgagagaacgttgccgcaggcaacggcccgaagggcgaggaaagatagcgacgagttatccttcccccaccaccattcattttgctgaatagcctacaatgtgattttacccctggtggggttcccgagcggccaaagggagcagactgtaaatctgccgtcatcgacttcgaaggttcgaatccttcccccaccaccatctccccatgtcatgcccagcataatctacctacggtattctatattctgccctacagggaaggatgagaagcttcgactaaggttcgactcgagcgaagcgagagaacgttgccgcaggcaacggcccgaagggcgaggcgctttagcgccgagtaatccttcccccaccatcatctcttcatgtattgcccagcttattccacctgcgatacgctatattctgccccacggggaaggatgagaagcttcgactaaggttcgacttgagcgaagcgagagaacgttgccgcaggcaacggcccgaaggcgaggcgctttagcgccgagtaatccttcccccaccactgttgcactctcagccaccggtcctgctgtctcatcgctcgcgcttcgcttagcgaggctacacattcctgcactctcagccacctgttctgctgtctcatcgctcgcgcttcgcttagcgaggctacaagtggtgccgtctggtagcccggacaggtgcgcagcaccgcctccggaaaaactcacagcggtggcaaccgcctttttaccggcgagcttttcaccaccgaggtgttacactgcgcatactccgccagaccgtccagcagggtatccagctgggcaatatcgcgcaccacgagacgcattacaaaacaatcttccccggtcaccttgtcactttcaatacattccggcatcgcctggatatatttatccaccttctgcagcagcccaggcagcggccggacccgcaccagcgcctgcaggctatagcccagcgcggcgagatttacccgcgccccatagccctgaatgacaccccgctcctccaggcgcttcacccgctcggcggtgctcggcgaggtcagccccactcgcgcgctcaggaccttgagcgaaactctggcatcctgagtcaggcaggtgaggatcgccctgtcaatttcatcaagtacgtcattcatatatttcacctaattataaaaggcatttccccccttctaccttaattcagccatatcaccctgtcagggtttttcgcacaataactaaaaaatggtggaggtgaaaaatgcaacttacccgcggcgtctggcagatgagcctggcaatgataatctccggctcgatcggcgcgttcgtgctgctctctggtttgccggtgactgatgtggtgttctggcgctgcctgattggcgcgctaaccctgctggtgtttatcgtgttaagccgccagcccttcagccggctaacgcgtttcactctcgctctggcggtgattggcggcgcggcgctggtcgtcaactggctgctgctgtttgccgcctattcgcggatctcaatcggtatggccaccgtggtctataacacccagccgtttatgctggtactgatggggatggtgctgggggaacgggtcagcgccgtgaaatggggatggttactgctggcctttggcggcctagtgatcctgctgtcgagcgagctgacgcctgcacacgaagaggggcttaccaccggcgtgttgctggcgctgggcgcggcattcttctatgccctgaccgccatcatcgcgcgcaaactgcatccgctccccgcgcagcatatcgccttcattcaggttctcgtcggcgtcgtgatgctgctgccgctggtgcatgccccagaattgacggccagcttcccctggcgctatctgctgatcctcggcatcgtccataccgggatcatgtatcagcttttatatagcgcgatacagaaactgccgacgcccgttaccggttcgctctcctttatttatccgctggtggcgatggtggtcgactatctggtcttcaaccatgcgttatccgcggtgcaattgctcggtgggatgcttattctgtttgccgccgcagggaataatctcggctggggcgaaaaaaaaccccgccgcggcggggtcagtgagcagtcgcgggccagttagcgacgggcgcggacaatctggtatttgcgcgtcaggtattcgaccggcgcgctccagatatgaaccagacgggagaacgggaacagcaggaacagggtcatgcccagcaccaggtgaacgcggaaaataaacgccacgccatccagatgctgtgacgcgccgccgtggaacgtcaccaccgactgcgcccagccgaccagtttcatcatttcactgccgtccatatgctgagcggagaacgggatcgtcagcaggccgagcgcacactgcaccatcagcaacgagaggatcagaatatccgctccggtggtggtggcgcgaacgcgcgggctcagcagacgacgcttgagcagcagtaacccgcccaccagggtcatcacgccgcaggcgccgccggcgatcatcgccatcttctgcttgacatcgatcggcaggaaggactcatacatccagtgcggggtcagcatgccgaggaagtggccggcgaaaatacccaggatgccgatatggaacaggttcgacgccaggttcatccccttacggtccagcatctggctggaggcggcgcgccaggtgtactggccatagtcatagcgcaaccagctgccaatcaggaacaccgaacccgcaatgtacggataaatgtcaaagaagaacatattcaggaagtgcattattgctgtcctccgttagagatattcagatattgcggggccacggctccggcaaaacgacgctggtgagcggaaatttccgactcgccgcagccctggtcggcaaagaatttgacctgttcttcttcccagacggcgtccagcgcctgcggcgtatcgtcgcgcgcttcgtcggcaatcttctccgccaccttctggctgtcgacctgcgtattggccagcttcagcaacagctcgaacagcaccgcatagcgactttcgcgctgctgcaggcgcgcgctgagcagaccgaggatcggcgcgacgtcccgcaggccgccaagcgcttcctcttccggcagctgcgccagatactccagatatagcggcagatgatccggcagctcatggctatccagcagcaggccgtggcgctcgtactgcgccatgagatccaccatcgcctgcccgcgatcgcgggattcgccgtggacatgttcaaacagcagcagcgaggtggcccggccgcggtcaaacagttcgctataggccgcctgggcgtccagcggatcctgagccactaaatcgcgcaggaaaacgcccagcgcgtgggcatcctctttgctgagtttctctgatgacgcgagcgcctcgaacatctcctgctgatgctgccataaggcagcgtcaggatattcgagcagacgcgatacaatcacgagttcaatcatgcgtgcggctccgttttgctggtcacgtcgatggcgtcgatgcgacggctgttgaacaggttgaactgactgtcagagccatggcagccatcgccaaagctaaagccgcagccgtttttctccggaaacgcttctcgcgcctgttcacgatggctgctcggcaccacgaaacgatcttcgtagttggcgatcgccagatagcgatacatttcctgggcctgcgcttcgctcagccccacctcttccagcgcgcgggtatcaacgacgccgtcaacggtttccgcacgcttatagtggcgcatcgccagcattcgtttcagcgccagcagtaccggctgggtatcgcccgcggtcagcaggttcgccagatattgcaccggaatacgcaggctttccacgtccggcaggatcccgttgctacccagttcacccgcatcggcggcggactgaatcggcgacagcggcggcacgtaccagaccattggcaaggtgcgatattccgggtgcagcggcagggccagcttccagtccatggccattttgtaaaccggcgactgctgcgcagcttcaatgaccccctgcggtacgccatctttcagcgcctgctcgatcacttttggatcgttgggatcgaggaacacgtccagctgacgctgatacagatctttctcgttctcggtgctggcggcgttttcaatcgcgtccgcgtcgtatagcaggacaccgagatagcggatgcgacccacgcaggtttcggagcataccgtcggcatcccggattcaatacgcgggtagcagaagatgcatttctcggatttcccgctcttccagttgaaatagatcttcttgtacggacagccggtgatacacatccgccagccgcggcacttgtcctggtcgatcagtacgatgccgtcttcttcacgcttatagatggcgccgctcgggcaggtcgcgacgcaggccgggttcaggcagtgctcgcacaggcgcggcagatacatcatgaaggtgttttcgaactggccgtacatcgccttctgcatgttgtcgaagttctgatctttggcgcgtttttcaaactcgccgccgaggatctcttcccagttcggaccgctggtgatcttgtccatccgctggccggtgatcagcgagcgcggacgggcgatcggctgatgtttgctctccggcgcgttatgcagattctggtagtcataatcaaacggctcgtagtaatcatcgatgcccggcagatgcgggttggcgaagattttacccaacagcatcgcgcgattgcccatgcgcggctgcagtttaccgttgattttgcggatccagccgcccttccatttttcctggttttcccagtcgttcgggaaaccgacgcccggcttactttccacgttgttgaaccaggcgtattccatcccttcccggctggtccagacgtttttacaggtcaccgagcaggtgtggcagccgatgcacttatcgagattcagcaccatgccgacttgtgaacgaattttcattttacgctctcctgtacctggtcgttgccttcgccgtctaaccagttaatgttcttcatcttacgtaccaccacaaactcatcgcggttggagccgacggtgccgtagtagttaaagccataggccaggtggccgtagccgccgatcatgtgggtcggtttcggcgtaatacgggtgacggagttatggatccccccgcgctgaccggtgatttcagagcccggcaggttcacgatacgttcctgcgcgtgatacatcatggtcatcccggctggaacgcgctgactcaccaccgcacgcgccgtcagggcgccgttggcgttgaagacttcgatccagtcgttatcttcgatacccagatctttcgcatccgcttcgctcatccagacaatcggcccaccgcgcgacagggtcagcatcagcaggttatcgctgtaggtcgagtggataccccatttctggtgcggggtcaggaagttcagcgccttctccgggttgccgttggacttctcgcccatcaccgctttcaccgaacgggtgtcaatcggcggccgatagaccagcaggctttcgccgaagtcgcgcatccactggtgatcctgatacagcgactgacggccggacagcgtgcgccacgggatcagctcgtgaacgttggtgtaaccggcgttgtaggagacatgctcatcttccaggccagaccaggtcgggctggagataatcttccgcggctgcgcctgaatgtcgcggaaacggatcttctcgtcttctttgttcagcgcgaggtgcgtatgctcgcgaccggtgatctcgctcagcgcttgccacgctttcaccgccacctgaccgttggtttccggggccagggtgaggatcatttccgcggcgtcgatggccgtttccagcttcggctggcctttcgccgggccttccgccttggtgtagttgagcttacgcagcagatccatctcgctctgggtgttccaggcgatgcctttcccgccgttgccgatggtttccagcagcgggccgatcgaggtgaaacgctcgtaggtcgccgggtaatcacgctcaaccggaataatatgcggcgcggttttcccggggatgagatcgcattcgccttttttccagtctttgacatccagcggctgcgccatttccgcggcggagtcgtgctggatcggcagggtcaccacgtcggtttctttaccgaggtggcccacgcacacttcagagaatttcttcgcgatacctttatagatctcccagtcgctcttcgattcccaggctggatcaacggcggccgacagcgggtgaataaacggatgcatatccgaggtattcatgtcgtctttttcgtaccaggtggcggtcggcagcacgatgtcggagtagagacaggtgctcgacagacggaaatcgagggtcaccaccagatccagtttgccgtcgaggccgttatcccgccattcgacttcttccggcttcacgccgccctgcttgcccaggtctttgccctgaatgccgttctcggtacccagcaggtacttgagcatgtattcatggcctttaccggaggagcccagcaggttggaacgccagataaacaggttacgcgggtggtttttgccattttccggctgctcggccgcaaagcgaatcgagccctctttcagcgacttcacggtgtaatccaccggggtcatgccggcttttttcgcttcgtcagcgatacgcagcgggttgacgccaagctgcggcgccgacggcagccagcccatccgctctgcgcgcacgttaaagtcgatcaggtggccgctgtaacgggatttatccgccatcggcgacagcagttcctgcgcggtcaccgtttcatagcgccactggctggagtggttatagaagtacgaggtactattcatgtgacgtgccggacgctgccagtcaagggcgaacgccagcggctgccagccggtctgcggacgcagtttttcctggcccacatagtgcgcccaaccgccgccgctctgaccgacgcagccgcagaagatcagcatattgatcaggccgcggtagttcatgtcgaggtggaaccagtggttgaggcccgccccgacgataatcatcgaacgaccgtgagttttatcggcgttatcggcaaattcacgggcggtacggatgatatgcgcgcgggagacgccggtgatcttctccgcccacgccggggtgtaggctttcacttcatcgtagccggcggcgcagttgtcatcgttcagaccgcgctccaggccgtagttagccatggtcaggtcatacacggtggtgaccagggcggtagagccgtcggccagctgcaggcgtttggccggcagtttgtgcagcagaatgttttccagatcgactttgttgaagtgctcagaaccttcgccgccgaagtacgggaagccgacgttcgccacttcatcatggctgcccagcaggctcagacgtagctcaatctcttcgccagttttaccgtcgcgctgttcgaggttccatttgcctttgtcgccccagcggaatccgagggagccgttcggtacggtcatgtcgcccttctcgtcaaaggcgacggttttccattccggattgttctcctgaccaagggaatccacgaggtcggatgcgcgcagcgtacggccggcggcataataaccgtcgcgctcctcgagcatcaccagcatcggcatgtcggtatagcggcgcacatagtcggtgaaatactggctcggcttatcgaggtggaattcacgcagcatcacatggcccatcgccagcgccatcgcggcatcggtaccctgcttcggcgccagccacagatcgcagagtttggcgatttcggcgtagtccggagtgatggctacggttttggtccctttatagcggacttcggtaaagaagtgcgcatccggggtgcgggtctgcggcacgttggagccccaggcgatgatatagctggagttataccagtcggcggattccggcacatcggtctgctcgccccaggtcatcggcgaagccggcggcaggtcgcagtaccagtcgtagaagctcaggcaggtgccgccgatcagcgacagataacgggcgccggacgcgtaggagaccatcgacatcgccgggatcggcgagaagccagccacgcggtccggaccgtaggttttgacggtatagacgttggaggcggcaatcagctcattcacttcctgccaggaggaacgtacaaaaccgccgcgaccgcgggcctgtttgaagcttttagctttgtcggcgtcttcgataatcgacgcccatgcctcaaccggatcgctatgctgaactttcgcttcccgccacatcttcatcaggcgtttacgcatcagcgggtatttcaggcggttagcgctgtacaggtaccaggagtagctggcgccgcgcgggcaacctcgtggttcgtggttcggcaggtccgggcgggtgcgcgggtagtcagtctgctgcgtttcccaggtcaccagaccgtttttgacataaatcttccagctgcatgagccggtgcagttgacaccgtgagtggaacgcacaattttgtcatgctgccaacgttgacggtatccatcctcccagtcccggttggtgtttagaagctggccgtgcccatcggcaaaggtttcacccttctgtttgaagtagcgaaaccggtccaggaatttactcatcgggtttctcctgatatggagcctgacggctctctgataaatcgacattgctggatttgcagcgaaggtaacgctatgaaagagggcgagaattgatagcgatcaatccgaactggcttgttactgtgcagcaaaacctcgattaccaccaaggtggtataagatgttattttttaaattattgttttttaatgattttcacctcaaaaagcggcgcctcatcgggatttgttaacaacggaggtattaaggggtagagccatttcactggcaagcccacctgttctggctcagcggtcgatgcggacaatattctccaacagtatgttgtaactaattaagcggttaaaaaaggcgcctccgtggggagcgcgcctttttatacgccaacgttaccgcggccgattactgacgcttacgaccgtataccgcccaggtgatcaccacgcaggcaatatagaacacgaggaacactttcatcgccccggccggcgagccggtcagatccagcgagataccgaacgctttcggaataaagaagccgccgatagcaccaatggcggagataaagcccagcgccgccgcggtatcggtcgccgcctcgcgcatcgcctgcgcttcgctgccgccctgggccttcacgcggtccatagtcagcttacggaagatcacggagatcatctggaaggtggaggcgctccccagcccggcggtcaggaacagcaccataaacaccgcgaagaaggcgataaagttaccgccctggccgttggtcggcagggtcaggaacagcagcgcgcagaagacagccatcaccacaaagttgaccagcgttacgcgggtcccaccgaggcggtcggagatcgccccgcccatcgaacgcgccagcgcgccaatgaacgggccgaagaaggcgtaatgcaggatctgcacatccgggaactgagtttttgacagcatcgcgaacccggcggaaaagccgataaaggagccgaaggtcgcgagatagagcagcgccataatccacagatgcaggcgcttaagtaccggcaactgctcgctcagcgacgctttcgaagccgacaggtcgttcataaagaaccacgccgccagagtgaaaataatcaggaaaggtacccagatccacgcggcgttttccagatacagcatcgagccgtccggttgctcgctaccgttaccgccaaaaacggcaaagatagagatcgagaccaccagcggcgcgaccagctgcatcacgctgacgcccatattgccaagtccgccgttaacgccgagcgccccgccctgcttcgctttcgggaagaagaagctgatgttggccatactggaggcaaagttggctccggcgaagccgcacagcagagagataatcacgaagatgctaaacggcgtagaggtatcctggaccgcgaagcccagccagacgcatggcacaatcatgatcccggtgctgaacgccgtccagcgacggccgccgaacagcggcaccataaaggcgtaaggcacgcgtaataaggcgcctgacagcgccggcagcgcggtcagcataaacagctgatcggttgtaaactgaaagcctactttgttgaggttaacggcaaccgcgctgaacaacatccaaacgcagaacgccagtaacagacagggaacggagatccataaattgcggcttgccacacgatggccgcgctgttgccagaattcaggatcttcaggccgccagtcggttatgaccgagcggttagccttctccgggagggaagattgactcatagatacctctgattattcatatttcctgccgctaccttaggggttacccggggcggtaagttgatataaatcaaaggaaaagcgcgagctaatttgtgcaaaaataaaccatgcctccaagtgagtagagaatggcggggaaaaaagtgtggtttttcacgctgctgccgggttgcgtataatcccccccctaacatcgcctaccaccgacaattaaggagtaactctttaggggtatgggtatactccaggggatagtcgagaataagcgccactcccggagacatgaccggtcaggagccacgcattccatgttaaaacgtctttttaccccgctgacgctggtcaatcaactggcgttaatcgtgctgctcgccacgattattggcgtcgccggcatggcgatctccgcgcgcctggtgaacggcgtgcagggcagcgcgcacgccattaacaaggccggttcattgcgtatgcaaagctaccggctgctggcggcgatcccgctgaatgaaaacgatcaaaaactggtggcggacatgaccgccaccgtcttcagcccggagctgcaaaattccgcccgccgcgacggccaggaaatccagcttaaagccctgcagcagtactggcagctggcgctggcccccgggatgcagcgcgcagtcaatcaggcggaagtggcccaggatgtcgccgactttgtcgatcgtatcgaccagttggtcaccgcattcgaccacaccaccgagcagcgtatcgaacgggtggtctggatccatcgcatcctcgccattggtatggcgctgctgctgatcttcactatcatctggttacgcgcccgcctgctgcggccgtggaaacagctgctgagcatggcgcgcgcggtgagccagcgtgatttcacccagcgggcgcacatcagcggccgcaacgaaatggcgaccctcggcatggcgctgaataacatgtcggaagagctggcggaaagctacgcggtgctcgagcggcgggtgcaggagaagaccgccggactggagcagaagaacgagatccttgctttcttatggcaggccaaccgccggctgcactccagcgccccgctctgcgaacgtatttcgccggtactgaatggcctgcaggggctgacgctgctgcgcgatatcgaggtacgggtttacgacctggaagacgaagataatcaccaggagtttacctgccactcggatgatgactgtgatgataaaggctgctacctctgtccacgcaatctgccgccgctgccggatgggggaacaacgctgaagtggcggctgtcagatgcgcatagtcagtacggcatcctgctggcgacgctgccggttggccgccatctcagccacgatcagcagcagctggtggataccctggtggaacagctgaccagcaccctggcgctggaccgccatcaggagaagcagcagcagctgatcgtcatggaagaacgggccactatcgcccgcgagctgcacgactccatcgcccagtcgctatcctgtatgaagatgcaggttagctgtctgcagatgcaaggcgacgccttgccgacggaaagccgccagctgctggggcagatccgtaacgaactgaatacctcgtgggcccagctgcgggagctgttaaccaccttccgcctgcagttgaccgagccggggctgcgcccggcgctggaggccagctgtcaggagtacagcgcccacttcggctttacggtgcagcttgattaccagctcccgccgcgctttgtgccctcgcatcaggcgatccacctgctgcagatcgctcgcgaagcgttgagcaacgctctgaagcatgccagcgcaaccgaagtaaccgtgacggtgtcacaacgcgataatcaggttcgtctggtggtagcggataacggccgcggcgtaccggaccacgccgaacggagtaaccattacggtttaattattatgcgggatcgcgcccagagcttgcgcggtgactgtcaggtacgacgccgggaaaccggtggaaccgaagtgatcgtcacgtttatcccggaaaaaacgttttccatccaataaggagaccctcatgagtcaacaggaacgggcaactatccttctcattgacgaccatccgatgctgcgcaccggcgtgaaacagttgatcagcatggcgccggacatccaggtgattggcgaggccagcaatggcgcgcaaggtatcgagctggccgagtcgctggatcctgacctgatcctgctggaccttaatatgccgggcatgaacggtctggagacgctggataagctgcgtgagaaatccctttctggccgggtagtggtcttcagcgtctccaaccatgaagaggatgttgtcaccgccctgaagcgcggcgccgatggctatttgctgaaggacatggaaccggaagatctgctgaaagcgctgcagcaggcggccgccggagagatggtattaagcgaagcgttaacgccggtgctggccgccagcctgcgcgccaaccgcgccacctccgatcgcgacatcagccagctgaccccgcgcgagcgcgacattctcaagctgatagcccagggactgccgaacaaaatgatcgcccgtcgcctggatatcaccgaaagcaccgtcaaagtacacgtgaagcacatgctgaagaaaatgaagctcaaatcccgcgtggaagcggcggtatgggtccaccaggagcgaatcttctaaggcgagtccgtccaggagacgcctggcgtggtaaacttgaccagcggctcggtcaacgccagggcgatctcattggaggagacgcgctgcccctgtttatcctccaccaccaccgacaggcgccagcggttcgcggcgcccggttcactgttccacaccggcataatgatgctccagccatcggggctgctggcatctaccggcggcgtcaggctgagggcctgggtgtctccctgccagtgcagcgccttgatgccatgcagactatggatctgcagcttcaactgcaccgtctccccggactgcagatcccagggcggcgtggccagatagaccgtcagatttttgcgctgacgatactccaccaccggcagattatcccgctccggactatcgaagcggctcccgcgcagcgagttgctgatcgccacctcgtctgccgcaagctgctgcttaaggggtacgccaaagcggtagtttagcttcaggcccacattgttctggctgacgccattttccccctgcttatgcttagcggtcaccgtgaccagcgggaccggggtgtaattgagcccaacggagacggccaccggattatggtagccggtgccggagtgaaacagatcgacgctatcgccgaaatactgttcgacgctgacgctggtgttgatgtgctggtagaacggcagccgcgcctgggcggtgacgtcataccctgcggccatccgctgctcctgagtctgattatcgcgtagctgccagtcgccaagcggatggtaatagtttgccgacaggcggagatattctccccacgcttcggcgccaacgctgccgcgcgccaggctttcgctcagcactttatcgtaaaacgagttatagcccagcagccaaccgccgacccgccaacgctggccaagcccgatgttgcccaccagatcgtgctcgcgccgggtcaccgagtactggttccacgtcagataacggtcgttatcctgcaacggcacgaaccagctccctttactgccggtgaatttcccctctttatcgaccagcaggtcgacattggcgttgccccacggcgagagccaactctccagctgatgactcacttcattgccgattttactgatggcaaacagctgcgcctgttcacccgccgtcagaccattgtcgctcatgctggcctcgccaaacttcttcgccacttcggcaaagtgccgggcgtcgtcatcaacctggggagcaatccccatatcgggcagcggatcttgcgcttgcgcagggcgggtggtgtcgctggcggtcagcgcccagacgggaacgcccggcaacagcaggagaaaggtcaacgttggcaacaaacggaacgacacaggcattaacagagtttgcgcaagctcacaaaaatggatagaagtgttagtttatcgttttttccctgctcccgcagccctgtgggcaattccaggaataagctgaaaccggttgggtaaggtgccgcccaaccggaggcgtcgccgcgcgccaccgttacgcccgggttcgctgcgccgccagcagcgcgttgagctccggcacgcaagagccgcagttggtcccgcatttcagcttcccacccagcgccccgacgctggcgcagccgctggcgatggcctcgttaattgaccattcccccaccccaaagcagctgcagacgatccgcccccgcggcgcgacggcggcgcccggtcggccgctaagcaaggcatgtcgttggacagcatcggacggcggcgcggcaaaggcagcgcttatccatgcgcaatccaccgccggctcgcgcgcatcgctccaccagccgagcatcagccttccctgatgccaggccagcaggttccacaccgcaccgccgtcagccacctgtaactgccagccgcgccgggcgcaccacgcgctgagccactgtcgggcagatgcctccccggccagcgagtagtgcagcacgcctggcgccgcccgccgccgccagtgccaggccgcaggaaatggtagcggttcgcggcaaaaaagctcgctgtgccaggccggttgccaggcggcgatcgccaccgccgcctgtttactttccggctggccggaatacgggtccgtgacggcggccagcaggttattcacccgcccctgacgggcaaactggttgttccagtgcatcggaacaaacagcgagccggggcgctgcccttcgctgatcgccactttcgccaccatcaccccatgccgcgaccagatccgcgccagcccgtcagcgggaagctgatagcgaacggcatcctgcggcgccacctccaccattggctccgcgatatgctgcatcagccgcggcaccgcgccggtacgggtcatggtgtgccactgatcgcggatccgcccgctgttgaggatcagcggataaaaggcatcggttgtcgcccgggtcggttgaggcgtcaccggcaccatccgcagcctgccatcgccatgccagccgcgcgtgatatcccaggcgacctcgctgcggctgaccggccagcgcaccggcggcatggtgtcccacgcctcacggctgagatccgccagcgcgccgatatcaaacgcccgctggccgtcgttttcgaaaccggacagcgccgcatgctcgcggaagacgtcatgcggatgctgccaggcaaacgcctcgcgataccccagagcctggcccactctggcgatgatccaccagtccgctttcgcctcccccggcggcggcagaaagctgcgctgacgggagatccgccgctccgagttggtgaccgtgccattcttctcgccccaggccagcgccggaaagcggatgtgggcgaaacgtccggtatcggtctgggcggcgacatccgagacgatcaccagcggacaggcggccagcgcctggctcaccgcgtggctgtcagggagcgacaccaccgggttggtacccatgatccagaccgctttgacctcgccgcggccaatggcggcaaacagctccacggcggtcagcccgggggtctgcgccagccgttccgtcccccagaagcgggccagccgctgcagatcgtctggcacaaaatccatgtgcgccgccagcatcgtcgccagcccgccgacttcgcggccgcccatggcgttgggttgaccggtcagcgaaaaggggccgcagccgcggcggccatacttcccgctggccagatggacgttgatgatggcgttacatttgtcgctgccgctggcggattgattgattcccatggtgtagagggtgatcgcccgcggggcggcgatgaactcgcgatagaatcccgccacctcatcggcaggcagaccgcaaaaggccgccaccctcgccacgtcccagccgcgggcggcggccagcgcctgcgggccgtcgcgaaagccatcgacgcaggctcctgcctcagccagggcgttaagcagccccgcaaacaacccgccgtcgcttcccggggccagcgccagatggcggtcggcgatctcgcaggtagcggtgcgtcgggggtcgatcaccacgatccgcaatcggggattatcccgcttcgcctgcgccagccgctggaacagcaccggatgcgcccaggcggcgttcgagccgaccagcaccaccagatcgctgttttccacatcatcgtagctgcagggcaccacgtcggcgccaaaggcccgcttgtagccagtgaccgctgacgacatgcacagccgtgaattggtatcgatgttcgccgcgccgataaaccctttcatcagcttattggcggcatagtaatcctccgttaacagctggccggaggcgtaaaaggccaccgcttgcggtccgtgctggtcgatgatctgtctcaggcgcgcagcggtttccgccagcgcctgaggccaggctacctgctggccgtcgacctccggcgtcagcagccgccccgccaggcccgtggtctcccctaaggcagcccctttgacgcacagacggccgaggttcgccgggtgctgatcgtcgccgcgcacgctcacctgccccgcgtcgtccacgctcgccagcaccccgcagcctacgccgcagtaggggcaggtcgttcggatggtcttcatcaggaggcctccgcgcgggccagcagctgctggttgcccacccacactttgccgttttccactttcaccggccaggcgcgtaccgcctgttcactgccgtcgcacggccagccgtcgcgcaggcgtatccgctgtttgtacagcggggagatcaccaccggctcgccgccgacgtcccctaacagcccacgcgacagcacgttggccgcgctgcccggctcgcggttgtcgagggcgtagacccgctcgccgaagcggaacagggcaatctgccgctcccctaagcgggcgccgatccccgcctgcgccggaatggcgtcaaggtcgcataccgcctgccacggtcgggatgggagttcgccttcgggcaacgtctcagtcagcagcggctgcggctgaccgcgcagatcgcggcgctgcacagcctcgtcgggctggtcgctattaacgaaggagcggaacagcgccagacgctgcggatcgttgagggtggtctgccactcgcactggtagctgtcgacgatccgggccatctcctgctccagctcctcgccaatgccaagactatcctccagcaccacctgccgcagataggcgacgccgccctccaggttatccatccaggtgctggttcgctgcaggcgatcggcggtacggatatagaacatcagcagacgatcgatgctgcggatcagcgtcgcttcgtcgagatcgctggcaaacaggtcggcgtgacgcggtttcatcccgccgttgccgcagacgtacagattccagcctttgtcggtggcaatcaccccgatatctttcccctgggcttcagcgcattcgcgggtgcagccggagaccgccatcttgattttgtgcggggcgcgtagccctttatagcgatgctcgagccgtaccgcaagcccggtggagtcctgcacgccgtagcgacaccaggttgagccgacgcaggatttcaccgtgcgcagcgacttgccgtaggcgtggccggtttcaaacccggcgtcggccagctcgcgccagatagccggcagctgttccagccgcgcgccaaacaggtcgatgcgctggccgccggtcactttgctgtagagctggtaacgtttggcgatctgcccgatggcgatcagtccgtccggcgtcacttcccctgccgccatccgcggcaccaccgaatagctcccgtccttctggatattggcgaaatagcggtcgttggtatcctgcagcggcaggtgcgccggcttcagcaggtactcgttccagcaggaggccagcaccgaggccaccagcggtttgcagacatcgcagccgtgcccctggccgtagcggctaatcaactgctcgaaggtatggatatggttaacccgcaccaggtggtagatctcctggcgcgaccacgggaaatgttcgcagacgtcttttttcacttcgacgccctgctccgccagctgatactccatcacctgtttcaccagcgcgctgcagccgccgcagccggtagccgctctggtgcagctttttatcgccgacatatcccccgccccattgttcaccgcctggcagatatcgcctttgctgacgttatggcaggagcagatcggcgcgctgtccggcagcgccgcgacgccgagcgccttcggcgcggctccctccagcgcgggcaggatcagactctccggacgcggcggcagcgccatgccgttcagcatcatctgcagcagcgtggcatagtcgctggcatcccccaccagcacgccgccaagcagggctttgccgtcctgactgacgacgatttttttgtaaatctgctgcggaccgtcggtccattgatagctctgacagcccggcgtgcgcccctgcgcatcgccaaacgaggccacgtcgacccccagcagcttcagtttggtgctcatgtcggcgccgctaaagcaggcgtcctctcctgcgagagtggccgcggcgatgcgcgccatctgatagcccggcgccaccagaccgtaaattttattgtcccacagggcgcattcgcctatcgccagcacgtccgggtcagaggtgcggcactggccgtcgatgtgaattcccccgcgttcgcccacctgcagcgcgcagccgcgggccagcgcgtcctgcgggcggatccccgccgagaagaccaccatgtcggtccgcaacgcgccgccgtcggcaaagttcagccgcaggccgtcggcctcgcgcacgatggcggtggtcgctttgctggtatgcacccccacgccgagggcgacaatcttctcccggagcatcgccgccccgccgttatccagctggacggccatcaggttcggggcaaactccaccacctgcgtctccagccccagctgtttcagggcgttggccgcctccagcccgagcagcccgccgccgataaccaccccgctcttcgccgcggcggcatgggcggcgatacggtcgagatcgtcaagagtgcggtagacaaagcaccccgcgagatcgttaccggggattggcggaacaaagggatacgagccggtcgccagcaccagtttatcccagtggatttcatgcccctcggcgtcccgtaccagccgtgcgtcgcggtcgatggtcgccaccgcctcgccgaggcggagttcaataccatgttcaataaagaaatccccggccgccagcgacagcgactcggcgctgcgtccggcaaaatactcggagagatgtacccggtcgtaggcgggataacgctcttcgccaaacaccacgattcgatattgctgatgcagattgcggctcacgcattgttcgagaaaatggtggccgaccatgccatgtcccaccagcactaatacaggtttcgtcatcgtcattattcctgcagcctgcggctgcgttgaagaggggtcaaaaagccagtccacggtggcaggctcatcgctttccaggcgcgcggtaagcgcggcggcggcggtgcagtcgcccatcagcagcacgccgcgcaggcggccatcgcgcagcagcaggcgacgatagtggcggtcgatggggtcccagctggtataaatgtcatcctgttcgccggcctgctgctcgccagcgctaaagagttcaatgccggtgaccttcaggcgggtcccggcatcctgccagacaaagccctcgccgggggcgccgcacaggcgatccgccagcacctcggcctgacgcaggcagggagccaccagcccccaggtctggccgtcaatttcgcaacattcgccgatggcgctgatccccggcagcgaggaggccatctgacggctggctcctaaaacaagctccgagcccacgagaccaacaaggagcgcg

SEQ ID NO: 63 - DNA, 149602 bp, Unknown
  source: /note="Description of Unknown: KP2-Mcoc1 Bacteria Sequence"
acgccggacagcggcatattccccaccggggaccgcaggccgcgctgaccgtcgccggcaccgtcagcggctgggacgaggcgctgcgtatttcacgggacttaaccggccgcgcgctgccggtggcccgcctgttggccgatgcgatcggctatgccgaagacggcattccggtcactgcctcgcaggcccacgccaccgccagcaaactggaagagctgcgccatcagccgggcttcagcgaaacctggctggtcgcgggcgaggccccgcggcccggcagccgcttccgccagcccgccctcgccggtaccctgcgcatgctggccagcgacggtctcgacagcttttatcgcgggccgctggccgagcgtctggcgcagggtatggccacgctggggatgcctgtcaccctcggcgacctgcaggcccaccgcgccaggcgtccggggccgctgacgctccagcaccagcagggaacgctgtggaatcttgcccctcccacgcagggactggtgtcgctggcgatccttggcatcaccgaccgcctgaagatggccgatgccgacgacgcgcaaacggtgcaccgtatcgtcgaagccaccaagcgggcgtttgccctgcgcgatgcgcatatcaccgatccgcgccatctggatgtggatgtacagcagttgctcaccccggaagccctgcagccgctggccgacagcatcgacgacgccagcgcttccccctggggcggcggcaaaggcccgggcgataccgtctggatgggcgtcgtggataacagcggactggcagtgtcgtttattcagagtatctatcacgagttcggcagcggcgtggtactcccggacaccgggatcgtctggcaaaaccgcggggcggccttcagcctcgatccgcagcatctcctggcgctggcccctggcaaacagccattccacaccctcaaccctgccgccgcccgcctgaacgatggccgggtgatggtctatggctcgatgggcggcgacggtcagccgcaaacgcaggcggcgctgtttactcgctatatcctgcagggggtgccgttgcaggagagcatctcccgtccgcgctggcttctgggccgcacctggggccagtcctccgattcactgaagctggagggacgctttgcccccgcctgtatcgcgcgcctgcgcgagctggggcacgacgtagaagtgctggctgatttcagcgaagcgatgggccacgccggcgccattgtccgccatcccaacggcctgcttgaaggggcgaccgatccacgcagcaacggcgccgccgccggatactaaggagcagaccatgaccacacagccagactggagcgagtatctgacgcagatgactcacctgttggatatggagctggatgcgccgcgccgtaaggagctggagcgccagtttgcccgcatcgccgccatggcgcagccgctgatggactatcccctcgggccgcgcgaggagattgcgggggtgtataaagcatgacacttcaacatttcaccatcgccgagatccagcgtgcgctgcacgaaggcgaactgagcgcccgggagatcgcccgccagacgctggacgatatcgcccgcgtgaatccgcagatcaacgcctggaccgaggtcaccgcccagcgcatgctggcggaggccgacagcatcgacgccctgcgccgggaaaagcgccccctgccgccgctggcaggcattccttacgcggtgaaaaatctgtttgatgtcgccgggcacaccaccctcgccggcgccgaactgctgagcgaccggccgccggcagccagcgatagctgggcggtgcgccagctgcacagcgccggcgccctgctcagcgggatgctcaatatggacgcctacgcctatggctttaccaccgaaaacagccactatggcgcgacacgcaacccgcacgatctgtcgcggatcgccggcggatcttccggcggttcggccgcggcggtggcggccggactggtccatttcagcctcggcagcgacaccaacggctcgattcgcgtccccgcgtcgctgtgcgggatctttggcctgaaacccaccttcggtcgcctctcccgctccggcagccatccgtttgtcgccagtctggatcatattggtccctttgcccgtcgggtggccgacctcgccgcggtgtatgacgccctgcagggacgcgacccggccgatgactttcaggccgataaagccagcgagcgcaccggcaacctgctggagcgggggctggaggggctgcgctgcgcgcggctggggggctatttcaccacctggtgcgatgacgacgcccgggcggccatggatcgggtcgcccacgcgctgggcgccgacagcgagctgcagttcgcggatgccgccctggcccgctcggcggcctttatcatcagcgccagcgaaggcggcaatcagtacctgacggatcttcgccactcgcccgagcgctttgaacctcactcccgcgagcggctgctggccggcgcgatgatcccctccgcgtggtatctgcaggctcagcgttttcgccgtcatgctcgccaggcaatgaaatccctgttcagccaggccgacgtgctgatcgccccggccaccccatgcagcgccacgccaataggcgccgaggagatggtgattaacggccagccgctgccggtgcgcgccagcatgggaatgctgacgcagccgatctccttcctcggcctgccggtggtgaccgtgcccctgcgtaccgccagcggcaagccgattggcctgcagctgattgccgcgccgtttaacgaacaagcctgtcttcgcgccgcgcgggcgctggaagcgatgggcattaccgatgcccgagtggcggagagtgcagcatgatcaatctggataatgtagaccgcccggcgatcctcgccgaggtgacggcggcgttttatcagtatgaagaggcgctggtcagcaataacatcgaggcgctggatgcgctgttctggcacgacccgcgcaccgtacggctgggagccggcgaaaatctgtatggcatcgaggcgatccgcgcctttcgcgccgcccgccccgccgccggtctggcccgcgatctgcgccataccaccattaccacctttggtgcggatatggcggtgtgcagcaccgagttcacccgcgagggcagcgcccgcctgggccgccagcagcagacctgggtacgcttcccctacggctggcggattgtcgccgcccaggtcagtctgatggactgagtggcgtatacgggagcggaccggagactaaggtatccaccggcccgcttccggtccggtaacatgctatttggagtcgaagatcatggtgttcatcagagctgctgaagcaaaagatatcccctcgctgcaaacgctatttctgcagctgggctatcagacggagacggcgatcttagcgcaacgcatcactgccccgcagagcatgatgagtgcgctggtggcggaaacggaaaacgccgtgtgtggcgtaatcgttatcaattttattttaccggtacatgagaaccgtttatgggcattaatttccgcgctggtcatcgaggaatcgtcacgtggatcagggataggccagcagcttctccaggccgcagagcgcctcgcccgtgataaacaatgcgctcagatcgagctttcaagtagtgaaaaaagaataagagcgcatcaattttatgaaaataacggctacaaggaggttcgcaaacgcttcgttaaacatttgtcttaaccgcctgcgcgcgagggctttccccggatgaccgtaactatattttgcccagcaggatatttaacatgcggcgcaggggttccgccgccccccacaatagctgatcgccaaccgttaacaccgagtagactgggtcattatttagcgacattttcttgtagcggccaatacctacctgcagcgaaccactaatagcagccggggtcaatttactgacactctcttgcttattattgcggacatagtttacccacggatgggaatgggtgactaactcagcaaattctgcttcgctgacctcacgtttaagtttcagcgtaatcgccgcgctgtgacagcggatcaccccgacccgaatgcataaaccattgaccgggatggtacccggcgcaaggccaagaattttattagtttccgcctcgcccttccattcttcgcggctgtttccatcgcccagatcgctgtcgatccacggaatgatgctgcccatgagggggacgccaaaattctccaccggcatgcccgcgctgttaatcaactcactcactttatttaccaatggcagcacggaacctgatgatgtcagttcatcagcggataaatgctgactgatataagcgctttgcgcgattaattcccgcacctgtttggcgcccgccccggaggcagactggtaggtcatcacgctcatccattcaatcaggtcagccttgatcagcccggccagccccatcaggctcagcgtgatggagcaattgccgccgacaaacagtttcaatcccgcttttaccgcgcgatcgatattatcgcggttgaccgggtcgagaataatgcaggctttttcatccatccgcagcgccgaagcggcgtcaatccagtaaccttgccagccatggttaattaacgccggatagatggctttggtataatccccgccctgacaggtgatgatgatatccatttcggcgagtgcgctaagggaattcgcatctttcagcctgtcgcttttaccattaataaccgggcccggggcacccgcactggaggtactaaaaaaatgcgctgtaatatcgtcgaaatcattttcttcgatcatgcgttgcaacaatactgaacccaccatccctcgccaaccaacaatacccacctgcttcatttatttaacctttataagttatgagaatgttaatttgagtgtcgccataccttatatcgtatcccccaataaaggtcattacccagcacctcgatttttatcattattaaaatgtttcatctgccatcagcgatatttatctcttattacggtcaagcagatataaggcggcggcgactgtccaatattcggcattcaaaggtgaaacggcgtagcgaaacggcagcagcttcttctctgggtactatgaagagtaacttgcattttgatagttactatgtcaatttgctggcaaaagccacctggttactggacagcccatgaaaaatgaaccgctttgccacgctccctgccccatcgcccgcagcctgggccgcatcggcgacagctggagcatcatgatcctgcgcgatgccttcgcgggctttacccgctttgacgagttccagaaaagcagcaacgccgcgcccaatattctgtcgcgccgcctgaaggaactggtcgatgacggactgctggagaaggtgtgctacagcagcaccccgccgcgctacgaataccacctcacgccgcgcggccgcgatttccgcatggtgctgctggcgctggcggaatggggtaatcgccacttcgcccccgaagggcgtcagatgcagctggtggaaatggcaacccagcgccacgtggagccagtcatggtggataaagcgactggggaagagattatcccgggtaaatacgccatggtgccgggccccgccgcctcgccgctgatgaaatatcgtcatgaatatctgctgcgcaaacgcgaaggcgatagcgggcaaaaattccagccggaaccttacagagatgccagcaatgaatccgaccagtaagaaaaatattcttgtcctggcggccctgggcgctgccgccctggcggcagcgagctacggcgcttactggtggcataccgggcgctttatgcagaccaccgatgatgcctatgtcggcggcgacattagcgccatctccagcaaagtctccggctatatccagcagctggcggtgcaggacaatatggcggtgaaaaaaggtgacctgttgatccgcattgacgaccgcgattatcgcgccgccctcgcgaaagccgccggagaagtggcggcgcagcaggccgcgctggccgatatccaggctacccgccagcttcagcaggcgaccattgccggctctgcggcctcgttactggccgccacggcggcaaccgaaaaactggctaacgacaaccgacgctataacgccctggccgcgtcgagcgcgatttccgcacagatccgcgataacgcctccgccgattatcgccgggcgcacgccgagcaggagaaggccaaagcggataaaaccgtggccgaacgtcagctggcggtgctggatgctcgccagcagcaaatcctggctgccctggcgcaggcccaggctaacctcgagatggccaggctgaacctcagctataccgacattcgcgcaccgttcgatggggtgattggcaaccgccgcgcgtggtccggctccttcgtcagcagcggtacgcagctgctctccctggtacccgcgcacggcctgtggattgacgctaacttcaaggaaaaccagctggcgcatatgcgtgccggccagccggtgaccatcgtcgccgatgtgctgccgaaccatacctttaaggggcatgtcgccagcctggcgccggcgaccggctcacgcttcagcattctgccggcggagaacgcgaccgggaatttcactaaaatcgtgcagcgggtgccggtccgcattgcgctggaaggtgacggggcaaagcttgacgtcctgcgcccgggactgtcggtgatcgtcaccgtgaacgaaaagagccctcgatgagcaccgttcaggcgctgtccgccccgcagggtctgtcgatgccgacggcgaagaagatcttcgccttcgccagcatgtgcgtggggatgtttattgcccttatcgacatccagatcgtctccgcctcgctgcgggatattggcggcggcctgtcggcgggcgacgatgaaaccgtctgggtacaaaccagctacctgatcgccgagatcattattatcccgctttccggctggctggcccgggtcatgtcgacccgctggctgtttgccgcttccgcggcgggcttcacgctgatgagcctgctgtgcggctgggcgtggaacatccagagtatgatcgccttccgcgccctgcagggactggcgggcgggtcgatgatccccctggtgttcaccaccgctttcgccttttttcagggcaaacagcgggtcatcgccgcggcgacgatcggcggcctggcctccctcgcccctacgctgggtccaacggtgggcggctggatcaccgaaaactacaactggcactggctgttctttatcaacgttgttccggggatttacatcgcggtggcagtgccgctgctggtaaaagtagacagcgccgaccccactctgctgcgcggcgccgactatctcagtattctgctgctggccttgtccctcggctgcctggaatataccctcgaagaaggtccgcgctggggctggtttgatgacgcgaccctgacgaccaccgcctgggtcgccctgctctgcggcgtggcctttgttatccgcaccctgcgccatccgcagccggtgatggatctccgcgccctgcaggatcgaaccttcagcctcggctgctatttctcgtttatggccggcgtcggcatcttcgccaccatctatttaaccccgctgtatctggggagcgtgcgcggtttcagtgcgctggagatcggcctggcggtattttccaccggtctgttccaggtcatgtctattccgttttattcgtggctcgccaaccgcgtcgatctgcgctggctgctgatggccgggctgatcggctttgcggtgtcaatgtacagctttgttccgatcactcacgactggggggcggaccagttgctgctcccgcaggcctttcgcggactggcgcagcagtttgccgtcgcgccaacggtgaccctgacgctgggcagcctgccgcccgcgcgcctgaagctggcctccgggctgtttaatctgatgcgcaacctcgggggcgccatcagcatcgccctgtgcggcacggtgcttaacgacagaaccaatctgcactacagccgcctggcggaccatctgaataacgccaacctggcaatgagcgattttgttcagcgcagcgcggcaaacttcaccgtccaggggatctcgccggatgccgcgcagacggcggcgctgaaaaatctttccgcactgacgctgcgggaggcgcgaactcaggcattttccgatgctttctacctcatcatgatgggttttttaattgccgcgctgctggttcccttgatgaaaaagccgccggcacactgatactacaggagagttaactatgggcgtttccgttaaacgcattgtcgtcaccgggatggggattgtcagcccgctgggctgcggcgtacagcacgtctggcagtcgctgctggcaggaaagtcagggatcacccgactcagcgagcagctggtcgcggatattccctgcaaagtggccggccaggtgccgtccattgacagcgatccgctgcacggcttcgacccgctggcgaccatcccggcgaaagagcgcaaaaagatggatcgctttattgagtttgcgctggtcgccgcccgcgaagcgctggcccaggccggttggtcgccagcatctgaggccgaacaggaacgtaccgccacggtgatcgccaccgggatcggcgggttcagcgagatcgccaatgcggtacataccaccgatgaacgcgggccgcgtcgtctctcgccgttcactatcccctcttttctggccaacctggccgccgggcatgtgtctatcgcccacggcttccggggccccatcggcgcgccggtcaccgcctgcgcggctggcgctcaggccattggcgatgcagcgcggatgatccgcagcggcgaggcggatattgccctctgcggcggcgcggaagcggcaattcatcgcgttagcctggccgggtttgccgcggcaagggcgctgtccagcgcctacagcgaccagccggaaagcgcttcccgcccctttgaccgtgaccgcgatggttttgtgatgggagaaggcgccgggcttattgtgatcgaatctctggagcacgcgctggcgcgcggggccacgccgctggccgagctggtgggctacggcaccagcgcagatgcttatcacctgaccgcaggcccggaagacgggaacggcgcacgtcgggccatggagatcgctattcgccaggccggggtgaccgtcgacgagattgaccatatcaatgcccacgccacctcgacgcaggtcggtgataaaggtgagctggcggcgattaaaacgctgtttggcgcgcatccggtcgccattacctcgacgaaatccgccaccggccatctgttaggcgcggccggcgggatcgaggccatcttcaccattcaggccctgcgtgaccaggtggtgccgccgacgctgaacctgcatcaccccgatgaagacgcggcaggcatgaacctggtggcgctgcaggcccgcccgcagaagatgcgttatgcgctgtcgaacggttttggctttggcggcgttaacgccagcctgctgctgaaacgctggcaataatcgtcagctcccctgcggtactggccgacgggggatttccaccgttgcggcttttgccctgctgctggagtaaatcaagtacagcgcgatacccagggagacaatggcgcctattcggctcatcgagaatggaatcgacgcattgtccagccagccgaagttatcgatcaaggtcagttttgagcgaagaacggaccacactatctaaagaatgatatcgcctattatgttgggaccgctcatgttaaaaaagggatagcttttcttttcattgacgataacgaaggaattttcatggttgaggttgaggaaataaaaaagaaatatcccggcgcagatgcctggcaaatgggtgacagtccgcaactggctaacgaacttgctgacctgatcaaaaaagggatcaaaacggcctcttgcggatcttttgcctcttaccagcaggaagaatccgccccgagaatcgggagttataacattattcttgatggtcagaatgttccagtttgcgtgatcagactgatttcgatgcagctggttcgtttttgtgatgtcactgaagcgttcgcccgcaaagaaggtgaaggcgatttaagccttgaatactggaagaaagagcatcagagatttttcagctctgaaggtcatttttctgaagatatggagttgatcgcagaagaatttgaagtggttgaggtgctttaaggcaaggtcaacgggctgacgttttatcactggccactcataacactgttcgcttctggcgcggagcggacaagctgtcgagctaaaggtccgcattgagcaaggagctgacgtgccagctataattggtaataaaatgagagtagaactattctgatttgtttaaaaaaacatttttacatccaagggcaaaatattttttatgctatcttacatgctatctcaatatgccaggctacctgtgcctgaagttactctacgttcatggttaaaacaatggttgtcagagcaggaatcgaggtgtacagacagaagtttctcggcgcgatttccctggagagaaactggattatgtcaggaatattttttacaacgaaaactcaaaattgatggaaagcaatttcttactggcccccgttatcagggcggaaatattaacaaaccttttattgatattgtaggtatggattctgacctaaatcatactgcattagaactcattagtaaggaatggtcacaactcagagctcagtatgtccgcattcttgtacccggccagtccttcccgcagggtattcccgaccagtatatatatgccacttctttttctgaaccccctgaattcaatgataaatctcttactttgcaagtggcgacatacgaagattttgactggtgttgtcaggccctgggcgatgcctataagcatacatggcagacagttcgcgaactatctgcaagcaatttggtagcagttgatgacgaagagttgtgtgaccatatttctgagagagaagtatatattatctatgaaaacgatgttcgcgccgggttgctaatatgccagaaaggaaacatcgcttttctgagaggatatcgtattactgacaaagtaatacttcctgcttttcgtggtcgatcattgtcggcccgagcgcaacgcctgctgtaccgattattaactcattccgattcggaactatctttgtatatgggcacaattattccgcagaatatcccctcgatgaaaactgcagaaagagcgggacgaacttgcatcctaagttatcaatttctacccatctgcagaacccacgattaacagcaatgctaatttatcttcagcctacacaggggacgtccagggcccgggagtactcccctggacgcattaatgggcaggatgtgattgttgcgcaggctatcatatggcgtgaggtacagcagaatcaggcttcgtagcaatgaggggctcacagcgtccggaatccacccggtgccgtaaatcaccgtaaggtctgtcataaggtaatttcatcacgcatcgcgacaccttttttcttcatgcaggccttctctttcacggtttgtcagaactgtggaccgcagtaatctccactccgtgctttaatcaatgagagtgtgtcgggtgcaaattaaactacctttctcaacagcaaaggcgggatacccctgccctcgcagggtttctgcgtctggtaatatgcccatgacagtctcaaagaccgctttgagggtttcccggtttaaggcacaaaatcgcgtggcgttgcccccaaaatgcagcgaaaagcagcggtaaaggccgccgggcatgagaaaccaagctggtaagcgacctgtttgattggaacaccgttcgcgagaagatccaacgaagcgcaaattctggctctctgcttccatgttctaaaactaaagcctgtatccttcataaacaatcgggaaaaggtccgttccgacatggccgacataaaagccagctcgctcagcgatgcttcccagcgctgattgaccagtagcgatctggcagcgctgaataatcgctcatcattcggcatgggaagcgccatcgttaaaggtggagcctcgctgagaatttccagaagcaacaacgctatcttccgttgactcggtctggcgtagtcctcactgaacagccctgcgataagctctttgactaagggcgtagccgtgatcacatgcacctgctgactcttcgtaaagctcgtacattctgcgataaggctactgctgaaatagatcgccctgagatcggtttgtgaaagcagatggtaactatggatatgcaaaggcggtagccataatgcccgctgaggagggatcacccaacggtcactctctgtttgcaccagcataacccctctggtggcgaagagtagctgcccctcaacatgatgatggggaggatctgcctcgccgcgttgatagcttatcgcagtactggaccagcctgtggcttcatcatgtcttggcgctttatctatactacctggcatttcagatttagcccctgccattatcatatcgaaactggaaccacccggagtagagccttaggcaatgggtgcgtgacttatcatcctgatcatcaaagatattacaggagcttaacctcatgcgtgtacactttatcgtacatgaaagttttgaagccccgggcgcatatgaaacctgggcaataaaccagggtcatgatgtaacttactcacgcgtctatgcaggcgatcggctacctgatgacgccgtaggcatcgattttcttatcgttatgggcggtccgcaagatcctgacaccacgcttgaagagtgcccgcactttaatgctaaagcggaacaggcgctgattgcttccgcggttaaaaccggtaaggcggtgatcgatatctgcctgggttcacagctaatcggtgaagcgctgggcgcgccgttctctcatagcccggaaaaagagattggtaaattcccgatcacattgaccgaagacggcagtaaggatgagatgttctctcactttgggaaaacactggcagtgggtcactggcataacgatatgccaggtttgacgccagaggctaaaattatcgcttacagcgaaggctgtccccggcagatcgttgcctattcagaccgcgtctttggtttccagtgccacatggagctcacattggacgttgtagaacggctgatcgctcattctgagaaagacctgagccgtgcagcagaatatcgtttcgttgacacgcctgaagcgctccgggcgcacgattacagtgaaatgaaccaagtgctttttgactttctgcataagctggaagcacgttacaaagcagcgcaagcataatgttatgctcggtgagcttgccatcggttttgattttaatgtccgctcctggcacagagcggacaagctatctgagttgaaggtctgatatgagcgatcagcggacgttggctacactgttaaacgtcgcagactcagcttctgactgccagtttttcgcgagttgggccttcaaagtagatgctcctgatatggcaattacggggttgagtcagcacaaagcgaattgcttcccagactgaacgcccattcatcagacgttcccccattttgggctggctatcgacaaacgcctctaaccctgtcagctcgaaatccgggggatacaacccagtcacacgtatattttctttagacaactggtacgaaagtttagttgtaaacccgctaagcccgtgtttactggcaaaaaaagcggggtgcgcaattgaatctgtaaaattaggaatcccacatgaagatataattgagacgatatccgcactttctgaacgtcttaacccgggtagcaatgcctgagtcagcagaatagaacctgtcaggcctgaactgatagtatttatgatttctgtgtctgattgatcgtctaacgttcctgaaagccactgagcagcattgaggattaaaatgtctatgggcttgtctaaagttaacaactgtgaagaaaactgagaaagggattcaggtagggttaaatcacagagatgccctttcgccattccgccttcagccgtaatgatactgcaagttttttgaatgtcatcagcgcgcctcgcgcaaaaatccacctcgacgccttctcgcgctaaccatacgctcagcgcctgaccaaatcccgtgccaccaccggtaattacagctcttttacctctcagcatcttcatccatcctttattaatgaataggggggaatgtagatatatatgaggaagcagattgacatctttcagttagtgccattttttgacgatagggataagttgtactgctacatttccatcgcgctcctgtgggcatgcaacatccgctcctggcactagtctgccgtaaagggcagctttaagggaggagcggacgagctaacgcaggtgaagatccgctgtgagcgaaaagcggatttttgtcgttctgtcatcaaaactggcgacttatattaggatatcgcaatacccctcgccctcaggctacgtctgcttgaattgattgcctcaagaaggcggaggcggctttccgctgattgccgctacgcgcacagcaggcgtaccggtcatttatgtcagcgtcggattccgcaaggggtatccagaggtcagcaaaaacaacactatcttcgcttcgattaaggagaatggagtttttatggctgataacgagagcacggctattcatcctgatgttgctccagcagaaaatgaagtcgtcatcgtcaaacgcagagtcggagctttctcgtttactgaacttgagatgatccttcgtgctcaaggcatcgaaaacctgattcttacgggtgtaactaccagtcgtgtggtgctttccacagtcggacaagcttttgatctggattaccgccttatcgttgtgaatgattattgcgcagatccagatcctgacaccaatatgtttttacttaaaaaagttctacctcaacatgcttttgttaccagttcctctgaaatatcaaaacctgggcataaaactatgaatttctgacgtcaaaaaacgggaggatataaccggggatccccagtcatctgaacgtccgctcctggtggcgatagtcagcatcatgtctggcccaggagaaatctccagaagcgtcagtgcgagaaggaaagtcataaacgtttcgatgaaaggcatcctggtagagtccgaaaacatatttccgctacgttacctccgttcgatgcgggcaagaagcggacgttgtacttcaatcatcatcgatttgaatgacagcaaggtaacggctaatccaggtgacgtaaatgtgtcgcgatcccccagcttagaacggtacagcttccattaatcaactcgaaaacggcgtaactcgcattgggttgtgcatagcggtgaaaatcatccacagatccactttttaatgtcgcaagcacgccctgaatgacctgcccgtgagacacaatacatattgttcgatgatgatgttttttttccagactggataaaaaatgtatcattcgctgcgaagcatctgagagagactcaccccctggcggacaatactctgcatccagggtgaataatgcttctgcggcgtccggattattttgcagcagcgctacggttgtcatgccttcaaactgaccaaaagcctgttctttcagagccggttcagctatcagtgaacaataaaaacgctcagccaggcgctgtcccatttgccaggcccggccaagtggagacgcgtaaacacattctacccggtaatcactctctgcaaacgctgccaataaagctgatgtttgacgctccccacgaagcgtcaatgcgctatcactgtgtccctgaataatattttttacattccattctgtttccgcgtgtcgaaccagtatcacttgcatcattgcagggtcacataagccgttatttgaaatgttatcatctaaaaaccctcctttgatatgcaggcaagttctcagctctcgacgaaaaacaggaacaagcgtagctgataatggttatgttcagcttcagaagtgacgtagttatcgacgttaacgtctgctctggcacagagcgaacgcttccccttgtcgacgcgaaaagcaactctgcccatgcctctatctcagtaaaacctgaatcagctgcacgacgatatacactcccgctaccacctgtatgatccgaaacccccatctcagatagcgccattgatggcgttcgctggcatcagcggcttcaatggcgggatcataacgttttcttttcctggttctgaaggtatcgaatccccacaggacgagaagaatgatgatgatgattttttcaacgataagatggttcacaaagagagactccggtcttctcacggttacaggcagaatagataaaccgcctggatgtagccaccactaaatgtaggggtacctgaaaacgaagccaggccttcctggattatctgtcttatgaccgcgtaaacgcatagcaacgccataaaagcgacattcatttccgacacatgctgcgggagtccccttctccgacgcctcaggctgggtgataaaacgacggcggctgcccggtcacgcggcggaacatggtggcgaaagaggacgcattgtcgtatccaagggataatgccacttcgttcaccggtttgcctgctatcaaccatgccagggcgctcaccacgcaggctcgctgtcgccaggcggaaaacgacaggcccagctgcttcaggaaatggcggcgaaaggtactaggactcataaacagcgccctggcccagcgcgccgcaggatcatggatagaggggttaagcaaaaaagcctgacaaagcgccagcagcgccggatgctgcggcaacggaatgtcaaattcgcggaccggcatggcggccagttccagcaacatcaactgtatcagcgcgcgatcgcgtgggctgtcgtacaacggtggtaaatccacagcctcaagcagtagctggcgcaacagcggcgagacgctgatcacttcgcaacgacggtgtttaatgaaagcggccacacaatctggctcaatatacaagctacgcgtggtcacccctgcaaatctgacggcatgcacggtttcaggggggatccagacagcgtgttgcggaggaaccacccattctccgtcctgcgtagtgacatacatcagtccggtcgcgccatacagcagctgtgcgcgacgatgctggtgcgggggcaggataaacccttgcgcatagtcattacctaacgccaccacatcacgatcgagtcgatcgacctcgtcaatttttacgttgcgcacacctgcctccctctgaccgatttacaaaggtaattgagcgctacgcaaatgggaagcagtacgcgaccggtataagctgctcgctcattttcaggtcggggatactctcttgaatgagatcgttattattgcgctggcaggctttactaccggcattaccacggtgctgttcggcttcggcggcggctttgtggtggtgccctttgtctatcaactgatgctccggcagccggcgatcgcgggcaacgccatgcatgtcgcggtggctacctcaacggcggtgatgatatttaacgccggctgggtcagctatcgaaactggcgggcgggcaggcttaccgcgcagacgctgtttccgttgttatggtttattgccattggggcggtggtaggctcctgtctggcggggatattgagcgagaagatcgttcgcgtgctgtttattctctatatgctggcaaccatcagcgattgtttgttgcgcaagggttttttcacgggcagcgctcggcgtcgcctgtccctgccagtggtcaccggcggcggtgtgattatcggtacgatcgccgcattgctgggcgtgggcggcagcgtcatgacggtgcccctgctacggcgacacgggtatgcaatgcaggagtgcgttagcgcatccaacccgctttctttgcccgtggcgctatgcggggctgtgacctatgccgtcattggctggcacagcattccgctgagcggatttttggggtttatcagcctgaaaattttaggcctgctcgtcctgaccggctgggccgggatagtgtttagccgccgggcaatccctgcggtacctgatgtatggtatgcgcgaatctatgtgctgctgctgtgcctggtactcctcgccatgcttattcaataatcaaattacattctggtgaaccggtgcaacagacgcggccgggcggagccctctccctggagagagggccaggttcaggggcaacaagctacccgcgatacggatgggtttcgcgccagtggtcggcaatctgctgccgggtgcagacccacaccttgtcgtgctgctggatatagtcaaggaaacgctgcagcgcgcggaaacggcccggacgccccagcagccggcagtgcatccccacggacatcatcttcggcgcggtttctccctcggcgtacagcacgtcaaagctgtctttcagataggtataaaactgctccgcggtgttgaatccctgggcggtggcgaagcgcatgtcgttggcgtcgagggtataaggcacgatcaggtgcggccgctggctgccgtcgctgcaggccacttcgctccagaaaggtaaatcatcgccgtaataatcgctgtcgtagtcaaagccgccgtgctccaccaccagctggcgggtgttagggctgtcgcggccggtataccagccggtgggcggtttgccgaacaggtcggtcagtacctgcaccgctttttgcagatgcgcgcgctcctcggcgatatccatgtgctgatagtggatccagcgccagccgtggctgaccacatcgtaatccgcggccttgattgccgccacaatctccgggtgccgcgccagcgccatcgccacgccgaaaacggtcaacggcagcccgcgctggctgaactcacgatggatgcgccagaaccctgcccggctgccgtactcatagagtgaatccatcgacatatggcgcgccgggtagctggcggcgccgataatatcggacaggaactgttccgaacccgcatcgccatgcaggacgtgattctccgcgccttcctcatagttgaggacgaactgcaccgcgatccgcgccccacccggccagcgcgcgtgcggcggctcccctgcgtaacctcgcagatcgcgaggatagtgttcctggttctctcccatctcctgccccttttaaaatggatttaacgactgaaactgtccgcttaacgcttttttctccgggaacgctaagtccccatgcttgctggtcgccaggcccagcgcgaccagagactccaccatcttcaccgccgcgctgacaccatcgatcaccggcacccgcagctcgcgggtcagctcctgcgccagggtcgccatcccgccgcagccaagaacaatcgccccgctaccatcctctttcagcgcgcgaaggcagcgctcacgcactttctcctgcgccaggccactgccgtcttccagcgccagcaccggcaaatcaatggcgtgcagcgccgcgcaatgttgatgaaatccgtactggtgcagcaaatgacgggcgatgatcagcgtgcgcggcagcgtggtcacaatggagaaacgggtggcgaccatcgtcgccatatgcattgccgcctccgcgataccgatcaccggcccctgggccagctcccgcgccgccagcagccccgggtcgccgaagcaggcgatcacatgcccatccactccctgctcgcgtccggccctgatctgctccagcacgccgaccgccgcgatggcttcgtcaaagtggccctcaattgacggcaccccggcgcggggacagaccgcaaggatctcggtgcccggcgcagcgaccgcacgcgcggcggcgcctatcgtttcggtcatcgccaggctggtgttggggttaatcacttgtatacgaacggaagacatcacgactccttgtggccggcgaacagccgggaaaaatcgggcaggctgacgccatcgcgctcgaagcacaggctggcgacaatatgatcaaaatggtgcatcagcgcctcgctgagcggctgcagggctttatcccgcagcaaaccgaccagctgctggtgatcgtcgcaacggcagccctgtcgccagggggcgccccaggcggcaatcactaaagaggagcgctggctgaggcgggtcaccatctcggtgagcaccgggttgccggagatagcctgcagctgaatatgaaagtcagcggagtggcggatcgccgccgggccgtcgtgcgtcgcatgggcctgctgttcacgctgaataatgttctccagcgccgccagatgcggcggctgacagcgcgcgatcacatcggggagattggcgacctcgagcagcgcccgggtgcgaaagatcgcctgggactcttccacgctcgggctggtgacgtgtgcaccacgtttgggcgtcaacgtgaccagttgcacagcggcgagtcgttgcagcacctttctgatgccggtgcggctcacggcgaacacctccgctagcgcctcttccggcagtttgctgcccggcggcagctgatgttcgacgatagccgtcatcagcgcctggtaaatgctttcgtccttgtcctgcagcgctggcgcggcctggagacgatgttcattattcattaacccactccggtttcacttatcgatagcagatcgtatacataaaatttattttttgtatacaagattcatcattctggcctggatcctgcaatagcctcagcaatccatatcaaagggttttcattcagaggagcaggtttcatgccacattcatcccacacgcagcagacgaagactcacgaggcggccgccggctacagtccgcggctatgtaatgacgatctggcgccgacccgcgaccagaactggagctggtacaatatcttttcattctggatgtcggacgtgcacagcatgggcggctacgtagtggcggcgagcttctttacgcttgggctggccagctggcaggttctgctctgcctgctggtgggcatctgtattgtccagctgtgcgccaacctggtggcgaagccgagccagatggccggggtgccttacgcggtgatttgtcgtcaggcgtttggcgttttcggcgccaatatcccggcggtgatccgcggactgatcgcctttgcctggtacggcattcagacctatctggcggcgaatgccctgatgctggtcctgctcaagttctggccctcccttgcctcgctgaccagcagcagctttctcgggctgtcgcccctaggctggctgagcttcgccactatgtggctgctgcaggcgatggtgttctggcatggcatgaacgccatcaaacgctttatcgatatcgccggtccggcggtttatgtggtgatgctggcgctggccggctggattgtatacaagaccggtctggatgggatctcctttaccctcgccagcaaatccctgagcgccggcgagcagacctggcagatgatcaccgccacggcgctggtggtctcctacttctccgggccgctgcttaacttcggtgacttttcccgctacggcaaaagcatgggcgagatccgccgcggtaaccgctggggactgccgtttaacttcctgctattctcggtggtgaccgtggtgattgtctccggcacccagtcgctgttcggcaaaatgatcaccgacccgatcgaaaccgtcagccgcgtgggtaacgatctggcggtggccatcggcctgctgaccatgatcaccgccaccatcggcatcaatatcgtggctaacttcgtctcgccggccttcgatttttccaactgcgcgccgcagaaaatcagcttccgtaccggcgggatgattgccgcggtgggctcgatactcctgacgccgtggaacctgtttaactcgccggagctgatccactataccctcgacgtgctgggcgcctttattggcccgctgtttggcatcctgatcgccgacttttacctgatcaaacgcggccgggtgtcagtggacgatctgtttgacgatacgccgcagggtaaatactggtaccgcaacggctttaacccgaaagcgattgccgccctgctgccgtcggtgggccttgggctgattatcagctttattccgaccctgcatgaagtggcgaacttcagctggtttatcggcgtctttctcggcgccaccgcctaccgctggctggctcgcgacgagcgtgaagtgcaggcgaaagccgccttccgctccggcgcggtggcgcaaaaagagtaaccttccccttctgccgcggcgtctggccgcggcaggctgcaaactggcaccaatcttgctgtttatcactattcccagagcgttaagagaaggcaggttcgatgatggattaccagaccgcggtgcgcggtgcattttttgatatcgccggcgtggcggagaccccggatgaggtggccgcccaggctcgctatctcgatgatggcctgttgtttctgcaggaggggaaaattatcgccctgctgccatggctggagggtgaagcctttctgcatccgctgaagggctatgtcgacctgcggggcaagctgctgttgccgggttttgtcgatacccacattcactatccgcagaccgagatgatcggcgcctttggcgaacagctgctggagtggctcaccacctacaccttcccggtggagagccagtttgccgatgcggagtatgcccaggagatagcgcagttttttgtaaatcagctgataagccatggcaccaccaccgcgctggtgttttgtaccctgcatccggcatcggtggaggcgttattcagcgaagcgctgcgcctcaatatgcgcctgatcgccgggaaagtgatgatggatcgccatgtgcccgactacctgtgcgaaaccgccggggagagctacgagcagacccgggcgttgatccgccgctggcatcagcgcggcaggctgggctatgccatcaccccgcgctttgcccccacctcgactccggcgttgctggaggcggtgcagcgcctgcgggccgagtttcccgacacctggctgcagacgcatctcagtgaaaaccgggaggagatcgcctgggttaaacagctgtggcctgagcatgcgcgctatctggatgtctatcatcactatcagctcaccggcgaacgcagcgtcttcgctcacgggatccatctcgatgatgccgagtggcaatgcctgcatgacaccgggtccgccgtcgccttctgcccgacgtcgaatctgtttctcggcagcgggctgttccgcctgcccgcctgctggcagcaccaggtgcggatgggcatcggcagcgacgtcggagccgggaccaccttcagcatgctgcggacgctgggcgaggcctacaaggtaggacaactgcagagctatcgcctgcgcgccagcgaggccttctatcacgccaccctcggcggggcgcgcgccctgcggctggaggagaaaattggcaatttccagccgggcaaagaggcggattttgtggtgattgacccggcggtcaccccgctgcagcgcctgcgcataggccgctgccatgacatttatgagcagctgttcgtgctgatgaccctgggtgatgaacgcaatatcagcgagacgtgggtgaacggcgagcgggtgtggtgtcaggattgacccgtttgagaagcggaaacaaccttcggtaagacaagaaatcagcaccaagccctaaaggatcttaaaagatccttcagggggattaggctggttaccagttaccgtaagggtagtgcttccctttgataaaatctataatatctttgtcatatccataagaaaaatcgctccttgttatatctttacaaatatctaatttattacctgatacggttttcaggactgacggagtgacgcggtaattagattcagatccacttccctgtaaccagacggccacttttccttctggagccagaccaatttgcattctgtcgtaccaggcaatacgtccccgataatccttatatttactcggcataagcatctgttccagtaccgatttagggatcgtcaaatgggtttcatacacttttttatcaataatcgagtcccagcaaaaaataatatgtcgtggagggcgctttacgtgattccagtaccctaccggcgcacggtctttgtcgttccactcgccgatcacgccaggcagatcgggtgtgctattcagcgtgttaaagcgatagtcatttccatcaacgtcaagaatagcggcaaacgtcaccacggcgggtaacgctttgggtgtgaaaaagttaaaactccactctgttggcgcatcactatgcatggcggtgttgggcaaaggttttccctgacaggcagccagcgccaataatggaagcagacaggccgcacgtattatttccatattttatttccgtccatatcgtaaacggtacgctgccagcggtcatcaggccggttggtgaatgtcaccagcttcgccggtttgaccgcaccgctgataataccccgactgtctcgtataacgctgttccagttggccgagcagtggatatatttttcggccaacatccgcaattccggtgtggtaaagcctggggcagacttaccactccttatggctcggcccatcgcaatcgctttttcacacaaaccgttcagttcttgcctaagctttaagtgtgcatttgtatctcgaataggttcaaacaccgccccggcatcctgggccgcatcgatcatcacccgcaataccacttttgaccagtcgttgaaagtcggacggttgataaccagagctgctccactgcgtttctgtagcgtgccgtaacggtcagctggcattctgtcgtcatgccaggtatcgacgctcacctctaccgcatttagcagtagagctattgccggatagccgtccatggttttaagttttgcacaggtctgccggtaaatacgcgtttccgtatccgggatggaaaaggggacggtttcaaactctggtcgggtaaggaaataagcttcattctcgttgggattatagccgccaccaatgtcggagtgcgcaccgggtagcgccagctccggccacgctggctttacgctgttcaatgcaaagttaaaacgacattcatgctgcgcggtgatgtgaaaaaccttctccgctacacctggacgtagcgccagattgacatctcctgtgtctgcgctgtgcgggttaaagccgttaaccggggtgccgatcgccgccacggtatcaaatatgcccagaaagcgggttttaccacccggtgcaccggagaattcaataccattcaaaccggctctaatcgccgtgataatgtcacggtcctgactgaatacccgattggcaaagtgccgtgccgcaccagccccgcgactgaaaccgaatatatcaaattgtatctctttgatggtgcaggaaccatcgcttgcatgctgaagtaaatattcctgaataccgacagtcagagctgcaactgccttatcggtttttctcaccacaccggtatcgcctcgaccagtacccattccgtaagtattgtcgccagctccgtcttccgtgccaataccttcaacataaatggcgtgctggcctgctccgctatcgggtcggatatcctgcctgtacaatatatacaaccagtgcacattgctataatagccaatatagctccctgcggcagtaccactatagccatgctttagtcgcacgcactgagagtacgccgttaccgcatcggcgtcattcatcccgaaatgttcgccggaacaggcggcctgacggtcaccgctattattcgcattgtttccggttccatcaaaaaacacaccgatggttagtgtgatttcccgttttttctttgcggcctgcgcacgctgttcaggctcgggctgttggttttttttcttcgccgtttccgcccgttcagctacccgcccggcattgcagtccctatcgtaggagtgagaaaagacggtcgggacgaaccgagcacgacacgggcaagagctgtagctgtccagtgagccagcccattctttcagggatccaccgacatcgtaggtgtcacccattcccccacagacgcgaaatcgcccctcgtgcttaccgcaggtcaccggatcgcccaccctgacctgttgccgctcaatgccgccaatgtggtaagtgtcatcaggcgcacccgaaagtatgcgtcccccacaggtggttttatccaggtgatacagaaagaatcccttcgccataatccctcacgaatgtaatggttataaaatcaacgcatcataccctgaagcatggctaagtcgaaattacctgtttctgattattgttaccgcgcctgaattggcccatttgcaggactatcaaaaactcattgccaggcctacaccatagcctgtggtgttattgccgaacatatagcgcgccaccagccgggtgcgggtgataaagaccgggtatttactgctgtccagctcgaggccaacccccaaggaggtcaaaccggtaaagcccagcgcccctcgctgctcgccgagaaattcagtatgcgccccctccagcacataacgcagtgggttgcccagcagcgtccagtcggctatcggcgcgcggcggcgcagatacaggccgagattctccgcgctggcctcgccctgcaccacctcggcgctactgccgaaactttgcagatgcatataggagtaacgcagttcggcatcaatatcctgggtggcagagaagcgttcgtaatccagcatcagtgccccgcccagcccccaggcgttgaaccgaccgccgtcgagaaattgcagatcggcgttggtttttcgctcaattgcccagctaccaatacgcgcatcgctggccagggtaccgagcatcacattgacgatcggccgcagcaccaggttgcctccgaggctgtcccggtgcagcgaaaaatcccaaccgacgccgccggtggtggtcagactgttccatttggtcggcacattccgcgtctgttcgccattgctgaccacaaagcgcgggtcgtaacggctgtaacccatcgtaccttcaaggtacagaggaaacgactcgctgagggttgccccgccgccaaactgggtgatggccagattatgtttgtcgttgctgccggaaccaatgttgagatcgctggcggtcacgtcagggacgacggtatagctcatcagagtcaatacggcatcggcacgctgtttgatggcgtggccgttcgccgccagcgtcgctggcgcggaaagcgaaagtaccgacaggagaacgaaaagacgcaccatatgtcgtttgccacctcagcgacaggctaacaatattgccacctaaatcagcaggctggcgttcactcagtatagtcggtgagtcaacctgcgcgtccggcggggagaaaaagcatcgggctggtcaggccgcgcctccgcggctatgcagcagttccacattttcaaaaggcatgcgcgtcacccgattacgcccatcattttttgccgcatacagcgctttatcgacgcgggaaaacagttgttcaaccgtttcgccgtcatgatgttcagccacgccgatgctgacggtcaccgacagcgtctggtattcgctaaccgcctggcggatcccctccgccagtatcagcgcgcggccgatcggcgaatggggcaaaaaaagcagaaactcttctccaccccagcgataaattttatcttcgcggtcgaccgacgtttccagaatacgagagagcaccagcaggacctcatcgcctttttgatggccgtgaatatcattaatgctcttgaaatgatcgatatcgattaacagcagacaataaccccgggggataaaagttggcgcctcaaccagacggtgaaactcccggcgattaagcaagccggttaacggatcgtgggcggcggaaaattccagctcttttttcagatgcacttcttcggtgatatcgtgaatgatgcatagcatcagtcgaatattatacagcaccaccggcccggcataagtttggacatgacgtagcgagccgtcagccagaatatgcgtaaaattaagcggtttgtgaccgccaggcagattggcaatattattcataatggggatgacgtcccggcccagggtatttatttgccaggtatgtttggtgcgcatttcctcatcggaataatgataaaaacgtagcgcggcaatattggcatcgacaatccggccatctttatgagggtcgatcaacagcatcggcgcggtattggtcataaaaaagcgagcgaaaaagccattgttacgccgctggtagcggcgggagccggtatgaatcgactgattttgcgccagcagcttcacggcttcaaacagcagcaagcaaccacagtcttcggtatcaatcagggtggttttgcaatacaccgactgcaacccattggcggtgggtaacgtccagacttcgaatatctcgctcatggtgtcgagatagcgaaggtagtgctgcagttgcgtttccggacaggtggaataaataccgttacgcatctcattgagcgacatctcgccgctcaatgtccgggaagcctgattggcatagaccaccctttcgttaaaaggatgaactacccatatcggggtgcttaagacctcaaaaacagccagctcttttaataacatacaggccccaaaccgacccactgccggcgcggaacggcacttaacgctgtgcagccccaacgctggtttaaagtgaaagcaaaatagacaccgagaaaccgcaattacgcgcgagcgcgccaagtatagtcggttatgcgcccagtaaagccctctgagggtgactttgcgcgcagtttaaccaacagaagcgatgctgcctttaataataattttatttcaacagcatagcagcaatgccagaacgggtagtcgcttttgatcacagagtgtgcatcgccaacaggggttacccggcaggcacagcggcatagtccagggcgggcagagagtcgcttttctgcccaggctaaccgtgatagtttctatcattacgctcattcatagcgacaattgccttgaaaaaaatcgccactaaagtcacccttgccgacattgcgcgtgaagcgcgcgtcggcgtagccaccgtcgaccgggtgctcaataagcgcgcggcggtgaaagagtccacggcgcggcgcgtgctggaggccgcccgccggctgggttttaccctcgagcagccccactatcgcctggctgccggcaaagcgccggtcacgatcagaatgggctttatcctgctgcaggagagccactccttctacctgccgttggcccgggcgctgacgcgcgaggctgccccatggctaccggcgggccaggcgccggtgatactgcattttgccatcgatgcggtggaagcgatggctcaggccattcaccgactcagcgatgaagtggaggtgctcggcctggtggcgctggatcacccgctgattcgccacgcggtggcccgggccgccgcccgcggcgtgcgcgtgttcaccctgctttccgatctgtcggtcccccagcgcagcgggtatatcggcctcgataatcataaagccgggcgcacagccgcctggtttatcgagcgcttatgccgggggaatggcgaaattggcattatcattggcgataatcgttttacctgccaggaaagctgtgagatcagctttcgctcctgcctgcgagaacagggcaaggggcaacagatccttgagccggttcgcagtcatgaacgggcggatatcgccaggaccgtgacggaacagatgctgactcagtacccggccctgcaggcgatctacgccccctgcggcggcgtcgaagggatcgtcgacgcgctgcgcgacagcggccgtcagcaggagatcgctctggtctgccacggtccgctcagcgacagtgaactggccctgatcgatggcaccatcgacatcatgcttaaccaccggctggatgagtttgccgccgttacgctgcgcgccatggcggacgctgcttcacgcccccatagcgaggtgatttcactccctcagcctttcgatatcatcaccaaagaaaatatgtaaattttcggctccgtctccagcggagacggttatcgggcggaccgcgccacctctcgacttgataaaaaattatcaaaaaatccatcaattaaaatcatgatgattatcataaaatcaaaattccatcattgttgataatgaaatctttattcaatactcagcggcatcccttgtatgaaaaaggaagccgacatgatacatcctatcgctaacgccccctgcagctggggcgtcgatgacccgaaaaaccctaacctccctgcctgggctaccgtgcttaaggaggcggcgcaggctggctatcgcagcattgagctcggcccctggggttatctccccaccgatccggccagcctgcgtgcggcgctggagcagcatcagctgtcgctggtcgccggcacgatctttgacgatctggtgagcgaggcccatttccccaccctggtggcgctgacccatcaaatctgccgcaatctgtcgcaggtagccgctgccgaaccgatcccgggccgccctttccagccgccctatctggtgattatcgacttcggcaaccccgaacgggcgcgctttgccgggcgcggcgcgctggctccgcgcctcaatgacaaagactggcagcgcatgatggagcacattatcgcccttagcaccctcgcctggcaggagtacggtgtgcgggcggttatccatccgcacgccgggggcagcattgaattcgcggatgagatcgagcggctggccaacgatatcccgcacgacgtcgccgggttgtgtctggacaccggacatctctattacgccgggatggatccgctcgactggctggatcgctattaccaccgcctggactatctgcacttcaaggatgtcgacccgcaggtttatcagcgcgctatccatgaaggtatcgacttcttcactgcctgcgccgaaggggtgatgtgcccgctcggcagcggcgccattgactatccggctatcaaagactttcttgcccgccgggggtatcagggctggataaccattgaacaagagcgcgacccgcgccatgccgcaggcagcctgcaggcggtcacggaaagtctgcgctatctgcgcgacgtcggattctgacaggaggcacgacatgattaacggtttaaaacctctcgaccgcaccctgcgctggggcatggtcggcggcggcggcagcagccagatcggctatattcaccgctctgcagcgctgcgcgatcacaccttcacgctgcaggccggcgcctttgatattgatgccgagcgcggacgccagttcggccaacggctgggggtggatcccgaccgctgttacgccgactatcaaagcctgttccgcagcgaggctgcccggcctgacggcattcaggcggtgtcagttgccacgccaaataacacccactatgccatctgccgggccgcgctggaggccggactgcacgtggtgtgcgaaaagccgctgtgcttcagcagcgaggaagctgacgagctggtggcgctcagccagcgacggcgcaagattatcggggtgacctacggctatgccggccaccagctgatcctgcaggcccggcagatgatcgccgacgggctgctgggtgatatccgtatcgttaatatgcagtttgcccacggttttcacgcccagccggtggaacaggaaaacgccagtacccgctggcgggtcgatccccgcttcgtcggccccagctatgtgctgggcgacctggccacccatccgctgtttctggtcgaaaccatggccccgcagctgaagatcacccggctgatgtgcgccagacaaagcttcgtcaaaagccgcgcgccgctggaagataacgcccatgtactgatggagtatgacaacggggccatcggctcactgtggagctccgccgtcaactgcggttcgatgcacgggcaaaaggtgcgaatcatcggtgaaaaagccagtctcgaatggtgggatgaacagcccaaccagctacgctacgaaatccagggcgaacccgtgcgcatcctcgagcgcggtatggactatctcgatccgctggcgcgtcaggatgatcgcatcggcggcggccatcccgagggcctgtttgaggcatggtcgaatctctatcgccgcttcgccatcgccatggatgccgccgaccgtcgcgacgaggcgctgctggccgacttctggtacccggacgcccgcgccggggcgttcggcgtccgctgggtggaaaactgcgtgcgttctgccgacaacggtgcctgctgggtcgacttccgctaactcgccggctcagggcgttcgtcctgagcctttacggctatttttctgtccgcgccagctgggttttatccgcctcatgggcgcggtccgccagcccctggaacgctccggcgccatagtattgcgcgggaaccggcaatgcctgcatatcgtgccctggatagatctgcagttcgccgaggtcgcataagcggaatcccccgacctgctccggcatggtcaggcgatacggcggcatggtttcgaatgggaccggcgtcggcagccggttttcctgtagatcgtagttacgcttcagtaccagaaacttatccggcacccgccggtgactgttccaccagtcgccgtcgatctgctgaaacatcgcttccgtctcaccgcgcgtcgccaccagcagccgggtcagcacttgtttcagcgccgcatccatggcctggttataatcctccagcgaaccgccgtggccgctgaggatgacattaatcgccagcctcgcgcccagtaaattggagtagagatcctcgggcgaaaaagcggaaatctcttcggaaaacccggggaccgactggaagccataccactgggcgatctcatgccactgggcgatttcgaaggccagatgcccggcgagccaggccgccagctgatagcgctgcctaacgcccgcctgcggcgtaaaggcattcagctgcacgcggcgcacgcccagttcttcactgtagaagatccgccccgcctggcccagcgtcggcgcaatacgattgaacagataaaaggtgttgtccgccgtatcgcgcacatgggcgatatcaataaacccgccgcggcgggtatagataagcccgttctgctcctcgctgagccccagcagatttttcaccgcaccgaacgcgctgtcgttgtaatggtgcttacccagcgtacccagagtcaacacattaccgatctggtacatcgggatcggaatgcccgccgcgcgcacgtgcaggtcgtaaccaaaagcgcagcacggtcgcagcgactccggcggcggcagctcaccgagggtgggcgccgtatggatcgccgtcacggcgggtagcaccggatcctgcgccagcgccggcagcgccagcgcgaataatagccagaaggctttacgcatcaacagcctctccacagcaataaaagtgcgcgcatcttaccggcagatagcgcctgcggttttagttaaaaacggtattcagcgccgacaacgaaactattgcgcgcgtaaaagccgctcttccgttcgtcgcggcccggtggttagtagttcttgcgcggaaaagcgctggctatcccccattaccatcatcctgcggcaaggtggcgcggtgattgtattcaaaaggtgaatgtcgtataacatagcgctaccgaggggtgtcccgtgagggctgagatggcgcaagccgaaccctttgaacctgatctgggtcatgccagcgaagggacgggtcggcaattttgccagcattaccgccattgcctgttcacacccctgcacgcccggatctcccctgaataaatggaggtcctgtgatcgttcccgcttttagccaaggtctttacggccgtttacgccagctggccgccgctgactggcagcgctatgtggcgcatcctttcgtccagcaacttgcctctgggacgctggcggaaaacgcctttcgtcgctatctgacccaggattatctgtttctgattcactttgcccgcagctacgcgctgctggtgagtaaactgcgcacgctgccggagatgcgggccgcggccgcctcgatgaatgccatcctcaacgaactgccgctgcacgtcggctactgtgcccagtgggggattagcgaaccggagatggccgcccaacctgaagcccccgaaactctcaactatacccgctatgtgctggatattggccactcgggtgacgcgctggatctgctggtcgccctgatgccctgcgtcgcgggctacgccgaaatcggtctcgacctgctgcagcatcccgccacccgactggacgataacccctacgcctcatggatccgcaactatggcgatgaaggctatctgcagggcgtcagcgccgcgctggcgctgttggaaacggtgtggcagcagcgcgggagcgaggcgcgaatcactgagctgagcgagattttcaccaccgccacccgccttgaggcgcagttctggcagatgggcctcaacgccgcggcggagacccgggcgtgacggcgccgggtattgaggtccgtggcctgagcctgcatgtcggcgaccgtcggctgttcgacaacctgtcgtttacggtccccggcgggcagtgggtgtcgctgctcggcgccagcggcgccggcaaaaccagcctgctgcgggtgatggccggtctggcgcccgccacccgcggagaagtggtcgccagcgatgggcaaccgattcagggccgtctggcgtggatggggcagaaagatctgctctacccctggctgagcgttagggacaacgtcgccctcggcgcgcggctgcgcggtgaaaaagtcgatcgtgcccgggtcgccgccctgcttgaacaggttgagctttcatcctgcgccgacgcccgcccggcgactctctccggcggcatgcgtcagcgcgccgcgctggcgcgcacgctgtatgaggatcgccccatcgtgctgatggatgagcctttctcggcgctggataccctcacccgtacgcgcattcagaccctggcggccaccctgctggccggtcgcacggtggtgcttatcacccacgatccgcaggaggcctgccggttgagccaccgcctgctggtcctctcggcggccgacggcgacattgatgatagccatcacctcgccggcacacctccgcgcgcgccggacgcgcccgatctcctgatcggccaggccgccctgctgcagcagctgatgagggcccaaccatgactggacgtctctggcgaggaggtatggtgttcggcgggctgatgcttctctggggtctggccagccgcagcggcattccccattttcttttaccctccccgctggcggtcgccgaggcgctttgggttaatcgcgcctatctcggctggcatacgcttatcacgctcagtgagatcctgagcggcctggcgctgggcgtgacgctcggcgtcaccctggcgctgggcatgatcctctccccccgtctgcagcgctggctgatgccgctggtgctcaccagtcaggcgatcccggtctttgccctcgccccgctgctggtgctgtggctgggctttggcatgagcgccaaagtggcgatggcggtgctggtgattttctttccggtgacttccgccttctttgatggcttgcggcgggtcaaccaggagtatctcgacctggcgcgcagcatgaatgcctccttcggcgctcaactgcgacatgtccgcctgatggccgccctgccggcgctgggctctggcctgcgcatggcggcggcggtggcgcccattggcgcgatcatcggcgaatgggtcggctccgccgaggggctgggctacgtcatgctcaacgccaatgcgcgactgcaaaccgatatctgcttcgccgcgctgtttattttagtactactgaccctcctgctgtggctggcggtagataccctgctacaccggctgatcgactggtcgccggaataagaatgacgtaataaaggaaaacagatgaaaaagtcgctattcgtcggggcaaccttgacggccctgttcagcggccacgcgctggccaatgaaccgctgacgctggtgctggactggtacattaatcccgaccatgcgccgattatggtggccgagcagatcggcgcctttaaggcccaggggctggacgtcaggatagtccccccttccgatcccgcgctgcctccgcgcatggtggccgcccgtcaagcggatctggccatcacctaccagccgcaggtgcacttctttgctgacgaagggttaccgctggtgcgtgtagggactctgattaattcgccgctgaatacggttatcgccctggataagcagatcaaaaccccggcagatctgcaaggcaagaaggtgggctactcggtcagcggcattgagcaggccaccctggcgaccatggcgcaacatgcggggatcgatccggccagcatcaaactggtgaacgtcaatttccagctgaccagcgccctgctggccggccaggtggacgcggttatcggcggctatcgtaatatagaagcgcaggagctgaagctgcagggcaaaacgccggtagtgatgaacgtcgaagattacggcgtgccggcctatgacgagctggtgattgtcgcccatcgcgacgcaattcatgaggcgaagatccgtaaattcctcaccgccctgcaggcgggagtgggctatctgcgcgcccatccgcagaagagctgggaggcgttcgccgccgcccacccggagcttaggaccgaactcaaccaccaggcgtggttgcaaaccgtgcccctgttcgccaccgatccggcagcgctggataaagcgcgctacgagacttacgaacagtttttatataacaataagttggtgaaaaaagttacacctttaacaaattatgcggtggaactgcattgagtcttgctatcgctgacggaaggcattccgtcagcgctttaacgtagcggcaataaaaatatagagactttctcactaataattacactttaaagggttatagtgacagagtgttgttctattataattcagcacgttacgttaattttgcccctggtaagaataacgtcaaaatagcgcaatcaataaaacgttgaatgcggatttaaaaagccatatattgtgcgcgctttatgaatgccaattcaatttcttacaccaattattcaaccagcgttcaaccgcaatgctggttgtgggagtgatatgatgacggataaagtccgtattgatactttacgtgccgatttattagacgcaaacaacgaaacctttttggcccgtcaggccgaattcgaatcgaatgtcaggagttacccgcgtaagctgccgctggctatcactaaagccgaaggcgtgtggctgacggatgcggataacaaacagtacctggactgcctcgcgggcgccggtactctcgctctgggccacaaccaccctgatgtattgcagagcatccaaagtgtcattaccagcggcttgccgttacatactctcgatcttaccaccccgttaaaagatcgcttctccgaatacctgctctcttgcctgccgggcgaagggaaagaatattgcctgcagttcaccggcccgtccggcgctgacgccgtggaagccgcgctgaagctggcgaaaaaatacaccggtcgtaccgcggtgatcagcttctccggcggctatcacgggatgacccacggcgcgctgtccgtcaccggcaacctgtcgccgaaagcggcggttaacggcatgatgccggaagtccagttcatgccttacccgcacctgtatcgttgcccgctgggcatcggcggcgaagccggcgtgaaagccctgacctactacttcgaaaacctgatcaacgatgtggagagcggcgtccgtaaaccggcggcggtgatccttgaagccgttcagggcgaaggcggtgtgaacccggcgccggtcgagtggctgcagcgcatccgcaaagtgaccgaagagcacggcattctgctgatcgtcgatgaagtgcaggctggctttgcccgtaccggtaaattcttcgccttcgagcacgccggtattcagccggacatcatcgtgatgtcgaaagcggttggcggcgggctgccgctggcggtgctgggcattaaaaagcagttcgacgcctgggaaccgggtcaccacaccggcaccttccgcggcaaccagctggcgatggccaccggcctgaccaccctgcgtcatctgcgcgacaacaagatcgccgacaaagtcgccgcccagggcgagtggctgaaaggtaaactggccgagctgcagaaacgctacccggtgattggccacgttcgcggtctcggtctgatgatcggtatcgaaatcgtcaagccgaacgaagcgcaggatcacatgggctgctacccggctgacggcgaactctctgccctgctgcagaagaaatgcttcgaagcgggcctgatcctcgagcgtggcggtcgtcacggctgcgtgctgcgcctgctgccgtccctgctgatcagcgacgcggagctggacgtgttcctcgacaaatttgaacaggccctgctggccgccggcgtaaaaccggtctgagtggagtaagtgactgccatgtccacattgaatccgattcttgctggttcagcgcagagcgttgaagcctatcagcaggttatcgagcagaccagccaggccgttgtgcagtggctgaagcaacctgagatgtatcaggggaaaagcgttgacgagctgcgtgagcgtatctccctagaatttaacgaacagggtttgggtaaccaggcggcgattgatcgtgcgatcgagtacttcctgaaagacagcctgtcggtgcatcacccgcagtgcgtggcgcacctgcactgcccgagcctggtgattagccaggcggcggaagtgctgattaacgccaccaaccagagcatggactcctgggatcagagcccgtcggcaaccattatcgagatgaagctgatcgaatggctgcgcgcccgggtcggttttccggcgggcgacgccggcgtcttcaccagcggcggcacccagagcaacctgatgggcctgatgctggcgcgcgacgccttcttcgcccgtcagggccactccatccagcaggacgggctgccgggggatatccgcaagtacaaagtcttgtgctcggaaaacgcccacttctcggtgcagaagaacatggcgctgatgggcctcggctaccgctcggtaacgctggtgaaaaccgacgaattcgcgcggatggacgtgtccgacctgcaggcgaagattgcgcaagcgcaggctaacggcgagcagatcatggcgatcgtggccaccgccggcaccaccgacgcaggcgctatcgacccgctgcgcgacatcgccggtatcgctgcggaacatcagatctggctgcacgttgacgcagcctggggcggcgccctgctgctgtctgagcagtatcgcgactaccttgacggtctggagctggtggattccgttaccttggacttccataagcagttcttccagaccatcagctgcggcgcattcctgctgaaggacgcgcgccattacgagctgatgcgttatcaggcggcctatctgaactccgagttcgatgaagaacacggcgtaccgaacctggtgtctaagtcgctgcagaccacccgtcgcttcgatgcgctgaagctgtggatgggtctggaagcgctgggccagaaacagtatgcggcgatcatcgatcacggcgtcacgatggcgaaaaacgtggcggagtacgtgaagtcgcagccgacgctggagctggtgatgcagccgcagctggcgagcgtgctgttccgttcccgtccggcgcagatggccgggagcgacgcggcggctatcgcgctgctcaaccagcgcgtcggcgacgccctgctggcctccggccgcgctaacgtcggcgtaaccgagcacaacggcgttacctgcctgaagctgactctgctgaacccggtggtgacgctggatgacgtgaaggttctgctgaacctggtggagcgcaccgctcaggagctgctggcgcaataacctgccttagcgaggcggcgcctgccgccccgctgtcagccttgcctgcaataagccgataatgtccttatcggcttttttttatttctttccgcaccgctaatgctctcttcgcagggcccgttgacccctgcctctcgcgatgccacagtactatcccgaaaataacaacgttcaggataaacgtcctgaaaatggggataatgatggagaaacgcttaccagggctggatctcgacgccctgcgcagctttgtgaccggcatggagtgcggcagtttcgcccaggcagcgctgcgcctgtcgcgttccacctccgcggtcagcgcccagcttaaaaagctggagagccagtgcggtacggcgctggtgaccaaacaggggcggcatctggtgctcaccgcggaaggcgaaaagctgttgagctacgccagacgcctgttggcgctcaatgatgaaaccctgcgcgcgctgcagggtgagcggctcaccggcgagatccaccttggtatgcaggaagattttggcgaatcgctgatgccggagatcctcgggcaatttaaacggcatcatccgcaggtgcggatagtcgccagggtggatcgcaatggtccgctgcgccaggcgctggcggaagaggcgctggatctggcgctgctgtggcaaaccgaagatcagggtcccgggctgggcctctgcccgctggcgtggattgcgcatcctgacctggatattcgcgctttgctggtctccggcgagccgctgccgctggtgatgttcgacagcccgtgcctgatgcgctcccgcgccattgcctgtctcgatgccgcggggatcccctggcaggtggtgttcgtcagccacagcctgagcggcatctgggcggcggtgcaggccgggctgggcctgacgatacgcacccgcatcggcatgccaggcaacctgcgccctgcaggaggactgctgccagcgccaggaagtctggccgtcagcctgcgacaaaccccgcgtgaggaatcgcattccgccgccgtggcgctgctcggcgaactgatgaccgaggccctgcagggatggctcgaaaggtgacagtgtcacgccatttccattcatcctcaccctaaccctctccctgaagggagagggaaccgttcggcagcatctgttaccccactccacattctgtctcccgggcaagcgcagcccagcccagcgccgttcccgcttcaatgcccggtggcggctacgccttaccgggcctacattctccctgcgcgctgatgtaggtcgggcaagcgcagcgccgcccggcaacaggcacaagagatgaacggaaccgtccggcagtcaccggcaatgggcattctgcgccattcccgcttcaatgcccggtggcggctgcgccttaccgggcctacacgcggctccgtaacgatgtaggccgggcaagcgcagcgccgcccggcaatgggcacaagagatgaacggaaccatccggcagtcaccggcaatggacattctgcgcctctcccgcttcaatgtccggtggcggctgcgccttaccgggcctacacgcggctccgtaacgatgtaggccgggcaagcgcagcgccgcccggcaatgggcacaagatatgaacgggtggatccgtccggcagccaacggcaatgggcattccgcgcctctcccgcttcaatgcccggtggcggctgcgccttaccgggcctacattctccctgcgcgctcctgtaggccgggcaagcgcagcgccgcccggcaatgggtataagggctggagggatccgtccgccagacgcctgcgccgcgggtcaggctttgctctcctgcagcagctgctggatcacctgctcctggcgggcataatccccttcgccgaatgcggtataacgcagctgtccgcgagcgtcgaaaatgtaatgcgccggccagtactgattgccgaaggcgttccagatggcgtactcattatccgccaccaccgggtaggttatccgccagtccttcaccgcctggcgcagcaggggcaacgaacgctcccagggatattccggggtatgaacgccaatcaccaccaggcccgccgcgcggtatttgttcgcccagtcgcgcacgtaaggcagggtatgctgacagttgatacactcccgggtccagaaatccaccagcaccactttgcccttcagacgctccggagttaacgccgggctgttgatccatgcgctgccccccgccagagagggcatcgcgctgctgggctgcggcgcggcgatcggctggaggctggtcttttgctccggctgcggcagacgggcggccagccgctgctccagcgcctggctcagtccaccagcgctttgcagatagcgatcgccgccgctggcgatcagcgccaccgaggccagcatggccccccctgccaaccggcgcagccgttcgccgaacgcctgtccgcgacgcaatctggcgatcaacgccgccccgcaccaccccagcaggaataacatcagcgccccgccgctgccgtaggccagcagcaagccgccggtagtcgcctgccccggatgcacaaagcccaggctaagtatcgcccccaataccggcccggcgcacggcgcccacagtaggcccaccgccagcccggccagcagagaaccgatccagccgcgctggcgtgaactggcatcgttaagctgattccccaacgctaccaggggtgaggtcagccgttgcgcgacgcgttgcgaaagcagactcagcccgaccagggcgaagaacgccagcgccagaccgcggcctgcgagggtcagattcaccacccagccgctggcgaccgtcaccagccaggagacagcgccgaacatcagcgccattcctgccagcatgatcgccagctgcccccggcggccccggacgctggcgaacagcagcgggatcaccggcagcgtacaggggctcagcagagttaacatcccgcccaaaaatgcaattaatatcgacatcgccttctcctcattatgccgtcgctgccgagagtggcagccacgacattacagcaaggccatgtaaggcgaatgtgtcgggaaagggggagaattgtcggcttagttatccgtcttccccggagatacatcaggatacaatcccgccgcggcaaggcgaacgctggcgtccaggccgccctgcgggcggttggccaggcgcagcgcgccgtccatctggctgaccagctgcgcggcgatcgccagccccaggccggtgccgccggtatcgcgattgcgcgagtcctccaggcgataaaacggctgcagcaccgcctgtagcgcggcctccgggatccccggcccctcatccagcacatgaagggtgatatcccccacggcgtcacgggtcagggttaccgtggccgtcgtaccgaatttcaaggcgttatcgataagattggtcatcacccggcgcagagcctgcggcggtacccacaccaccccggcggtctcttcgggacaaaactggaccggccggccgacatcggcataatcgcagacgatagtgtcgagaaacgcatcgagattcagccgctgtcgcgcctcctccagcggctgcgaggtgcgggcgaaggcgatgccctcccgcaccagacgggtcatattgtcgagatcctgcagcagtttgtcgcgcagttccggctggtcggccatctccacccgcagcttcattcgggttatcggggtttgcagatcgtgggagatggcggcaaggatccgcgctcgctcctgcagatgatcgtggatgcgcgcctgcatcgcgttaaacgcgcgggcggcgcgacgcacctcctccggcccctgctcggccatagttcccgccgtgtcgctggccggctccagggcatttaccgcgtgggtaaagcgggaggtgggcagcaatacctggcgaaccgcgtaccaggcgcaggccagcaggaggacaaactgagcgatcagcaccaccggcagccagcgggcgatggccggtagtttcggccacaggtcgagggtcaacggcgcgccgtcgtgaagggtaatatgggcctgaatatgctgccgcgggccggggatcgccacaatacttaccggatactgcgcgctcagcgcctcctgcagggagcgcgctgcgtcccgggcgcgccagctgtccgggtaatcgccgcgctccccggcgtccagcagatagcgataattgccgcgcgccagcttcggcagccattgtgggcgctcagcggccggcaggcggtcaaggatcgccacgctggtggcgacatcggaagccagattgcccagcatcacgctgcgagcgctgctcatacgctcataaaacagcagcgacagggttaaggtattcgccagcagcagcgccagaaacagcagcgccatcagcctcgactgcagcgaggcgggccagaacctcattcatgcctctcgcgaatggagaccggcaccgacagcacatagccttcgctgcgcaccgttttaatgtaggccggctcgcgggcatcctcccgtagccgttggcgcagtcggctcaccagcaggtcaatcgaccgctcaaacagttccgcgtcgcgtccctgggtcagattgagcagctgatcgcggttcagcacccgctggggatggtcgagaaacacccgcagcagccgatactccgccccgctgagggcgacaatcgccccgctgtcgtccagcaaatggcgagcggcagtgtcgagcagccagtcgccaaaggcgatcagcctgcccgcctcggtgatctgcaggttgggcggcagcgcccgggtgcggcgtaaaatggctttgatgcgcgccagcagttcgcgggccacaaagggcttaatcagataatcgtcagcccccatttccaggccgaggatccggtcgctgtcatcggtgcgggcggtgagcatcagcaccgggatatcctgctgcgggttggcgcgcagctggcgacagagcgttaagccatcctcgcccggcatcataatatccagcacaatcaggtcaatttgatggtttttgagtaccgaccacatggctttgccgttcgccgcgccgctggcgcgatatcccgatttttccagatagtcgacaatcagttcccggatgtcgcggtcgtcgtcgacgaccaggatgtggtcaatacgctccaaaggctgctcctgcggcaaaataaactcttcacaagcataagccgtgttgccggaagcgcaacgtcgcgcctccggcaaggcgcgggttacaaacgatcggcgtccaccaccgcctgcacaaacgccgtcggatcctcctgcggcgggttatggcccaccgctcccggcagatcccggtgctcatatttaccggtaaatttggcacggtagctggcgggagccggatgcggcgcgccgttattcgccccttccagggtgatggtgggcacggttatcggcggtagcgccgccagccgttgttcatagccggcatacttcgcttcccctttctccagccccaggcgccagcggtagttgctgatggtgatcgccacatggtccgggttatccagcgcccgggcggttttggcaaaggtcgcgtcgctgaattgccactgcggcgacgcctgatgccagataaatttcgcaaagtcgtgggtgttttgccggtaaccggcctccccacgcggggtggcaaaatagaattgataccaccacgacagctcagcctgcggcggcagcggtttttcgccaatctgctgactgctgatcagatacccgctcaccgagaccagggatttcacccgctgcggccacagcgcggcgacgatatccgccgtgcgcgcgccccagtcaaaaccggccagatccgcctgcctgatgttaagggcgtccatcagatggacaatatcggccgccatcgccgacggctgaccgttacgcggcgtgctggcggagaggaaacgggtcgtgccgtagccacgcagatacggcacgatcacccggtaacccttctgcgctagagccggcgccacctgggcatagctctgaatgtcgtagggccagccgtgcagcaggatcaccggctggccgtcgcgcgggccgatatccacgtagccaatattcaggtcgccggcgcggatctgctggatcttgtcgaacgcccccgcgtcttcagcggcgcaaacggcggcggaccacagggtggataaccccagcgccacagcgctggtatagcggatcagggataatctgttcatcgttttctcaccttttatcgtcatgaagagagtacgtgaccagtaaagcggaaatttgtatccgccatgtgcccgaccggggccatttttatctcttaatgtcagcgcagcaccgcgagatacagtgtgatacaaagtcgaggttggcaattgttgcgggcatgtgaatttatgcttgccccgggagataaatccgttaccgtggcaggcatttttcaccacttaagaacgcagaaacccgctatggcgatttttgatggtcacaatgacctgctgctgaatctctggcttcaccatcgcgaggatccggtgagcgccttctttgccgggatagagaacggccatctcgactatccgcgcatgctgcaaggcggatttgctggcgggctattcgcgctattcgtgccaccgcaggaatatattgcccgtatgacgccgcaatacgccagccaacgatgggatccgatcgatatcctctggcagcaaatggccatcctgaagcaacttatcgcccactccgctggacgcttgagattgtgtctgagcgcggcggatatcgagcgctgccgcgaggataaggtactggcgatggtggcgcatattgagggtgccggaggttttgatggcgagggccgcgacctgcaggccttttatgccgccggggtccgcagcattggtccgttctggaatattgcgaaccgcttcggcagcggcgttaacggttcgtttcccggtagcccggacactgggcctggactgacagcggcaggtatcgatctgattaagcaggccaatgccttgaagatgcagattgacgtgtctcatatgaatgaaaaagcgttctgggataccgcccatcactcgacgtcaccgctggtggccacccactccaatgcccacgccctgtgcccgcagccgcgcaatctgaccgaccagcaactgcgggcgatccgcgacagcggcggcgtggtgggcgtcaatttcggcaatgctttcctgcgcgccgacggccggcgcgatagcgacacgcccttaaccaccattgtccggcatatcgactatcttattaacataatgggtgaggatcatgtggcccttggctcggattttgacggcatcaccctgccggacgagctgggcgatgtggccggcttaccgcggcttatcaatacgttgcgcgctagcggctatgatcaattggtgctggataagctgctgtggcgtaactggctacgagtattaaaaaatgtttggcaacaataggttatattgtaaacataaagttaattccctacagattccgggttgatctctctcccggtgaagcgcaatatgcggcagccgtcacagatccaccattatccgtgaggcctgtagtcatttttaagaggaacaaaacatgtggaagaaacctgcttttatcgatttacgtctcggtctggaagtgacgctgtacatttctaaccgttaatcgccccgcccgccgttcgcgcgggcaccttcattcattacccggtccgtcttcatgttcattaaagtcctcggttccgccgccggcggcggtttcccgcaatggaactgcaactgcgccaactgtcagggtctgcgcgatggcaccattcaggctgccccccgcacccagtcgtcaattatcgtcagcgacaacggtaaagagtgggtgctgtgcaacgcctcgccggatatcagccagcagattgcccatacccccgagttaaataaagccggcgtactgcgcggaacgcatatcggcggcattattctcaccgacagccagatcgaccacaccaccgggttgctgagcctgcgggaaggctgcccacatcaggtctggtgcaccccggaggttcatgaggatctctccaccggcttcccggtgtttaccatgctgcggcactggaacggcggcctggtgcatcatcccatcgctccgcagcagccttttaccgttgacgcctgtcctgatttgcagtttaccgcggtgcctatcgccagcaacgcgccgccctattcgccgtatcgcgaccggccgctgccgggtcataacgtggcgctgtttatcgaaaaccgccgcaacgggcagacgctgttctatgccccggggctgggtgagccggatgaaacccttctgccgtggctgcaaaaagcggactgtctgctgatcgatggcaccgtctggcaggatgacgagctgcaggccgccggcgtcgggcgcaataccgggcgcgatatgggccacctggcgctcggcgatgagcacgggatgatggccctgctggcctccctgccggcaaaacgcaaaattctcattcatattaataacaccaacccgatccttaacgagcagtctccccagcgccaggcgctaacgcaacaggggatcgaagtgagctgggacgggatggcaatcacccttcaggataccgcatgctgatcactgacacgctgtcgccgcaggcctttgaagaggctctgcgggctaaaggcgccttctaccatattcaccacccttaccacatcgccatgcataacggcgacgcgacccgcgagcaaattcagggctgggtggcgaaccggttttattaccagaccaccattccgctgaaagacgcggcaattatggccaactgcccggatgcgcagacccggcgcaaatgggtgcagcggatcctcgaccacgacggcagccacggcgaggacggcgggattgaagcctggctgcggctgggggaagcggtcggtttgagccgcgacgatctgctcagcgagcgtcacgtgctgcccggcgtgcgcttcgcagtggatgcctatcttaatttcgctcgtcgcgcctgctggcaggaggcggcctgcagctccctgaccgagctgttcgccccgcagatccatcagtcgcgcctcgacagctggccgcagcattatccatggatcaaagaggaaggctacttttacttccgcagtcgtctgagccaggccaatcgcgacgttgagcatggcctggcgctggcgaaggcctactgcgacagcgctgaaaaacagaaccggatgctggagatcctgcagtttaagctcgacattctgtggtcgatgctcgatgccatgaccatggcctatgccctgcagcgcccgccctatcacacggtcaccgacaaggcggcctggcacacgacccgactggtgtaatcatgcagaaaacgtccatcgttgcctttcgtcgcggctaccgactgcagtgggaagtcgcccaggagagccatgtgatcctctatccggagggtatggccaaactcaatgagaccgccgcggcgatcctcgagctggtcgatggccggcgcgacgtcgcggcgattatcgccatgcttaatgaacgtttcccggaagcaggcggcgtcgatgacgacgtcatcgagttcctgcagatcgcctgtcaacagaagtggatcacctgccgtgagccagagtaaacccaccgtcaatccgccactgtggctgctggcggagctgacctaccgctgcccgctgcagtgtccctactgttccaatccgctggacttcgcccggcaggataaggagctgaccaccgaacaatggatcgaggtctttcgccaggcgcgggcgatgggcagcgttcagctgggcttttccggcggcgagccgctgacccgtaaagatctgccggagctgatccgcgccgcgcgcgacctcgggttctataccaacctgatcacctccgggatagggctgacggagagcaaactggacgccttcagcgaggccgggctggaccatatccagattagcttccaggccagcgatgaagtgctcaacgccgcgttggccggcaacaaaaaagccttccagcagaagctggccatggccaaagccgtgaaagcgcgcgactacccgatggtgctcaacttcgttctccaccggcacaacatcgaccagctcgataaaattatcgagctgtgcattgagctggaagccgatgacgttgagctggccacctgccagttctacgggtgggcgtttcttaatcgcgaagggctgctgccgacccgggaacagatcgcccgcgccgagcaggtggtcgctgactaccggcagaaaatggccgccagcggcaacctcaccaacctgctgttcgtcaccccggactattacgaagagcggccgaaaggctgcatgggcggctggggatcgattttcctcagcgtcaccccggaaggcaccgccctgccttgccacagcgcgcgccagctgccggtggcgtttccgtcggtgctggagcagagtctggaatcgatctggtatgactcattcggcttcaatcgctaccgcgggtatgactggatgccggagccgtgccgctcctgtgatgaaaaagagaaggacttcggcggctgccgctgccaggcctttatgctgaccggcagcgccgataacgccgacccggtgtgcagcaaatccccgcatcatcacaaaatcctcgaggccaggcgcgaagcggcctgcagcgacataaaagtcagccagctgcagttccgcaaccgtacccgctcgcagctgatctaccaaacccgggacctgtaatgacgctggcgacccgcaccgtcattttgccgggcggcctgcaggccaccctggtccatcagccgcaggcggatcgcgcggctgccctggcgcgggtcgccgccggcagccaccacgaaccgtcgcgcttccctgggctggcgcacctgctggaacacctgctgttttacggcggagagcgctaccaggatgatgaccgactgatgggctgggtgcagcgccagggcggaagcgtgaatgccaccaccctggctcgccatagcgcgttctttttcgaggttgccgccgatgctctggctgatggcgtcgcgcgtctacaggagatgctgcaggccccgctgctgctcagggaagatattcagcgcgaagtggcggtgattgacgccgagtaccgcctgatccagcagcatgagccatcgcgccgggaagccgcggtgcgccacgccgccagcgcgcccgcggcgtttcgccgctttcaggtaggcagcgccgacgcgctggcgggcgatctcgctgcgctgcaggccgccttaggcgattttcaccgcacccattacgtcgcccggcgaatgcagctctggctgcagggaccgcagtcgctggaggcgctcggcgagctggcggcccgtttcgccgccgggcttgccgcaggcgagcctccgccgccggcgccgccgctgcgcctgggcgagttcactgcactgcagctggcggtctccagccagcccgcgctgtggcgctgcccgctgatcgctttaagtgacaatgtcacgttaatgcgcgagtttttgctggatgaagcccccggcagcctgatggccagcctgcgccagcgccggctggccggggatgtggcgctgaactggctgtatcaggatcggcacctcggctggctggcgctggtcttcgccagcgaccggccggaagaggtcgaccggcagataacccactggctgcaggcgctacagcaaacgacgcctgagcagcagcaacactactatcagctatcccgccgccgctttcaggcgctgtcgcctctcgatcagctgcgccagcgggcattcggctttgcccccggcgcgccgcccgccgggttcgccgatttttgcgccgccctgcaagtcgccccgtcggtcagcctggcctgtcaaaccgtttccccaggggagcctgttgccacccagggctttagcctgccgcttagccgctggcgccgccgccctgagtctgacccggcgctggcgttcgctttctatccgcaggccgctggcgatctcgttgccaaatgcccggagaaagccgcgccgctgctccacctcccgtcaccgggagatccgccgaggctcctgctgcgaccgcccttctactgctcgcccgatcaggccgaggggctggcgcgtggggaacagctgcgcccactgcttgccgccctgcgccatgccgggggacacggcgagtggcatctgttcgacggcagctggcagttgaccctccagctgccggagcccggccgacggccggaggcgatcctgcaggccatcctgcggcagctcgcgctcccggtcgcctcgctgaccccaccgccggaaagtatcgctatccgttatctcatggctcaactccccgaacggctgggtacatccgggcatcagaaaggttggctggcggccctggccggtggcagcgcagaagatgcgcagtgggtagcgcgtcagctgagcctgattaccgccccggttaatccgccgatgcccgctccggcgccctgccgccgcggcgtcgaacgtctggtttatccgggaggcgatacggcgctgctggtctttattccgctgccggatggcgcctcgctggcggccctgcggctgctggcgcagcattgtgagccgctatttttccagcgcctgcgggtggagcagcagattggctatgtggtgaactgccgctatcagcgggtcgccgatcgcgacgggctgctgatggcgctccagtccccggatcgccgcgccggggaattgctgcgctgtggtaaagactttctgcgccagctggcccccatggatgaggcaaccttcagaccgctacagcagcgcctggccgctcagatccgcgccagcaggccgccagaggcgcgggcgctgtccgccctgcgtcaggagtatggtttaccagagctaacgccgcaggcggttgacgcgctgcgcgttgcagaggtggccgatctggcacgcgaaatgacccgccggcgtcgccgctggcaggtgctgttcacgacaggggattaatggccgggggcatccggggtcagaaaggcgctgacgaagcgcgtaaggatcgccgcgccctgcgggctctcctgcacctcgtcgtgtaaccgctgcgcgtcaataccttccgcctgcagcaccgcctcccggtggcggatcagcgaacgggctatcggcgcggaaaattccgggtgaaattgcgtagagaccgcgtgcggcccatagcgcacaatctggtggagatcgtgggaggacgcggccagcaccgtggccccttccggcagacgagtcacggtttgcaaatggctcagatgcgcaggaaatgtggccggcaggccgctcagcagcggatcatcgacaccccatggcgacagcgtaatggtttggctgccgctttcccgcccgccaggatgatacgccacctcgccccccagggcatgggccatcagctgatgaccatagcaaacgccgaacagcggcatgtcgatagccaccgcctgccggatccagtcggcggtccgttcgctccacgccagacgatcggtcaccatcgcccacgagccggttagcaccgctatggtctggttatccggcgtcggcagcggttcatcttcaaacacccgcaccgtggtgagctgcgtctgccacggcgccagcagcgtgcgaaaccagcgcggcagatcgccatgcgcctggcgaatggccgtcggcggcgtgccggtctggaccagcagtaatcggttacgtgtcacctttcctcctcgctccgggtcatgttcccgtaaaacactatgccgccgggaagacgatgggacaaataaccaattactatggacgatgcgcctgcggaataagtcctgtcgcttactgggcatcggcgctatcacgctgcggcacatcggctgccgccgaagatgcctgctgcgggacaaaaatatggtccaggatggcgcgcgccgtcggtccggctaccaccccatccccgccgccgttctccagaatcagcgccatcgccaccttcggatgctgataaggggcaaacagggtgtagaagatatggtcgcgcagacgcaccgggatcattttggcgttataggtctggttttgcttcaggctaaagacctgcgaggtcccggacttcgccgcgatctgatacggcgcagtatgaaacagcttatagccggtgccgttgggctgattcgccatcccatacatgccgttgcgcacaatgccccagtacggggatttcgggtcacccacctgcggcaggttcgccggctgctgataacgttccacatggtttccctgcttcatcgaatagagcagatgcggatcctgtactttaccattgttcagcagagtggtaagcgccttcaccatctggatcggggtggcgatccagtacccctggccgatgccgaccgagatggtgtccccctgataccagggctttttatgcacccgctgtttccactcccggctgggcagcaccccggcgtactcctcattaaggtcgatgccggtggactggccgtagccgaacttgctcagccattcatggatccggtcaatgcccatctcgaaggcgacctgatagaaaaaggtgtccgctgactcttcgatggctttagtcacgttgagcatgccgtggccggttttcagccagtcgcggtagcggcgttgcgtgcccggcagcgtccacgtcggcgccccgaagaagctggtgttcggggtgatgaccccagcggagagcgccgacagcgccatatagggtttgaccgtcgaagccggaggatatagcccctgggtgacgcggttgatcagcggccggtccggattctccagcagcgatttataggcctgatagccgatacctttgacgaagggattaggatcgtagctggggctggagaccatcgccagcacgccgccatcccggggatcgaccaccaccaccgccgcgcgctgccccttcagcaccgactcaatatactgctgcaggtgcaggtcgagggtcagatagaggtttttcccggccaccggcggcacctctttcagtagacgcaccacccggccgtggttatccacctccacttcctgatagccggtggtgccgtggagcgctttttcataatagccctcgatcccctgcttaccgatattgcggtcggcggcgtagttctcctcttcgccgtttttcgccagccgctgcagatcgctgtcgttgattttcgacacatagcccaccacgtgcgccagctctgcgccgtaggggtattcccgttgttggtagctctccaccgtcacgccggggaaacggaattcgttaaccgcgaagcgcgccacctccacatcgctgaggtctgacttgagggtgaccgctttgtagcggctggtgtggtgcatatcgtcgcgaaagctggcgatttcgcccggcgtcaggtcgacgataggcgtcagctgctgcaacagcgcggccatatcgggaattttgctcgggatcacctgcaggcgatacagggtgatattctgcaccagcggaatgccgttgcgatcgaatatcagcccgcggctgggggcgatgggcagcattttgatgtcgttctggtttgaccgggtctggtaaaaatcgtgctgctccacctgcagatggtagaggttaacgatcagcacgccaaagcagaccaccaccagcagaaaagcaattgcggcccggcggataaacagcatctcttccgcggagtggtcgcgaatttcatctctcaaaaggggcattagcggtacatcacctgaatcactggaaaagccaacggcgtaacggccgggaagcatagccttatcgcagcgtcagccctactgaaaggttgctaatgatctggcagaaatgtttcagcatgttagagggatcgttattcttaaccttgcccgtgacgcgtcaggctatattcacgatgcccgacgcgtcggcgcagctcactgttctgcgcgggccgcctcgtgggaggtagccgacttccctgaggtgtagattaagtacagcgcgagggccagacatatcaccgccgccagtctcgccggcgagaacgccatcgtgctgttgcccagccagccaaagttgtcgatcagcaggctcatcgtcagctggccaaagatcaccgccacggtggccgtagcggtgcctatccgctgcaccgccagcaccataatgacgatgtagggcacgccgcaaaaagcgcccagcagctgccacttaggcacctgtagcagatttaccgacgtcgctggagcaaaaaacaggatcagcaatcccgtcaccagcgcgccggtagcgaaggttaaaaaggcgctgcgcagcacccccacctggctgccaagacggccatttatcgccgcctggacgctaagcaatgcgccgccgcacagcgccagaatgatcactatcgtatccatttcccctccttaccccagagccaccagcagtaacgccgccataatcaacatcagcgccatggcgcgccgcggatcgattttgcgccgtgggctgccgaataacccgtaatggtcgatcgccaggcttttcgccacctgacccgccaggatgccgatcatggtcatggcaataccaatcaccggcgtcgccacggtcaagatcaccacgtaccccgcccccaacagaccgccggtgagttgccagccgggcagagaaaagaacgacgggctgctacgcgggctgaaaaagagcatcagaaaaaaggttaacactgcgccaatcccaaagatgctcatggttgcccacagatcccccacctggctcgccagcggccccagcaggccggcctcgaccgataatcccatgccgccggcaatcactaataaaatgaataataacgccattactgcgcctcctctgtacaacaggcggctgaggataaaacagcgtgctgatgcgataaacggtataatgcagaaaaccctattgcaggaattgcacagatggccgatgccagcagcgtcgattttcgcgcccttcagcttttcatcgcggtttacgataaccagagtttttccgtagtggcccgccgcgaaggggtctctccctcgttgatctcgcgaaccatccagcagctggaagatgccctcgggcagcagctgttctaccgcaacacccgtgccgtggtaccgaccgaagcaggacgccttttcgcagcgtccgcccgggaactgctgggacagtacgccgacgcacaacgggcgttacaggatcgggcacaggtccccggcggactggtgcggatcaatgcgccggtctattttggtcagcgtcatatcgccccctggcttccggaactggcggcccggcatcccaaactgcagtttgacctgacgctgaccgacgattttatcgatccccatcgcgatgcgacggatatcctttttcgcatcagcagcctgccggacgcgggctatcacgccagagtgtttggcagccagcgctattacctgaccgcctccccggagtatgtttcacggtacggcagcccgacttcgccggaggcattgcatcaacatcgcacgctggtgtatggcggttcgcagggagccaaccgctggctgtttcgccagcgcgaagaggcatgggtgcactatccgttgaccccgctcatgacctcgaacaatgccgatgccctgctcacttcagccatcggcgggatggggatcgtgttatttcccgactggatggtcagcgaagcgctgcacaacgggacattagtcacgctgatggaccgctattcggcggccatcagccacacgccatcgtatatcgcggcgatttatccttatacccgccatccctctctcaacgtgcggacagtgattgactattttgccgacgtgtttggatcgccgccctactggcagcgctaatgcgagtttcgtagtaaaacttgtcatatctcaaacaattagcattccttcgcccagcttgacgcggatcgtttcctttgccgcctcgttacggctatggttactaatgaggttaatctcaatctccaggccgacacggtcccaccagggggttgcctaacccttcattgaacggaaatagctattaaatccgtagattcattcaaatatcgcttattggtagcagtgtatatcgtaacggcattcacaaaagcaaacggagcctgatatgagcacgtctaacgacccatccaacaatgcatcccccgggaagtgccctttccacgccgagacgccaaaacagagcgccggcagcggcaccgccaaccgcgactggtggccgaaccagctgcgtgtcgatctgttaaaccagcactccaatcgctccaacccgttgggtgagaattttaactacagggaagagtttaaaaagctcgattactccgcgctgaaggctgatctcagagcgctgctgaccgattcgcaagagtggtggccggcagactggggtagctatattggcttgtttattcgtatggcctggcacggcgccggcacctaccgcaccgttgacggtcgcggcggcgcaggtcgtggacagcagcgctttgctcccctgaactcctggcctgacaacgtcagcctcgataaggcccgccgtctgctgtggccggtgaaacagaaatatggccagaaaatctcctgggccgacctttacatgctggcgggtaacgtcgctctggaaaacgccggcttccgcacctttggctttggcgccggtcgcgaagacgtcggggaaccggatctcgacgtcgactggggcgatgagaaagagtggctggcccaccgtcatccggaaagcctggcgaaacaggccatcggcgctaccgaaatgggtctgatttatgtcaacccggaaggtccgaacgccagcggcgagccgctgtccgccgcggcggccattcgcgccaccttcggcaatatggcgatggacgatgaagagatcgtcgcgctgatcgccggcggccatacgctgggcaaaacccacggcgccgcagaaaccagccacgtcggcgccgagccagaagccgcgccgctggaagcgcagggtctgggctggcactccagctacggcagcggcgcaggcgcggacgccatcacctccggtctggaagtggtctggacgcagacgcccacccagtggagcaactactttttcgaaaacctgttcaaatacgaatgggtgcagacccgcagcccggctggcgcgatccagttcgaagccaaagacgcgccggagattatcccggatccgtttaacccggagaaaaagcgcaaaccgaccatgctggtcaccgacctgaccctgcgcttcgacccggagtttgaaaaaatctcccgccgcttcctcaacgatccgcaggcctttaacgaggcgttcgcccgggcgtggttcaagctgacccaccgtgatatggggccaaaatcccgttacctcgggccggaagtgccgaaagaagatctgatttggcaggatccgctgccggcagcgacccatcagccgagcgcggaagatatcgccagcctgaaaaccgccatcgccggcgccggcctgtcggtcagtgagctggtctcggtcgcctgggcgtccgcctccaccttccgcggcggcgataaacgcggcggcgctaacggcgcgcgtctggcgctggccccgcagaaagactggccggttaacgccatcgccagccgggtgctgccgaccctgcaggcgatccagcgcgcctccggcaaagcgtcgctggccgatattatcgtgctggccggcgtggtcggcgttgagcaggcggccgctgccgccggcgtcagcgtcaatgtgccgtttaccccaggccgcgtcgacgctctgcctgagcagaccgacgtcgagtcgtttgatctgctgcagccgctggcggatggcttccgcaactatcgccgtatcgaaggcggtgtctcgacggaaaccctgctgatcgataaagcgcagcagctgacgctaaccgccccggaaatgaccgtgctggtcggtggcttgcgcgtactgggcgcgaactacgacggcagcaaacacggggtgtttaccgaccgcgtcggcgtgctcagcaatgacttcttcgttaatctgcttgatatggctaccgtctggaaagcggccgatgataacgcggagctgtttaccggcagcgaccgtaaaaccggcgaagcgaagtacagcgccacccgcgtggatctggtgtttggctccaactcggtactgcgcgccctggcggaagtgtacgcctgcgccgacgggcagcagaagctggtgcatgacttcgttgccgcctggacaaaggtgatgaacctcgaccgcttcgatctttaatcctctcgccccggctcccgccggggcgtttttcttataccgcccgcggcagctgttgcaggcgactccgcgttcgttgaatatcctccagttccacccctgccaccagcgtctccaggtcgcagcgggtcaccagcagcaggcggatctgcttttcatacagcacatcaatcacattgataaagcgctgctgggccgccggccccaccgtagccaatggcggcacctcgtccagtagccagacggcatagctttcgcagagcgtcagatagtccatcaccgccgtggcggcctgacaaagctgggtaaaggtgaagtgcagcaacgcgggcgacgccgcggccgccagcagcgtgcgatagcctaccgtcagcgaaaccggttcgccaggcagcgacggcaggtcatacagctgacgctgttgtgcattcggattaacccacatccgcccgctgcagaaggcgttatcctggctaagatgccgtacgcgataatcctcctcgccgttcagcgccaccaccgttagatgggcgcggatcagcgcgatcgacggtaaaaagcgatcgtgatatagcggattgggcagcagcatctccggtgggtagtttgaggtggccagcagcacgataccgtgttgaaagaggtgttccagcaaggctttaatcagcatggcgtcgcctgggtcgtgtagatgaaattcgtcgaagcatagcaggcggcaaccggatgtcatctgcctcatcaccgtctgcaggtcgggcgctcagggggcattcagccgctggtgcagttcgcggaagaagtgatgaaaatggacccgccgcctggcggcgagcggcaggctggcgaaaaagtggtcgaggataaagcttttccctcgcccggtacgtccccagacgtacaccccctgcggcctgcctgtcgtggacaccaactgctgaccgagggcgtcaaggcgggcgatgagtgacagctgatcgtcgtccagcgtcagacgcgcccgcgccgcctgctcggccatcacgcgggtaaaacgaaaatcagccgtcacctctgtgggaccagattccgagggtacacatccattttttaacattcttataacctcctgcaaggaggccattctagccgctttcccgcgggatggcgaatcgcgcgacgagcggccatttccgctgctccgccgccagcccctacgcctctccgacacgccagtgcaccgatgtgacgttctgctgaacgcccatctgtgccataatttgcgccagcgttttttggtgctgcttatggctaatcagctgcgcgcaaatctccagatggtccgcggtgtccgccgccgccgactgcaatccctgcagggtaaaccgctgctgctgcgcaatattcagcaacagctgacgcacggcattttcatgttcgcgcagacaggtgacgcgtaagacatagcgtttctcttcgtcaccggcccccggcaaggcatgaatgcgctgcgccgcctcgcgcagcaggatattggcgcacagaataatcagcgtagccgccgtcgcgttccagaactgtcccaggccgcagagtacgccgatcccggccgaacaccacagcgtggcggcggtattgaggccgcggacgttcatgccatcacgcataatcacccctgccccaaggaagccgataccggagacgatctgcgctgcaatacgccccgggctgtccggcgaggccgacatcgcgctgagaataaacaccgccgcgccggtggccaccagggcattggtgcgtaaaccggccatacgttgtcgccactgtctttccgcgccgatcagcgcccccaacaacattgccgcgagtaaatgtgtcatataaggaaataccatcgcgccttcctccagaaaacagaaagccaaaaattacagatgtagcgctcagccgcgccgggcgattagccggtggatgatggtggaggaaataagggtctggaaaacataaacataacgctgcctctcgcgctcaatggcgcataaattattgagggaggcaatccggaactgagagattgctgcccgccgggacggcaagcagcgaaatgatcgcgttagcttgccggaaaatcgcaataagggtgactgtccaacgtatgactcctgaataaaagtgggcacattatagcccggggtaatgatgggtaaagcacgaaaacgccgccggtgacgattcgtttagtttgtctttcgcgggtcctgcgtagcgtgacatcgccaggcgactaaaatgccgtcagcggtgatttacttcaattccgtcgctgggatgcggcgaaaaccagcatgaatatcaactttatgtctccccagcgcgatcttacgctaaagaatgtcgctaaggctaaggattaaaaatttaaaactattaacaatcaattaacattagcaggcaaaccattcttcctgaggaacacaacaccatgtctaccacccaggttctcggcgaaacgccctatgcttcgccaggacaaccgcacgccagcttaaccggacgcattgatgcgctgcccgcctcatttgggttatggtcgtttattaccctgctctcacttggcggcttctttgagctctacgatctcttccagaccgggtatatcagcgcgggcctgctggcggagggcattttccacaccggacaggcgggcatcttcggcatcgccgaccaggcggccttcgcctccgccacctttatgggactgtttatcggcgccagtctgctggcgccgctggcggacaaactgggccgccgcctgacctttatggtggcgctcgcctggtacggtcttttttcgctgctgatggcgacgcagagtagcgcggaaggggtgatcttcttccgctttctggtggggatcggcctcggcattgagctggtgaccattgatacttacctcagcgaatgggtgccaacccatctgcgcaataaagcctttgcctttgccttcttcatccagttcctctcggttccggcggtggcgctgatgtcctggatgctggtgccgaccaccctgttcggcctcagcggctggcgctgggtgatcatctttggcgcactgttctcgctggcgatctggtttatccgtaaaaagctaccggagtcagcccgctggctggcaagcaaagggaggcatgatgacgcgcatacggtgatgtgtgagatggaagcccgctgcggcctgacgccgtcgccaaagcatgcgcatgcggcacagagcgtcgtcaaacgcggcaccttccgcgaaatctgggcgccgcagtatcggcagcgcaccctgatgctgatggtgatgaacttcttccaggcgatcggtttcttcggctttggcaactggctgccggcgctgctctccggtcagggcgccagcatcacccatagcctgctgtacgccttctttatcaccctcgcctatccgctgggctgtctgttctgcacccgcttcgtgcatcgctttgaaaacaagtggcagattgtcctctccgcgctgatgaccgttatcttcggcaccctgttcgctctgcaaaacagcccgattctgctggtgatctgcgggtttatgatcacctggtccaacgcctggctgaccatcagctaccacgcctaccaggccgaggtcttcccgacccatattcgcgcccgcgccgtcggcttctgctactcgttcagccggctctcgaccgcggtgaccagcattctgatcggcattattctgcaatacgccggcacgccgggagtaattagctttatcgtcgtcagtatgctgatggtgatgctgtcggtggggatcttcggcccgagaacgcggggcattcgtctggagaatatctgatggcggtcgccgccgagggtgccggcggcgacatattttatcagttgcgatgttgcagctggcgctgaacctcaataagctccgcgatcaactcccgcgcgagcatagaggtcattatatgatcctgggcatgtaccagaataagattaaccggtactttgccacagccctcatccataccaataagcatggtttgtacatcatgcgcgcgttttgcggaatctgcggcgtcctgcatcagcctatcaacgtcctgccacactccttttctggcggcttgcagcgcctgcatcgccagactgcgggactcaccggcgttaatgatgagttccatgacggttgcttccatatccatacggtttccctacttgttgagtgaaggttcatccagcagcgccagcgccgcagcaagaattttatcgccacgcatcatgccgtaatccatgctatcgataacggcgactctcttacccaccgcagcggcctttttgttaaattcttcgaatttatatttaatctgcggccctaaaagacagcaatcgtaatttggtaacgtgcgatcaaaatcatccattgaaacagcaataatatcgacagcaatgccttgcgccgcggccgcttgtttcattttattcattaccatgctcgttgacatgccggcagcgcagcacaaaaatatttttttcatcttatttatctgttcctgtaacgtattattgatgcttatctttgagattttggtctaaaaaattaataataatttttgatacttcaggctgataccacatcaaacctgcgtgatccgcccctttcaccacgtaatgggtggacggtatttttttcgctaccagcgcctcgtgtaaaagcgttgactggctgggtgaaaccacattgtcggcatcgccgttcattagcagaaaaggcggcgttttattcgaaatccaggtgatgggattagcccgtttcgccttttcgggataggcggagatcgcgccaccgccttgccagggaataccattaaccagcatcgcctctggtatggccggtgactgatgcgctttttgaatgtccgcggaaaagtcagccccgactttcgtcagatcggacaggccatagagatcaaccaccgcctgcacatcgctgctttgatttgaatactctccctggtcgaattccttatggccgctggtggtacccaccatggcggctaaatacccacccgccgactcgcccatcacagcgatatggttgggatcgatgcctaatttttcagcattggcgcgtaaaaatctgaccgccgttttcgcatcttcaaccatgcccgggaaagtcacattgggtacgacccgataggtaatgctggcgacgacgtaaccggcccgggcaatatcgacccgctgaccgataaattttgatttgggcgcatcaagaaagccgccgccggtaataaatactactgcaggtaacggtttatcagcataaggcttgagcaaatccatcgttaactggagcggtcgtcccatgatattttgcgtaaatgaataggcaatatcaggcaccatctcgacggccagagcgctgggtttaataacgatagttttgctgtctgttaaaggtgtttgtgcaaaagcagacggaataataagcatcgtcagcatagcagcgacgtgtttgttcatagggtaatatcctgtagtgatgtagtaatgattcagaaccagacttccattcgatacccgactcgccactccgagtcttccggcaataacgtgacctctttgtccccgcctgcgtaggtaaccgtcaaactgagaatcggcgcgacatacggtaaaacatccagttgcagggccgggccggcggcaattttgtagccgacgccgctggcaccttcgacgccatttttattgatagtgttattcaccatgacttcatacaacatggagagattttggtgatgaatattttgtttaacgtttacgccggtaaagatcccggtttcatttgcggaaccataggtcatgtccccccctgaataacctgtatcaggtataaaggtggttcggtcagcagttttttcacgcttggtatattcatagatgaaagccggcgagacggcaaaatcatcaaataacgtcaagtttccgtcggtggaaaaacgcattgaacaatcgccctcttcgctaaggacggtaatacgactggtgttcagataaggagcaataacccctttaccatactgtaatttgactgtcgattgtccctttgccactccccaaaaagacggcatgctgtatttcgcggaaaaactaattgctttctgcttgccagtgcccaatgggtcatcaatttctttaacataggtcatacccagctctgtctgatcgatacgataagccatatcaacgatgcgccgcgagccttctatcgcctgcggcgcggtatcgctggaccagtcgatctggtcggtaccaacgttcagatcaaaattcttactgttataaccgaggccggaatcaatatgtacttctttggtattgtaagcgaagatattaatacgttgatcgaggtaacgacgcccagcccaaatgtttgcgccttcgggaagaaaagagagcccaccaaagcgcccataattctgtgccgtttctaccgttttatcgccgtaacccaccatttcataggtgtaatcagcccattgctcgggagaagccagcccctgccattttttagtaatagccagcgatgtccagtaatcgtgccagaaactgtttcccaaatcgcccattttgccacgaggatcctgattaggcccggtgggatcggtatgcaacgacatgtttttgggacggtttagttcgctctgaaaatctccagccaccatgccatatccatttaactggaagctgccgtcgtcgcttagattggccgcatggcataaggtcgcaggcagaaaacatgagataacacctgaaataataattctggggttcattcttcagactccatcgggtaagagatataaaataaataaaattattatttttattgcttatctgattttatttaaagaatgccacccgtgttataacccagcttgcctttttatatatcggttgttgccgattttacttattacaaaaacatgcaatagcatgaacgctgtgagccaatttactattcaggagttcaggtcacgatactccttaatactcatattatatttctctttaaataccttataacaatgcgaggcgttttcataacccgtcatattaataacatcaataatagagtgattagtatgcttaaggagatggatcaacacatccaggcgtttttcaaccaacaaatcgctaaagttcttaccagtgaagtcttttatcagtttactcaccttataattcggctgatttaaacgacaggagatctctttcaggctggcagttttataatcggtatcaatatatctcaacacggccatggcaagtgattcattgtaactgccgttgatatggtaatcgctggcttgcacattcgagagcagttcggtcatcaacagtcccaccaggaaattgacgcgtatctcttttaagtggttattactgtagatctcgctaatgatgacatgcataatgttttgaattgcgtcgatttctcccactttaaagtgaatatgctctccatgtttttttctgccattaattgctgaaaggataaaacgggaaatgatgttattttcgtcaaaaagggacatgagtcgaccgaaaaattcggtcttaataataaaattgatgataatatcattctgccctgcggcttcaatttcgtgtctggcaaactggttgataagcaggatctcccccttacctaaagtgagactttcttcattaatcttctgatgcattttaccctgatatatataaataagctcgataaagccatgagaatgcaacggaattttagtaaatcgggtctgcttttcaatatggatgtagttgtctttgaaaaaccttcgctccatatggcttttgaatttatgacacagttgatagttagcgcgaagcagttcgagttctctatcggtataagccagtagcttttcatgaatatcatggtgtaacataaaagtacctaactggagcgaacgtttgggtatgcactatcattacaatagtacttttatctcacctgcatcggtaatgtcataaaagtgatgataggtatcacagtctatcggcgcaggtaattgtttattaagttgatacacttttggtaatttaagagtgcattttttgaggttaaatggcactttgatgactaattctatgccttttttatagcgccgccagcgacactcaatacgccctctgatggtttgatgccagcaatccacaaagttaatcgtgtcagtaaaggatggactgattaaaataacatcagcaccaaccgcctcctcagcgacggtaatgccgcccaaagcctgaaacagccaactggaataagaactgaacatcgcatgattattcgaaccattcaggttatcaccgaaaaattccttcaatgtgctggcatcatttttaagcattttcttgaatccggcttcgactcttaaccattcaaggattaattcattatgaccatagcgatgaaatatttcataggcaaaactttggccaaaaatcccacaagtgataacattttgctcttttttgatgagatcgatcaatgcattcaatgaactctcgatatcatcacacaaatcgaagtagattgcaaaaacaaagctggtctgactgcgatcggcaaagctgccatccgtattcttatagagtgataaaattttctctctaattttattggccttgccaatatattttagccatttttctttaaagccaagatcatcacatatttttgcgataattaacaaatgataataatagaaacaagcactggtgaaatggagagctggcgagccatttttgtaattacgcatatcatgaacgcggcttccccagtcacccaggcagcaggtcaccaggtcatcaaagtcgcgcatttccagggagaggatctgcttctcaagaaatggcaagctttcggccagcagattgacattgccataatgtcgatagtgaatggctatcaaataaggtaataccagttgccagcccagggggcccgtttccccgccgactccattagtcttaattcccataaatggcgcagtttccgtcacaccaccacagggacgaatatcattgataaaatcaaagatagttttcttatacatagcggcagagtcaaactgatacacttgcgaccgggccaacgcgacaatgtctccgccataggcaaaacgttcgcgggcacaatccccgaagaccgaatgaatgttattcagtttggttcttttagcaacctcaaagagcttatttatgtaaggatctgagcagtaaaagcccccgttttcccttagtacagtatgtactgaaagcgcctgaacgttgtttaattgttcaatattaataccgcttaactgcacatagcgaaacgaatgacaggtaaaggcattgataaaatgattcttcccactgcggcattcaaaggcatccttctgttccgccctcgccggtgctccaattccgccgtcaataatcacaccttcagtaacctgtttgccgacaaatcccgcaagggtggagtcagtgtttagttcgtagttttcatcaacgtcttcgctatagagcagttccacacgttgattctcagacgcggtaatggataaatcgataaatccggtgacgatggcaccgaaatcaataatgaatgtctcttcgtctacgacgtggatatgctctgccccgagggacaacgtatggttaattttcggaataaagctcgagaccagacggccttcaggcccgttgctcagcaccacatttttccagtcaggcatcagcaaatcggtggtgttgtctccgcgaaacagtttcatatccaggcgctcgcccaaatagatattattgaaggtataagcgccttcgcaatattgccagtcggcatcactaccgatgatcatttcgcgatctgcaaacctcatataaatgtcagcgatgacctgtggttcaccgatggttaaggtctctctcaggttatatttaccaaataatttaagcggtgctggattaaaccagccatcggctagctcaacaatgacttcatttttcggctgattaataaacggctttatattgtaagtatcataataaataattttagcataatttgtccagtcagtattgagctcaccgcgtgtgacctctttaccgttgatatacaatttataaaaaccaagaccaacaatactgatataggcatcgaggaggtcttcgtcgagataaattgtttttctcatcaccacattacgtttaccgcgatagtaatgaatatcattagtgaagtgatacccaccgctcacccagcggccagaaaaatggccaagattactggttgtgaaactgtttctaaaaacgttgttctcaccattgtcaccgtgggtaaggacttctatggtataagaagtaaagctttgtaacgatattgcatcgagagtgacaattgtattattaccctctcttgcgataagagataccagttcggcacctttatacacttttatcgaaaatgacttttgaggataattggtagaccagcacaccataattggcagatgatcgacaataatgttttccgtttggtaattgatacttaacatctttcccaccatggctaaattggcgttgctggcatttttttaaggagcattcaaatggtatccgtctgattttcttcccggcaagcgacaagatcggcagtcttgaagaagaaataccatcctgcaaatcgcgcaaaaagtcctataaattggaaagcggcaattttccagctcccctgcataaaaccagaaataatgatcggcatgccggccggggtactcaccccagcgacgcgaggcaatacgccaatgaccgttagataccatgcaatgccgagcatgatgccattgataaaaatataaggaatcgccagagtaaaattcattaccagcggcacgccataagccatcggttcgccaatggtgaagatagctggcggcaaggcgatcttaccgagcgttttatagcgtgcgctcttcgcgaaaaaagcgagcattatagccagcggcaataaatctccagcagcgccataagtcataaagaacgcaaagccggtgatgttgggtaagtcgacgcctgcagcatacgcagcaagctgctgggcatccatggcaaaccagatcggcgctacgataccgagggtgatagcgtggccatgcagcccaaaaaaccatagcaattgcgcaacaacagcaacaaagatgagtgaccagattccggatccaagtgatgttagcggaacctggattaatttataaataatttcgtgaatgctcccataaccaacgctggtaatgactgcggagataattgtaaacagcgtcaggatggcgattcctggaatcaatgaagagaacgatttggagataaattcagggacattttctggcattttgataatcaaccccttgcgagttatcgccacgaatattcgtgttgaaattatcgccaccagaatggcggtaaacagccccatgggccccagccattggccagggattgaaaatgattgccctaacggccctatttcaccgagatcatacggcgttaaaataaagaaagagatcattgaaatcaggcctgacatgaagccatcaacatcgaaatttttcgctagcgtataggcaacggagaaagcgacaatcacggctaaaaaattattcgtgaaggtaatcgggatatcaaagaagcgagttaagttgtgtcgtaacaaaaaatcctgatatggagcaaacggaaacactttaaccaaagtcgccacagaactcatgatcgttactggcaatatgagcatcataccgctcatgattgacttaaggtaggtattttgaccaatactttgcatcagttgcaaagccttttcttgtacaatgttggtatgagatgacatgtaaacagtccgtaatattattagttttcagacatattcatttaagaattcatatgccggcatgacattaatgcatcataatctaaccaggaagtcagcctaatatatcattagggagtaatacatatcggttgttgttaacttaaatgacggctgttgccatagttaatatttgtgatgtgtactgcaggagggataaaaaattgtcattaaggcttgtaacttctggacagcattaagcggcgccgcaataccgcttttaccaacggtccagcatcaccggggctatattgacactctcccatcagaggggcgtttaggcattttagtgacaagccgccaggtcggcggcccggcctcagccaaatatcccctgcgcctcggcgaagcatttttccgccagggtcgagactggttcctgctggcgcataatcagcgccagctgtgaatcaacatgggtttcggcgatcggcagaatttcaagattatcgcttagcgcttcgaggccgttgttaagcggcataatggcgcagcagatccccgcctgcaccgcctggataatctgaaacgtcgaatcactttcaaagacataccttggcgttagccctttggccttaaagctgatttcaatcgattcccggtaatacatccccttggtcagaaagccgaggggcagcgtcgccagcgtctcccatcccggcgtcccggcgctgaagtcgaaatggcgtttatcgtgcagcagtcccatccgggtttgcggcaagcgagcaatcttgaactgaccttcatccagatgctgcagataacagatccccagatccagctgattacggctgacgccatcgataatctgctccgaggtcatcgacaacaggctgaactgcagcgccggatatttctccgccaggggtttaatcaactgcatcggattgaggctcgccagcggcaccataccgacccgcagctggccgaccatctgcccgcgacagatggccgcctctgccgccaggccgtcatgagcggccagcaccgcccgcgcccaggccaggatccgctctccctccggggtaaacccctcaaagcgttggccgcgctggatcagcgtcaggttcagctcctcttccaggttacgaatgcgcatagagagcgtcggctgggtaatatgacaggccgccgccgcctggccaaaatggcgcgtctgatcgagcgcgatcaaatacttgagttgcttaatatccattctctttcccgtttgaaccccgccgttcacccccggggccgcgcacaggttaccagaatgttagtttcgctagcgataaattcaagcgaggacaccacgaggtgctgcggggcgcagggcggcgcgacgccgctctgcgctatacctttttagcgcccgccggccagtggacggatctctttcgagcgcagcgtcaggcgaacgggaaccgacttatacgaaggggtgccgctctcttcatcgagatagttcagcggcaccagcacgttggcttccggataataggcgccgacggtgcccggtgcaatgccgtaggccaccaccgtgatatcttccagcgtcagcgcgcttcccggcagcgcggtatggatatccacccgatcgccatgctccagaccctgggcggccatatcctgctcgttcataaacagcacgtcgcggcggccaaagacgccacggtagcggtcatccatcgcgtagatggtggtgttgtactggtcatgactgcgcagcgtcaccaggcgcatcacgtcctcaccctccaccaccacgttctcatgcacccctttaaataccgagaacatggctttaccggtggcggtaggccagatacgctcggtcggcggcagcggcatgcggaagcctccaggatggcgaatgcgctggttataatcctcgaacccaggaatggtctgttcgatcagatcgcgaatgcgatcgtagtcttccacgaggtactgccagtccactttgctggccggcaaggtggccttcgccagaccggcgacaatcgccggctccgagcgcagcatcggcgaggcgggcttaagcttgcccgacgaagcatgcaccatcgacatcgaatcctcgacggtgatcgactgccggccgctggcctgcaggtcaagctcggtgcggcccagacacggcagaataaaggtctctttcgccgtcaggagatgtgagcggttgagcttggtgccgacgtgaacgctgagctcaaggccgcgcatcgccgggaaggcgcgttcgtggtccggcatcgccacggcgaagttgcccccaaggcagatcagcgctttggcttcgccggcgatcatggcctccagggcttttaccgcatcgtggccatgatgccgcggcggcgtaatccccatcacccgctgcaggctgtcgaggaaagccgcggagggtttttcgctaatcccgacagtgcggttaccctggacgttcgagtgaccgcgcaaaggacagatcccggcccccggcttgccgatattgccgcgcatcagcagcaggtcggcaatcagacgcacgttggaggtgcctttgttatgctgggtgatgcccataccgtaggtgacgatggtggccctggatttggcgtaagccgccgcaacctgggtcagggattcgcgcgtcaggccagactcctgttcgatgtcctgccagcgggtggcgtggaggtcatcggcgaaggcggtgaatccctgggtatgttgggcaataaacgcgtggtcgagcacattgccctgctcctcctccagctgcagcagcgctttggcgatccctttcaacgccgccgcgtcgccgccggcccgtacctggtagtaggtcgaggcgatcggcgtcgagcgccgggtcgccatctccattacgttctgcggatcggcaaaacgctccagcgcccgttcacgcagcggattgaaaacgataatcggcacgccgcggcgggatagctcatgcagggtgcccatcatccgcgggtggttggtgcccggattatggccgatggagatcaccagctcggtctggtcaaaatcgtcgagggagacggtgcctttaccaatgccgatcgactgtggcaggcccacgctggtggattcatgacacatgttggagcaatcggggaagttgttagtgccatactcgcgggcaaacagctggaacagccacgccgcttcgttggaggctcggccagaggtgtagaattcaacctcatccggctgcaggccgcggaggatctcgccgatacgggcgaaggcttgctcccacgccaccgggcgcagggtatcgctgtcccggtcgtaaaccaaaggatgggttaagcggccgtagccctccagttcaaaatcgctttttgccagcagggaagatacggtatttgccgcgaggaatgcgggcgtcacccgtttggtggtcgcctcccaggtcacggctttggcgccgttttcgcaaaactggaaggtcgatttatgttctttatccggccaggcgcagcccgggcagtcaaaaccgtccggctggttggtacgcagcagcgtggcgggcgcctcaaaggcatccatctgggtgcgcacggcgatggccgtggccttcaacgcgccccacccgcctgccggaccgtcataggggtgaacaccgggaaccgcgcgtcttttattggtcatctctttactcctgctgctctgttctggctgtcgctagccgaaaaaggcgtacaacaaccccggcgacgaagcgtgaatcgcatggcgtcacctgaaaagaatgctgtttctcaaggatagtacgatgggaaagcgtaggtactgcgtttgttaactgaataataacatacaccacaattctgtataattgatgttatctatcaggtgttaaatttaacttatttgcaaattttgcggttttcaccgcggtgctgtgacggataaattgctacggaaagtgatgaccgggcagcgaaaccgcccggtgggccaggctcaggtcagattgaagtaacgatccggacgcagcgtctccggcagcggatgctgaccggtcatgtcgagcagattgcgctcgatggtattgcacatcgcgttcagcggcaggtcattggctgcggtgccgaacggatcttccagctcttccgccagcgaatcccacgataaaaaggtgtaagagataaagaccgagacaaacggcgtcatgtagtgcagatcgccgaccagggcgaacggcagcagcgtacagaacaggtagacggtacgctgcaggatcagggtataggcgaaaggcaccggggtggtggccagcctttcacaaccgcccagcacgtgcgccagctcgtcgagtttgttgtccatcagcccgtaagtgatgtcgctgagcttgcccgcctcccgcagctggccaatttcgttgccggccagcagcaggatccggttggtgggcattgagctggcgaggatctccgtcaccctctcctccggtagcaaccgccgcaggtcagccgtcggatcggttttgcgcagctggtgcttcaggctccagctaaaggccaccagatagctgacgatgcggcgatgggcatcgtgttccgccggcaggatattgcgcagctgacgcaccagcgtgcgttcggcgataagcaccgtcccccacagattgcgcgcctcgacgaagcggctgtagctggcgctgttgcgaaagccgaggaaaatcgcaatcgcaatccccagcaggctgaacggcgccacggttaagtggatccccaactgttcgtaccattgatagctgataatggcgatgatcgacatcagcacatttagcagcaggcgaaagatgattttcgacagcacggagccgtgccagtcaaataggcgaagaaaccagtgttgttctggccgaatgatcattgtctgacttcctgaattaccgctctggtcattatctctgaatacagaatagagattatctatgagccgattggtttattttatcgttaactgcgatgggcagatctgcgccattatttagcgatggtaatggcgtttttagtatgggccttttttatatttcaggcaatcaatgcgccagcaataatggctcagaagaaaaaataaccgctgagccaattcatttttccgcttaggctaccgggtgtatcagaccgctttcgtcaacccctgcgcttcgcagggatcgagatgcaccatcacattaagcaccggatgctgcgccagcacccgctcccgcgcgtgacgggcaatctgatgcccttcggctaccgacatctcgccagccacctcgagatggacatccaccagcaccagatcccccgccttacgggttttcagatcgtggaggcccgccacgcccggcgtagttcgcagcgtatcggcgatcgcctgctgcatctcttcatcaaccgcacggtccattaaatcatgcagcgcgctgacggcgaaacgatagcccatgcgcgcaatcagcagccccaccgccagcgcggcgagcgggtcgaaccaggcgaacccggccagattaccgataatccccagggccaccaccagggaggatgcggcgtcagagcgggcatgccaggcattggcgataagcagcgacgaattcagccgcctggcggccgccagcatatagcgaaacagcccctccttgacggccagcgccaccagcgccatccacagcgccgcgctgtgcaccggcggaatagtttgcggttgcgcgagatggcccgccgcggaccatagcatgccacccccgacgagcagcagcatcgcgccgatgattagggaggcgccgttctcatagcgccagtggccatagtggtgatcgtggtcagacggtcgacggctctttttattcgccatcaataccacgccatcggcgaccagatcggaaaaagagtgcattccgtcggcaattaatccctgagagccggaaaatattcccacgactacctgtaaggcagaaaggaaaatattaaccaccacgctaacaagggtactctttcgcgcctgcaccgaacgctcatgatatttattatcattttcaaaattatgttgtgtcattatttctctccctttgtgagcgggaagaataaactgacaaactgagtttatgcttaacaatataaaagccattgccttgccgtttaacgatatcgcggcggtcggtaatgactatttactgtatgtgccgttggaacgctgcaaccttgcgcctatgaactatcttttgaagggtggccacaggtcgggccactttagcttagccaccacaggagtcagcgatgtcacataacaaaccatcccggctgcgtttcgccattaatctgggcaatgcggtcctggcccatctcggggagacaggaaagcccgcgggcatcaccgtcgagctcagccatcggctggcgacgcgctggggcgtcagcgccgaattcgttccctatcctgccgcgggtaaagtggtggctgacgccggtggcgagcactgggatattgcctttctggccatcgatccggcgcgggaagccaccctgcgctttacctcgccctatatcaccatccagggcaccgcgctggtctgcgttgattcgccctgccagagcgtggccgacatggatcgcccggcaaccaccattaacgtcggacaaaacgccgcatacgatctatggctaacccgccatctgcagcacgccagcctgcatcgccttccctcttcgcaggaggcaatcgacgccttcctcgccggtgaaggggatatggtcgccggcatccgccagccgctggaggcgacagcccgtcagcacgccggggtgcgggtactggcggataattttaccgagatccagcaggccatctgcgtcgcccgggcggacgtggaccgttttcacgcggtaaacgacgcgcttagcgagtggcgggcggatggcagtctgcaggcgctgattgccggtcacctgggccaagcgaactgaatcacgcctccgtcatccggcgcatggcgcaatgccaggcgccgttgcgtaccgaggcgcgcagtacgcgggccacgccatgcaccatcaggcgcgtcgtgcgccgctgcagcggcgtgagcgacaatcccagcatctcctgcgcccattccggcaaaaggtcaattcctgcgttcatcatcacccggccgaccggctggctcatccgccccggcagacgggtggagagcagcacctgagctacctcccgggtacgttcgtcgcagcgcagtcgcgggcgcatcgcctcgagatagtccgccacctcctgcggtgtctgagggatatcccgagcccccagccgccgggcgatttccgccgactcacgaaaatagtcctcctggcgctcgggactgaccaccgtccgcttgtagcgcaggtgggaggccataaagcaactgcactcggcgacgtgcacccaggttaacagcgccgggtcgctcgcctgatacggggttccgtccttatccaccccggcgatccgctgatggatcccctgtactttggcgattagccgttcggcgtcgggggtagtggcaaaagtggtggcagaaataaactggctggtgcggcgcaggcgacccaaaatatcctcgcgaaaacgagagtgatcccagacgccggccagcgccagaggatgcagcatctgcagcaacagcgcgctaatgccgccgcagagcatcgaggtaaaatcgccgtgcacctgccagatggccgactggggaccaaacagccccggctctcctttgggtcgttcaaagtcgatctcttttagcgccatgccggtcaggccgagcacctgcgcctcgatcatccggcgaatgccgatcatgatggtatcccttacgtgcaactaaaggacaaaagataccactgttggacagcattgggagagatattgcggaaagagtgcccgcagcacgcgggcacgacggcttacggattcagctggtaatcgagggtaatgttggccttcagcacctgcgataccgggcagcctgctttcgctttctggatgatctcatcgaacgccgccggagacacgtccggcaggacgatctggctttgcagcgcgatatcggtaatcgcaaagccgccgtcggttttattgagggtgaccactgcggtagtgtcaatggacgttgcggtatatccctcttcgctgagcatcagcgacagggccatcgaaaagcaggcggcatgtgcagcgccgatcagctcctcagggttggtgcccttcaccccctcaaaacgggtgttaaatccgtagggctgctggctcagcgccccgctttctgtcgacacggtgcctttgccatgcttcaggtcgccttcccagtgcgctagccctttcttatgaatcgccatttgattcctcctgtagtgatgtcgaacaaaaagtatagtgcgtgatgccgaagctgcgtctttttgcagcctctggcccccacgttcccctggttttcgtgtcgttggtgaggcagggtgacgctatcggccatcctgcggatgccagggatcggatttgtcatccttgctgtcgtcccgtttacgcggaacttcgccctgctctccgggcgcctcacgggcaggttgcttaccgcgctcttcgtcttgcgagtgagaaaaggtgctcatatcgacgtgctccgcttacttaggcgactgcttgagcagacgatcgattcgcacgaccggcggcgtcattttgcgatccagactgccgttgatattgaccagatcgtctggctctacgtgttgttcgttaaacgcggcgaccgggataataacggtgatggtgccgcttttatcacgaaactgataacggtcatctccctgccgcttgagcagattgccgcgcagcgaaacggtcgcgccatcgtgcatggttttcgcctgctcaacggtcatgatccggccatcctcgacgccgcgatagccgtcatcgagtttgtgcggcggcggcggcgcggcatcctgagtaaaccctcccttatcgtccgcctgcgcgacacctacggcaaacagacaggccatggccaatgctagttttttcatcatgcctccgttttttgctgacgatgagaataaagcctggctgaggctggccatttttacaaagtcaattgttctgatatcgtctaatataagaatgtccttatcgttacgctcctggcgaaacgaaacgcggggaaaatattaatgattaagaatcaacagccttgtcctatcgtcgatgagaatgaacgctccttacgctttgaatatcgcttccgccgctatgggataattgttttgagtctcatcattcttaccgcgttaagcggcctgtggtcctccggttatttcagtgaagcacaccgggaaaccagtggaggcgaattaagcgtcgattatcagcgctatgccaggctgatgagtgaaaccgagtttaatattcagattaaaccggatacggccagcgacaccattatcagcttcgccgccccgttattaacccgctaccagatcggtgatatccgtccgcagccggataaaatgtatagcgccgacgggaaattacatctcgtctatcagcggtcgaaccccccttcaccgatatctgtgtggttagccgttaccccaaaaacggccggtaatatctctctgcaggcggtagttaacgatcgctattctgtaacctggcagcagtttgtctatccgtaggagtcgctatggaaatggtccttagagccgcagcaatctatctgatcctgttgattatttttaagattgccggcagaagaaccctgatgcaattaaccaactttgacctgatactgttgctgattatcagcgaagccacccagcaggcgatgctcagcacagactattcggttaccgggtcgatgctgactatcgttaccctggttagtattgatattttgttcggctatattaagaaaaaatttgctcaggcagaaaattttctcgatggtacgccggttatcgtggtggaaaatggtgctgtcatcgacgagaagattaagctcgtcaatatctctgtcgatgatatcctgctggcggccaggcagcaccatggcatttatgaattgaaagcgatcaaattcgctattctcgagcgtaacggccagatatccattattcctgagcaggaatagtatcggcttcgctatttatcacgctccggttgtttatcacctgattccggagcgcgagtggcgtcatcctcttctttttcaccgttaacaacgttcaacattaacatttttcctcctcgctggttgtcagggatcctacaaattatagaacgccttcgccgaagtatgcaggatctgccgaaactaaccaggagatgccgcctgattcacattgcgcttattccaggatatttcccacctcgtcattgccattggtgagaaataattaaccgatccgtacagtcaatattgtgaaagccaaaacataatgaggtcactatgtctgtgatggttattaccggtggaaccgcgggagcgggcaaagctaccgcgctgcgtttcgcccgcgctggatatcacgtggcgctgatcgcccgagacgaaacgggtttacaggagacgcgacaggcctgtgaacggtttggcattaaaacgctggctattagcgccgatgtcgtcgatgccggggcgctgcagcgcgccgccgccgaggtggaaaccaccctcggggcaatcgacgtctggatcaacaacgccatgaccaccgtgctggcgccctttcgtcagatgagcgaggaggagtttcgccgggtgacggaggtgacctatctcgggtacgtgaacggcacccgcgcggcgctggaggtcatgatcccccgggatcggggggtgattattcaggccggctcggcgctggcctggcgttcaatcccactgcagtcggcttactgcggagcgaaagcggcgatccgcggctttaccgatgccgtgcgaaccgaactgatgcatgagaaaagccacatccagttgaccatggtgcaactgccggggatgaacaccgcccagtttggctgggcgcgaaacaaaatggatcaggccatgcagccggtgcccccggtctatcagccggaagtcgccgccgaggctatttacagcgtcatccagcgcccggtcaacgagctgtgggtcggaaaaagcaccatccagtcgatcctcggccaggtcttcttccctcgcctgctcgatcggctgatggtgaaaaaagcgtgggagggacagtttaccggtcagccaaagtcgtcagaccaacaggacgacctgttcacgccggtgcgcggcaatcatccgggccacggcccctttaacgatggcgcacggcgtaaagcagtcaccatcagcgccgatctcccgggtaaagtcgccgccggcgtcggggtagcggtggcgacgatggcgctgcgggcgttgttccgtcgttccggaaaacggcgctaactcaggctgcggctgaaccaacggtaaccatacccggagagtgccagccgcgcatctttcccgccgtgcagcccatcctgatagagcttatcttccagaattgggctccagtagccctcggccagcggcgggagcaggacctctaccgcctgctggctgcagttggccagcatcagtacctcccgcgattcgctgcgatagagtaagcccagcaccgcgtcgggctttagggtaaggagagtaaaagggagggatcccggttcagtatattccgtgcgcgccaataccatattgcgtacccgatgcagcagcgacctgggatggcgcagcgccgtttctacattgatccgttggtagcggaaccgcccgctggccaccggttttaccggcaaatcatcccgcgccgcccgggaaaagccggcgttggccgcggccgaccactgcatcggcgttctgaccgcgtagcgctccggtaaggagagatcgtcacccatgccaatctcgtcgccatagcgcatcaccggcacgccgggcagcgccagcaggatagcatgggctaacgctatgcgtcgggtatcgccgtccagcatcggcgccagtcttcggcgtacgccgcgctggtaaacggacatcgatttatcaggggcaaaggtgcggataacctggcgcttgttgcgctcgccaatcccctcaagatccagttcatcatggttgcgcagccagttgacgaagcagcacccgtccggcggggtcaccatcgcctgcagggccttcaccaccggcgcggcgcgctgctgcgccaggctgaggtagaggtatttgttaagccagaaattaagcaccatctgcagccgatcgccctggccgaaataatgacggtaatcttctaccgcgacgtccacttcacccaggagtatcgcatcgggattgaggcgctgtacaacctgccggagatgggtcagcagcgggtagccgcgcgtctcgtcgccctttccggcctgcttgaccagatgtgacgcggcatcgagacgaaagccagacaccccagcctgcagccagaaggtgataatgttttcgatttcagcgatcaccggcggatgggcgagattcaggtcgggctcgtggtgataaaacatgtggcgataatattgcccagcctgttcgtcccagcgccagacgctctcctcaacgccgggaaacatgggaggatcgtcgttttccggcggccgatcggcccacagataatacggccgccacggcgaccggggatcgcgtcgcgccgcctggaaccacgggtgctgcgcggaggtgtgctggatcaccagctcaacgatcacccgcagtcccagctcgcgggcgcgggcaatcagctcaatcacgtcagcgatagtgccgaaccgcggatcgggctgcagatgatcgctgatatcatagccatcatcctgcagaggagtgagatagaacggagtcagccagagcaccgtcgctccgaggctgcgaatgtagtgtagcttttggcgaatgcccgcgagatcgccaaaaccatcgccattggcatcataaaagagcgaactgtcaacctgatagatgaccgctctgtgaaaccactcttcccgttgcatcactctcacctcgcgttctgcccgtccctgtcagccgcctcagcgcgatccggaccccgccctggccttcgcgcgcggtttgccgacaggcgatacgggattgcgttccgctggtagcatcctgttcgctaccgcgtccaccagcgcctgctgcctggcggttaataccagcggaacctgttcctcggcggcgaggagcgcgatggtttgccgtttgaccatagcgttctccggcggcttaatgcccggcctcaacgccaggcatatcggtatccataagatattgcccggtcagcgctggcagataatggagcagccaatcagccattcctctctcttcagccaggataccctccagtgtatgcatcgcgctgtggtcgcctactcttttcgccgccgttaataaagcggtatagcaggcgacctcaaaatgggcaaaaacgtaggcagtgataatcactttaataacctcatcaccgggcagcatgatgccaatggtctgtcctaacgccgccacccggctcatcgcatccttcagcgcggagcgggaaatatggttgcgggcgatgatatcctgcagggcggacaattgccgtcgggtttcatagagatgttgttcaaggcgggtgcgtaactgcggttcattatcgaggcgtctgatggtggccaccagcagcgactcagcctgtttttccatggcatgcgcatcgcgaagccagttgtgataattttcgatatccgtcatatacacctctgatcattaaccttttattttgacgtggaatcttcactctcttccgccgcctggtcagctcgcgctgcgctatatccggataaatggccaacaatattggcataaatactgatgagaatgacccacagtacgctgtctttccaccagattaacgagggtatcgccagacccacccacataacggcggcgacaagatgacagcgcttaataaacactggcgtcaacttcattttattaccttaggaccgaacaatattgagcgaccattttatcgacgctctgaccgctgcgtcaggcgctaaaccttacgctgaaaatgtctttcttttgcctaagcataaaaaagaaaacagcgttgcgtattgtcccgttccgttattttctgtctttaccgtccggcaaatttattgccgctgcggccgtctttaattgctagtgatgcggcgacttcctcctcaccttttagtttccccacatcgcggataatgaatgtcgttatagataaataaaccctgaatatgcagaaacctgcggaccatctggcccacaggttttgtctcaacgccgatttgtcggcgtcacagctcatcagtcgctagctgtcaccggatttacggccgccgccatgactgttcttaccacccttcttaccggcttcggatgcacgttcaggatcatttttaaagttcccgccgctgtgctgtccgcctttacgcccggcttcggatgctttctcacgatcttctgcaaaattacctgaaccgcctctatgctctgccataattttcacctttggtttgatcaatatcggttggtaaatggaaaatgaccctgttacaaatcatcgccctcgatatctaacactagaggaatgcctgcaggagtcaaattaatttcagatacccatccgcgcactgacaaaataaagctttactaacgaagcggtaagataaaatatacctcacacaactcctttatttgacgtaggttatgttcaccggcgggtaaaacagaaacgtccaacggccgtttgtaaaaaaatgcaaacgatttaatgaataaatatttctttatctcgcggaacacaatacccagaaatattacccccaaagaggtatcaccttataggacatggtttgcgaatgaacatcttcatcgtttattcaggcagcaccttcatcgtaacttgagaaaaagatcatgcgcgttacgaaaatagcccttggcccttgattaaggatggaataatcctaatttaacgtcagcaataataacgcaacgctatcccccgaaatacgccaaggatcagtcggttaaggcataccgttacgcctacggttggccattgactgcgatgttgcgagtcatccagggtctgtcgccaggagaagctgacctattcttagagctggcccgttctgtctgaaggagatgactatgcaagatgaaaaaccgccaatgaagaagttacccacctccatgttgccagaagagacggctccacgtccggagttcccggagcaagaacaaaccccgccgggtctggatgcggaaatggagccatccccggaccacggtgaaaccagctacaccggctccgggcgactggccggtaagaaagcgttaattaccggcggcgactccggtattggccgtgcggtggcgatcgcctttgcccgcgaaggcgccgacgtcgcgataaactatctgcccgaagagcaaaaggatgcggatgaagttatcgccctgatcaaagccgaagggcgcaccgcggtcgccctcccgggtgatattcgctccgaatccttctgccagtcgctggtggccgacgcggtggaacagctgggaggtctgagcatcctggttaataacgccgggcgtcagcaatactgtgaaacccttgaggaactcactaccgaagatttcgacgctacctttaaaaccaacgtctacgcgccgttctggatcacccgcgccgcactgcctcacctccaggccggaagcgcgattatcaataccacctcggtgcaggcgtataaacccagcccgatcctgctcgattatgcgcagaccaaagcctgtctcgcgatcttcactaaatcgctggctaaacaggtggcgaaacgaggcattcgcgtgaacgccgtagcgcctggcccttactggacggtgctgcaatccagcggcggccagccggacgagaaggtgaaacagtttggcaaagacacgccgatggggcgcccgggacaaccggtagagatcgccccgctgtatgtcaccctggcatccgatgcctgctcatatacctccggacaggtgtggtgctctgacggcggggatggtgtggtctaagcctcccggcataccgacgcgcgccagcgcgcgccggtattttcccggccaacccttgcggctatatactggcccctcgcctcccggttgcggccattttttctttcctccactccgttactctggccgcatgctatgatgtccgcccgccgctgtgcgctaaccctggccccgacgccacccctgaggacgacagatgagtaatgacatccccctgaaattttatgacatcgtggacgaatacgagaccgaagcggctgcgccggtaaaggatgaagaacgcgatgcgctggcgcgctatttccaactgctgattgcgcggttaactaataacgaagagattgacgaagaggcgcagcgagaaatggcccgcgaggcggccattaacgaagaccgcattgacgatatcgctaatttccttaatcagtggggcaacgaataaagctcaacgtcagcctaccggcggaattgccttccgccggtgctgtcggggcgcgaagcgccaagactcagccgtggccagtctcctctcccagacgcctctgcagcgcatcaagaaatagcggtaatccgtgaggttggtagtcgcgggaaagatagatgccgtaaacgctcaacgccttcggcgtccactccggaagcaccacctccagcgtgccgctggcaatcgcgccccgggcctccagttcgggaagcatcgcaatgccgcacccggcaaccgccgcctccagcagcaatgaagatatccctgcgctcagattaccgttcaccgccaccgacgcttcccgcccctgcgcatcgctgaactgccagtgctggctggcgaaatggctgtatagcaggcagttatgtcgttgcagatcgtcgggcgtcgtcaacgggccatgctggcgcatccagcgcggcgcggcgcagagcagcgaacggcacactccgaggcgacgagcgatggcccccgcctccgggttgtcggtaatgcgaatggccacgtcgatacgctcgccgatcaggctgaccggatggttattgatatccagctccaggcgcagcagtggatagcgggcgagaaagtccggcagcagcggagagatcagctgcatggcggtaaagtgcgcgcaggcgacgcgcagtgtgccgctgggatcggcccgctgacgctcgccggcgatttcatcggcgatccgcgtcaaaccgcgggtcttgagcaataccttctccccggccggggttagcgtcagccgccgggttgagcgatggatcagccgggcgccggcccagctctccatttgttccagatagcggctcaccatcgggcgcgacatccccagcgcccgcgccgcggcgctaagacttcccagctcgcagatgcgcagatacacctgcgcagcaatcaccctgtccatcactccccctgatctgcacgttttatgaaactcagcatctcttgtttcaggaattctatcaaatagcgaaatccgtacaatggaacgcattcacctgttactgagaataaatcatgaaattatctgcccttgctgttgctaccgccctgttcagcggcgcggtcttcgcggcgcctctgacgctgcaaacttacaacccgcaggaaaaaggactttttgccgtcaactcgaccctcgtttccggtccgcatgaagcggtacttttcgacgcgcagttcagcgtcaaagatggggaaaagctggtggagatgatcaagaaaaacggcaaaccgctatcgcggattgtgatcacctctggcgatccggatttctattttggtcttgagccgctggtaaaagccttcccgcaggcggaggtggtcgccacgccggaggtcgtcaaacatattgcagccaccaaagcggccaaactggcgtactggggcccgcaaatgaaagacggcgcgccgacgcaggtgtatgtcccgcaggcgctggaggccaacagctttaccatcgatggcgagaaagtgaccatcatgcagccgcatgactacgcggcgttcgtctggatccgggcgaacaaaacgatcctcggcggcaccggcgtggcgtggggtatgcatctctggaccgccgacacccagacgccggccagtcgtcagcaatggcgtaatacgctggaccagatgatcgccctgcacccgcagcgggtgatcccgggccattatctcggcaccccgccggagggagacagcgcggtgcgctttacaaaaacttatctccagcagttcgagcaggcgctgaagacgcattcggattcggccggggtgatcaaggcgatggaggcacagtggccgggcctggcggagaccagctcgctggagttaagcgccaaagttaataccggtgagatgaagtggtgacccctgcggcgcgcaaggaggactgttcttaatctggctacccagggttgctattaccgagaaaatggaccaccctacctgtggccgcacaaaaaacgcgcggccgactttgggttacatttcatccggtcattaccgggtttgcccttgaaaccagaacaggataaaggagtcagaatgaaatcgaaccatcaggcacgtcatcttctcggtctgaactataagctttcccggcagaaaaaagtggtgctggaaggcgatgaagaaaccaccatcaaccacatccatgctaccggccgcaaacgccgcggtggttaattttcagcctgagtgataataaacaacaccgtcctgttgccaggatggtgtttttttatggcaattgactgcttgtttacccgcttgaagaccttctgctctatactctgcccgctgctttccacccgcccttcgcttatcgccgcgccgggactgtggtcatgatcaaggagttagtgcgatgcaatttacccataagaaaaaccgttccctgtacatcccctacgcgggtcccgttctgcttgaattccccctgctcaacaagggaagcgccttcagtatggaagagcgcagcaatttcaatctgctcggcctgctgccggaagtggttgaaactatcgaagagcaagcggaacgcgcctggatccagtatcagggattcaaaactgaaatcgacaaacatatttatctgcgtaacatccaggacaccaacgaaaccctgttttatcgcctgatcggcaaccaccttgaagagatgatgccggttatctataccccgacggtaggcgcggcctgcgaacggttctccgagatctatcgtcgcgcccgcggcgtctttatctcctaccagaatcgccataaccttgacgacatcctgcaaaacgtcccgaaccacaacgtgaaagtgattgtggtcaccgatggcgagcgcattctcggcctcggcgaccaggggatcggcggaatggggatcccgatcggtaaactgtcgctgtacaccacctgcggcggcatcagcccggcttacaccctgcctatcgtgctggacgtcggaacaaacaaccagcagctgctcgacgatccgctgtatatgggctggcgccatccacgcattaccgacgacgagtactatcagttcgttgacgacgtgatccaggcgattaaggcccgctggccggacgtgctgctgcagtttgaagattttgcgcaaaagaacgccatgccgctgctcaaccgctaccgcaatgaaatctgctcgtttaacgacgatattcagggcaccgcggcggtgaccgtcgggacgctgatcgccgccagccgcggcgccggaagccagctgagcgagcaaaaaatcgtctttctcggcgcgggttcggccggctgcggtatcgctgaacagattatcgcccagatcgtccgcgaaggactcagtgaagaagaggcccgccagcgcgtgtttatggttgaccgcttcggcctgttaaccgacggcatgcctaatctgctaccgttccagaacaagctggtgcaaaagcgtgagcagctgcagagctgggataccaccagcgaggcgctgtccctgctggacgtagtgcgcaacgtgaagccgaacatcctgatcggcgtctcgggtcagccgggactgttcacggaagagattatccgcgagatgcacaagcactgcccgcggccgatcgtgatgccgctctccaacccaacctcacgggtggaagcgacgccgcagaatatcctgagctggaccgacggcgaggcgctggtcgccaccggcagcccattctccccggttaccgtgaaaggcaagcagtatcccatcgcccagtgcaataactcctatatcttcccgggtattggactgggggtgatcgcccccggcgcgtcgcgggtcaccgacgagatgctgatggctgccagcgaaaccctggcgcagcactcgccgctggtcaacaacggcgaaggtccggtgctgccggagctgaaggatatccagaccgtctcacgggcaattgccttcgcggtcggcaaggtggcccaggagcaaggcgtggcggtgaaaacctccgccgaagcgctgctgcaagcgatcagcgataatttctggttaccggaatatcgcaattatcgccgcacctcgatttaatcactgtcaccgggtcgacatatcggcccggttattaataacgtcagaataatacctcccgccacagaaacgtttttttcgcccatattcattcatcgtaagaatataaaacggatagcatttgccgcgcgccctccgctgtgcaaaatagttgtttctcaccccctcacaacggaatgtgaaatgctaaaattaacccctggcgcgaataaagcgaatgcgattctgatccgtattgtcttgtttcttatcggcggtatcgccatcatcaccggaatgtgcctcttcagcggtgatatgtggatgctcaccccgcgggcggaacagtatcagcccgccactggcgatctggtggatgtcgtcatctatgaaccgagtaaatttttcttcgctctgctctacgtgtttattattaccctggtctggctactggcggtacgtaaaatcccctggcggccgatacagcatcctatattaccgctgatggtactgattgccgccgggatatttattttcctccacccggaggtcaccccgggtcgggatgccagtgttcagtacggtaaacacaatacctattatgcgtccatattctggatgaaaacccggtcaggtagtcattccgctaagcaatcaaaatatgaaacctttgttgaagcgaaagatccccgctggcttatcgacagaaacaatcttcgccgcgcctggcgctgtgaagtgcagcggcatacccagttttacaccctgtcattcaatgagggctggttcccgaacggcgatccgcaggtccttgccaaccagtgtagtcagattgccgatctggatacggtctctgaagacgagctgcttgtcactaaaaccatcaggagccgtaaatgagccagcaaaaaatggttttgcagccgatattacgcctctggctggggctgtttagcggactgttgctggtgagcgccatcagcgcctttcacggtgagtactggtatttcggcgataagcaggcgttttacgcggcgaaagccggcgaggtctctgtgcatgaactctatacgccggcgaaaatcctctttgcttttatcgtcagcacgatcccgccgctgctgtggctgctgctggttaaccgtcgggcgccgcggctgctgacccacactctcccatcggtgttactcctgctggcgggtttgctgtttttcttcctgagacccgacgtgattcccggcggggaaacccctgtctatcgctacggcgagcgggagcgctactaccagacgatacgctggcagaaaccggagcctggcgcgtggcggggtacccgctctgagtacaacgtgtatatcgaatatcgtgatcccaggggatatcgcaaagtcgacaatattaaaaacgcctatacctgtgaaacccaccgggagtctcgcttttttaccttaacgaccgaagaggattggtatccggattcgtatccgaatattctcgaggctccctgccaggcgataaaggatccccaggcgatgacggaatatacccgcgaccacgcccgctggtttcccattacgttttagcaaacacactagccttttgcgccaacaatatctcgccggtaatggcactgaacacgaaaactggtgggtatcggcccctgccagttttgtcactggcgcgctttccctttccccactacactgccatcacccatccacttactgaataaaaaaggaggccccccatgctgtattgtgaaatgtttattgtttcacatgccttaggcaattgcgccagctcaagcgttatcggtatcgtgctgcgataactatggcttgagcgaagacccttcacgcaatcccttctctccggcttaccgggttatcgtcagcgagttttgacgaggcatttgcatgcctgtaactcttgagtaagttgactatgagtacattactaactgcccatgcgctccacgtggagacggcttttgggccgctgtttaactccctctccttcaccctgaagaaaggcgaccggatcggtctcatcggccataacggttgcggcaaaagcaccctgctgcaggtgctggacggcaccctcgcgcccacctcgggcagcgtctcgcttgccggtcagtgtctgatggcccgcgttgaacagcatctgccggaggcgctgcatacgcagtcgctgctgcaggcggtgctggccccattacccgctgatgtacgggaagcgcagcgctggctggccgaacgcctgctggcgcagatgggctttaccccggcggtgatggagcagcagaccgccaccctgagcggcggccagcacacgcgtctgctgctggcccgggcgctgatccgccagcctgatctgctcttgttggatgagcctggcaaccatctcgatctgcccaccctgctgtggctggaaagcttcctgcaaacctggcaggggagcttcgtactggtgtcacacgacaacaccttactgggtgctgtaactaatgcgagttggatcctccgtgaccagacgctacattgcttcgccttgccctgcagcgctgcccgtcaggcactgcaggagcaggatgaaagcgccgcgttacgtcataaggcggagcaaaaagagatcgaccgggtcagcgccagcgcccggcggctggccacctggggtcgggtctatgacaatgaagatctcgcccgcaaagccaaacagatggagaagcaggtcgcccgtctgaaagacgagcagaccgagctcagcgtcggcccgccgtggcgcctggtgttacagggggacgccctgccggccgaccgccttttggagatggacacccttcccgtctcgcccgcgccgggtcagccatccctcttcaccaccggcgtggcgcgcctgcgcagcggcgatcgcgtggccatcatgggacgtaatggcggcggcaaatcgtccctgctgcgcctgctgtggcagcagatgaacaacgcatcgcctctcccggggctgcgcctgcatccccggttgcaccccggctactatgaccagacgctggcgcagttgccggacgaggccagcctgctcgaggccctgacgccgtttgccccgtcggcggacacccgtaaacgggcgctgatcgccgccgggtttggctgggcgagacatagccagaaggtcagcaccctcagcggcggcgagcgatcgcggctgctgttcgttggcctgtcgctggcgcgctacagtctgctgctgctggatgaacccaccaaccatcttgatatggagggtaaagcggcgctggcgcagacgctgcgcgattaccccggcggcgtgctgctggtcagtcatgaccgccagctgattagcgaaagctgtaaccgcttctggctgattgacagcgccgggctaacggagtggcacagcctggaggaggtctatgcccgtctgcaggccgtggcgcccgccccggacagtcggctcgctttgcagagtacacccgccggggctgacgatgatgaggaggcgctgctggcgcggctgattgacctggagcagtggctggctgacgacatggcccgcaagccaaaacatcaaaagccgtcactgcaggcacagtggcaagaggagattgaccgcctgcttaaccaactgacgtaatctccatgtccccccaccggctaaggcgccacgcccttagccggtgtttccggaccgggtaaactgctgctcggtcattacctttccccactgctccccctgccattcgcggattaacgtgaagccaaaggattcatacagtttgcgggccgcgtccagccctttaaaggtccacagctgcaccgcgctaaactggcgactatcgcagaaagccatcgcctcgctgaggagccgcctgccaatgccggttccccggcagctctcatcgagaatgaaccagcgcaaatgcgcctcctgctggccgaggtcctcgccatcgatagccagcgagccgacgattttcccttcgcggatcgccagccagatctggttggccggggaggagagccgggtggcaaattccgctacgccgctggcgaccttgccttcaaaaaaagcgccaaagtcatgatgacgggcgtaatactccccgtgcatctgggctatccggccgatcatccccggctggtagccggtcatcagcgaaatttgcggagccgtatccgcgagcgcgctatcccgacactgcgccagcgcccgggcataggccgccagtccagtggcgacagtttgctgctgcgtctcatccagatggtctaacgccttcaccacctgacgggtaccccaggcgttaattttcgccaccgtatcgtgcccctttgccgtcagggcgagtgatttcgcgcgcgcatcctccgcgcaaggacgctcctccagctcaccagccgccagcagacgagagaccatccggctgacgcttgatttttccagtcccagcaacgtgaccagctgcgcggccgtcatctcccccctcatcgatacctcaagcagggtgtgcaccgccgaaggtgaataatgggtggcggccagcgtggtgctcataaagcccagctcgcgcaccattaaccgcgaggcggtacgaatctgttggattaagggggtatcaggcatggcggcgggtccagaaaatgaaatggttgtacaatacaaccatcgccttcatcctgcgtcaagatgcaatatggtgggataagcgttgtcgtgtgacgtgtgacgtgtgacgtgtgattttgccgccatagggatcgtgaaagcgaatgccgcgggcgccggacagcgcccgcgatgaatattattgcgagttcttcgccttccaggcctcccaggccgatttgatctcctgcttcgcggccgcggcgtcattaaagccggccagctcgacctttttacgcccctccggcagttctttatagacccggaagaaggcctccagccgctgctgttctattttcggcagatcggagatggtcttgatgtcgtcgtaggtcgggtcaattttactggccggtacggcgatgattttgtcgtctttctcaccgccgtctatcatcttcagcacaccaattgcccgcagcttaatcagcgtgcccggggccatcggcgcgcgggtataaaacaccacgtccagcgggtcgccatccccggccagcgactgggtcagcgagccgtagttcgccgggtaggccaccggcatcgactgaaagcggtcggcgacgataaaccccgttttagcatcggtttcgtacttaatgatcccgcccgtcgggatctcagtgacggcgtaaaattcttccgggttgttttccggctggggaaattccagcacattgtgggcctgggcggcggcggacaaaagcagaccggcggtgaggatggtttttaccagatgcattgttgtatcactctgttgttataagaaattgatgcgcaaaacaatagattcgagtgatgacaaaaacatgaccattcagcgtcaatattattacctaccaaatatagcgatattgtctgaattttgtgctatctctgtagcaaaaagccacattctgtactaagcgccttgtattttaccactcagcgtctaatccttattgggtactattgcattaattaagttaatcaattcccccacaaggagacaggcatgaaggcagctgttgttacccacgaccatcaggttaacgtcacggaaaaaacgctgcgcccgctggaaaacggcgaagcgctgttgaaaatggaatgctgcggcgtgtgtcatactgacctgcacgtgaaaaacggcgattttggcgataaaaccggcgtcattctcggccatgaagggatcggggtggtacaaaaagtcggcccgggcgtcacctccctgaagccgggcgaccgcgccagcgtggcgtggttcttcgaaggctgcggccactgcgattactgtaacagcggcaacgagacgctctgccgctcggtgaaaaacgccggctataccgtcgatggcggcatggcggaagagtgcatcgtcaccgccaactacgcggtaaaagttccggacggcctcgactccgccgccgccagcagcatcacctgcgcgggcgtcaccacctacaaagcggtcaaggtctcccacatcaaaccgggccagtggatcgccatctacggcctcggcgggctgggtaacctcgcgctgcagtatgcgaaaaatgtctttaacgccaaagtgatcgctatcgacgtcaacgacggacagctggagctggcggcctcgatgggcgccgacctgaccatcaactcccgcaatgaagatgcggcgaaagtgattcaggaaaaaaccggcggcgcccacgctgcggtagtaaccgcggtggctaaagcggcctttaactcggcggtggatgccgttcgcgccggtggccgcgtggttgcggtgggcctgccgccggaggcgatgagcctcgatattccgcgtctggtactggacggcatcgaggtggtcggttcgctggtcggcacccgtcaggatctggtggaagccttccagtttgccgccgaaggcaaagtggtgccgaaagtcaccctgcgtccgctggaagatatcaacgctatcttcaaagagatggagcaaggtcagatccgcggccgtatggttatcgatctgcgtagctaatcacccgcgcctctcccgtccgggagaggcgatccccctggcacgtcctctcgcttcccaacccgggaagtaaatgcaatttccgcaaatgcttagcgcaattccttggttcctttgtttttagccgcgcccgatgatggcaacacaatagataacaaaggaattcaccatgcatcgtcattttcgcctgcccgcgctggccgcgctgtttctcaccggcgccttttccgtctgggccgccgacacgccggttaaaggcggcaccttaatttatctggagcagcaaccgcacaccaatctctatccgcccgccggcggcttttacccgaatggcgggattctcaatcagataaccgacaagctcacctggcagaatccaaaaacgctggagattgagccgtggatcgccgagagctggaccagcaatgccgataaaaccgagtacaccttccacctgcgcaaaggggtcactttctcagatggcacaccgctggacgccgccgccgtcgccaaaaacttcgatacctatggtctgggagataaagcccatcgcctgcccgtctcagaggtcatcaataactaccagcgcagcgaagtgatcgacccgctgacggtaaaattctacttcaacaagccgtcgccgggcttcctgcagggaaccgccaccatcggctccggtctggtatctctcagcaccctgcagcgtaattttgaagagctgggcgatgcccgacatattatcggctccggccccttcgtcgtgcaggatgaaaaaccaggccgcgagctgacgctggtggcgcgcaaggattaccagtgggggccgaaaaacattgcccagcaggggcccgctaacctcgacggcatcacctatattgtgacgccggaagacagcgtgcgtatcggcgcgctgctggcaggtcaggcgggctttattcgccaggtgcaggcctacgatgaaaagcaggctaccgatcagggatttaagatctacgctgcccctacccgcggggtcaacgacagcctgagcttccgcccggataacccactggtcgccgacctgcgggtgcgtcaggccctgctccatgctaccaacgccaggcaggtggtggagacgctgttctccgctaactacccgcaagccacctccgtgctggccagctctgccgccggctatgtcaatctcagcgataaactcaccttcgaccaggccaaagcccggcagttgctggatgacgccggctggaagcccgccgccgacggtattcgcagcaaagacggtcagcggctggcgctgaccgtctatgagtcgctgccgcagccgcaaaataaggaagtgctgcagctgatcgcccagcagtggcgccaggtgggtgtggcgttgacggtcaaagccggggatgccggtagccgtacgctggataacctcgacccgcagaaaaccccgctcaccgtctcagaagtgggccgcgccgacccggatgtggtgaaaagtatgttcttccccaacaaccgcgatgcgctgctgcagaaaggcggctccagcgataaagtgcagcgcttccgcgatgataagctcaatgacctgctgaccggcatctccgcggcggtagagccgcagcagcgcttgcagttaaccggtgacgcccagcgctatctgatcgataacgcctatgtgatccctattttcgaagagccgcaggtgttcgccggcgcgccgtgggtcaaaggcgtcagcttcgaggccgtcggtcgtccgtcgttctacggcgcgtggctggacaagcactaagaggccggttatgagcgcttatcttctgcgacgattcggccaggggctgctggtcctgtgggcggcctttaccctcacctttttcctgctgcaggtcctgccgggggatgcggtgctgatcaagtttcagaacccggacctcggcctgagcccggcgcaaattgcggagatgcggctggcctacggcgccgatagcccgctgtggcgccagtacctgcacacgctgctggcgatgctgcacggcgacttcggctattccctgcaggcgggtctggcggtcagcagtctgattgccagcaacctgccggataccttaagcctcgcgctgccggccttcctgctggcggtggcgctggcgttcgccctcgctttcgcctcgcggctgccggggctgcgctggctgagcaattttctgcagtcgctaccggtgctgtttatctctctacctaccttttggttgggtatcgccctgatccagctcttctcgtttcagttgcgctggatcccggtaatcaaccccggcccactggaaggactgattttaccggttatcgccgtcgcgctgcccatctccgccccgctggcgcagatcctgatgcgcagcatggatcaggtggcggttcagcccttcgtcgcggtcgcccgcgccaagggcatgagcgaaacgggcgtcctctggcgccatgtgatggggaatgccctgctgccggcgctgaatattgccgggctgctgctcggcgaactgattgccggggcgctgatcaccgagaccgtcttcggccgcagcggcctcggccagctgacccagcaggcggtcaataaccaggatatcgccgtactacaggcggtggtgatgatctccgccctcggtttcgtcctgatcaacctgctggtcgacctggtcatgccgcgactggatccccgactccatttacagaccggaggtgcgaaatgagcctggtcgactataccatcgcggttcgccgccgcccggagtggcgtagagtgcgcctgcagcctggcctgtggctggcgtgggcggtgatgatcgccgccctgttaatggccattgccccacagtggtttacctccgctaacccgctggaggggatccccggcgctcagcgcctggcgccgcaggcgcactactggctgggtaccgaccagctggggcgcgacctgtggacgcgggtggtttacggcgcggtgcattccctgtcggcggcgctgatcgccgtcgccatcggcctggtggtgggtaccgcccttggcaccctcgccggggcgctggccggacgcgtggaatccaccatcatgcgcctggtcgatgtcctgctggccatcccctccctgctgctgcagctcacggtgattattctgctgggtttcggcacggtaaatgcggcggtggcggttggcatcgcggctatcgccagcttcgcgcgcctggcgcgagcagaagtggtacgcgtgcgccacagcgattacgtcgaggcggcccggggcagcggcggcacttttttcgccgtcttctggcgccatattctgcccaactcgctcactgcggtgcttgctttcgcgacgctgcagttcggtcaggcgatgttggccctggccaccctcagcttcctcggctacggcactccgccgccggtcccggagtggggactactgatcgccgaaggtcgcaattacctgtcaaccgcctggtggctgaccaccttccccggcctcgccgtggtcgccgtggtccttgccgccaatcgtcttagccgccagtggagtggagcacgcccatgaccgttctgtccgttgaagatctacgcatcagctaccgctcgcggggcgaatggcgcgaggtggtgcacaacatcagcttttccatccagcgcggcgaaatgctggccttcgtcggagaatccggctcggggaaaaccaccaccgcgcaggccattatcggcctgctggcggataatgcccgccgggatgccgggcggattgtcctcaatggcgaagtgattagcgactggtcggataaacgcctgaaccgcctgcgcggagtgagcatcagcctggtcccgcaggatcccggtaattcgctcaacccggtaaaaaccattggtcagcaggtggaagagatcctgcggctgcatcagtccctctccgccgctgagcgccgacagcaggttcttaacctgctcgctaaagtcggtctcagccacctggaacagcgttttgaccagtatccgcatcagctgtctggcgggatgaaacagcgggtgctgatagccatcgccattgccctgcaaccggatctgattattgccgacgagcccaccagcgccctcgacgtcacggtgcagaagcgcattctcgacctgctcgatatcctgcgtcgcgagtcgggtaccgccgtgctgtttgtcacccacgatctggcgctggccgccgaacgcgccgaccggatcatggtgtttcgccagggagagattcaggaacaaggcgccaccgagacgattgtccagcgtccgcagcatccttacacccgccagctgctccacgacctgcaggatgcgccgttgaggctaacggcggcgcgtcaccggccgctggccacgccggccattcgcgtggaggggatcagcaaacgcttctcgctgggcaaacaggcgctgcaggcgctcgacagcgtcagctttgaggtcagacgcggcagcacccatgcgctggtgggcgaatccggctccgggaaaaccaccctggcgcggatcctgctgggctttgagcgcgccgacgccggacaggtcatcatcgacggtatcgacgccgggcatctcagccgcgaggcacagcgtcagctgcggcgcaagatccagtttgtctaccagaaccccttcgcttcgctcgacccgcgccagacgctgtttgcgattatcgaagagccgttaaaaaactttgagcgcctcagcgcggcgacgcgtcgccagcgtgtggagagcgttgccgcccgggtggccctggcccccgagctgctgtcgcgtacgccgcgggagctttccggcggccagcgccagcgggtggcgattgcccgggcgctgatcctcgagccggcgatactggtccttgacgaagcgacttcggcgctcgacgtcaccgttcaggcgcagatcctcgccctgctgcagcagctacagcagcagctgggtctgagctacctgttcattacccacgatctggcgacggtcaggcggatcgccgacagcgtcacggttctgcgcgccggccaggtggtggagcatggcgacgtaaactgcctgttcgccgccccgcagcaggcctacacccgcgaactgatcgccgccattccccaggtttccccccgcttagcacaggcccacacggagaacgcataatgcctaaacgcctcggtttttttacccgtctgctcgatcagggctccgcgcaaacgcgctaccggctggcggccgaacagatccgccacgcggagcgtttgggcttcgacagcgcatggattgcccagcaccattttcatgaacaggaaggcggcctgccttcgccgctggtgtttctcgcccacgtcgcggcgcagaccgaccggatccgcctcggtacggcgattatcaccttgccgatggaaaatccgctgcgcgtcgccgaagacgcggcggtactggatttactcaccgacggacgtctggaggtgggttttggctccggcggcacgccaacctcgtttctgcccttcggcctgaccagcgagcagcgcggggcggcgtttgccgaccatctgcacctgatccatagcgcctggcgcggcgacacgctgagccacccggacaaccgtctctatccgccggcgccgcagttggcggagcgtatctggatcgccaccttctctgcggagggcgccatccgcgccggtcaggcgggacacgggctgatgctgtcccgcacccagccacggccacccggcgagccacgtctgccgctggacgccattcagaacccgatcattgacgcctacctggcggcgctgccggacggcgttgcgccgcggatcctcgcctcgcgcaccgccttcgtcgccgacagtcacgcccacgccctgcaggtcgccgagcccggtctgcgcaagcaggcaactcagcaccgggcggcgggtcatacgatagaaggtgacagtgtcaccgactatctgcaacagctggatgcccacgttggcgatcctgagcatgttattgcctccctggcgcaggacagcgtgctggcccgcgccaccgatatttcgtttcaggtgcactcggtcgagccttcgcaccgggatacgctgcgttccattgagctgatcgctcagcatattgccccccacatcagataaggagtccccatgacgctgagtcaggatattctggccgaactggcggagatcgcccccggttccccgctcgatcaggcgcgcgccgtccgcgatgccgccacccgtcacgcccagggaagttatgaagtgctgttccgccagcaggacgctgactttcctcttgatgaacgcttcgcggtggccgcgaaggtggcaaaactgcaccaggcggacgcgcttgcggcgcactatgccggtttcggcctcgccgatccgaccaccgatcgtctggtcccggcgctggcctttgcccgcctgctcaccttcacccccgttgaagccactcccggcgcgctgcacaccttaaccggcgcgggctggagcctgcggggcatcgtcaccctggcgcagctggtagcctttgtcagcttccagagccgactgctgctgggcctgcgggcgctcaaccataagcccatcgtcagcgcagatacgccgctggtcgccggatactggcataccaccccgtacgcgcagagcggcaaagcggccccggttcgcttcacccgcgacgagctgcactgggaaccctggctggccgataaaccgctggaggaattcaacgctgaagaacaggcgattctggccaaatatggccatagcgactccccctactttcgcctgctggcgcgcaaccagccggtgctggagcagcggaccctgaccgataggggcattttctataccgcgggaggattgccgcgcgccgaacgcgagctggccgccacggtcgccagtaaaatcaacggctgtatctactgcgcctcggtgcatgcccgcaaagcggcgcagctggcgaaggacgagaccgccgtcgacacgctgctggcggtgacgccgggagaggatctacgcgatgggcaatcgccgcgctggcaggcggaaatcgacgccgccgccgcgctatcggtgacgccacccgcgttaaacgccgatcatctggcggcgcttgatgagcagggcttagatactctggcccagctggatctgctgcagtccgcggcctttttcgcctgggccaaccgcctgatgcttaccctgggcgaaccctggcgtgagtaggcgtcgttagtaagcttgtcgccgctgatggcagccatagatgagcaaggcgctcatcgccagaaacgacagcgcggcggcggggagcgccacgctgttccagccaaagccctgggcgatcatcattccgccgcagaaggcgccgatggcgctgccgaggttaaaggcgatctgtcccccggccgcccccagcatctcgccgcctttggcgttctgcagcagcaggatctgcagcggcgctgacagggcgaatagtcccgcgcagcagagaaatgccagcgccagcgaagcgactttgtgttcaccgaaggcaaagatcagcagcagcgtcacggctatgaccccgtcggtcatggccgcaatgcgcagcgggctgtagcgcccggaaattttgccgctgaacagattgccgaccaccattcccagccccgccagcatcataatcagcatcatcttgctttcagcaaagccggatacattgagcataaagggcttgatatagctgaaccaggcaaacacgccggcgttaccgaacatggtggcggcgaaaatcagccacggcgccggggaggcaagaaaacggaactgctcgcgcagccgcgtgctggcccggtcataaagcgtgggcacccagcagaagatcgccagaaataccgccacgttaaataccgcgataagcgcaaaggtatagcgccagctgaagtgatgcccaagccaggtgccgcccgggacgcccaccaggttagcgatcgtcatgccgccaatcatccccgccaccgcggcggtcaccttccccggcggcgcgattttcgacaggataatcgcgccgacgccaaagaacgccccgtggggaaacccggaaaccagccggccaagcgccagcatggcgtagctactggagaaggtaaacagggtattgccgagaatacacaggccagccaggaacagcatcaccgatttcagggaaaaccggctggagagcagcgccatgatcggcgcgccgatcaccacgccgaaggcataccaggcaatcatattgccggcggcgggaatggatattccgacatcgtgcgccatatccggcagcacgcccataatgccaaactccgccatgccaagtccaaaggtgcccagcgccagtgaaaaaatcgtttttttcatacatcttataggggtattgagagccggccggcattatttactatcccgccccgacacaccagctaaaaacgcccgacggcagtttcctccatacaacagcctgattcgttcatgttccccagccgcgtggcataccggcggcgtggtttcgcagtaacaatcccctatcaaaatcagtgggctcaaagagataaacacctcattgatctcaagttaacttgaggttgtaaagtcaaaacatcgttcaccttgggagaattatccatgcaaagtgttgatgtcggttttactcatgtcgcctttaccgtccgctgtctggccagcagcatcgatttttatacccgctataccgcgatgaccgtcattcaccagcgcgagcccgccctcccctcggcgcggaaagtggcatggctcagcgaccgcacccggcctttcgccctggtgctggtgcaaagtgacgatccggccgatacgccgctgggaccgttcggccatctcggcgtcgcctgcgccacccaggccgagatcgatgagaaagtggccctcgcacggcgggaaggtgttttacgccgggagccggagcagctgggcgatccggtgggctatttcgctttctttgccgacccggacggtaacaccctggagctgtcgtgggggcagcgggtgggactggaagtcatcctggcgggaaaacccggcgaataattttccaccgcctcgccgggggaggattacacttcaaagggatacctcggcaacacggagcatggcgatgggcaacaagaaaagcggtaatccggtcgacacggcggcaaaaatcgcgccgctcgacaacaaagcgtacgagaaagcgctgcgcaaactccacgttgagctggtgaaactgcagcgctgggtagtgcacaaaggactgaaagtgtgcattgtctttgaaggccgggacggcgccgggaaaggcggcaccattaaggccatcaccgagcgcgtcagcccgcgtatctttcgggtcgtcgccttaccctcgcccaccgagcgcgaaaaaagccagctctactttcagcgctatatcaagcatctcccggcggccggcgaaatcgtgattttcgatcgcagctggtataaccgcgccggcgtcgaacgggtgatgggcttttgtacgccggaggaggtgcagaagttcctcgacggcgcgccgatggtggagcgcggcatggtcgaatcgggcattattctgctcaagtactggctggaggtctctccgcaggagcaggagcgccgtctgcgggatcgcatcgacgacgggcgtaaaatctggaagctctcgccgatggacattaagtctttcaaccgctgggatgaatatactgctgcccgcgacgccatgttcgccgccaccgataccgcctgggcgccgtggttcgtcgcccgctcggaggataaaaagcgcgtgcgtctaaatatcatcacccatctgctgtcgcagatcccctatgaagctttaccggtggagcctgtgacgctgccgaagcgcaaaattggcaaaatgaaacagactaattttcctttccgcttcattccagagaagttttgattatttctcgtcgcgctggttaatgccagcgccaggtttattactataaccatgaatatttcaggctgttacttccctctggaagctgtctcgcaaaataaatattaaacttactgctggtatttattttttagtgggtaaagtaaataatcacagaaccaaccgcaaggagcctatgatgaaaagtaatacgctacgtaaaagacccactgacgtacccgtccagaaggcgtcagaacagccaggtaaggatttacgagaagcagataaacagcgacaacacaaggaattcattgccgcaatgaatgaatttattgcaaaaggaggcactcttactgatgatgaatttttcagggtgctatgatgcttgaataattcaatgtttatcgaaattgttctgctcagacaaataaaaccctgccatattatatgatcgtgcagaatgattattatgcagacctggccacgagagtcattattcctttaatgcgaccacaacagttaccacgctggcatcagcatgccgtaccaaggataaatatagaatttgacagctttttactttgtacgccaatgagcagtaacttaaataataaacggatcccgccacaggatttcgtctgcaatctgagtcatgcgcgccagggcgttatcgattcaatcgatacacttatcacgaactgctgactgccgggaacccgctccgacatctccggagcgggtttcgcgccgtgaaggcttacttcatcccttcacgactctctttcatcgcttccaggcgttcgacatcgcgataccagcgcgggtggtgtttcttcgcccagcggcggctcaccttgccttcaatcattcccttaatcgaccccttcacccagaacgccatatacatatggataaggatggcgtggatcagaatgatggccgatgttgcgtgaatcagcaggctatagcgaatcacctgcatcgggaaatattccgcaaaatatgggcgccagataatcaccccggtcaccagcagcacaaatatcatgctcatgatggtccagaacatcatcttctgcccggcgttatacttaccgacgcgcgccaccttatgctcgttgcctttcagcacctcgacgatgcctttcagccacggaatatcctgtttatcagggatgttatggtggacaaagcgcacgaacataaacatcagcgcgacaaaaatcagcaccccaaagaacgggtgcagaatacgccccatctgcggcgtgccgaaggtttccgttagccactgtagcgtcggaaagaagaacgatattcccgacagcgccaccaggaagaaacagataaccaccgtccagtgacaggcgcgatcgataaacgtcgtgcgcacaatcatcttcgatttactcatcatgcttctcctcgtcgtcgtcaacttccttgttcggcccgataccgatgtagtggtaaatcagcccggcgaaggtggcgataaagcccgctgccgccagcggtttcagcgcccccttccacagactgatactggtatcgatctgcggttccttcggcagcttgtgatacagctccggctggtcggcatgatgcaggacgtacatcacgtgggtgccgccgacgcccggcgggttgtaaatcccggcgttggcataaccgcgttttttaagcttagccacccgctcctcggccacctccagcatctctttcttcgtaccgaagtggatcgcgccggtaggacaggttttcacgcaggccggctcctggccgacgctgacccgatccacgcacagggtgcatttatagacccggttatcctctttattgaggcgcgggacgttaaacggacaccccgcaatgcagtagccgcagccgatgcagttttcctgctggaaatcgacgatgccgttggcgtactgaataatcgccccagcggacgggcaggccttcaggcagcccggctctgcgcagtgcatacagccatccttgcggataagccactccagtttgccgttctgttcggtctcgctaaaacgcattaccgtccaggatttggcgctgagatccgccgggttgtcgtacaccccgacgcagtgccccacgtcatcgcggatgtcattccactcggaacaggcaacctggcaggctttacagcccacgcaggaggagacatcgataagcttggcgacttccgctttatagtcccgcgcgcgcggcgcgggggtgatcgggttggtcgcggagcgtttaataatgtcttgggtttccatcgccattgaatcgctccttacgctttctcgatgttgaccaggaacgccttgtattccggcgtttgcgagttggaatcgccaacgttaggcgtcagggtgttggcgatgtagcctttgcgggccacgccttcaaaaccccagtgcagcgggatcccgacggtctccacctgctggccgttgacgttcagcgtgcgcagtcggcgagtcaccacggcaaccgcgcgaatgaagccgcgcttgctgctgactttcacccaatcgccgttagcgatacctttgcttttcgccagcccttcgctgatttcgacaaactgttccggctgcgcgatggaattgagcaacgcatgcttggtccaggtgtggaaatgctcggtcagacgataggtggtcccgacatacgggaatttatccttcttacctaagcgaatggcgtcctcttcatacaaccgcaccaccgggctggagaccaccttcgggtgcagcgggttagtgccaagcggggtttccatcggctcgtagtgctccgggaacggcccttccgccagtttatcgagcgcaaacaggcgacccagcccctcctgctgcatgataaacggcccggttttgctccctggcggcgcggtattgaagtccggaatatcattcccgacccacttgctgccgttccactggatcagcatccgcttcgcatcccagggcttgccgttgatatcggccgaagcgcggttgtacagcacccgacgattgagcggccacgcccaggcccatcccagcgtattgcccaggcccgaaggatcggcgttatcacgattcgccatctggttaccctgctcggtccagctgccggtatagatccagcaagacgacgcggtgctgccgtcatcgcgcagcagcgcgaagctattgagcagttggccttttttcgccagcaaagtgccattttgatcgtagagatccgccagcgcgtagccgttgttctcttttgccacctcttccgattccggatggtccggctgcttgtagcgccagctcatcttcagcaggggttccgcgcccttcccgccttcggtgcggtacagttcgcgcaggcgatggtaaatcccggcaaggatttcgccatcattgcgcgcttcacctggggcatcctgacctttccagtgccactgcagccagcggccggagttggcgatcgaaccgtcctcttcggcaaagcaggtcgacggcagacggaagacttcggtctgaatcgccgacgggtcgacatcattagactcgccgtggttctgccagaaggtcgaggtttcggtcaccagcgggtcgataaccaccatatatttcagcttgctgaggctgcgaaccactttgtttttgtccgggaaggaggcaaccgggttaaagccctggcagatatagccggtgacgttgccgttatccatcatgttgaagtatttgataacgtcgtaagcctggtcccacttcggtaaccattcaaagccccagtcgttctctttttgcgccgcctcgccgtagaaggatttcatcaggctaacgaagaatttcgggtagttgctccagtagttcacctgctcgggcaaggtcgccttcggcgtgttggcgctgaggtagctatgcagatcggtctgtttgtccgatggcagcgtcaaatagcccggcagactggtcgacagcaggcccaaatcggtcagcccctgaatattagagtggccgcgcagggcgttgacgccgccgccggccatccccatattgccgagcagcagctggatcatcgccatggtacggatgttctgcgcgccgacggtgtgctgcgtccagcccagggcatacaggaaggtggtggtgcggtccgcggcgctggttgaggccagcacgtcgcacactttaaggaagtccgctttcggcgtaccgcagatgttttcgaccacctcgggcgtgtaacgcgaaacgtgctgcttcagcagattccacacgcagcgcgggtggctgagcgtttcatcgcgtttggcgtagccgttttcatcgaactggtagttccaggacgatttatcgtactggcgtttttccgcatcgtagccgctgaacagcccctcttcgaaggcaaaatcatcccgcaccagcaggctggcattggtgtaatgcttaacgtactcggcattgatcttattgttttcgatcaggtacagcagcacgcccgacaggaaggtaatgtcagtaccggaacgaatcggagcatagatatcggccaccgacgcggtgcgcgtaaagcgcgggtcgacgacgatcagcgtggcgtcgttattgtttttcgcctccatcgcccagcggaaacccaccggatgggcttcggcggcgttaccgcccatcaccaccacgacgttggcgtttttgatatccacccagtggttggtcatcgcaccgcgaccaaatgttggagcaagacttgctaccgttggtccgtgtcagacgcgcgcctggttgtctaccgccagcatacccagcgatcgcacaaatttttgcgttagcatgccggtctcattgcttgccgccgaggcgcacagcatgccggtggaaagccagcggttaaccgtcacgccctgttcgttcttttcaataaagttggcgtcgcggtcggctttcatcagtcgggcgatgcggttaaaggcttcatcccaggagatgcgctgccatttatccgagcccggggcgcggtattgcggataacgcagacggttttcgctgtggacatagtccagcaggcctgcccctttcgggcacagcgcgccgcggctcaccggatggtccgggtccccttcgatatggtagatcgcttctttggcgtttttcgcaccgtcgccgaggctatacattaatagcccgcagcccacggagcagtaagtgcaggtgttgcggatctctttcgcacgcagcaatttgaaattgcgtgcctgagccagcgccattttaggggcaaagcccagggcggcggcggtagttccggccataccgcctgcgcagatcttaaagaactttctgcggctgacgtccattgcattcctccatgcaggatgttgattcatcgcgcggaggaaactaacagcaaaatcccgggaaaatttgcgtcaaatcaaggaggaaaaccttcgcccccttaatcgccagccctggccattttcgctaatccctaagggttagcaacggcggaaaatttcgcccctcaccgataaaaagatgatatatatgccggctgcatttgcgtaaccatcaggaaaagcatggagaaaaagagagccacgacgatcggcttcgccgccattatcttatggagcacgatggtcggattgattcgcggcgtcagcgaaggactgggagcggtcggcggggcggcgatgatttacagccttagcggcctgctgctgatctttaccgtcggctttcccaacctgcgccagatcccgcgtcgctatctgctggccggcagcgtgctgtttgtcagctatgaaatctgcctcgcgctgtcgctgggctatgccgccagccgccagcaggccattgaggtggggatggtcaattacctgtggcccagcctgacgattttattcgccattctctttaacggccagaaaagcagctggctggtgatccccggcctgattttcgccctgctgggcgttggttgggtgttgggcggtgagcatgggctacagcccgatgagattatcagtaacgtcatttccagcccgcttagctatctgctggcctttgtcggggcgtttatctgggccgcctactgcacggtgacggccaaatatgcccgcggtaaaaacgccattacgctgttcgtcctgttaaccgccctgacgctatggctgaaatttctcgccagcgaccagccgccgatgctgtttagctggccggtggtcattaagctgatgacggtctccgtggcgctggggctggcctacgcggcgtggaacgttggcatcctgcacggcaacgtcagcctgctggcggcggcctcctacttcacgccggtgctctcctctgcgctggcggcgatcctgctgagtgcgaccctgtcgtggtccttctggcagggggccgggatggtatgtctcggctccctgctctgctggtacgccacccgccgttagccgagatcgcctccggctaccggcagcgtcacgccggtgatatagctggcctcatcgctggcgagaaacaggatcgcattcgcctgttccgccagcgtgccgtaccggtgcagcagactgctcgccaccgtctgatcgacgacctgctgataccacgccttttcctgctcgctcggctgctcttcgttacgcggcgtcaggcgcggcggcgcctcggtcccgcccggggccacggcgttaatccgaataccgctgccgctgtactccatggcaatcgagcgggtcagcgcgttaacgccgcctttcgccgccgagtacggcacccgattcactcccgccgtcgccaccgacgaaatgttgacgatgctgcctttgccctgcttcagcatccatggcagcgccgcgcggcagccccacagcgtggggaacagcgagcggcggatctctttctcaatctgctccggctgatattcggcaaaggggcgcgcccagatggtgcccccaacgttgttgatcagcacgtcgatacggccaaaatgagcgaccccggcggcaaacgcctgctcggtactttcccacgcttccagatccgcctccagcgccagcaccagacagccggattgcgccagcgtcgccgccagctcatggacgtatgacgagcgatcgatgagcagcagagccgcgccttctgcagccgcctgctccgccgtctggcggccaatgccctgcgccgcgccggtgatgacgacgactttatcggtaaaacgcattttgtctccttatgccgccgcgctctggctggcgataaatttctcataccagaaccccgccggggtgatcccgcggtcgcgcaacgccgtggcaaccgcgttaaccatcggcggcgggccgcagagatagatgtccacgtcgccgttgttcagcatcgcgtcgtcgagatggtgggtgacaaagccgcgctgcgggcaagtgctgttttcatcggccaccaccggtagccaacgataccccgtcagctgttgaataaaggtatccagcgcgtcggttttcaccagatcgcagtcacgagtaacaccgtacagcagcatcaccggacgctggctgccctgtgtctgcagggtatggagcatggagagcagcggcgccaggccggtaccgcccgccagcatcagcagcggacgttcgccgtggcgcagatagaagctgcccatcgggccgctgagggtaagacgatcgccgggccgcgcccgctgggttaaccactggctcatcatgccgccaggcacgttacgaataaggaaacgcccttcgagggaacccggttgcgagctaaatgagtaggcgcggacatgaagcgtgcccggcacctgaatgttgacgtactgccccggcaggaaggccagcggctcatcgagggcgaccaccagttcgatggcggtatcggacagtaaattcacctgccgcacctgcgccccgagcgtcgccagggccgttttgcactgcgcggcggccaccggcacatcgatcacgcagtcgctggtcgggaccatctgacaggtcagcacctggcgggcctgcgcttcgtcgtcgcttaacgcctcgtcgagataatcttcacccaggtcgtactcaccgctggcgcagtggcatttgcaggtaccgcaaacgccgtccgagcaatccatcggcagattcaccttctggcgataggcggcatccagcaccttctctccggcatggcattgaataaagcgggttacgccgtcctcaaaattaagagcaatattgaaggtcataagcgcctcttaaatgtggtaaacgtcaatcacctgacggatataatcgttattcaggcgcacggttttgcggacgatctgcggtctgccgtcctgttcgattagcgtgcagcaggtagagccaaaataggcatccgtgtgctgatagcgatggctccaggtgacccagctgtaacgcacctccagaccctcgtcgctttcgcccatcagctcaacgttgctgatgatatgggtggtccgcggctctggcgtgctggccccggagcgctcggttttaatgcggtagacgcgatcctccagcccttcgcggttggggtagtagataagcgaaatctctttttgcgggtcgcgggtcagctggtcatcgtcgccccacgccggcatccagtagaccacctgcgggctgtagcagctgagccattcgtcccactgacgatcgtccagcagacgggcttcgtagtagagaaactggcgaacctgttcgaggttaagcatcaggccacctccacgcgctgggtaatggactggtcgtaacgctgttgttcctgttcaatggccgccagcatcagcgtctgccagtggtggtgatgggcgatgtacagcgcttcgtcctccgatttcaccccgcttaaccgcggcgaaaagccggcatgttgcgcatgctcatccgcgccatcgacccagcgcagcgcgccgcggctgaggtcgctccatggcagattttcgccgagaaagccgcgctggcaggcgctgaactcttcgaggtcgtccggcgtccccattccactgacgttaaagaaatcctcgtactggcggatacgcagcgctctggcctggtcggattcccctttcggcgcaaagcaccagatggtgacttcggttttatccaccgcaatggggcggatcacgcggatttgcgtcgagaactgatccatcaggtagacattggggtacaggcacaggttgcgggtttcgttgaccatctggtcggcacggcgttcgccaaattccgcctgcagccgttcgcggtgggcatagaccgggcgcacttccgggttcagcgcccgggtccacaacagcatatggccgttatcaaatccatagccgccgccgaggctttttgaccaaccgttggcatccaccgcgtgcgtcccttccgcttcatagttgcggcgtgacatggttgaggcgtagttccagtggaccacgctgacgtgatagccatcggcgccgttttccgcgcccagtttccagttgccctcatatacatagctcgacgaacccttaagtacctcgagcccctccggcgcctggtcgacgatcaggtcaataatcttgcaggtttccccgagataggcctccagcggctgcacgtcggccttgaggctaccgaataagaaaccgcgataggactgaaaacgcggcaatttttgcaggtcgtgggagccgtcttgtttaaagctcggcggatagccgccagtgctctcatctttggcctttaataatttgccattattgctgaaggtccagccgtggaacggacaggtaaacgaatttttattcccggttttgcgtcgacataacatggcaccgcggtgagcgcagctgttaattagcgcgtgcagctcattctttttatcacgggtaataatgacaggctggcggcccagcgtcagggtataataatcacccggctggggaatttgactttcatgagcgagaaatacccagttaccttcgaaaatatgcttcatttcaaattcaaacagctgcgggtcggtaaatatagagcgatggcagcggtaaatatgattttcacggtcgacaactaaggcattattgattttgtctttgagcgtcgagagcgttttttgcatgagtcggtccctcctgcaggattcaggatgaaagaaacagggtgaattcttcgttttcgagtgcaatatctggcccgggcagtagcgtgcccggggccgataatgccgcttactctttggcgcgcaggcggatcccgcgctgctcttcgtcggcgctcagcgctttacacagggtgaaatcaaaacaaacctcggtgtgctctccctcaagattgcgctgcgcgatgatctcgcggtcggtcacttttaccggatcggcaatcaggccgtcgcgggtggcaaaggcaaaatcgtcccacaggtatttatcgccattgaggttaatctggctggtcagatgtttatgacccggcgcggagacgaaaaagtgaatgtgcgccggacggttgccgtggcgacccagtctgtccagcagtttctgggttgggccatccggcgggcagccgtagccggagggcatgatgctgcgcacgctgtagcggccatcggcgccggtgcggatccgccggcgcaggttgtactcactctggcctgggtcgaagaaggaataatttccgagggtgttggcgtgccagatatcaacaatagcgttggccactggccgaccttcggtgtctttgacttcaccgtgcagccacatcacttctccggcgtcggcgccgtcatccatgcgggcgtgaccctcggccagcggcgcattagccacgtacagcggcccttcgatggtgcgcggggtgccggtttcccgatgcgctgccgcgtcgatggcgtcctggcgcagatcgaggaaatgctccagtcccagtcccgccgccagcagcgccgcctcctgacgcccgcccagctcgtgcaaatagtttaccgcgtgccagaactcttcttccgtaacgttatagtcgtcgatgagcgtgcagatattttccagcagacgatgaataatcgccttaaaacgttcatcgccgccggcaacatctaatccggcactgtcgcgtaataatttctgaatagctggttgttgtacgaatacattactcatactggttctctcttatattttgcagggtatacgccggtaataccggcgtgaggtcagatattattattagcgatcgtcatcgcgaattgatgacggatgacgacagagggcttccacttttatcgccataaagggatatagcggcaatcccattaatatttgatgcaattcttcggcatcttgaacatcgaaaatactgacgttggcataaaggccggcaacgcgccagatatgccgccatttgccttcccgctgtaattgttgcgaataggctttttcgcgttgttttatttcctccgcctcgttggcgggaaagccaggcggaatattgacggtcatctccactttaaataacatttttttctcctgttccccgctacggctggcgggtataaaaatgcagtttgtcttcatccagctcgacgccaaggcccggcgtttgcggcagcgccacctgaccgtcggcaaaggtgagcggcacgctgacaatatcgtctttcagcaacagcgggccgaacatctcggtaccccactgcagcggcagcgtcgaccaggcgtgcagagaagccacggtccctacggtgccttccagcatggtgccgccgtacaggccaatccctgccgcctgcgcgacgcgggccagcgccagcacgctgttcggccccccggctttggcgattttcagcgcgtaagcgccggtaaagccctgctgcgccagctgataaccatcgtaagcggtcgcgaccgcttcatccgcgaggatcgcggtttcaatttgctggcttagccgcaccagggcggcattatcgtgggcgctgaccggctgttcgataagatcgacgcccatcgccgccagttcgcggcagcctttcgcgccggtggcagcgtcccaggcctggttgacgtcgacacggatgctggcgcggtcgcctaacgcttcaacgatggcgcgggtatgacgcaggtcggtggcgagttcacgcgcgccgatcttcagtttgaacgcccggtggcggccttcggccaacagtttttctccttcagcgatatctttcgcggtatcgccgctggctaaggtccacagcaccggcaacgccgtttgcagcgcgccgccgagcagggctgataccggcagacctaaggctttgccccgggcgtcgagcagcgcagtttcgatggcggacttcgcaaaggtgttgcctttaatggcgccgttcatacgggcggtcagcgcattcaggttatcggccgactgccctttcaacagcggcgtcagataatgggtgatcgccgacgagatggcctcggggctctcaacgccatagctcaagccgccgatggtggtggcttcgccgatgccgcagatgccgtcggaacgggtaaggcgcacaatcaccagcgactggcagcccatggtggtcatcgacaatttatgcggccggatggtcgggacatccacaatccagctctcgatttgctctacggtggcagtcattttctgttcctgatgagatatataactttttgtacccacatccataacgggggtctgtgccattgacaatagggttcagcctggcggatggtcaacggcgataatcgaaatgttgtgcgattatcgacgcgtttgttaaaagacggttattaatgtgatcatggtggtaaaaccggcacaattcagcgcgccccattttgcgcaaggtatagtgatctgccgtgagctttacgctgcaacggagaaggatgcgatgagcgacaatatccccaatacgctgagcgccaggcaggccgagcacgaccctaactttatgctatctctggcccgcgggctggaggtccttaacgccttcaccccccagcgccagcggctgaccatttcccagctcagccagaaaacgcaaatctcgcgcgcggcggtacgccgctgtttgtataccctcgccgcgctgggcatggtgcacagtccggatggccgtagctatgaactgctcccccgggtgctggccgtcggccacgcctatctggcaggcacgccgctggccaaggtggcgcagacggcgctggataatcttggcaaagcgctcggcgaatcctgttcggcggccacgctcgacggggataacgtgctttatattgcccgcgcggcggtcaataatttactgagcatcgatctggggcgcggcagccgcctgccggcgtgggccacgtcgatggggcgggtgttgctgagcgcgctgccggaggaacagctggaagtgacgttgtcacgggctacgcttattcgctacactccgcataccctgtgcgatttgtccggtttacgtgcagagatcgcccgggtgcgcatgcagggctatgccctcgccgaccggcagatcgaggtagggttgtgctcgctggcggtacccgtgctgtcgcgtcacggtcaggtggtggccgccctgaatgtcggggtacctgccgcgacggtcagcgccgcggcgttaaaagagaaggctctcgccccgctacggcgcgcggcgatggatctgtcgctgcagctatagcgccgactgcggtttcgccacggtggcgaggctgcgccagatcccggcggccagcagcagaagcaatacacccgccgtcgccagcaccaggctatgagcctgaataaaagccgtcttcgccgccgccatcagcgcctgcgccaccccggcgggcagcgcctgggacagactcaccgcctcgccaatcgatgacgccgcctgctgcgccatggcgccactcaggccagacggcagcgcaatagaggcgctgtagctgcgggtcaggatcaggccgaacagcgctatgccgagaccggcgcccagctcataggccatggtttcaatcgcccccgcggccgccgctttctccttcggcgctgccgccataatcgcggaactggaggccagcagcgcgctggccacgctaaagcccagcagcgtcatcagcccccaggccagccactgctgggtactgaaatcggtcaacgccaggccgagaaagctgaaggcgctgagcagcatcccgccggtcgccacctcgcgcagcccaagccgcgataccagcaggccggcaatcgggccgctgaagccgctggccaccattaccggcagcataaatatccccgcctcgaacggcgttttctggtgcacaaactgcagctcctgggccatcagtagctcaaaaccgaccagggtaatcagggccgtcatcgccatcatcaccccgcttaagattatgcgatgggtgaacaggcgcatatccaccatcgggcgggccgccgacagctgcttgcggataaaccaggttaacatcgccgccccgccgagcgccaccagcgcggtgagccacagcgccagctggcccttcagcgccgatttcgcgctaaacaccagcatcaggatcgcggcaatcaaaacgagcgcctgcagtagattgagcggctgttcgcggcgcgcgggctggcgcggcaccactttcgcattaatcgcgataaccaccagcacgatcggcacattgatcaggaacaccgacccccagtagaaatgctccagcaggataccgcccaccagcgggccgaaggccgcgccgccggagccgaccgctgcccacagccccagcgccatattgcgctggctggcctcggcaaaggtgctgcggatcccggccagcgtcgccgggacgatcatcgccgcccccaccgccagcaaagcgcgtgaggcaatcagcgtcatggccgtcggcgacagcgcggcgcacagcgaggcgatgccaaaaatggcgctgccgagcagcagcaggcgcttaaagccgatcttatcgccaagggcgcccatcggcagcaccatcccggccatcactaatgagtagatatcaatgatccacaacagctcattgccgctgctacccagcgccacgctgagggtcggcgcggccacatgcaacaccgtagcgtcaatcgccaccggaatataaaccagcaaaatcgccatcagcgtcatccattgccgtgacatagcttgtacctcaatcaatattgaatattggacacacgtccaggatggcgatcctgccggattgttgaacacatgtccaactttttgttacactcggccaaagccagatgacagcggggttctatgcactatttacaacgtgatgcgcgacgggaagggattatgcaggccgccatgcgcctggcgctgcgcggcggctttgccgccatgaccgtgcggcagatcgcccgcgaagcccaggtggccgccgggcagctgcaccaccacttcacctccatcggcgagctgaaagcgcaggttttcatccgcctgatccgcgagatgctcgacatgccgctggtggctgaggacgccagctggcgcgagcgcttgttctcgatgatcggcagcgaggatggccgactggaaccctatatccgcctgtggcgcgaaggccaggtgctggccgacagcgatccggacatcaaagcggcctacctgctgaccatgaatatgtggcatgccgagaccgtcgccatcatcgagcagggcctcgccagcggcgaatttcggtcggctgagcctgcggcggatatcgcctggcgctttatcgccctggtgtgcggcctcgacgggatttatgcgctggacgcgcaggccctggatgaggcggcgtttagccgctatgtaaataagatgattacgctggagttgttttaggcatatttacatttagtaacaattaattccgctacgcttaccacgtgctctctgtcagcacgttttttttatctacgcttcatagataacgcaaattaagcgttattcactatccccttgtattcagctgttgaccttatttatttactcctttccgggcaagtagagggcaatatgtcggtgcagaatgataaagataatcattaccttttgaacaactggcggcctgaaaacaaggcgttctgggaaaataaaggccaagccattgcgcgaagaaatctatggatatcagtggcctgcctgctgcttgctttctgcgtatggatgttattcagcgccgtagcggtgaatctcaataaggtcggttttcatttcaccaccgaccagctttttttattaaccgccctgccttcactttccggcgcgatattacgggtcccctactcctttatggtacccctttttggcgggcgctactggaccgtattaagtaccgttatcctgatcgtgccttgtatttggttaggggtggcaatccagaatattactactccgttctgggtatttattattattgcgctgctgtgcggttttgccggagcgaattttgcttccagcatgggaaatatcagtttctttttccccaaagcgaaacagggcagcgcgctgggagtcaacggcggccttggcaatctgggcgtaagcgtgatgcagatggtcgccccggcggtcatcttcctgccgctcttcacctttctcggcgtccatggcgtcacccagcccgatggttcgacaatcaccctgagtaatgcggcgctcgtctgggtaccgctgctgctgctcgccaccgtcgcggcatggttcggcatgaacgatatcgccggttcaaaggcctcgattcgcgatcagcttcccgtgctcaagcgaccgcatatgtggctgttaagcctgctctatctggcgacgtttggctcgttcatcggcttttccgccggctttgccatgctggcgaaaaccccgtttcccgcggtcgatatcctcaagctcggcttctttggaccgttcatcggcgcgctggcgcgctcgttcggcgggatcatctccgaccgtctcggcggcgtgcgggtgacgctggttaacttcgtcctgatggcgctgtttaccggcctgctgtttctgaccctgccaggcagcggctccggcagctttctcgctttctacgtggtgtttatggggctctttttaaccgccggtctgggaagcggctccaccttccagatgatcgccgtcatcttccgccagctcaccatcgacagcgtaaaacagcgcggcggcagcgatgaagaagcgcagcacgaggcggtcaccgataccgctgccgcgctgggctttatctcggcgatcggcgccatcggcggcttctttattccgaaagccttcggcacctcgctggcgatgaccggctcaccggttggcgcgatgaaagtcttttttgtcttctatgtggtttgcgtgctggtgacctggctggtctacggccgccgtaaacccgcttaaccataacgatttatctgccggatagcggcttacgccttatccggccttacgagttcgttcgctcatccggccgggtggcacgatgccggacatcatcggagcaggagaaatgtcatgagtaaacttctggatcgctttcgctactttaagcagaagggcgagacctttgccaacggccacggccaggtctacaacaacaaccgtgactgggaagatagctaccgtcaacgctggcagttcgacaaaattgtccgctccacgcacggtgtgaactgcaccggctcctgcagctggaaaatttacgtcaaaaacggtctcgttacctgggaaacccagcagaccgattatccgcgcacccggccggatctgccaaatcacgaaccgcgcggctgcccgcgcggcgccagctactcctggtatctctacagcgccaaccgcctgaagtacccgctggcgcgtaaacgactgattgagctgtggcgcgaagccctggcgaagcatcccgacccggtgctggcatgggatagcatcatgcaggatccggcaaaaacccgcagctataaagcggcgcgcggcaaaggcggttttgtccgctccagctggaaagagctgaaccagctcatcgccgccgccaacgtctggaccatcaaacactatggcccggaccgcgtcgccggcttctcgccgatcccggcgatgtcgatggtctcctacgccgcgggcactcgctatttatcgttgattggcggcacctgcctgagcttttatgactggtactgcgatctgccccccgcctcgccgatgacctggggcgaacagaccgacgtgccggaatccgccgactggtacaactccagctacattattgcctggggctccaacgtgccgcagacccgaaccccggacgcccacttctttaccgaagtgcgctacaagggcaccaaaactatcgccatcacgccggactattcggaagtcgctaagctctgcgaccagtggctggcgccgaagcaaggcaccgacagcgcgctggcgatggccatgggccatgtgatcctcaaagccttccacctcgataacccgagcgattactttctcaactactgccggacctacaccgacatgccgatgctggtgatactcgagccgcgcgacgacggcagctatacgccgggccgtatgctgcgtgcttccgacctgcttgacggtctcggggaaaggaataacccggaatggaaaaccgtggcctataacagcgacggcgaactggtggcgccgaacggctccatcggctttcgctggggcgaaaaaggcaaatggaatctcgaacaacgggcagacggcaaagatgtcgagcttaagctgtcgctgctggatattcgcgacagcgtggtgtcggtgggcttcccctactttggcggcaacgaaaacccgcattttcgcagcgtagcgcagtcaccggtgacccttcacccgctaccggctaaacagctgacgctggccagtggcgaaagcggcctggtggtcagcgtctatgacctgattctggccaactacggtctggatcgcgggcttgacgatgtcaatgcggcgaaggatttcgccgaggtcaaagcctataccccggcatgggcggagcagatcaccggcgtaccgcgtcaacatatcgaacaaatcgcccgcgagtttgccgatacggcgcataagacccacggccgctcaatgattatcctcggcgccggggtgaaccactggtaccacatggatatgaactaccgcgggatgattaatctgctggtattctgcggctgcgtcggccagagcggcggcggctggtcgcactatgtcggtcaggagaaactgcgcccgcagaccggctggctgccgctggcgttcgccctggactggagtcgtccgccgcggcagatgaacagtacctcttatttctacaaccacgccagccagtggcgctacgaaaaactgaccgcgcaggagctgctgtcgccgctggccgacgccagcaaatttagcggcagccttatcgacttcaacgtccgtgcggaacggatgggctggttaccttctgcgccccagctcaacgtcaacccgctgaccattaagcagcaggccgaggccgccgggctctcccccgcggagttcaccgtccagtcgttaaaatcaggcgatattcgctttgccgccgagcagccggatagcggcaaaaaccatccgcgcaacctgtttatctggcgctcaaacctgctgggatcgtccggtaaggggcatgagtacatgttgaaatacctgctcgggaccgacagcggtattcagggtgatgaactgggcgccagcgatgaggtaaaacctgaggaagtcgagtggcagaccgcggcgattgagggcaaactcgacctgctggtgacgctggatttccgcatgtccagtacctgtctcttctccgatattgtcctgccgaccgccacctggtatgaaaaagacgatatgaacacctcggacatgcacccgtttatccacccgctctccgccgccgtcgacccggcctgggaggcgaaaagcgactgggagatctacaaggatatcgctaaatccttctcgcaggtctgcgtcggccatcttggcaaagagaccgatgtggtgctggtcccgctgcagcatgattcccccggcgaactgtcgcagccgttcgaggtgcttgactggcgcaagggcgaatgcgatctgatccccgggaaaaccgcaccgtcgattgccctggtggaacgcgactatcctgccacctgggaacgcttcacctctctcggcccgctgctcgataagcttggcaacggcggaaaaggcatttcgtggaatacgcaaagcgaagtcgatttcctcggcaagcttaactacgtcaagcccgatggtccggccaaaggccggccgcggatcgacagcgccattgacgcctccgaagttattcttagcctcgccccggaaaccaacggccaggtggcggtgaaagcctggcaggcgctgggagagtttaccggccgcgatcatacccatctggcgctcaataaagaggatgagaagatccgctttcgcgatattcaggcgcagccgcgcaaaattatctccagcccgacgtggtccggactggaaagcgagcacgtctcctacaatgccggttataccaacgtacatgagctgatcccatggcgcactctctccggccgccagcagttgtatcaggaccatccgtggatgcgcgccttcggcgaaagcctggtagcctatcgcccgtccattgatacccgcagcgtcagccagatgaaggccgtgccgccaaacggctttccggaaaaagcgctgaatttcctgacgccgcaccagaagtgggggatccactccacctatagcgaaaacctgctgatgctgacgctgtcgcgcggcgggccgatcgtctggcttagcgaaaccgacgcgaaagagctgggcattgaagataacgactggattgaagcgttcaacgccaacggggctctcaccgcgcgggcggtggtgagccagcgggtgccgccggggatgaccatgatgtaccacgctcaggaacggattatgaatatcccgggttcggaagtgaccggtcgtcgcggcggcattcataactcggtaacccgcgtctgtccgaagccaacgcacatgattggcggctacgcccagctggcctatggctttaactattacggcaccgtcggatcgaaccgcgacgagttcatcatgatccgcaaaatgaagaatattgcctggctggatgacgaaggtcgcgatcaggtacaggaggcgaaaaaatgaaaatccgttctcaggttggaatggtgctgaatctggacaaatgcatcggctgtcacacctgctcggtcacctgtaaaaacgtctggagcagccgcgaaggcatggagtacgcgtggttcaataacgtggagaccaaaccgggcattggctaccccaaaaactgggaggaccaggatcagtggcaaggcggctggatccgcggcattagcggtaagctgacgccccgcctcggcaatcgggtcagcgtattatcgaagattttcgccaacccggtgctgccggcgatcgacgattactacgaaccctttacctatgactaccagcacctgcacaacgcgccggagggcaaatatctgccgaccgcccgcccgcgctcgctgatcagcggcgagcgtatggataagattaactggggcccgaactgggaggagctgctcggcggcgaattcgagaaacgcgcccgcgaccgtaacttcgaagccatgcaaaaagagatgtacggccagttcgaaaataccttcatgatgtatctcccgcgcctgtgcgagcactgcctcaacccgagctgcgtggccacctgcccgagcggcgccatctacaagcgtgaggaagatggcatcgtactgatcgatcaggataaatgccgcggctggcggatgtgcatcagcggctgcccgtacaaaaaaatctactttaactggaagagcggtaagtcggaaaaatgtatcttctgctatccgcgcattgagtccgggcagccaacggtctgctcagaaacctgcgtcgggcgcatccgctatcttggcgtactgctgtatgacgccaaccgtattgaagaggcggccagtaccgaacatgaaaccgacctctatgagcgccagtgcgaggtgttccttaatccaaacgatccggcggtcatcgaggaagcgctaaagcaagggatcccgcacaacgtcattgaggcggcgcagaagtcgccggtctataagctggcgatggactggaagctggccctgccgctgcatccggagtatcgcaccctgccgatggtctggtacgtgccgcccctgtcgccgatccagtcggttgccgacgccggcggcttaccgagcaacggcaacatcctgccggcggttgagagtctgcgcatcccggtgcaatacctggcaaatctgctgagcgccggcgataccggaccggtcttgcgcgcgctgaaacggatgatggcgatgcgccactacaagcgctcgcaaaccgtcgagggcgtcaccgatacccgcgccattgaagaggtgggcctcagcgttgagcaggtcgaagagatgtatcgctatctggcgatcgccaactacgaagaccgcttcgtgatccccaccagccatcgcgaactggcggaggatgcctttccggaacgtaacggctgcggctttaccttcggcgatggctgccacgggtcagatacgaaattcaacctgtttaacagccggcggatcgacgccatcgacgtcagcggcgtgcgtaagcatggggagggcgagtgatgcggatcctgaaagtgatcggtctgctgctggagtaccccgacgagttactgtgggagaaccgcgacgacgccctggcgctgatcagggccgatgtcccttccctgacgccgtttgtcggtgagctgttgacggctccgctgttggatcgccaggccgaatggtgcgaggtgttcgagcgcgggcgcgccacctcgctgctgctgtttgaacatgtgcatgccgaatcccgcgaccgcggccaggcgatggtcgacctgatgaatcagtatcagcaggcgggtctgcagatcgattgtcgcgagctgcccgaccatctgccgctgtacctggagtatctcagtattctacctcccgcggaggctcgggaggggctgcagaatatcgcgccgattctggcgctgatcggcggccgtcttaagcagcgagcctgcccgtactaccagctgtttgacgccctgctggcgctggctaaaagcccgctcaccagtgacagtgtcacaaaacaggtggcgggagaaaagcgcgacgatacccgtcaggcgctggacgccgtgtgggaagaagagcaggtgaagtttatcgaagataatgcgaccgcttgcgatagctcgtcgatgcaagcttatcaacgacgctttagtcaggatgtggcgccgcagtacgttgacatccgcgccggaggcccgaaatgatccagtatctgaacgtcttcttttacgatatctacccttacctgtgcggcaccgtctttctggtgggcagctggctgcgctacgattacgggcagtatacctggcgcgcctcatccagccagatgctggataagcgcgggatggtgctatggtcgaacttatttcatatcggcattctcggcatcttctttggccatctctttggcatgctgaccccacactgggtctactcgtggttcctgccgatgtcccagaagcagctgatggccatgatccttggcggcatctgcggcgtgctgaccctggtaggcggtatcggcctgctgatgcgccgcctgaccaacccgcgaattcgcgccacctccacgaccgcggatattttgatcctgtgcattctgctgattcagtgcgcgctggggctgacaaccatccccttctccgcccagcatccggacggcagcgaaatgctcaagctggtggactgggcgcaggcggtggtcaccttccacggcggcgcctcggcgcatctggacggtgtcgcatggatttaccgcgtccacctggtgctcggaatgaccatctttctgatcttccccttcacccgcctggttcacgtctggagcgcgccggtggagtatttcacccggcgttaccaggtggtacgctcccggcgctgagcgctggcggtgtttaccattcatccttaccggtagcccggacgaggccttcgcgccaagtccgggtatttatcgtacctggctccaggctttatgccggatggcggctgtcgccttacccggcctacagggtcctctcacaggctcataccccgtaggcccgcgcaagcgcaacgccgccgggcaagatatcaggcacggtacctgtaatttcgccgggtggcggctacgccttgcccagcctacagggacctctcacaggctcatacctcgcaggcccgcgcaagcgcagcgccgccgggcataaggagatttacttcccggcttccggatgggtatcgaacgccgccatcaccgccgccagcgccgcttcgctgaagccatgtttaggatcgtccacccccaggccgaagcgggtctgcagcccttcatacagcgcggagacatcggcaaaatcgatcttctccaccacatggttattctcccagtgggtaaagtggaagttggtgagggtcattttgccgccgtccggcagatgacgacacatcagcagatggtgacggaagtgggactgcggccagtgcgccgaccagaagttgcccatcacataatcagatgcatactggcggcctaaatcgaaatggtacatcgactgccagtgttcgtgatggttgaactgcagcgtccactcatccccttcatgcaccagacgatagctgccgtgcggcgtttgctgtaggatatcggccagcagtttgatcggcgcggtcagcgtctggccgccgaagccgacgtcggcgatccagcgctcccccgccacctccaccagcaacagacggtgagtacgcggcggcatctgcggcgggttggccagcaccacgcggcccagcaggctgcggacgttaaagcctatctcgcgcagcgcgcgctccagcaggccattctgttcaaaacaataccccccgcggcgggcggcgatcagcttctcttccagcgccccatcgtcaaggtggatttcacgcggcagcaggacgtcgaggttttcaaaggggatggcgctgttatgctgcagatgcagttcccgcagggtatcaatggaaacatcaggctcacccgtccagctcagacgggaaaaataggcgcgtaaaaagggactcatcagggcctccagctgtaggtgtccgacatttatagcctatttttccgcgccgaccgtcttttttgtgcgcttagcgttaaccgcacgtgcggcgctgcatcagcgccagcgacgtcagcatcaggaccagaccggtcaacaacgtcaggctggccatcgccatgccctgaccgacggaaccctgttcgaactggcgccagataaacaccgccacggtttgcgtaccggccggagagagcagcagcgaggtcaccagctcccgggaggccaccgcgaacaccatcagcatcgccgccagcagcgccggaaagaccagcggcaggacaatcaaccgcagcgcctgcagtggcgacgccccgtgcaccctggcggcgggctcaaggttcgggcccagctggcgcagcgcgctgccgacatagcgcaccggccagggcaacagcaggcagcaataggagagcagcagcatccacagcgtgttatagggcgagcgcggccagaagggctgattccacagcaggatcaaaccgacccccaccaccacgcccggcagcgccgccggcatcagcgacagcgcatccaccatcccgcgccctttaatcttctgcaccatcaccagccaggcggccagcaggcccagcgcgccgacgattagcgccgaacccagggccagcgacaggctggtgccgagggccgacagggcatctccctgctggtcaaacagcgccgcgaaatgacgcagcgtgacattctcaacactcacgccaccggagagcgtgcccatcacgctggtgagcatcatcgagacggcggggacgccgaccgccaggccgccgacggccgccatcgccagcacggcgggcagcatcatccagcccagcgatgccccgtggttctcccccggcttaccggtgacgctggtgacctctttctcccccaccagccgcctttgcagccaccaggcgaataacgccaccgccatcagcagcagcgacaatagcgcggcgccagggagatccaccggccagtcggccagctttttctcaataccgaccgtcagcatcaccactcccgcccggctgcccagcgccgccggtacgccaaactcctcgatagcgagggtaaacgccagcagcgtgcccgccgccagcgccggggagagcatcggtagcgtcacgtgccagaaggcgcgccaggcgctggcgccatggacgcgggcgaccaccgccagccgggtcccgctcgccagcaggctgcgggagacggcaaagtagaccaccggaaatatgttaaaggtcatcaccagcacgatcccgctgcggctgaacagcagatcgttcagctgccagccggtcagctgctgcagatagccctggctttgcagggccagcatccaggagagcgccgagatatagggcggcgtaagaaaggggatcaaaaacaggagatcccacagccggggcagcggcagcgaaaacataccgcgcaggatgccgagcggcaggccaatcattacgctgaccagcgccacgccggcggcgatccatagcgtaccgccgagcatcgccggcagctgaggatcggccagcagcgccgggatgccgccaaaggcgtccccgagcgaaccggcgctaaaatggggaaaaatcgcctgcagcacaataaacactaacggtaacgcgaccagcatcaccagggcggcaagggtcgcgccggaaaggaatgtttgtttcacaaccggttcctgaagctgagggtcctccggcggccagcgccggagaaacgggatcaattactgcgcgtacagctgactgaagcgggcgagcacggcgccccgctcgctgctgccctcgctggtggtgggcagcaccttcagcgcgtccagtaacggacgtttagccgccacgtcgcggcgggcgggcatcagccaggcgtcggcgaccttcgcctgaccttccggcgacagcacgtaatcgataaaggctttggcctcgccgggatgctggctggttttgaggatcatcatcgggcgcggggcaatcaccgttccgctggccgggaagatcaccttcagcgactcgccctgctgaatgttgccgtaggagacataatccaccgcgccaaacaccgccgctttcgctccctgcatcaccggcgtcaccgcctgggcgttgggtccgctgactaccatgccgttctttttcagatcgtcaaacagttgccaggcctggtcgcccatgctgttttgcagcccgatcagcaaatccagcgacgcgccggagagcgccgggtcgggggttgtcaccttgtctttaaacgccggctgggtgagatcccgccactctttcggttccggggtgccgcttttactgttccagacaatacccagggcggagacgccctgggcgatatagtccgccgatttcaggttcgccggtacctggtcggcgttggcgctcgcaaaaggcagcaaccagccccgctggtgcagatcttcggcggtatcccacgaggcggagatcagcacatccgcctgcgggttggcctgctcggcctccagtcgggccatcactttgccggtggtggcctgaaaaacggtcaccttcaccccggtctgttgttcaaaaccgctggccaggcttttcgccagcgagccgggtccggcggtgtaaacggtcagcgcatgggcgctggagagcatcatggcggaaagagccatcgcgagtaccactcctttcttaacggtcataacggtgttcatgcaacttcccctgaggttggcgtaacggcgcggacagcggccacgcggcccgcggataaatagacaatctggtcggctaacagctcggcttcacgtcggtcatgggtgacatacagggcggtgatgccgagctgtcgcagcaggcggctcatttcgccacacagcgattcgcgtagttcgctgtccaggttggagagcggttcatcaaacagcagcacccgcggcgcggcgacgatcgcccgcgccagcgccacccgctgctgctgaccgccggagaggcctgaaggcttacgttcggcaaagccgttgaggcctacccgcgccagcgcctcgctgacccggcgctcgcgttcgctgcgggagacgccgcgcatgcgcagcggaaaggcgacgttctgcgccacgctcatatgcggccagagggcgtaatcctgaaaaaccatgccgatatcgcgctgctccgggggcaatccccatcctgcgcgggcgaccagcctgtcgccaaagcggatttcgccgctggccggcacgctcagcccggccagcagacgcagcagtgtgcttttgccgcagccggaagggcccagtagcgccacgatgcggccgggttcgatatgcaacgtgaagcggtcaagaataggggtctctgcgaaggcgaaagagacctcctgcagggtgataggggtcagcgtgcgcatcatcgccctccctttcgggacagcgagaccagcccggcggtcgacatccgacggggcacgctcacctgggatagcatcaggggagccaacatattgtgatcctctttgggacttagtgctggcgactatagtcagacgagatgacgtattgattacattttcattgcggcttaacgtgttacctgccaaccgacccattattcaaggaacgcctatgagccgctttcgccacgttgaactgcagtacgccagccgcctgctcaaccacggcccaaccattttgatcaccagctacgatgccccgtccgaccggcgcaacgttatggccgccgcctggtcaatgccggtggaattcgccccgccgcgggtggctatcgtggtggataaaagcacctggacgcgggagatcatcgagcgcaatggcaccttcggcattgtggttcccggcgtcgcagccgccagctggacctacgccgtcggcagcgtcagcggccgcgatgaggacaaattcaatgcctgggggatcccggtagtgaccggcccggagctggggctgccgctgatcgaggagaaatgtctggcatggatggagtgccggttgctgccggcgacggcggcccagacccagtacgataccctgttcggggaggtggtctctgccgccgccgatgagcgcgcgttcgtcaccggacgctggcaattcgacgacgataagcttaataccctgcatcatcttggcaccggcaattttgtcgccagcggccgtcatgtgcgggcaaactccctcgacgaataagcgtgacttgccgcgggcggccggtttttcccctgcccggcctgcggcccccttttaacccggtgggcggcggcgatcggcgctgggggtcaggccaaacacttttttatacagggtggtaaagtggttgctgttggcgaagccgcacagataagccacttcggtaatggtcatctccgtttcgcgtaatttgacccgcgcggagaccagccgcagacgtttcagataattatccggggttaatccggtggcctctttaatatggcgaaacgcggtgcgggtggtgagatgaaattgctccgccagctgctgccagttatgttcttcgaaacagtgctcctgaagccaggtgagtaatttatgcagtttatagcgagtgctgctatattcggcttccgactcggctgtgagaatggtggtcaccagctggaaaaagagagactcccgtagcggggtattatccgccgccctcagcgccggggaaaatatcttttccactagttcccggcaatagctgcgagtctccggcgccagccagccatagcaggcggcgcgctgcgcggataattgctgcagcaatccctccatctgctgtaaatagccaaaggccaccgccggattaattaagacattaatcagcttcagcgtccccagctcatcataataatgcacatcgccaggctggacgtaaaatacgtctccctgttggatatacagcgggcgaccattaataacgtgtaacccatgcccctcctcgacgatcaccagttcggcaaattcatggccatgctcctggctattatcctccgggtcactggcgtatatgccgagcttatcctggggatgggtgaaataatactcaacggtcagtgtcatcattacagcaaatcctgaacaacctatggcgcaggggcacgataatctattccagccctcggcacgcgcccgatgtgcggatttgtgatcgccagcgcccccacctcattattcctgccattttcactgacggtttggcattgccagagtggtagccgcgccggacgacggcctatgctgcgcctaacctaacggagaggacgcagtatgtcacaagcaattcaatacaattccagcgtggcgatgatccgtcacccgcgctttttacagcgtgcggccgacctgacgcccgcgctgcaacgcctgcgccagacgccgcaggccatcgtcgaggccgtcgctgaaccaggagcgctgaacggctggcgggggaataccgtctgcacgccggagcagttttatcagcaaccgctcaacgtcggcgacagcatcattattgattttggcagccattttgttggctacctgcagttcagctgccgcagcgtcggcagcccgcccgatgccccggcccatctgcacttcaccttcggcgagacgctgagcgaagtctgtgagccgttcagcgaataccagggatggctgagcagcagctggttgcagcagcaggatctgtggcttgacgtcctgcccgcccgggtcgctctgccacgtcgctattgcctgcgctacctgaaggtggaggtcaaagcgctgtcgcgcaagtttcgtctgcagttcgatgagatcgctctggaaaccgtcacctctgccggcagcccgcacccggcggtcatcgccgatccgcagttgaaagccattgatgacgttgccgttcgtaccctgaaaaactgcatgcaggaggtgtttgaagatgggccgaaacgcgaccgtcggctgtggctgggcgacctgcgcctgcaggcgcaggtgaatgacgtgaccttcggccaccacgatctggtccgccgctgcctgtatctctttgccgcccatacccgggaagatggcatggtttccgccaatgtctttgttcagccagaggtacgcgccgatgacacctttctgtttgattactcattgttttttgtcgacgtgctttataactacctgcaaagcaccggcgacacggaaaccgtcggtgagctgtggcccacggcgcggcggcaaatcgagctggcgctgacccgctgcgattcgcaggggctggtgcgcgacagcgatgactggtgggtatttatcgactggcaggcggagctgaataaacaggcctcggcgcagggggtgctcatctactgtctgcagcgcgccctctggctggcgcagcgttttgaaccgcagcgggtacccgactacactgccacgctctggcagctgaaggaggccgccctccaccatctgtgggacaacgagcggcaggtgtttatcagcggcgccgtgcgtcaggtctcatgggcgtcgcagatctggctggtgctggcggaagttggcaccgccgggcagcgtcaggcgctgatgcgccgcctgcagcagcagccgcccgccattgccatgaacaccccgtacctgcgtcatcatcacattgttgccctgctacagtccggcctgcgcgaggaggcggtggcggagatcaaagcctactggggggcgatggtcacctacggcgccgacaccttctgggaaattttcgacccccaacatcctgacttttccccgtatggcagtaagcttatcaacagttactgccatgcgtggagctgtaccccggcctggtttattcgccagtacggactttaacaacaacgataagcgagtgatttatggcagaaacaacgtttaccctgtggcggcagcgccttggctatggcattgccgatctctcctgcaaccttgtgtggcagatgatctctctgtatctgatgttcttttacaccgacgtcatgggtctcccggcctattatgtcggcctgatgttcctggtcacccggctggtagacggcgtggccgacgtgctgatggggctggtgatcgacaataccaccacccgctgggggcgctgccgcccctggctgctgatcggcgccctgccttttggcctgctgtgtattctggccttttatgtgccggatttcggcaccaccggcaaactgctgtacgcctttgtcacctatctgtgtctgtcgttcctctacaccctggtgaatattccgttctgcgccatgctgccgtttttaaccagtgattccgcagaacgcaccacgctgtcggcggtgcgcattttgctgggctcccttggcgccaccatcgtcgccgtggctacgctgccgctggtcggcatgctaggcaaaggcaaccagcagcagggattcctctataccgcggtgatttttggcgtactggcggcctttttcctgctggtgagctttcgcaacgtcgaagaaaagatcacccttaccggggagcgcatgaccctgaaacgcgcctggattagtctgcgcgccaatcgtccgtggtgggtcttcgccagcaatatctttctgatgtggggtgcctttttctttcagaccggggccctggtgtacttcttccattattacgtcgggaataccgagctgacggcggttatcgccgggatctccaccttcgttcccctgctcggcaccctcaccgtcccgctgctggcccgacgcatgaaaaaacgtcatgtctatctggtggccagcgcggtcaatctgctcgggatggggattatgatggtgtctggcgcccacgttctgggactgatcgtcggggccgtgatcctctccctcggcgccggccaacgcacggctatctatttctcgatgcaggccgacccggtggattacggcgtgtggaaaaccgggattaataccgcagggatcctgacctcgataaacggttttctcggcaaggtggcgatggctggtgccggggctatcaccggcgtgctgctctcctccagcggctatatcgccaaccacacgcagagcgacagcgccctgttggccatcaaggcctgctatctatacattccggcgctattgatcctcgcctcgatgctgtggatgggccgcttctaccgcctcgacgatcagtatgagcagattcgtgccgaccttgatgccggacgcggcgcctcgccagccccggccccgaccgccggagaatcccccgccatgtaaggcgcccccgctgatttaacctctggataaattaaggatttttatgcgtatctctgtgattagcgcagcggtttgctgcgccctttttccgctcatcagcgtcagcgccgccggcttgagcgtggagcaacggctggcgcagctggaagcgcgcctcaatctcgctgaacagcaggccagcgaggccagccgccgcgcgcagcgggcagaacagcaaactgccgccgccgagcagcgcgccgcggcggcggagcagcaggtgcaggcgctcagccagcagaccacggctcgcgaacaaaaacagcaggccactaatcagcaactgagcgagcagctggcgaagcgcgccccggacgatgggtttacctttaacgcctacgcccgttccgggatgttagtcaacagccatggtaaaggcgcccgcggcgggccgggcgtctccccggccagttcgctcaacggcgatgcccatgtcggtcgtctcggtaacgaaaaagataattacgctgagctgagctttggcaaaaagctcaccttcaacgatggttcatgggcgcgctttaagaccatgctcgccgacggggccaccaacccggatccgtgggttcaggataacgacagccaccatctgaacattcgtcagctgtacgtcgagatgggtaactttgccgaattcaccggtccgttaaaacgcgcctcaatttgggccggcaagcgctttgatcgggataacttcgatatccactttaccgatagcgacatcatgttcctcggcggtaccggcggcgggatcaatgatgtcgactggggaagcggcctgcgcggcgactattcggtgtatgcacgtaacttcggcgaccttggcagcgataattacgcggataatgacatccagaatctgctgttcaccgccaaccatttttacggcaactggcaactgatgaccacggtgatgaccgcccagggcaacgatgatctgaaagataatacctcgaccaccgggagctatgccctgcgcagcgataacaccgccataaacggctactacgcgatgctggccctgcacgacaaacagcagttctacggcctggcgccgggggtgtctgaaagcgccctgcaatacggcgtcgggctgggcgccgaagcgcgtcagccggggagcgatggcgatctgaccgagaacgcggcctccctgcgctttgcgtcgtatggcatcctgccgttggggaaaaactggcagctggcgccgtcggtgatagcccagcatagcgaagaccgctatcgcgacggcgaccgctacgactgggcgacgtttaacctgcgggtatcacaggggatctccgctcacttcgccctgctgtatgaggcctcgtggcagtatatggatctcaatccgaacgggcgcagctatcgctataatgacaacgtttatcagtatcaggcggtgcgcggtgatttctacaagctgaccttcgcccccacctttaaagtgggtgatgtgctggatatcaaggcgcggccggaaatccgcttctttgccacctggatgaactgggataaagcgctggatcgctacgcgataaatgacgatttcggcagcaaaggctttaccgccggtgggacatggaacttcggcgtgcagacggagatttggttttaatcaaacggcccgtccggctcaaatgccaggacgggttgatttaaatacacgctgttactttgtcactatgccagtgctgtatgaagtaatataaactcataaaataaaaaccataacaggctaaaaagataaaggttgtttttataattccaacaagtgactttcgttttttctcaacgatgagaagatcatggaacctttcttgctgttgttctggtgttaaattatcaactattttattttttatatcatcgtgaatctttttaaacgttcgcttttcacctggaaagctaccgtgtagaagaaacaaaaaaataaagaaaagcataacgaatgctaatatccgaatactgggctcagttaccccccagcatccaagggtagcaataaacaaccagataccatgagtgtttgctcgcgctctaaacctatcaatatgagcgctgtatttcttgatttctttcaaaatagaatcgttggtttccatacgtaatgcactcctttttaaagaccccggttacgaaagggggcaaactctgccattttccttgcgaagaataacctttcaaacaaccttcaacaagttgataatcaatggattaccctgaagcaataaaagcagttttctggctgcaccggttggctgacgtcgtttcgtttcccagcttttaaccaactcgtagctaacgccaacggccgctgcaaagtcctgctgttttaaacctgtggcttcacgtatcgctttcacgtcaatttcgctgaaggtatgaacgtgctgctccatcggcatttgttcacctttctcgatcctgaccatttcttctgcactcgccagcagatcggcaaacaattcgtctttcatatacacctcagttggctctctggcgctatcgacttttccatcattaatagctcagccttactttatgtttatatgctagtttattaaatcagccacttgtctcaacatctttttttgctcctgatttaactcatcctgttcatttttaggatagatgagcgccaggtaaattcttccctttttcgttacattatagtaaatcactcgtacaccgccgcgcttccccatcccgggacgactccagcgaattttacgaaaaccaccggttcccgaaattgtgtccccagcctcgggatcgtttataaggatttcctgaaaggcccgaaattcatcatcctgcaacagcacctggcgtcgcttactgaaaccttgtagttcaataaaagtcaacatctcattccctgatgtcctgacgacttaccaaataacatacatgtacagggtacactaatcaaggagtttatgtacccggtacattttaaaaaattcacccatgacaaaattcatcaatcagcacttcgccagagaaacacctgccggaggcggcgcaaagccgcttgccgttggacaaatgcgcagcatcgcctccgggtgtcgggttacatgctataacccggcttcttaatcaactgcgccatctgcggggcgatctcactgtcccacaccgcctgccacgcgtccggctcaacctgagtgagtgcgacgctgacggcgctctctttgctgttcagatggcggatcagcacctcagtgatgtcggcggccagcgcggttttttgttcatcagtcagttcacggggaaaacatttaatatcaacatgcggcatagcaaagactccttgtgatcagagccataacgctaccacagaatggccgttctggttggcatcgcgtgcgttaaatcagcttgttacggcgtagcgccgcggccagctccggtcgctgacagaccgcccgggcgatggcggcgaattttggcgcgtggtcgtcaaaccacgcctggcggggtccccagctgtacatcgccgcgatatagcaatccagcaacgttatcgacgcgcccagcgcccacggcccggcggccagctgctgttcgaaccagagatagagatttttccggtactggcgacaattctccaccagctgctccgcggcggcgggcgcccagcgttccgggtaatcggcataggtaaaggtaggatagacattggccaccagccagaccagcaggcgctgaaactgcggacgctgtggcgtccccggcgcgggggccagatcgggacgctggtcgaggatcatcagcgcgatggcggcggtttcggtcatgatgctcccgtcggccagcctcagggtgggcacctggcacagcggattaatctgccgcagacgctcgcgcgccggaccgggctgatcaaagccctccacgtcaaccacctcgtagggaatatcggccagggagagcatcagctcgctaatcgtcgagccccatcccggcacgccataaacggttatcatggtcggcctccagggtaaagcctaagtgtaggcagaaaaacgccgctcacctacccggcacaccatgccactgggggttagtaggttatccccggcgggttgaccaccgactgcgccaccgcttcgccctgctccccccaacgcgccagcacctgctgatattcaccgcgggcaatcgccccgtcgagagccgcctgcagggcatagaccagaccgttgccttttttggtggttgtcgccacccacgcttttttcggccccaggcccaccacccgggtctggccgttaagcgccgctttataggctgccaccgactgcgggccgaaaaagatatccgcccgcccggactggatatagagattgccggaggcatcatcggtcaggtagaccggctgggcctgcggccgtccggcggcgcggttgtcctcgttccagcccagcaggatccgctcctgattggtgccggacccgacgatcactttgcgccccgcgagatcggcgggtccgtttaccgcggcgatgtcgctggtggatttcaccgagaaggccagggagtccacccggtaagtcgcaaaatcgaacttctctttgcgcttctcggttaccgcgatattgatcagcgccacatcgtagcggccggaggcgatgcccagcggccagtcctcccacgcggtgggcaccagcctgagcttcaggccaaggcttccggccagcaggcgggctatatccgggtcgctaccgatccgcgtgcggttgtcgctggccagcagggccagcggcggcgaattgagcgccgagatcgccaccgttagcgtccccggctcgacgaagcgatagcccggcggaattttcgctatcgcctgcgggtcgcgggtgaccggcaatggctgctcattggcgcgcagatccagcgccgcgtaagcgctcatggcaaaagcgctgagaacaagggtcattagcgctctgttcatgacggcagcaccctggataaaaactgccgggtacgcggatgctgcggatggttgagcacctcgtcgctgctgccctgctcgacgatcctgccgtcgaccataaacaccacctggtcggccacctcgcgggcaaagccaatctcatgggtgaccaccaccaggg

SEQ ID NO: 64 - DNA, 140607 bp, Unknown
  source: /note="Description of Unknown: KP2-Mcoc1 Bacteria Sequence"
ggtccagtgtcggcgatcctcgtgcatggcgtggattgccgccagcagcccggcctgcgccggacggcagcgttcaatggtgaatgtcttgtccagatgggcatggggttccaccaggccggggagcgtcagggctcccgccaggtcccacaggccgggagtcggctggtcggttggggtcaatgcggcaatccggccgtcgcgaaaggccaggtccgccagcagcggctcaccgttggcccgcgtcggccagccgtcgggcagcgcccaggccgggagtcgggcgcggctgatcccgacgagcggcgcggaagaggaggggaacgtcatcgtcagtctcctcacagatccaaaaccagaagcggggatttcgcccgcgaacagcagagcgtgatctggtcgttgccggctttctcttccgccgtcagcacgctgtcccggtgctcggggatcccgtcgaggaccccggtaatacaggagccgcacattccctgttcgcaggagagcattacctccaccccggcgtgctgtaatacctgagcaatggtttgatccgcggccacctgcaggcgctgcccgctggaggccagctcaatataaaacgcatttttcgccgcagtattattttccgccgcgggagtaaaacgctcgaagacgaattgcgacggcgaccagcgatattcctccatgaccgaccgcagtcgctgaataaaaccctccgggccgcaggctattactgcggtatcagggtggggcacggttaagcattcggggacccgctggcgaaacgacgcgccttcctcgctgcagtgaatggccaccgtgccgttcgcagtcagctggttcaggcgcggggagaaggcggtctggcgcgaactggcgacataataatgcagctccagcgccccctttctggcggcaatcgcttcagccatcgccagcaaaggcgtgatgccgataccgccggcaaacagcaggtagcgcccggcctgcggcaggggaaaatggttgcgcggcggcgaaatggcgagccgatcgccggctttgagctgctggtgcaaatagcgtgagccgccggtggaggtgtcagtcagcctgacgcaaatttcataagtattactgcggtcaggcgtgccgcacagggaatactgccgcggaccgacgccgggaataataatatcgatatgcgccccggcggagtaggccggtaatatttccccggccgccgtctgcaaaattatggatagatttccctgtccgttggggcgtatttccccgaccgagaccgaaataagatcgtggctgtgcattaccgtttactctccctcattccgctgtctgcagggcggccaggggcggcgaagagataactccccttcgcggtgaactgtccggcatgcaagaaaatgggtgaaacgatcgtttctccgctatgaatgctacggtattgtgataaaactgttgcgtccagagctttgattcgcacaacccgttgcaaaaaagagagcacccaaaccatgtttgccttctcccgatttctgctctatttcactgaagtggcccgtcagggatcgtttcgtaaagcgtcagaggcgctgcatgtgtcggcgtcttccatcgatcgtcagattttgcgcgtggaacaggaactggcgatgccgctcttcgagcgccatcccaccgggctgaggctgaccgccgccggggagctgctcctgcacgcggccaataactggaaaaaggactttacccgggtctgcgagcagctggacgatctgcgcgggttgcggcgggggcatgtgcgcatcgccaccatcgatgccattaaccggcatttcttttcgacgatgctcaaagaggtgcataaacattatcccaacatctcttttacattgaccaccatcaacaatatccacatccagcaggcgctgatctccggcgaggcggatttcggcatcatgctcaatccccagacctctcgtgaactgcaggtccgggcgtttgccgagatgaatatggggattgtggtgcccaccggccatccgctggccagccgcagcgcggtgcgctttagtcagtgcctcgactacccctttatcctgccgtccgccccattgatgatcagcgagccggtggaggcgctggtgaacatcagcggcaacgaggtaaaggaggtggcggtatcgaataacattcacatgatccgcaccctgatcaaagagcagatgggcatcggcatcctgtgtcggctggatattctcgatgagatcgagtccggccagctggcgtttgtgccgctaaccgatccgcagcttaagcctttcaccctggcgctgtgcgtctcgcccgcccgccagctttcccttgccgcctcgatgatgctgaaccagctggagatgctcttcagccagctgtgaaatgtcgggcaggcactaaaatcattcattagcgcaccattatggtgcgtttcttgtgggcatgaatcaaaggttgcatgcccaaggggggcggcgcaggcgatttctcgcggccgctcgcaggcgtttaaatctggcattgtttttgtatagctgagtgtgagtagaagcggtcagtacgggttatccatacgggacattgctcagtcaccatgtcgcggttcaatgttgaccgggatgggaggctgagccacattcgctcgctccccctcccggcgtaaagaggagagggatatgaaaacaggcgcacgccttccccggggcatacgctggctgggcctgatggctctcggcggtgtctcgctggccgttcaggccgaggagaaaatcgttctgctgacctcctggtacgcccaggcggaacagggggggtattatcaggctcaggccaccgggctgtacaaaaaatacggtctcgacgtcgagatccgctccggcggaccgcaggtcaacggcatgcagttgctgttgtcgaagcgggccgatgtgatcatcgggtacgacctgcagctgctggaaggcattcagcgcggcttccaggcaaaggccattgccgcgccctttcagtacgatccccaggggctgctgacccatgccgatgtcacctccctgcaggggctgaaagacaaaaccctgctggtctccagctccggtcaggcgacgtggtggccgtggctgaaggcgcaataccagctgagcgacgcgcaggttcgcccctataccttcaatattcaaccctttgtcgtcgatgacgctgtcgcccagcaggcctatgtcagctccgaggtgttccaggtgcagaaggccggagtgaaggcgaacttcttcctcttttccgagcacggctatcccccctacggcggcatccttatcgcccgcccggataccatcgccgagcgtaaagcggcgatggcgaagtttgtccgcgcctcaatggagggctgggtgagctatctcaaggatccggcgccgggcaatgcgttgattaagcaggacaacccgaaaatgaccgacgatctgctcgcctggggcgtgacccagatccgtgagcatcacctgatcgacggcggggatgccgccagccagggctgggggacgatgaccgacgcgcgctggcagaagacccgcgactttatggtcagcgccggtctgctggcggcggctaccgactggaaacaggcctacaccaccgaatttgttcaggccatgcaggttaaaccctgaggagcgacgccatgtcattaatgattaaaaatgcccatgccatcctcagcggtctgcccggagaggcggcgcggctggccgggccggatattcgcatccgcgacggcaagattgccgccatcggcagcctgacgccgctgccggaagagcgacagatcgatgcccgcgactgcgtgatctatccggcgtgggtgaacacgcaccaccatctttttcagtcgctgctgaagggcgagccgcaggggctgaaccagagcctgacggcctggctgagcgccacgccgtaccgctttcgcgcggctttcgatgaacatacctttcgtctggcggtgcgcattggcctggtggagcttctgcgctcgggctgcgccagcgtggcggatcacaactacctgtactggccggatatgcctttcgatacctcggagattgtcttcagcgaaggggaagcgctggggatgcgcatcgtcctgtgccggggtggggcgacccagggccgggcggtggaacaggatctgccggtggcgctgcgtccggaaaccttcgacggctatatggcggatgtcaaacggctggtcagccgctatcacgacccccggcccgagtctctgcgccgggtggtgatggcgcccactaccgtcctgcactccgcgccgggcgcccagctgcgggagatggcgaagctggcccgccagctggggatccggttgcacagccatttatcggaaaccgtcgattatctcgacgccgcgcggcagaaattcgccatgacgccggtgcagttctgcgcggaacacgactggctgggaaatgacgtgtggtttgcccatctggtgaagctgctgccggaggagattgccctgctgggccgtaccggaaccggcatcgcccactgcccgcaaagcaacggccggctgggcagcggcatcgccgatctgctggcgttagagcaggccggggtcccggtctcgctgggggtggacggcgccgcctcgaatgaagcggcggatatgcaaagcgaagcccatgccgcatggctgctgcagcgcgcgcgcaaggggatgctggcgcagccgcgctacgccgggggcacctttgagggtggggccgatgcggccacggtggaggatgtagtgcgctggggcagcgccggaggggcgcagatcctcggcttagcgcagagcggcaccctgcaggtcggcatgcaggcggaccttgccatttaccggctggacgatccgcgctacttcggcctgcacgatatggccattgggccggtggcctgcggtgggcgcgccgcgctgaaggcgctactgctcaatggccgccccatcgtggaagacgacgccattcccggtctcgaccttgacgcgatgcgtcacgacgcgctggcggccgtccgtaccctccaacagcgcgccgctgtttaactgataacaggataatgacgatgaacgcaaccacccagaatcaacgctacgccttacaggaactggaaaaagaggcgctgatgggcgccgagggtgaagagaccttcgcccgcgaagtgcgctgtatcgacctgtcgaactttgccgcaagaaaaaatgacattgccgaacaactgtgggaggcggcggtggagattggcttcttccaggtcagccatcacggtattccgctggcggatatccgccaggcgttcagcatgaccgaggcgtttttcgaccagcccgacgaggtgaagcgccagtatccgctggccggtaacgccggctgggaaagcaaagcgcaggttcggccgtcgacccgcaccccggatcaaaaagagtcgtatcagataacccggccgttgatggctgggcgctggcccagcgatcgggagctgccaggtttccggcagacgatgctcgggtttgaatcgcagtgctggcagctggggatgaagatcctctcctgctttgctttgaagctcggttttccggaatcgtttttcaccaccgcgcacgatccgcagcgtgacacctatcagagcaccttgcgcatgctgcattactatgcaaccgagcagtcgcagcaggggatgtggcgggccggcgcgcacaccgattttgactgtctgacgctgctgttccagcgccccggccagggcggcctgcaggtttgtcccggtaaagaccgcgaaagccagcagtggaccagcattgagccgcgcgaggaggtgatcacctgtaatatcggcgatatgctgatgcgctggagcgacgaccagctgccgtctaacttccaccgggtgagaaacccgctgctccacgaatatcaggggccgcgctacagcctggcgtttttctgccaggccaataaagatgtcgagatcctcgggccgcagaggaagtacccgcccatcagcgccgaggattatctgcagcagcggatccaggccaattttgccaaagggtaagatgctgccttgagaggtatacctgccgccggctttcgctggccgggcggcaggatatccggcgctgagcttttcagctaccgtgttaagttccctggtgtcgttgaaataactgaagaatatcccctaagcgtcagcagcaagctaccttggttaaggccctgaaaatcacgtcctttacgtcgtaaacgccgtaaagccagctcaccggggttaaagggattaccttaacttctttattgctgttagtgggttaaggctaaccagggcagggggaccgaatttatagctcggtaaccggctacaccgggctttcggcgccatgtgactccacagacacatgtaacctcatctggcacctccatgccgctgacgcggcattcagaagcttcccgatgctgtaggtgttaacgtctgctctgtgccaggagcggacattccctgcgctattgatagctatgttcagtacgccattatatgattatgcaatccaaccgaggactcacaagaagagtctataaatactaagatgctgagggttgatatgggcgatgtatcaattattactaatgctcttgggcgttttgccaacaatatgcgactctatggggaagcatttttaagataccgagaattggtagcaatcgaccgtgaagaggctatccacaacctagatcgagcatttgagcaaaatcttgagggttttcatacgttatatgatgtatcacaagcgatatttgacttccatgagcatcctgagactagcctcttaatttcaattcgaaatgctcttcatcaccgcgatcatcctctattccatagccttctccagactatttggttggatgggaaacctgagcgtctacttggggctgaatatttaattgctaggcatcgaacgacaggtggcaatcctccgttgatgatgcatttgataaagttagaagatgtttatagtcgcttagatccacgcagcgaatcggactacttaaacccaatgggtaaagcaaatgctttatccagattcgtctctctggaaaatggcttggcctttgaaaaagtgtgggaaaaaacgaaagtagatcgataccccgcaaagcaagtgtatttggacttgttgccgatattcaattctgctgtttctagagtttttactgcattggataatgctggagtgttattccaagggtttgatgcaaatgcttataaatccgtatttattgaagaattaaaaaccgatcttcagcattttgatttttttggtcttagaataaatgcgctacagattgagttgggtccaaaatttacaatccaagaagcttctatccgacgaggttgtacctaacaagggatgatgttagacgaataggtataatggcacactaaatttgagtcaagagcatttattcgactattaaagttggaatggagaggtgggatggaacattgtcattgcgagacgctcgaagaactcaaaatagttattaaacaatatgggccaggagttctctacagaggacaaactaaacattacctatcttcagatggctcgccctcaatgcccacgtcatttcagcgtcaagggtgcgtaccagatttgatgattatgtggacctattatgcaaagagagccttgcaacacttagtacgcggttggaatgataccggcgataatgcaaccaaccaagcaatccttcagcattatgggtttcgttcctttttccttgatgttagtggcgatccgcgtgttgctgcttggtttgcatgtaataaatttgattctaagtatgtggtcaatttggtagaggattgctttgaagatccagtttggttgcgtactctaaatgcttgtttcgctccatccgaagatattggccacatttatttaataagccagaagttactacgacaatacaatcttcaagctgttcatctatccgaaattgcgacagatcatggcgctccaagatatgtgcgacaggatgcgtacatggtggggcctttaattcgtgaagggttagatggagactgtattatttgtcatatcagcgctccagcagaggttctgcgtaaatatgcggagggatatagtgttggctggctatttccagaaccatgtgaggatcctgtttatcgcgaacttttggcaatgccatgggtgaagatgcgacacctttcggatgaaggtcttgaggcgttcaagaggtcattggagttaccagagtattcctgtcaccttcaaaaacgcatgccttctagaagtgcaatgtatagacccttttggactagggaccttccgcctccggacggtttggccattatctcttcacaaatagttcagattctatgtggaagcgccctgtatcatggtgtaagtgacccttgttttgttcttcctgaaatcaacaagctattagaaaagtataatgagatatcaattgaacttgatggacttgtttaccatggtatggacacaagatatgggaagggcgttggaatagtaaaaatgcctgaaaatattgtatgtgtatttgaatatggtatcgatcatccagggttgcgtatcatgagtattggtcgcttctgtgggatgcactatctaatcgatagtaacggctgttgggaacgtgttattcatgaggaagactgcaagtgtggttcagaacatattgacaatatatccttacttggccgggttgatgtttccttgaggaacaagttactagaagatatcggttcagattcatatgttcagaaaggtattgacccgacatctgacaaattggctacatggggggaaccttactagcgtgattgagctggcaaggaaatgtctaaattatccgtggcggttcacttatcgttaagtattacagtattctatggctgtatgaatataacgttgagtcaactgaccaccaaacgaatcggaaaaccttcacatgaaaaaatctaacttggcgaccagttttatttgacaagtgtctacattggtgataataaagcttattcgaaagctttcgctaaaatttaatttagaagaaaaagcttttatgtattggcgttagtattagtcaactattggaaaataagaaactcatggcgaattatgataactattggaattactacagtaatgactttgattggccaaataatttttaccccccaaatttagagaagactcgacagatttattctgaccttggcatccaaactgcagaagccgaagcgctaatctcgtcagggtatgtgaatatgggtggtgacataattatagatcgttactatggcggacctctagccagttcggatcttgccacacgtattcacaaaaataattttaccgagtggtatcagatagcaaagtccggtaagaccttctgtaaagatatttttttaaacacagcaaaatcatatgacgaattaacgaggcaggttaacaaaatccaagaatctctagggcaaaaactattgttccgtgggcagattatgcattacgagattactcgcccaataagaaatccatactttcttatcgaagggcttggcgagacttcttttattccttctatttggcgaaatctcctccagaatcatccgcgatcatttcaccatttcaatggtattaacttgtatgagtggtcgaagattatctattcacaattcgacatcgaggaagtggatcgacgaataaacgaactcataaaacgaggtgagtcgatatattcagcacaagatatggaggattcagatgatcctttagtgagtctctttggccgcgttcgattggatttgagtatgggccataattacaatctggctgacctacttaatactctactgcagcactatggactgttttcgccgtatttggatttaagcagtgatttgcgagtggcaatgttttttgcgagtcatcgttttgttcccaatgctggcaatgatcattaccagttcgtcggaagtaacggttcgaagtccatcctgtacttgtttaagcataaacaaaatgaaatggcggtgtatgcacacgatcgagttcttcatggtttacagccacttagaccggagaggcaatcatgtgtaatctgccgatcaggtccgtacgcacttaatcttgcgggcttatatcttgttggagcgattcgaatcgatttcgaactgccggagtctgaacgtttatcgtcgcatgtgctctttcctgatgaacatgaggataattttctcgcggccctaatagaaaattgcaggcatccagaaagagtgaccacttttcgacatcgatagccactcttaaatagcacaataaactgtggtagctcaaactcatttgacagctactgtcaggtcaaatcacaatgagtctttaaattatccacatgcgactttgggtcgaaatcggtcataaataaccgataggtctggtcaaaagcgtaagttgttactgtggttagtcttagcggatggggagctggtccatttgacctactccccgatgattaaaattcctcaatgttagtcatgtagctgttggcgttgccaacttccgcttctcgctcatagcagaccttcaactcaggtagcttgtctgctctgtgccagaagcggacattccacacttctgctaatgtggctaaaatcggtatgccactacaatctagtaaaggatagaaaatggataaaaatgagccatcaatatggcctccgtaccatgtcttctatatccaatcgatgttgttcaatacaacatcggctctacaggccgtggatagagcatctaagtacatccaagctatcagtgaagggaagctagggccacaagatcggaaagatgagcttctagactgtctacaaaacttcatcaatcatagtgctgctatagctcggtacttctttccatcaatgattggtggaaaaggtgagaaggttttacataagaaccgtgctgagtttctgaggcaaatttttgatgtgacagaaagcagccctttgcatgataagaaacttaggaatgcaatagagcactttgatgaacgactggatatgtatcttgaaggtggaattgtaggaaatatcttcccaagtctaatcttgaacaaaccagaagaaacagatgtgccgcatcacatcttcagagcctactatctaaatgatggaatttatcaagtattgggggaaagacataatgttcaacctattcttgatgaagtcatgagagttcatgaactgttggagatatttgatgaaaatggtggaatgtttgggaaataaaaaagcatcttcgggcgtaatgccactttctctttgctcgtatgccattccaaaatcagaagtggatgacagtcaatataattttgtggcgggcatggcgggcgccattgacgtttatttaaataacgaccttatggattaccagatagctgggaccggaaaaagttttatcggaaaatacttggacgtgtggaactacgatagcgcggaatatcagcaacgttgccaacaggctgtcaaaacgtttacgaataaaccgatcacaaaaggagattgtaatcatctgagtgctgatatttacaggcagaatcaggcactggccagcgtcgaccaacagcgccagctggagcaacaggaacgccagacccagtctctcaatgatgtcttgaaagcacctgtgcagaccaactgcacccggtacgggaattccgtttactgtacgtcctattatctctttatgacgcgtattgtcaccaccatctggcgccacgctgatttatcccggtaaaggaaatgcgcgcctttacaccctgttcagagataaagtaagaacattcagttaggaattttttttagcggagtgattgcattttggaaaagatccaggcgactgctgttaaatatatcaagctgggagagggaggcgaatgggaacatgagtgcctgacatctggcattattaagtttgggtaccacaaaacgccccatcagatgtgccttgagggaaagtgggaggatgtgaataaagtctggttagaagaaaggaaaaataaccagtccactgccaccagtgatgtcagacagataaggacgttttacaccgccacccccgatatactcttcattacgttcagccagggattattgcattggtgccagccttccggagaggtcatcgaactggatgatggcagtaggacccgccccacggtgagcggatggcacagccatagtctggccgggaaccttctatcccacagcgtcctgagcggtgctttactcgctacacagaattaccgggggaccatctgcgatgtgcgtttggccgattacgccctgcgaacaatcaatgatgagcaatcgccggaaatcatcagcgctgatattgctaaagctcagtacctgaaggctattaccaggctgtgtagtttgcttacctggcaggactttgagttgctcgtagatctgattttctccgccagcggatggagaagaaccgggagccttggcaggacacagaagactgtcgatattgagcttgaactgcccaccaccggagaacgggcatttgtgcaagtgaagtctgttgctgagcagtctgtattctctgactatctgtcacggttccaaaccagtgacagctatgatcggatgttctttgtctggcatcatgggacattgagtgaggatctccgtgctgaaggcgtcactatgattgggcccacgaggcttgcagaactcatactggacaccgggctggcacgatggcttagaaataaggtttcgtaatagcccggtaccttatcggttacgggcatttatgctagaagatgccttttcttattctgtgtagtggatagctaaatttggccactttcaaaggtatgttaatttccgctgttcgctcgcagcggaccttcaactcaggtaaccgttcacccagatgaactggtgtgaaaggtaaagcgaagggccatgtgctgcaaatcaagattcagcggtgcagacttttctgaccttaggggaagggggcggcacactctgcttcagtgggggtagctaatcaccacaaattgttagacacaaggggtagggggcgccgatgcgggtgacaagggtatctctgccgcagccataaaatcgataaaacagcgtattctcggtgacaggtagcggctggcgggccacaggacggagaaatgcccatccttgacgcaacagccgggcaacacctcctgcagttgtccctcatccatggcctcgcgcacgacaaaatcaggcacataagcgatgcccatccccgccgcgcttaagcgaatggcggcctcaatgttattgaccgtcatcacggccgtggccctgaaatctcccgtcagccgcatatcgcgcagttcccagggctggatcagccccgtcgcggggaagcggaaaaaaatgcacttgtgcgccgccaattccgctggcgagtcgggggcgccgtattccgccagataggccgggctggcacagagcacaaaacgaaagcctcccagctttctggcgatcaagcgggagtccgctaattcaccgctacggatagcaacatcaaatccttcatcgatcagattgaccagccggtcactaaagtcgagatccagttcaacctgcggataaagacgggtaaaggcggtgagggcggggagcaacaggcggtagccaatgacgggcagtgaaatcctcagtttgccggtgggctgtgagagactgctggtcagctctgactcggcctcctggatctgctccaggatactctggcagcgcgtcagaaatgcggccccctccgccgtcaggctgacgtttctggtgctgcggttgaacagtcggacccccagtttatgctcaagccgggcgacattcttacccaccgccgaggcagatatgcccagcagcctggcggcctgaacaaagcttagcgtttcggcggtgcggacaaaggacgtcagcgaggtgaggctgtccattgattataaaccttatgtctcttaagaagatattttcagtctatttatcggcaataacatccgcaataggatggcgacagtttattcattccttgccgactgatgagggccgcccgatgttactcaccgccagaacaccttcccgatccgccagcgccctggccgcgctttctgtctttatggcggccttgctgctgccgttaagttttaccggcggcgtcatgaccacccccgcgatacagcagtcgctgggcggctctcccgctgcgctgtcgtggctgaccaatggctttatgttgaccttcggcagctttttgctggccgcaggggtgacggcggatgccatcgacagaaaacgtatttttatcgccggcgccgcgctgttttgcctgagcagcctgctgttttgcctgacgcacaatctcttcctgtcaggcgtgttgagggctctgcagggcctggccgcggcgatgattttagccagcggcagtgcggcgctggcccagctgtatgatggcgctcagcggacccgggcattcagtatcctgggcacggtgttcggcgccggcctggcgtttggcccgctgctgatcggcttcatgaccgacgcggtgggttggcgcggcgtatacgccctgtttgcgctgctctcggcgatagttctgcttatcggtctggcgtatctgcccgcggcagaaaaaagcgagccgcggacacccgacaacctcggcttactcctgtttacgctggccctgatgctgtttactgcatcgctcatggtcattccggcccgcggttttttatccctgaccacgctggccttgctcatcgcgtcgggggggctgttcgtggcgtttgtcgtgcgctgccggagggtgaacaacccggtgctggaactctccctgctgcgtcatccgcgttttgtcggcgtactgttgctgcctgtcgccacctgctgttgctacgttgtcctgctgattattgttcccctgcattttatgggcggagaggggatgagtgagtcgcagagcgcgctgtatctgatggcgctgaccacgccgatgctggttttcccatccgttgcagccctgctcacccgctggttttcaccggggcacgtgtccacggcgggactgatgatggcctccgtcgggttgctgttgctggggaacgcttttcacagtaaccacctcccgcagctggtgctggcgctgatcctctgtggggcgggggcggcgcttccctggggactgatggatggcctggcgatatccgctgtgccggtcgccaaagccggtatggcggcaggcctgttcaacaccgtacgcgttgctggcgaggggatcgccctggcggtcgtctccgcggtattaacggcaagcaataccctgaccctgcagagtcgcgttcacgggtatgcgcctgaggtgattgaccgcgccgcaggctggctgggggccggcaatatgccgcaggcggctgcgcttttgcctgatttttccctccgggtgctgcgcgagagctatgactctgcttatacgctactgtttagcgggctggcggtcgtcaccctgctgtgcgccctgatgatctggctgacgttatgccggaaggggggcgctatccaaacccgcgacagtggatcctgaacccccttgatagccttacatctgggcgtatctatcgccacgatcggaacccaccttagcgccctgtaccagaaaacccatactcgacatcaggcagagctcctgctgattctccgcgtaatcgacggcgaatggtttcgctcggtcaggaatgatggtcgcgcaggaaaacggtcagcacctctttcggcggcacgccgccgcattcgccaatcatccagcccaccgcgccgcggtgataggcgccgtgaaagagcatgtggttcagcatctccatcgcggtcatattgccgtcgccgccgtcgacaaatttgaaggcgatacgttcgtggaaatcggcgggggtcatggcgctgacgtactgaatgtattcgtccgtacaggcggtcatggccgtttccagctcatcaacggttggcgtctcaggggtattcagcgcggtgtagccgtgcggcctgccgcgcaggttcgcccggaaaatcatatcaacgacatggatatggttcatcagcctgatggtcaggtgacgcttttcgccatgtcccgttccgtcaatcgcgcggatcgcctgtaaggtggcaaggtcaatccagcgcttgtatttcaacagcgttactactgtgtctttgtccatagtcggtcccgggttggttgaaccgttatcatactggttatgccggtgagccgtcactcaccggcatcaggcacaaaaaagcctcgccgaggcgaggcttttcaataagcagatgatttagtcaaacacaccgttaatcacggcggtgacgatcgcggtgctcagggccaccagcaccagatcatcgccgaccgcccgccattcatagcccggataatagggcaggtcgttaatcatggaagccggcagggtctttttggcgatccccggagggagcggtttgccgcgagcgacatttttggcgatacccggcggcagcgcctgatagccgaccagaccgtagtttacggcaagggagcgcgcccgtgagaagctaatatcgctgtcgacgtggtcgggcttgccgtagtttttccgtttgccgtgatcttcagtggactggcctttattttgccctttattgccatggtcgccactgttaccgttgttaccatgattgccgctattgccatggttaccactgttcccgtgattaccaccgccgttgccattgccattacccgggttggcatacgctggcgcggccatgacggcaagagaaataaccgccgccagtgctgttttgagagtgcgacgcttaagcatgatgttgataccttaacagggagtacacgcttaaaaaataagataaagctataccccaggcaatctcatgttgtcttatttttttgcccttatttaattagcggcgggaaaagggtagcgggacgcggacgagcaattccattgctgcgttttgacagacgggcgaccgcgccccgctaaatatcttgccgggaggatcgctcccgggcgtggagaaaaaatgcccgaagccattgggcaaaagagtacaaagatgttccgcttcatttatcgcgcgtctcacaagacggggcggacagtaaatcctggcgctgccgcgcacaatcggtcggttgtttagaaataaataaccccattgaccgcgctcaggatgcgacccaatgacaggcgacccgatggcccggggccacctcgcgcagcgccggaggctctctgcggcaacgttcgctggccagcgggcagcgggatgaaaagcggcagccggcggggggattggccggatccgggatctcgccttgcaccagcgcctgcggttcgctgtgcgggtcgagggtcggcaccgcagccatcagggcgcgggtatagggatggagggggcggctgaacagcgcatcgcggctggcgctttccaccagttgcccgagatacatcaccgccacatcgtcacataaatgctccaccaccccgaggtcgtgggagataaacagaaacgtgacgccgcggttgtcgcgcaggtcggaaaacaaattgatgatctgcgcctgaatcgacacatcaagggccgagatgggttcatcggcgacgataaaatccgggttgaggatcagcgcccgggcaataccgatccgctgacgctggccgccggaaaactgatgcgggaagcgggcatagtgttccggcgccaggccgcagatcttcatcacgtcgattacccggtcatatagctcattgcgggcgcacagtttgtgctgcagcatggcttcgccaatcgcgtcgccaatacgcagccgcgggttcagcgagctataggggtcctgaaacaccagctgcatcctgggccggatagcgcgcagggcaggcgcggtcaggtcggccagctcctgaccgtgaaatttcacgctgccggcgctcttctcgtacaggccaagcagggtccggccgacggtggttttaccgctgccggactcgcccaccaggccaaaaatggtgcccggacggatattaaagctgacgccgtccaccgcgcgaagctcgccggtctgctgaccaaacaggccgtcgcgtagcggaaaatattttttcaatccatccacttcaatgacatagcgttcgctcatgctgtcacctccgcaaattcgctataaaagcaggcagcacgttggcggtcgccgagcagcggcggaatcgcctcccggcagcgcgccgtcgcccgctcgcagcgcccggcaaaggcgcagcccgccggtagggcggccagatccggcacctggccgggaattgagtacagccgccgacgccgctcaccgggcaccggtcgggaggcgatcagcccccgcgtgtagggatgctgaggatgccgtagcacttccgcggtggcgccttgttccacaattcgtccggcatacatcaccaccacctgctcggccatctgcgcgatcacccccagatcgtgggtaatcagcatcatcgccatctggctggcccgggcccgatcccgcagcaggcgtaggatctgcgcctgcacggtcacgtcgagagcggtggtgggttcgtcggcgatcagcagtttgggccgacagctcagcgccatggcgatcatcacccgctgcagcatgccgccggaaagctggtgaggatagcgggtcatcaggctgtccccgcgcgccaggccgacctcgcttaacagctggatggcctgatgccaggcggctttcggcgtggcgctgaggtggcggatcggcggttcgcacagctgctccccgatggtcaacaccgggttgagggccgacatcggttcctgaaaaatcattgccagctggtgaccgcgcagatcggccatctgtctggctttcagccgcagcagatcgcggtccgcgaagcggatctcgccgccgtcgatgcgcgccgtctgcggcggcaggaggcccatcagcgccatggcagtgacgcttttgccgcagccggattcacccaccacgccaacggtttgcccggcctgaatggtgaaagagacctcctgcaccgcgcgcacgcgagagcgttcgccggcgaaagagacggagagatgattaaaggagactaacggcgtggtcatttcagcctcggtttcatattgggatccatggcatcgcgcaggccatcgcccagcacgttgatggcgatcacggtgataaagatggcgatgcccggcggcatccacagccaggggcggcgctggaaatcgatcaggctgttagcggcatccatcatattgccccacgacggcgtcggcggcaccacgccgaggccgagatagctcagcgcggattcactgagaatggcgttggcgacggccatggtcgccatcaccaccagaatcggaatggtattcggcagcaggtggccaaacagccggcgacgcgccgacaggcccagcacctgggtggccagcataaaatcgcgttcgcgcagggagagacattgcccgcgcaccagccgcgccagtcggggccactccagcaggctgagcatcaccaccaccatataaatgcgcgagtccggcgaaaaatcgagctcagaaagcatcgccccggcgacgatcaatagcggtaacccggggatagtcatcaccaggtcggccacgcgcatgatcagtttgtcggttaacccgccgacgtaacccgagagggcgccgagcaggtagccgaggcacaccgacatcaccatggtcagcaggccgataatcagcgagatgcgcccggccagcagcaggcgggtgtagacatcgcgaccgaggaaatcggtccccagccagtgttccgccccgggcggctggttgatgctcagggcgtcggtggcatcatcactccacggcgaccagacgggccccagcacgcaccacaccgccatcaccgccagcaggagcaggcagaacatggccagccggttacggcgcagctgtcgccacccctggcgccagggagagggagtaatgtgcgccagcgccgggatagccgcctgccgctggcggcgacgggaagctaagtaagacaggatcattatgacctcacccgaatacgcggatcggcccaggcgtacagcacgtcggcgagcagattcccgacgatcgtcagcaccgccagaaacagggtaaaccccatcagtaccggatagtcgcgggcggccagcgagtcgatatgaatgtggcccgcccccggccagttgaataccttttcggtaatgatcgccccggagaacagccccggcagctcgaagcccagcagggtgataatcggcagcagggcgttgcgcagggcatgtttgaggatcaccgtgcgctcctgcaaccccttggcgcgggcggtacggataaaatccattttcaccacgtcgagcatactggcgcgcacatagcgcgtcaggctgcccgcctgcagcatcaccagcgccagcaccggcagcgccagatgggcagccacctgcagcacatactgccagccgctctcgtcgctgccggtattggtcatcccgcctaccggcagccagtggagatcgacggcgaaccatttaatcagcagcaggcagaggaaaaaggtggggaacgacatggcggcaaacaccgcgacgctcaccagatgatcaaaccaggagccagggcgcagggcagaaaccacgcccaccgccaggccgatgccccagtaaaagaccagcgcgacgctggccagcagaaaagagttccagatgtactggttgagcaactggctgaccgggatctgatactgcagcgaaaagcctaaatcaccgcgcagcaactgtcccagccagtggaggtagcgggtcaatagcggctggtcgaggccgtagatcgccttcagctccgcggcgcgggcagcggtcagggtgatattgccatcgataaagtcgccgggggttttggcaaacagcaaaaaaataatgaaggaggccagcagcagcatcggcagcgtttgcagcaggcgcctcaggatgaaatttctcatgacggtctcacatcagccgccggttaacccggcggccagggatttatttgacgatttttacatccggcaggctgccggtcaggccgttgtagatatccggcttaaagccgctgacgcgggcgctgctggcggaaaggatctcgcgatagccgagcaggatcaccggcggatcgtcggccagcactttatacagctggtggtagatcggcttgcgctgttcgatgtcgagcaccgcgttgccggcgttaatcagcttatcgacttccgcgttatggtagccggactctttagcttcgctgctgtagaaatcccataccccgtcgtgcgggtcgttgagggtgctggtgctgaacgaggccaaatcgtaatttccggctttgcgctgcgccatcagggcgttgaaatccaccacctgcggcttcagcagcacgccaatctgccgccagttctccttggcgatggggatcagcgcatcgttgagcaccttcttgctcaccagcagggtcagctccaggcgctggccgtctttggcgcggataccgtcggctcctggtttccagccggcctcatccagcagctttttggcctgggccggatcgtaagggtaagggtcgacgccttcagcgttaaaggcccaggagatcggcgcgatcggttcgatggcgactttgccgtatccctgatagaccacgtcgatcagcttctgcctatccaggccgtaaatcagcgcctggcgcacccgcttatcctgtagcgccgggcgatgcacgttgaattccacctggctgtagtcgctggagccgtaaagattaatattggcgaagccgagcatcttcagttgctcaatatcgtcggggcgcgaggtaaaggcgtcgtagtcggtctccccggtctggaacagctggaagttggtggacggattggtcacgcgatagataaagcgcggcgttggcggcgtcccacggtaaaaatggctattggcatggaagcgtatttcctgaccgggaatatatttgtcgtacacgtaagggccgttgcccagcggcttgccgtgcagtgagcgcagatagtcgagattcccccgctgataccctttgccgtaccaggctttcgacagtacaggcccgccaattttggccagcgtggtggcgcctggctgcgtggtggtcacctgcagggtgagcgggtcgatgaccttcaggccgctgacgctgtcagccttgccggctttgtagtccgccccgccggcgatattggccagggtgatgtcggtatcgccatcatagctggggtcgagcaggaccgtcagggtaaaggcgacatcttccgccgtcagcggtgagccgtcgctaaaggtgagaccagggcgcaatttgatggtatagactttgttatccgggctgaccgtccagctctccgccagtcccgggaccagcttgccctggctgtcccagtcgatcaggcgtgaaaaaatgacgttagtcacgttctcatcccagccgttgacgaaaaagtaggggttaaagatcccctgcggctcggagatcccggccaccaccgtgtctgtgcgcagtttggcgctggccgggatctggctggcgtcagtggccggggtgatgccttctttcaggatcacttccgcatgggcaacagaagaaaatgctaccacgccgccgagcagggccacttttagcgccagggcgaagcgggtttgtctggtttttaatccttgttgtaatctggacaaaagtgctacctcatcaaatgattgcgtggttatttacaattcatgacgaaagataagaggcgcacttcgccctgtctaacactgaaacgctatgatttataactaattatccttagcaaaggatcggcaatataatcccattttatggctatgaagcagtggtttccgctgtctgatgatggttggtcagcatgctgtctgcgacccagcttttcaatcgcgaggttctgaacaggcgtcacacctgcgcggtattcgccggctgaaagggaacgatgatagtggccccgtaccgaccgccgtgcagggagtaaggttccctggcggtcagttccgggcagacgttaacgctccctcgccgctgggggaagcagggagggtgcggtttcggttagcggcaaccagagccgctcggggtcattaaatccctcttcgacaagggcataaaagcggctggcgtggagaccatcgacgaaggcatggttaaaccgcccggccaccgggataacgccattctgcaattttccccaggtgagcgcggggaccgccgcgccgacggcatattccgcatgggtcatcgaggtgaagtggagccatggcagacagctggcgcagataaaatgctcgccatcgacgatgagcggcgccggggatgtctctcttgccgcgacaatcttcggcgtggccgcggcgctgaaggcggtgaactcgggagcattgtcgcaccacacctgacggaatccctctccgacggtcatcaccggcgtcattactgccagactgtcatattcaatcacctcatcgttccgcactcgctggcgtagctgcggtaccccgttggccgcgcgcagcagggcatagagcgcgagctgaaaaaacgagacccgacggtccttcgcacattcgtacaggcgctgcgccgctatcggcacgcagagattaaagctggggttggcgaattggcggtaaaaagtgaaatggtcccggcggggccaggatgcggtgtcgataatccggtaatgtgccatggctgcctcctgaatactggcgttctgctgactatgcgacgatttcgatcaggttgccatcgggatcggcgatcaccgcctcataatagccgtcgccggtggtgcgcggcggcgaaatcagtattccggcggccccggcgcgttgggcgatggcatcgacctgttccgccccgcccaccgagagggccagatgcgcccagccggtatggttattatccgcgctggcctgctgcaggccaggcttgctcatcaactctatcaccacctcgtcgtcgatagtaacaaaataggaggcaaagccggggttggtctggctaaggtatttttcattgatgctggcggcaaagaagtccacccagaagcgggcctggacgtcgagctgttgggtccacagggcgaaatgggcaattttcatggtaaacctccgggcaggaacgttgacaaccagagcagggcagacgatcatgcttgctactgctcggttttgatcatttaaggattgtgttatgctcgattatgctgctttccctcaacagcgacaagcgctgatttgccagatcctgcaggaaaacggcagagtggtgtgcgcggagctggcggcgcgtcttcaggtgtcggagcataccatccgccgcgatctgcatgagctcagccgcgagggattctgtaaaaaggtgtatggcggggcggtgctgagtctgccggaagcgggggattacagtgagcggaaagataaaaaccgcgcgataaagctcaggatcgcgcaacagtgtgcccggctggtgaagcccggcggcactattttcattgataccgggaccaccaatctggcgatggccgaggcgctgcccaccgagctggcgctgacggtggtaacgaactcgccggagatcgccgcggtactggtgaaaaaaccgctgtatgacgtggtgatgcttggcggccaggtacagcgcgcgagcggcggttgcgtcggcgccgcggcggtggctcaggtgcagggcatgttattcgaccaggggtttatcggcggctgcgcgatggcgccagagtcgggcctgaccggctttgactatgccgactgcgagttcaagaaagcggtcattaaacagtgcagcgaaattattgttggtctgacttcggataaaattccggccgcagcgcggtttgtggtggccgccagcagcgatatcgatgtgctggtggtggaagagaatatcagtcgcgaatatcgcgttgcctttcagcagcacgatattcgcatctataccgtgtaacccgctagcgggtgagggaggtggcgataagccgcaggcccagcgcccccagcaccgtcgcggtggcgatgtcgatccgccgcttcagccgcaggtagacgcgccgcgggcggtcagcagacagcaccagcgccaccagcgaataccagctgacgtcgatcagaaagctcatcagcggcacgatgtaatagaaggcggtggggatctgcgccggcagcagggcggtaaaaattgaggcgaacaccagcgcagttttgggattgctgagctgagtatacagcccgtcgcggaaggtcttcagcaaagagcggttgccggccatcccgctggcggaaaagtccatcggctgcgccgacccgcgaaaaattttatagcccagccacagcagatagagcccgcccgccaccttcaaaccaataaacagctccggcaccgcggtgagcaccttctgcaggcccagcatcgccataatggagaaaatggccgcaccggcgccagtaccgagggcggtcaccataccgtgcagacgcgagcgagcgacggcattgcgcgcgacaaaaataaagcttgggccgggactgatcacgcccatgatcagcaccgcggcaatggccatcaggctggataggaacatagcgactcctgttatgtccgccgcaggcaggcggtcggtaacgtgtggacggttggagcagacagagtagcaaaatggttcaggaaagcacgtcaaaaaggtgtgtattagacggggagaagcaggcgttggcggcgcgcgttttctgcgcaactgtttgaataacgattcccattcttgtcatcgatggtaaactgaataactgtgatctttgtcataccgtaataactacagagaagagacactgctatgcaacatatcattgagggcttcctcaacttccagaaagagatcttcccccagcgtaaagaactcttccgcagcctggcctccagccagaatcccaaagcgcttttcatctcctgttctgacagccgtctggtgccggaactggttacccagcaggagccgggacagctctttgtcattcgtaatgccgggaatatcgtgccgtctttcgggccggagccgggcggcgtttccgcgaccatcgaatatgcagtggttgcgctgggcgtgacggatatcgtgatctgcggccattccaactgcggcgcgatgaaagcgatcgccacctgtcagtgccttgagccgatgccggcggtgtctcactggctacgctatgccgatgccgcgaaagcggtggtggaaaagaaaacctgggctagcgaaaccgataaggtcaatggcatggtgcaggaaaacgtcatcgcccaactgaataacatcaagacccatccttcggtggcggttggtctgcgcgaccataccctgcgcctgcatggctggttctacgacatcgaaaccggcgatattcaggcgctggataaaaacacgaaatcctttgtttcgctgtcggaaaatccggacgtctttttcgaataaagtctttccagggcacggaggccctgcaaaccctcaccacgccacgcaaattttgccaaaatgggcgccgctttgcagacagcggaaggcctccgactgattcgcggcgacagacctctccgctttacgccgacaagccgcagataatccagccaatcgggtatttattgctatcaggctctttttgtgctgagagtcagtattgtccgggatccggcgaatgccgcatggacctgccgggaaaggtcaggaagggggaaaaactaaagcgccgtccaggcggcgctttaggaaacgtttaggggcaagggtttatttgctcagttcagccgtcatatgaacacggttgttaaactgggcgctggtaattttataggatgcaccctgttctgcggcctgggcggcaattttagcttccgcgcggtccagcgtggaggcagtggcgctgacgctctgagcaaagctggcagcagagaacagagatagcgcagcaacagcaacgaaagttttgatgaatttcatggtcgtattccttaatttggtgtctgataaagggcctgttgccctgatgtgataaagaatacgcttgattgctggagcctaaaatcaaaacaatttgcgaaactctttcaaataatatgaatgattttccgccagccgcgaggctgcgcgcggcggcagggttgcattagctgctgtggtcaggcatcggaggtcggcagacaggcgactaaaagagagcctgtcggtcatgaaatgatgaaaatggctatgactgaccaggcggaaattcactttaatcctttccaggccgttatagacccgcttgcgattaatccccagcgtagcggccatttgatgaaccgactgacccttcatggtggcatcaatcatccgcatctccaggcggttgagcggggctcgttgacggaaagaaacgctctgacgttggtgacgcggcacgagtggccagcggcgctcggccaggcagcgcagaaggcggctcacttcacgtaccgcttcgcgctggctgacccacagtagggtatccgcgaaaaaggcgcgtccgcgccttacgttgccggctgacgtaaagccaatgaccaggccctgaaagtgctgagcgatttcagcggcagccaggtaatcatgatagttttccagtgacaaaataatcacatccagcccggacagttctggaagatggctgaggggcagggagtgaataacctttaattcgggcgctgttttctgaatatcccgaaaacactgggcgataccgatattaaaataaatattattgctgtgaattaaaatattcaacgaataaaccctgttgctggcgatgtaaacggcgcggggaggggattagctgcgtaccagaagcttattcatatcagcaggcgaagtgtttatataattcatcatccccggcggtttgtatgaataaatttcggctacgtaaacgttattaatataataccccgcgcacttaacgcggatgattaacgcgctctccacgccagcctggtgtaagcgagactttaagctctgaataacctgccataggcgctgcgcggaagggcggagattatttttttcccaaacgttaatcattaactcttcatcgctgaccagacgttctctgccgtgcgccagcaggtactccagtaaacaggccatggtgctgcgtagctggacttgcgtccgtgtcccgcgcagcgtgataatttcccgatgatgcaggcagtagaaaatattatccgctaacttatagccaagtagtttatagcctttagtcatccaccactccctgacaaatcctcttcttgccggtgcagagtacctgcccgctgctgactgaccaagtgaattttatcagttagaataatcaaaacaaataaccacacagccatacataactagaataaaaatctgataatatcgcttgattctgttgtattatgcggtataggaaaagtcttaatcaggcgactggcgaaggtaagcgcttgaaaatataggtggcatcgaaaaataaatgcacttaaattgatttggatcaatttaagctatttcagagggcgatgaccatttacattctaaaacaaagattgaaataacttccgttacgcggtgatacgctaattctgaacttgtggaactacccagggaatggttcattacttttcaggagcgtttttatggtcattgcaactcgtaagcctctgtgcaacaaacgctggtcggccagcccggcctcccaggatcttcagttgactcagctacgtcacccgtgggtcgccaccaaagctagctgcaaaagtaaaaaaggctggaagagccgcggttaacggctcgtccactttcccggacaaaacgccccggtcgtgctcatgccgcgaccggggttttactgtggtcattgttctgctcaacgatcacaccgagcgcagacaatagcctgaggcggtgttctccactctggcgaatcccggcaggccaagatgcataccggcaatcaaccaccgttcgctggcggcctggcgcagcaggatctccctggtacgccgggcctgttcaggatcgacgtcgaaggcgaccgaggcttctggccgcgcagactgaatggacgggaaatggacgatatccccccagatcagcagcgaggtatcgcccgcttcgagacgatacccggtatgcccgggcgtatggccgggcagagggcacgggcggatcccggcgatcacctcctcatcatcaaccccgctgatttgcgccgcgcagttcgccagtacacggcgaacaagcagcacgttgcgccgaccgcgatcgctggcgttgtcgaacgtggatgttgccagccagtaagcgctttcccgcgtaggcaggaacaccgtggcgttgggatacgctggcgtaccagcggcggacagcaggccgccgatagggtccggatgggcgtgggtgagaaggatggcgtcgatctcctcaggaccaacgccgagccgcgccagattggcgataagttcgccgccaacgccattggctccgccggtgccggtatccaccagcaccgtattcccgcgaccgcggatcagataggcgccaatcgcaatggtctccggcgaggctaatcctgaatgccgctgcagatgctccgcctcctcccgcgagatacccgagagtaaggacagcggcgctgacatcagaccatcactcacggcagtcaccgtcaggtcgccagcggtcaacgtataaaagggagcaggtgacatggcgacctcacgcgcgctgcgccgggttgcgtaaccgggcggtgatgggctgatagataaagacggcggcagtcgtggccaggtgatgcaggttgtcccgtgggaggatggcggcataccgggtttgttcggtcgccaggccgcctggctgcaggtgtatcggcgcagcgacgggcaagtcctccgcggtatcgcccagcagcagcacttcatccggggcaacctcccgcagcgtattattcgttagatagaggtggcgatgccagtcggcgatcgccgattgccagcgggcaaaatggccgccgccgttgcggcggtaggcgtcgctgtcgatgacggtagcatcgtggatatcgtgcagcgccaggtagcaggggcagccctcgctgagagcgcggaagcgctgggaggcgtagaaaccgggcacagagaccagcgccggtagtttttcctgattgtaaaaggtattccacgccgcttcgctttggggatcggtgtaggcgcattcgacgacatagagcatagtgacctcgatgaacagatgatgtgcgcacaaggcgctttagtgagttttcatcatcctatcggctaaaaatggcgctgaaaaacgatgttaattcaaggcgtagtgatattctgtcactgactttcggtgagcctgcacaaggagcattggctatgcgtcgtaaaatccccagcagcgctgcgctactggcttttgaggccgcggctcgtcacggcaactttgcccgcgcggcggctgagctcgcgttaacggaaggggccatcagccggcagattgcccgtctggaagcgctcctcgacagtaaactctttgacaggacggggagccgggtgcggctcaatccggcaggcgcccgctatgctcgtcaggtccgcgagatcctcgctcgcctggaacgggacacccatgacgtcagcgggatgcccgtcgatggccgcagcctggagatcgccgtgctccccaccttcgccagccgctggttaattccccggctcgggcgctttgcggcgcagcatccgcatatcgtggtcaatatcgccgcccgcagcgatcccttcattctgccgggaagcggatttgatgccgccatccattttgaacacccggcgtggaccggaatggaggtgacgtttttatttgcggagtatttgctgccggtctgccatgctgcgctgctgacggatgacgatcttccggggctgcttaaccggctaacgcgcattcaccggcggcaaaacccggacgcctggctgcactatgcccgcgagtgcggtctggcgctggataaccccgcccaggggccgcgctacgatctgcatgagatggcgatcgccgcggtactaagtcagcagggagtggccctggtgccgaagatgtatgtggaaagcgagctgagcgccggaacgctggttgccccgtggccgggctccccgacgctggctaagcgcttctgcttgatcaaacccggcggcggggagggggagccagcgctgcagatgtttgagcgctggctgcagacggagattgcggcaggttaagtcagagctggccgggagacatttagcgccgcccatggtttcctccctgttataccgcgcgctcgcttttttacaccagggaatagttatcagtatggaatattgttgttgcgaagccaccgcttctgccctgcgtccagacagcttccttctctcgcatgacaaaatattatcagtttatttgttttattctgtttatcgtctttgtcagtattacgcagtcactcccgagctgaaccgagatgccactgaattaaaactggacttactccggcaggatgtggatacgaacgggatttccttggacatttattgctgagcgactgttattccgggcgttaaataaaagatcaccgttctgccttacccagtgcgctttgggttcctgtagggagacagcgacgggcggtagcgttcgcgaaagcaggcgggtgcgatagcgcggccagtgggtggggtggcgaagggtaacgaatggaggacgtaatgatgaattttaacgccagaaaagatggagtgaagcgatgaggaacaggctgataaacgatgcaaccagtttggtaaagcaaccgccggggcagtcacgctaccggatggttgttctccggagggcgcaatatcgacagcctgctgaatcagcaactgttaacccatatggcggcaggaccgaagccgcagcacctgacgcggagcgggatgaggaagaggggaacgcctcaagaggagtgtccgctttttttgcaggaagtcttgccggattattattatccgttggagctgaaacatccagagcaatatacacgtcccgatatctgaagcgcagaaatccggtactgcatgataaactgcaaaatctgggagatctggatcttctgtattttcttgttgaggatattgtaaaacctttcgaaacagcgtgtatggtcagtgataagaatccagcagaatttaacaaaatatgtgaatatttctttggtggactatgaatataaaacgaacattactcatcctgctttcccgtgttatcagaggggctgggatgggattaggtgcttcaggtatcgcgctggctggctggttcttttttttctcagtaaatgaatataaatttctctggggtttactttcagttgtgggattcctggtggggtatctgatatatcgatttgcatatgcatatatttatgatgaatggaattattatcattaagaaattaaacggcgtggtctgttgatcgatttttgatgctcattaaaagggttggcttccttagcactcatgtggactagtatggactatgcaaggaaaacgctttgccaatacacaacattttaagtcagcaataccaacggggagcaggtgataaaattcaggaattacagaaggaaaaatgattggtgcgtctgaatggactcgaaccatcgacccccaccatgtcaaggtggtgctctaaccaactgagctacagacgcattatggtgcgtttaattggactcgaaccaacgacccccaccatgtcaaggtggtgctctaaccaactgagctataaacgcattatggtgcgttcgattggactcgaaccaacgacccccaccatgtcaaggtggtgctctaaccaactgagctacgaacgcaatgttgtggtgacaacggggacgcatattagcggcagggaggggatgtggcaagaggtaaacgtcacttttcttgcacattgcatgcgattgcggaacttttactcattccggatatattttactgaaccacaaggatatttcttcgccagcgagcatcacggctcttatttttcagccagtccaaacctgcgcggaagggttgccgatgtgttaaattatcggccaccagaagagaaggagtcataacgaagatgaaatcgattggtattttttgcggttcttcagctggcgaacatccgctgtacctcgaaaccgcccgtctggttggacgtacgctggcgcagcaggggttggcgcttgtctatggcggcggcaaagttggtctgatgggggcggtcgccgatgcggcgctggaggccggtggcgtggtgatcggcgtgatgccgcgcggcctggtggagcgggaaattgcccaccgcggcttgacggagctgcatgtggtcgaggatatgcacgagcggaaaaccaaaatggcggcgctggcggatggctttattgccctgccgggcggggcggggacgctcgaggagattttcgaacaatggacctgggcgcagctggggatccatgagaaaccgtgcgcgttcctgaatattaagggttattacgatccgcttcaggcgatggtcgataacatggtacaggaagggtttatgcacccgcgctacgcggaaatgctgccgttcgctacctcggcagacgagattatcgccggttttcgcgactatacgccgccggcccgtaaatgggttcagcagccagctatttaaacatcaagcgcagggtaaacagcgcgcagacgatgagcagtaacagcagcaattcgaagcgatagcgttgcagcatgatgtcctcctgaaaaaaaaccggcgctgttcagcgccggtttatcaccttaacgccctgaccattatgccgccggtttaaccgccggtttagctgcgtggtgtgccgctttatgatgtttctttgcagcctgcgctttctgcgcgactgccggtttcgcagcggttttgtggtgtttcttcgccgcctgcgctttctgcgctactgccggtttagcagcggctttatggtgtttcttcgccgcctgggctttttgctcagcagccggttttgcagcggctttgtggtgtttcttcgccgcctgcgctttctgctcggctgccggtttcgcggccgctttgtgatgtttcttatggtgaacggtagtatggctggctgctgcactcggggtggtgcttgccgcatcggcagcgaaagcaactgatgacagacccatagcagcggcaacgaccagagctaatacttttttcattctgaaatcctcgacttggtttcttgagtaaccccactgcggggctgttggcaacactataagcgcctgccgggaggctatcagtgagtctttggtgtcagggagtaacggaatgtacaacgcgccgttatagcgaagaacgaaaaagcccgccggagcggcgggcttagacaagttagcgcgcagcgcgctgtaagatgatgctggaaggctggcgctgcagaaaacgcatccgcagcatcatcatgatggcggcggaggtcagaccgatgataaatccgcaccagaaaccggcaggtcccatgcggggcacaatcatatcggtcagcgccagcagatagccgctcggcaaacccagcacccagtacgcggtaaaggtaatgaaaaagatagaccgcgtatctttatagccgcgcagaatgccgctgccgatcacctgaatagagtcggagatctgatagatagctgccagcagcatcaggtgcgaggccagcgtcaccacttcgggattatcgttatacagcagcgcaatctgcttacgcatcaggacggtaaagatagcggtaaatactgccaggcagatccccacgcccacgccggtgcgggccgaaacctgggcatcgatcgttgagccctggccaaggcggaagccgacgcgaatggtgaccgccgccgccagcgacagcggcagaacgaacatcagcgagctgaaattaagcgcgatctggtgaccagcgacgtcaatgatcccgagcggggagaccagcagcgcgacgacggcaaacagagtgacttcaaagaacagcgccagagcaatgggcagccccagctgcaccagccgtaacaggacggcaaaatcagggccgctgaagcgctcggcgcagcggatatcgcgcatcgtacgcgcccggcgcacccaccacagcatgctggcgaacatcacccagtaaacggaggccgtcgccacaccgcagccgacgccgcccagctcgggcatgccgaaatgaccatagataaaaatatagttcaccggaatgttgaccagtaatccaataaagcccatgaccatcccgggcttggtttttgccagcccttcacactggttacgggcgacctggaagaacagatagcccggagcgccccacagcagcgcgcgcaggtagccaaccgccttctctgccaacagcggatcgatgttatgcatggagctgatgatgtatccggcgttccacagcacgaccatgatcagcaccgagacaaagccggccagccagaagccctgacgcacctgcggcgcgatacgctctcgccgcccggatccgttaagctgcgccaccaccggggtcagcgccagcagaaggccgtggccgaagaggatcgccggcagccagatggaggtcccgatggccacggcggccatatccgtggcgctgtagccacctgccatcacggtatcgacaaaacccatcgccgtctgcgctacctgcgcaaggatgacgggtatagccagagctaataactgacgcgcttcaacgaaatacttctgcacgtgaacaccttcgaattgttgttattttgagactaaaaaagccgccgtaactggcagcaaggggataaaaatgaggaatttccagtctattgtagcgaggattggctattaagccagtgaaaaaagagtcgaggcacgaagcgcgctggcaaccgctttgccctcctgttattgttcccgatagcgaaagcggtaatgataccgtcatgattttcaacaggagccaaacatgtttactggtattgttcagggaaccgcgaaagtggtctccattgatgataaacccaattttcgcactcacgtggttgagttaccggcacatatgctggaggggctggaaaccggcgcctcggtagccaacaacggctgctgcctgacggtgaccgaaatcaacggcgcgcgcatcagcttcgatctgatgaaagagacgctgcggattaccaatcttggcgatattcaggtcggcgatgaagtgaacgtcgagcgagcggcgaaatttagtgatgaaatcggcgggcatttaatgtccggccacattatgaccaccgcggaaatcgtgaagattctgacttccgaaaataaccgtcagatctggtttaaagtgcaggatccaacgctgatgaaatacatcctctataaaggattcatcggtattgacggcattagtctgacggtgggtgaggtgacggcgacccgtttctgcgtgcatcttattccggagacgctgcagcggaccaccctgggagcgaaaaaactgggcgatcgcgtcaatattgagattgatccgcagacccaggcggttgtcgatacggtcgaacgcgtgctggccgcgaaagagatggcggctaaggtcaatgaagcctgaaaaaaaatcccccgccgataagcgggggagtgttatttaacgggcgacgcgcagtccatgttcaataccgcgcgagaacaccacctgccagagctgaatgtcgcgggcgcggaaggcgccggcgcaggcgttcagataataggtaaacatgcgtttgaaacgctcagaatagttatcggcaatttccggccagctggcgaggaaacgctcataccaggccatcagggtcgtgtcataatcggcgccgaagttgtgccagtcttccatcacaaaatgcttttcgctggcttcggcaatgtgacgcacggaaggcaggcagccgttcgggaagatatatttatcgatccacgggtcaacgttatggtcggtgaccttggaaccaatggtatgcagtaaaaagcggccgttgggtttcaaattacggtcggcaacctcaaagtaggtagcgtaatttttcggccccacgtgctcaaacatgccaacggagacgatgcggtcaaagctgtcgtgcagatcgcgataatcctggagacgaatctctacatcgagatcggcgcagcgcgcctgggccattttttgttgctcggcggagatggttacacccacgacgctgacctgataatttcgcgccatatattcggcgagaccgccccatccacagccaatatccagtacccgcatgcctggctccagctccagtttgcggcagatgagatccagcttagcctgctgggcggcctcgaggctctgcgcctctttccagtaaccgcaggaatactgcatatagggatcaagcatccggctgaagagatcgttgccgaggtcgtagtgctctttaccgacaatccaggcacgttttttactttgtagattaaacagacgagcgcctgcgatgcggagtgtgtctttgaaatggtgtgggagctgcttttccaacccggcgcgtaacaccttgtggaagaatatatccagacgctcgcattcccaccagccgtccatatagctttcgcctaaacccagcgaaccttcctgcaaaacccgtttaaaaaagagaggatttttaacccgcaggtcggacggcgcggagccattgatttcaattcccgcacggcctaataattcagctgcaatccggtaccagtcatcatttggtacacttacttcttctatacacgatgaactcatagcttctccatcacgcccaagtgatcagaaccttaaaacagcgtagacgcttttttggctttgtgagaaatctcacggataatccgtgaagtcgctatccgacgtaaacagaggaagggagataacccttgccgaaaggccttccatggtgaaacggaggcatcctgcatccgttaatctgtaactattttctatttatgtgaacccggatccagtataggacgctaagtactggctttcaataaaaatttcttagcatgctaacgactggtccgggccctggcgacgggcattacgcgtgggaagagtggggtgtcagctccggcgtctgctgcaggcgatagcctattccggctaagccaatcgaaaccagcattacgctggtggtagtcagcagcggcgtggcgatcagcgcggataccagcagactggtcaggaagcacaggccaagctgcagggtattttgcagcgccgccgcgcggccggtcgcctgcggaaaaggcttcaacgcctgagcaaccacgatggggtagatcccgccgttgaccaccgccatcatgcagaacgggatcattaacgccaccagcgaggcatgggtttgcaggcccaccagccaggtggcggctacgctgacggcaaaaatcaccagcagccacggcagcatctgttgaccggaccatttctgcagcagcgcgcgacagccatagcctcccaccagaaaggcgatggtctgcggaatatagctcaggccgatagcggttgggccatagcccatttcatgcaggataaaaggtgaaccggtaagccaggcgaagaagctggcggaacaggcggcgtagatcaggacgttgccgctgtattcccgggagcgcagcagcgcgagaaaggtgatcttttgctgcgtcactactactgacttcgcggctgccttcaggcgcagggcaggcagcatcagcagcagagtgatggcgaacagggtggcgaagatggcttgccactcgaagtgcaccagcagccagctgcccagcagcggggccagcgccggcgacagtcctaccagcggcataatggtggcgaagatgcggttcgtgcgctgggcaggatagtaatcggcgaccatcgcctgccaggtaacggccgcggcacagacgccaatcgcctgcagaaagcgcagcgccagcatcagggtggcgttgtgcacccacagcatccccagacagccggccgcgaaaatcgccaggccgcccagcagcaccggtttacgtccatagcggtccgacagcggtccccagaacagctggcccagcgcgaagccggcgaggaacaggctcaggctggcgctaatggaggcggcggaggtgttgagatcctgctgcatggcggcaaacgccggcaggtacatatcggtggccagaaagcccagcacgctcaggccggccagccagactaaaaatcctttcccgggttgtgacataacgttctcatagttggtgtacaggtacgatgccgcagagtgtagggagtgcattgtggcttgtgaaacgctaatatttgtcacatgcattcaaaaattttgcaggcagaaaatgtggtctgaatactctctggaagtggttgatgccgtcgcccgtaacggcagcttcagcgcggccgcgcaggagcttcaccgggtgccttccgcggtcagctataccgtgcgtcagctcgaagagtggctcgccgttcccttatttgagcgtcgccatcgtgatgtggagttgacccccgccggggtctggtttttacaggaagggcgctctgttatcaaaaaaatgcagatcacccgccagcagtgtcagcaaattgcgaacggctggcgcggacagttgtcgatcgcagtggatgatattgtgaaaccggcgcggatgcgtcagatgatcgtcgatttctatcgccattttcccgacgtcgagctgatcgtctttcaggaagtattcaatggtgtatgggatgcgctggccgacggccgcgttgagctggcgattggcgcaacgcgatctattccggtcggcggtcgctatgcgttccgcgatatggggatgctgagctgggactgcgtggtggcgagcgatcatccgctggcaaagatggatggacccctgagcgacgacgtcctgcgtaactggccgtcgctggtgcgggaggatacctcgcgctcgttgcctaaacggacaacatggttgctggataaccagaagagggtagtcgtccctgactgggaatcatcagcaacctgtttgtcggcaggactctgcgtcggcatggtgccgagccatttcgcccgtccatggatagatcgcggcgagtggactgcgctggcgctggaaaatccgttcccggatgccgcctgctgcctgacgtggcagcagaacgatgcctcaccggcgctgaactggatgcttgactatctgggggacagcgacacgctgaatcgggagtggctgcgggcgccggagagatccgcgcccgccagatgccttaacgacgataatcgacaaacgggccatccgctaccgagcggcgctcaaccagacgagggtgcacttcgatagactgcgactcttcacgcttgttgacgatacgatccaacagcatgttaaatgcggcctcgcccagggaatctttcggctgatgaatggtggttaacgccgggctgaaatagcgggcgttgcgcacattatcataaccgatcagcgaaatgtcctgcggcacccgcagtcccatttcatccgccgcgcagatagcgcccatcgccatgatatcgccgccgcagaagaccgccgtcgggcggtgctgctggtttaggatctgctgcattgcgcggtagccggactccggctcgaagtcgccctgcacaatccagttttccggcacgctgatatgcgcctctttcatcgcctgcatgaagccggccagtcgccccgcgccggtgttgcgctccagcgggcccgggatcacgccgatttcgcgatggccgcgttcaatcaggtagcgtccggcgatatagccgccctggaaggcgttatcgatcaccgcatcggtgaagtcggctttcgcctcgccccagtccatcaccaccatcgggatatggcggtactcttccagcatgctcaataccgaatccggatactcggaacacatcaccagcagaccgtctacgcgcttttgcgccatcatcgacagataggcgcgctgtttttccagatcgttccacgcgttaccgaggatcagagtatagcccttctggaagcagctcttttcaacggactcaataatttcagcgaaataggcggcttcgctactggtcgccagcaggccaatcgatttggtgtgattgactttcaggctgcgcgccacggcgctcggcgagtagtgcagctctttgatcgccgcccataccgcattacgcgtctcttcggcaacgaaacgggttttgttaattacatgtgacacagttgtagtggaaacgtttgcgcgtttcgctacatctttaatagttgccattacatctcactccatgccttgacctgatcgcctgatcatcgatacgtaaacgtttgcctacacacaccctgaatacaattttcaacattgcatcacgtcgggaaaacgacacagaacgacaggaaggggtcaatggccgatacgcttttaaattagcgtgggattttgtccgatcttggggcaaagtggaagagcaaaaatgtgcatcgccctaaatcccggaagatttttgcgattttttgtgcaaaaatgagcaagctcacttttggtgtggggataacaagagggaaaaatgatggataccaatttaaagttttcgctgatcaccacgattattgctctcggcgtgattgtcgctttcagcctgaccgccatactgcactaatgtttcgctgagggaggagcgccgcttcctccccatatcccgctattattatcaattctgcaaaaatcttttgtcatttcgttcacttttgtttttttgtgattgatgtcatgcttttgacttctgatgttacgccgtcctctctgacggtctgatggagtcattgaatgaaaatcaactttcctttacttgcgctggcgatcggcgcctttggcatcggtaccaccgagttctccccgatgggattgctgccggtgattgcgaaaggtgtggacgtctcgataccggtagcgggaatgctgatcagtgcgtatgccatcggcgtcatggtcggcgcaccgctgatgacgctgctgttgtcgcatcgcgcacggcgcaatgcgctgatttttctgatggggatcttcaccgtcggcaacctgttgtcatccatcgcgccggattacaccacgctgctgctgtcgcggattattaccagcctcaaccacggcgcttttttcggcctgggatcggtggtggcggccagcgtcgtgccaaagcataagcaggccagcgcggtagccactatgtttatgggcctgaccatcgccaacattggcggcgtgccggcggccacctggcttggcgaaaccatcggttggcggatgtccttccttgctactgcgggattaggcctgctggcgatggttagcctgtggttctccctgccgaagggcagcgcgggggaacgtcctgatgtcaaaaaagagctttctgtcctgctgcgcccgcaggtgctctccgcgttgctgaccaccgtgctgggcgccggggcgatgtttacgctgtatacctacatttcgccagtgctcaatacgctgacccacgcttcatcgctgtttataaccgcgatgctggtgctgattggcgtcggtttttcgctaggcaactatctgggcggcaaatttgctgaccggtcggtctccggcacgctgaagggctttctgctgctgctgatggcgatcatgctggcgatcccgctgctggcgcaatcccaggccggggcggccatcagcatgattgtctggggcgcagcaacctttgcggtggttccgccgctgcagatgcgggttatgcgcgtagcgcatgaggcgccggggctctcttcttcggtgaatatcggcgcgttcaacctcggcaatgcgctgggcgccgccgccggtggggcggtgatctctggcggactgggctatgcgtttgtgccggtgatgggcgcgattatcgctggtctggcgctgctgctggtctggtttagcgggcgagcgcagccggaagaggctttcgccagccagtaaccatcggctgggcaagggcaaaaaaaaccgcagccggggagaccccgctgcggtttgtcgtttatgccgccaggttagccgcaacaaacttccagtttaccagcgcccagaagtggtccaggtagcttggacgggcgttgcggtagtcgatgtagtaggcgtgttcccaaacgtcaacggtcagcagcggcttcgcgtcggcggtcagcggggtgccggcgttgctggtggagacgatagccaggctgccgtcggcatttttgaccagccaggtccagccagcgccgaaatttttcgccgcggcatcggtaaatttggctttaaaatccgcgaagctgccgaaagatttggcgattgcggccgccagttcgccttccggttcgccgccggcgttaggcgccaggcagttccagtagaaggtgtgattccagacctgcgctgcgttgttgaatacgccgccttcagacgtgcggacgatctcttcgagggatttgccttcgaacgcagtgcctttgatcaggttgttgaggttagtgacatacgcctggtggtgtttaccgtagtgatattccagggtttctgcggaaatgtgcggcgccagggcgtcttttgcatatggtaatgcaggtaattcaaacgacattgctactctccttataactttttgttttatctcacattgacaggatgaggttttcacctgaatcgtgttctgaccgcccgacgctgtcgcgtcccgggcgtgttattgtattgagaatgttaacatttgccgcaagcagtgaaaagccttacaacgataaaggctattatcaccggtgcatgtggtgaaggcttaatcgttttctgcaggagtgggtgataagccgccaaaattgttgcaaccatgtataaggagatgccctctgcggatttgcgaactcgcatggcgattaactactctgcttcgccgctgtcacgcaatgcgctgaacaaaaaataaaactttaatatcaaacgattaataaaaatatgcgctcaggcaatcgtcgctatgccaataattcattgtctattttttaatttgtatgacaaatatggccgccagcagtaatttccccaggatgacgacgatggcaaaaacagatgaggtggtgagcgcgaaaatgatcccggtggtgcaggggatcgttgactggatcgaagcacatattttcgacaccctgtcggtgagcgcgattgcgaaaaagtccggctactcacactggtacttccagcgacaattcgccatggtaacgggctgcacgctggcgagctacgtcagccgacgaaagatgacgattgcgacaatctatttaacgcagacgcaggcgtcgatacagagtatttctcagtgcctgggatacgagggacaagccgctttctgccggacctttcaccgtcactttggcatgtcgccgacccgctatcgtcgtgatacgccgggcaaagagagcaatctgcaatatcccttgcgggtggggatggagatggagcaggagaggcggtctgccgccgcagcggcagaccgggatcagcgaatggttttcggcgtcatgacgcgacgagcgccaacataatggcgaacccagtaatcctcgctcagggaggtgatttgaatatcacgacctgtgcgcggcgactgaatgaattttccgttgccgacgtagacgccgacatggtcggcagcgccccgtccgcgggtgcggaagaagactaaatcgccgctctgcagttcatcacgatccaccggacgcgcatcgcgcaggtggtacatttcgttggccgtacgcgggatgtggatcttgaccaggtccttataggcgtaatagaccagcccgctgcagtcaaacccggtgcgcggcgaggtgccgccccagcgatagggtttacccaactggcccatcagtttgttcatcgcggtactttgcgctttttgcacccggaccttgtgggcgtcggcgatcgttaaattcgcttcgctggcctcgggcttacagcgttttttatagcccttgcgcaccacgcacttgcttttgacgctgtttagcgccagggtcggctcggcgctggcggcgaccgttttcgcgcactgctttttataacctttacgcagcacgcattttttcgtcgcgccagcggcctgacgatgaagtgcggtttggcttgctgcggtagtgcgggtagggagccgggtgcgcgaggactttttactggtggttttagcggtggttttagttttttgactggttgcttttttcttgcgctctgagccacttttcgcgggcaacgcttttggcgaagcggaggcgtgcgtatgccctgacgcctgagccagtggcgtgaatgagatagacgtgaacagtaatgcacagagcgatatcgcgattttgtttagccgcgccactgagcaatcccctgattaattacagacatgtacaaatgcctgacgatgaatgacaaaccggaatgattctaaagcataaaaagccggaaagttaatattcttttgtatcaaaaatgtcgattggttaacgattgcaagaaaacgcgtcagacattgaccgcctcgcacagaaaatgcgcaatgagcgcccgcctgtgaccgcaaaatgatatttttaaggcaacttcgcgcaacagaagataaaatatgaatagtgaaaaaaatgttattatccgtcctgcctacaggacgctacaatgacaagttactgccgtagaaagaagtttaaggaagcacgacaatgagctcgactttagaaaagatccaacgccaaatcgctgaaaacccgatcctgttgtacatgaaagggtcgccgaagctgccaagctgtggtttctctgcccaggccgttcaggcgctgtccgcctgtggcgaacgttttgcttacgttgatatcctgcagaacccggatatccgcgccgagctgcctaaatacgccaactggccgactttcccgcagctgtgggtagacggtgaactggtgggcggctgcgatatcgtcatcgaaatgtaccagcgcggtgaactgcagcagctgatcaaagagacggcggcaaagtaccataccgacgagccaaaagcggaataattcccgccatcagtgaaaaagcgacttcctggaagtcgctttttttatcactccggggtggccactggcagcggccagccgcccagacgcttccagcggttcacgatctcgcaaaacagccgcgccgtctgctcggtatcatacagggcggagtgagcctgcgcgccgtcgaacggcatacccgcggcaatacaggctttcgacagcaccgtctggcccagcgccagcccgcttagcgcggcggtgtcgaaggtaacaaacggatggaaagggttacgtttaagtcccgcgcgttcggcggcggtcatggtgaagctgtggtcaaaggtggcattgtgcgccaccatgattgcccggctgcagtcgctctctttcatccctttgcgcaccattttgaagatggcatgcagggcatcgtattcgctgacggccccgcgctgcgggtcatgcgggttaatcccgttaaaagccagcgcttcgggctgcagattggcgccctcgaaaggttcaacatggaaatgcagcgtttcatcgggcatcagccagccgtgctcatccatcttcaacgtaatggcggcgatctccagcagggcgtcggttttggcgttaaatcctgcggtttcaacatcgatcaccaccggataaaaaccgcggaaacggtcgcacagaccattcagttgagcgttctcggacatcagattctcttagctggaaaaaagtagcgcgcattatggcaaattttgccgcggcttgcagcaggcaggggtgaaaacaacgggcgccgtagcgcccgggcgagccatggcattaaatatgccagcgtggggaagcgttagttgcccagacctttgccggcatctttctcttcaatgagctcgattttgtaaccgtccggatcttccacgaaggcgatgacggtggtgccgccttttaccggcccggcttcacgggtgacgttgcccccgttctgacggatcagttcgcaggcttcggcggcgttatcgacgctcagcgcgatatggccgtaggcggtgcccagctcatagctgtccacgccccagttgtaggtcagttcgattaccgcggtttcgctctcttcgccgtagccgacaaaggcgagggagtacttgtactccgggttttcgctggtgcgcagcagcttcatgcccaacacgttggtatagaagtcgatagaacgttgcaggtcgccaacgcgcagcatggtgtggagtaagcgcataatgtcccctatgcagtttatttgatagatcagaacgttgagtatagcggcgatacgtcgccgctatcaatggagggattacagagtcgggtaatcggtgtagccttccgcgccgccgccgtagaaggattccgggcgttgcgggttaagcgccgcttttttctgcaggcgagccaccagatccgggttggcgatgtaatcgcggccaaatgccacggcatcaatcagccctttattgataagatcgttggctttttctactgtgtaagcgccagcgccaatgatcacccccgggaagcggtcgcggactttctgacggaaagcttcactgtaaggtttgccgcccgcccagtccggctcggacatgtgcagataggcgataccgcgtttcgccagctcgctaatcagatacagcgcgtcttcttcttcgttcgggccattatccacattttggaagctgccaatcggcgacacgcggatgccaatgcgctcggcgctccactcttgactcacggcgtcaaccacttccagcaccagacgggcacggttctccacgctgccgccgtactgatcggtacgctggttcgccgatggcgagaggaattggtgcagcagatagccgtgggctgagtgcagctcgaccagatcgaagccggcgtcacgggcattgccgaccgcctgacggaaatcgttgacgatccctgggatctctgcggtttccagggcgcggggcattgaggtgtcgacgcgaatggcgtggccgttttcgtcacgcagtgaggtacgggtgcccgcgctcagcgcggaaggcgctaccggggcggcgccgccaggctgcaggctactatgggaaattcggcctgtgtgccacagctggacggcgatatgaccattttcggcatgaacgccggcggtgattttctgccaggcggcaatctgctccgggctgtgcagcccaggcgcgccggcgtagcctttggcctgcgcggagatctgcgtcgcttcggtgatgatcagcccggaactggcgcgctggcggtagtattcgcccatcagcggagtagggatatcgcccggctcaatgctgcgcagacgcgtcaacggcgccataaatacgcgattagggacggtgaccgcaccgactttcagtgggctgaataattttgcttccgacatagtgactcctgagtagaccggtcgtctagtaactgatgaaataaaaacgcctgttataccgcaggcgccgcaataatctgtttggcgtgggcaagggcgctttccagcggcgttgcgctacgcgtaattttggcctgcaggttggccccgagccacagggaatacagcacctgcgacagggtcatggcctcgccgtcaaatgcgagactgccttcctgacgtcctttctccagcgcgtcgcccagcagggcgataatctggctggctccgcgatccatggcggcgcgcatatcttccgacagatcgcaaacctccgcggatagcttgacagtaagacacccgctaataatcccctgctggcagaactgattcagcgtgtgctgatagtaggccagcaggcgatcgcgatagttaccgtcgccatgatcgaagtggtccaccaggcgctgcagatatccggtgtagtgatgttcaagcagcgcgacgccgaaggcttccttagagcgaaagtagtggtagaaggagcccttgggcacctccgccgtcttcagaagttcgctcaagcccattccggtaaaaccgcgatgcatgcaaagctgctcgccggtggccaggatatgttctcgggtatcgcaatcgctgtgtctgttcatgctgcacactgtagtagaccgattggtctaatgcaagcgtcagcggaaaaatgttagctggcgcagcacgtagtgaacaaaatttgcgtcggcgcggggaaacgtcttcaatgaaaggagacgaggggacaggaggcgtgtggtggcagagcagttagaatttttcccggtgcagagcccgtgccggggaatatgtcagaccgatgagcgcggctactgtcgcggctgtttccgtagccgtgaggaacgttttaactggcaaacgatgagcgatgcgcagaaacaggaggttttgcgtctttgccgccaacggctgctgcgcaaaatacgcgcgaacaggccggagccggcggaagaaccgcagcaaccctcactgttttaagccaaaaattacgtatactcagagcacttttttattgaggaagcggttatggttcagcgtattgctatggctccccaggggccggaattttcacgttttgtgatgggctactggcgtctgatggactggaaaatgtcgcctggcgagctggtcagctttattgagcagcatctcgatttaggcgtaaccaccgtcgatcacgccgatatctatggcgattatcagtgtgaggctgcctttggcgaagcgctgaagcgagcgccgcatctgcgtagccggatggaaatcgtcagcaaatgcggtatcgccacccgggcgcgcgctgagaacaccattggccactacattaccgaccgcgatcacatcgtgctcagcgccgagcaatcgctgcgtaatctggcgacggaccatctcgacttgctgctgatccaccggccggacccactgatggacgccgacgaggtagccgaagcttttctcgcgctgcatcatagcggtaaagtgcgccattttggcgtctcgaactttacccccgcccagttcaccttgctgcagtcacgtctgccgtttaccctggccaccaaccaggtcgaaatttcaccggtgcatcagccgctgctgctcgacggtactctcgatcagctgcagcaactgcgtattcgtccgatggcgtggtcttgtcttggcggtggtcgcctgtttaacgaagagggcttccaggcgctgcgcgatgagctggcgcaggtggcgcacgagcttaacgccgacagcatcgaacaggtagtttatgcctgggtgctgcgtctgccgtcgcagccgctgccgattattggctcgggcaaaatcgagcgcgtgcgctcggcgattgtggctgaaaaactcagcatgacccgtcagcagtggttccgcatccgtaaagccgcgctcgggtacgacgtaccgtaacgggcatttcccctccggaaaggcgttcctggtttacacttaacagggagacagccatccggaggtgttatgcaacgatgtattctcgcgatcttatccctcgcattttgcgctggcgcacaggccgttagtgaagatgtgcaacttaatctcgtgaccacccagggcgtcggtcagaccatcggcagcgtcaaaatcaccgaaaccgaccgcggactcgagttcgcccccactctgcgggcgctaccgccgggtaagcacgggtttcatattcatgccgaaggcagctgccagccggcgatgaaagaaggtaaagccgtggccgccggggcggcgggcggacattacgatccgcagcataccggcaaacacgaagggccgttgggagccgggcatcttggcgacctgcccctgctggtggtcaacgatgcgggcgtagccgaccagccgattattgctccgcgcctgaaaacgctggcggaggtgaaagggaaagcgctgatggtccacgtaggcggggataacatggccgacagtccgcagccgctgggcggcggcggcgaacggtttgcctgcggggtgattaagtagttccttcgccaattgtgccggccaccggggcctgttccagctgcgacaaggcgcagtacagtcgccaaatcgcggcggccagttcccgcgccgccggctgatgatggtggttcagggcgtcgcagatccgctgcagctcctgcagggtggaggccagcggacgctgttgcacgccgcgctcgctcatcacatcgcgtaacaggttgatgcacaggtcgcgcacctgggcgagaggatcggagcgggtttcccattcgcgaagctgccagacgacgtgcgagcaattgagcagcacgacgccccaacgcaacagccagcggcgcgccagggcatccttactctggctgagctgactgacgtggtgatagaccagcgattcaaattcatgctcactgtgctgaggatgacggctaagctgatcgacaaagtgacgccgtaacgctctgatatggcgtcgccctttgcgggcgtccgagcccggactcagtaccgcaaaggccagccaggcaaagcctaccccgacaatcttgctcaaattatcattgaaaaaggccgcataatcgtacaccggcgggttggtgacggcgataaacgagcccataaagacgataagctgtccccacaggccggcgtatttgggccactgcagtttgagtaactgcatggtggtcaggagcgggaacaggaacagcagaaactgccacaggtcggttacctgcaccatcaggccgaacttcaccacgaaactgaatagcgacagcaggaccagagtctgcatcagcaatgtcagcgagcgaaacggcgaggcggatacggagtagagcacgcagcagatggaggccagggtcagggccgccgcgcagctggtccactgggtactgatcccccatgcgccaatcgccaccagcgcgcaaaaggtacggacaccgttgagcaacgcctccgcctgatcggtatggcgggctaacggcggggcggcgggcacattgaactcggcgatcgccgaggcattttcaacgcggcggatccagcggctgctctccaggtaaatgcgacagaaatagcgcaatcgcgcccagaaagcgatgtgccggtaatcggcatcctgccgcggcgccagcggcgccaggatccgcgcaacgtgatagctgtcggcatgaggggtggcgagctcggcgagcagcgactccagtacctggcgagtgttcgccggcgcgtcaggccagttcagcagcatccgtcgcagactggagatgacgctggtcatcctgagctgctgatgcaggaggtagttcagcagaggattctgccgacggaaacggtagtggctccagaaggcctggatacgcagcaggttcatggtcaggatctggccaatcacgctctcatgggcggtgcgaatggcatccgtcgtctccggcacccacagcaggctggcgtgctccagcagccgggcgtgcatggttttcagggccgtcagcaggttgctgccgtcggaggtgcttggcaggatcatcatcattagcccgccgcataggatcccgacgatgacttcgcagacgcgcgactgggcgatgacccacagttcgtagctgtcgctgatgttaatcaccggaaaggcgatgatggcgcaggtatagcccgccagctgaaaggcgtaggcgacgttgttggtgaacagggcgcaggcccaggtgcagagcgccagccagccggagatactgaacagaaacagccagggatcgttgagtgtatgaccggcaagcagcagggcggcgcaggcgccgagcaggctgcctgcgatgcggccaaaacttttactgatcacgccgccgacggtgggaaagctgaccaccgccgcggacgtcatcgcccagtagggctcatcaagatccagcgcataggcgatactcagcgcaagacacatcgcgatgccgttgcgcaatgcgtaccgccactgcggccgggtggctttaacccaggggagtgcgcgccacgacagggtctgcaggttcattactgcccgccaattgagacagtgcaggtggtgccggagaccagggtgacatcggccggcagcgtatcaaaggcaattcgcaccggaacgcgttgggcgagacgaacccaggggatatttggtttgatgttggccaccagcccggttccctgttccacgctctggtcgacaatcgcgcggccgatgctcgcgacatggccctttagcgtctgctgattgctatagagaataatttgtgccggatcgccgatgcgaatgtggcgcagtttggtttcttcgaagtagcccagcacgtaaaacgagtggctgtccaccagggcaaagaccggatggccggtggtagcgtaatcaccgacgcgggtggaaaggttagtcacccagccatccaccggcgctttgacaaccgtctggctgagctgccactgcgcatgtttcagcgccgcttcggttacgccgacccccgctctggcggcagccagggtggtggtggcggtattcagggcggtattgacgttctcaagatcttcagccgagatggcattttgcgacaggcttcggcgacggcgagcctcgctggcggccttgctttgctccgcctgcgctttcgccacctccgcctgggctttcgccagctgcgcctgggcgttcagcaccgcgatgcgatagggggtgtcgtcgatggtaaacaatacttccccggctttgacccgttggttatcggttacgttcaactgcagaatactgccggagacctgaggggtgatcccaacctgctcggcgcgcactttgccgtcgcgggtccagggtgactgagtgtagaaattccataacaaccatgcggcaatcagggcgacggccgcgaccagcagcgttgacagatattttaatcttttcataacagggagatcaccaggcaatgagcaataccagggccagacagaccgagagcgcgaacagggagagatccattagtagcgggtgccagatgtcgcccgcatacatccagtcacgcagctggcgatgtaaaaacaaccagataaagaaacccaacaagacggctttgaacagcggagggaaatagacggatgcgccgaacaccaggtcctgcagcggcaatccggatgtgttaagactcagtttcacaagcaaaaatcctttgccattacaggggtaacctcaggacgtgctactctttaacagtgtaaatcattgttttggtttttgttgaatcaagtaattcatttgttttgataattcaaatgctgcacactattctaaaatcagtataataacttagcaagctaattataaggagatgaaattggaatcgccacttggttctgatctggcacgtttagttcgcgtttggcgcgcgctaatcgaccatcgcctgaaacctctggagttaacgcagacccactgggtcacgctgcataacatccaccagctgccgcctgagcagtcgcagatccagctggcgaaagctatcggtattgaacagccgtcgctggtgcgtacgctcgatcagctggaggagaaagggctcatttctcgccagacctgcgcaagcgatcggcgggccaaacgcatcaagctgacggaaaaagccgaaccgctgatcaacgagatggaagaggtgataggtaagacccgtgatgaaatcctctcaggggtctcgaagcaggaagtggaaaccttgctccacttaatccgtaaacttgaacaaaatatcctcgatctccaggctaaagattaattctttgcggcccgggctaatccgggccttttttcaccctccctgccgatgccagacgatcacctggttacgtccgttattctttgcttcatacatggcttcgtccgcgcgctgaacgcacgcttccgctgtcacgctattgtcgtaggtggtatacacccccatgctgatggtcattcgctccggtaaatggctctccccggcactgaccgccaggcggatacgctcggcgatcgcttgcgcttctttttcaccggtgttgaccagcagcagagcaaattcctcaccgccgatgcgtgcggcggcgtcatctacccgcgaatggctttccagcaccgaggcggcgaactggatcactttgtcgccggcgacatggccgtagctatcgttgatgcgtttgaaatggtcgaggtcgctgatgagcaccgacagcggatgctgggcattcaccttcgccagctgttggttaagagtgtcgtagaaaaagctgcggttgtagaggcgggtcaacgggtcgcggatcgaattctgatacgaatggacatatttgtggttagactcgcgatagaggataaagacgtcaaccagtagcaccagaatcaggaacaaggtgcatagcgtttcgaaaaaacgcgcctggtaccaggtctgatccagctcccctgcggtggagagcagctggaaaagcgtgaacaaataagcgctgcaaaaaaaagcgccgctgaaccaaaaaatattacgcagtttactcaagctaattaataaaatcagcgtgatgaaccaaactgccatcagcagccagccgataatactttgccacaacggggtaaaggtatggctcagatcgtcgataaaattgacgctcagccacggcgaatggctggagtatagccatgataaaacaataatggtcaacgtaaaaagtatacatgctgtaaatgtaagaacgtgtgctttccacgaatgcatgatgcgctggcgaaaatagtacaaaataatagatgacatgaataacacagccatcattatattgcggaagaaataatagataacggcgtcattttgattaacgaccggggccggattgcaggtaagccagtccggatagctgctgagcgtgccaagcatcagcagcgctgagcaggcaaacccgaaagagaccggtgtaaggtagagacgccgcttgctgctccagtatttcatgcccataaaacaggcaatggtaatatgaaaaaccatcaggaaactggtcagcagcggaaataatattgaggaagtactactgaagctggtatgaaaaaacgcagtcatcccggaaatgccaatcccggccagtaaacaaatgcaaatataaaggattagacgtttgacgatatgatgcacatgttcgggcataggcaatattccacataaaaggcaacggcagcgacgatgagtcaccagggctaatttacgttcttgagggtaataggggcgggcagataagatattgcgcaggcgcaatgattcatggaatattaaagtaaagatgtctgatggttactacgaatttattacggcgaaataaacgtggctgaaaaatacgatgcggcgcaaccggccgcatcgtaagggaaattatcgcggagagacggtgacctggctgccgctgccggcaatggccacgcgctgaccaacggagaacggagtgctgccctgtttctgcactaccataatggtattgccatcgtccttacggatttccagttcaacgccctgcgttttattcatcgcgccctgaacgccctgaccggctacgccgcccgcgaccgcacctgccgccgtagccagagagcgtccggtaccgccgccgatggtgtttccaaggaacccgcccagtaccgcaccgccaatggccccgatggcattgctatcgtcgccgctctggatctgtacggcgcgcgtatgcacgatagtaccgtaagtcacgctctgcacctgtttggcttcagatgcggaataaacgtcgccggacaggccgctgctgctcacgcagcctgcgagcgtaaaaccaatcatcgatacagccaaaacacgtaaaatcatttatgaatctcctgttcaccgaaggtgttcaattgaacgtccatacggttaattatatggcatttagtcgtcggcgggcataggttctccctggactatacaaaaaataataaacactggtgcttcaacctcaactaaacgccggttctttacgatgttctctgatttgtcgctctattgttaaaaagtattagtacaacatagcattaaccgacactttatgatggagtgaagggcatacaagggtcatggaatgaaggaaaacgtatgagatcgggtcgctttattggcgttatgtctggtaccagcctggatggtatcgatgtcgttttggccaccattactgaaaacatggtggcgcagcaggctagtctcacctggcccattccacacgcgataaaagaagagattctggcgatttcccaggggcagtcgctgaccctttcgcagctaggtcgtctggacacccgtctgggacggctgtttgccgatgccgtactggcgctgatgagccaggaaagtctcaaacccaccgacgtcatcgccatcggctgccatggacagaccgtatggcatgaaccgcagggagaggctccgcataccctgcaaattggtgacaacaaccagatcgccgcccacaccgggataaccgtagtgggggattttcgtcgccgggatatggcgctaggcgggcagggagcgccgctggtgccggcttttcatcatgcgctgctggcccaccccgttgagcgacgtatggtgctcaatatcggcgggatcgctaatgtgtcgctgctggcgccagggcagccggtgcgcggctatgataccgggccgggaaatatgttgctggacgcctggatctggcgccagaagggcaaaccgtacgacaaggacgcccaatgggctagcgaaggtaaagtgctgctgccgctgctgcaggacatgctgagcgatccgtggtttgccttgccggcgccgaaaagcaccggtcgggaatatttcaattacggctggctggagcagcatatggcccgctatccggggctacgcggggaggatgttcaggctacgcttgcggaattgaccgccgtcaccatcagtgagcaggtattgttaagcggcggctgcgagcgtttgttagtgtgcggcggcggcgcgcgtaaccccttgttaatggcgcgcctggcggcgctgctgccgggaaccgaggtctccaccaccgatgaggcggggatcagcggcgatgatatggaagcgctggcctttgcctggctggcctggcgaacgctggctggtctgccgggcaatctgccctccgtgaccggcgccagcgaagcctcggtgctgggcgccatttttccggctaacccgccgcagaatcggagttaactgaaatcttaaatacgatgcgaccggtaaactggacaagttaagcggagggcggagtgcccgccgtgaccgggaaagtcgaaggcaaacgaatgaaaaaaattcttatcgcagttgtaccttttatgctggcgggctgtagctactacaaccagtttgtcgagcggatgcagacggacacgctggagtatcaatgcgaccagaaaccattgacggtccatcgcaataacgcacgccagcaggtcagttttatctatgataatcagcaactgaacctgtctgaggggctgtcggcttccggggcgcgctacaccgacggcgtctatgtgttctggtcaaaaggcgataccgccaccgtctataagcgcgaccgcatcgtccttgataactgtcagctgcagacggccaaacgttgagatttctgtccggggggcgcacaataacgccaccttatgactacatcctcaatggccatgtctgataacgacgaactccagcaaattgcgcatttgcgccgtgaatacacccgtggcggtttgcgtcgccacgatcttcctgctgaacccctgccgctgtttgaacgctggctgcgtcaggcctgcgatgcgaaacttgccgacccgacggccatggtggttgccaccgtcgatgagcgcggccagccctaccagcgcattgtgttgctgaagcactacgacgaaaaagggttggtgttttataccaacctcggcagccgcaaagcgcatcaaattgaaaacaacccgcaggtcagcctgcttttcccgtggcatatgctggagcgccaggtgatggtaatcggcaaagcggagcgtctgtcgacgctggaagtggtcaaatatttccacagccgtccgcgcgacagccagattggcgcctgggtctcgaagcagtcgagccggatctcagcccgcggcatcctcgaaagcaaattcctcgagctgaagcagaagttccagcagggtgaagtgccgttgccgagcttctggggcggattccgcgtcagcattgagcagatggagttctggcaggggggagaacaccgtctgcacgatcgctttttataccagcgcgagagcggcgcctggaaaatagaccgtctggcgccgtaaacgccgaaattagttatcgaagcgctggcgctgaaagggccggcgctttattctatgtacttttcgcatctggcgaaaggtcgtgtaccggcagaggtgcagtcgtttatacatggagaatttgatggcaagcagtaacttgattaaacaattgcaagagcgggggctggtagcccaggtgacggacgaggaagcgttagcagagcgactggcgcaaggcccgatcgcgctctattgcggcttcgatcctaccgctgacagcttgcatttggggcatcttgttccattgttatgcctgaaacgcttccagcaggcaggtcataaacctgtggcgctggtgggcggcgcaaccggtctgattggcgacccaagcttcaaagccgctgagcgtaaactaaacaccgaggataccgtgcaggagtgggtggataaaatccgcaaacaggtggctccgttccttgattttgactgcggcgacaactcggcgatcgcggcgaataactatgactggtttggcagcatgaacgtgctgaccttcctgcgcgatatcggtaaacacttctctgttaaccagatgatcaacaaagaagcggtgaagcagcgtctgaatcgtgacgatcagggtatctcctttaccgagttctcttacaatctgctgcagggttacgactttgcctgcctgaacaagctgcacggcgtggcgctgcagatcggcggttctgaccagtggggcaacatcacctccggcatcgatctgacccgtcgtctgcatcagaaccaggtgtttggcctgaccgtaccgctgatcaccaaagcggacggcaccaaattcggtaaaaccgaaggcggcgccgtgtggctggatccgaagaaaaccagtccgtacaaattctaccagttctggatcaacaccgcggatgctgatgtctatcgcttcctcaaattcttcacctttatggacattgcggagatcaatgccctggaagaagaagacaaaaacagcggtaaagcgccgcgcgcccagtacgtgctggcagagcaggtgacgcgccttgtccacggcgaagaaggcctggaagcggcgaagcgcattaccgaaagcctgttcaacggtaacctgagcgacctgagcgaagcagacttcgaacagctggcccaggatggcgtgccgatgatcgaaatggaaaaaggcgccgatctgctgcaggcgctggttgattccgagctgcagccgtcccgcggtcaggcgcgtaaaaccgttgcctctaacgcggtgaccatcaacggcgaaaaacaggccgacccggaatatgtattcagtgacagcgatcgcctgtttggccgctacaccttgctgcgtcgcggtaagaaaaattactgcctggtctgctggaaataaaaaaatactgccagggcgtgggaaaccacgccctttttctttttagggttgtggtaagaaaatgaagaacatcctcgccattcagtctcacgttgtgtttggccatgccggcaacagtgccgccgaatttccgatgcgccgtctgggcgccaatgtctggcccctgaataccgtacagttctctaaccatacgcagtacggcaaatggaccggctgcgtcatgccgccttcgcatttgacggagatcgttcaggggattgccgatatcgacaagctccagacctgcgatgcggtactgagcggctatcttggctccgctgagcagggagagcatatcctcggtatcgtgcgtcaggttaaggcggccaatccggcggcgaaatatttttgcgatccggtgatgggtcacccggagaagggctgcatcgtcgcgccgggcgtggcggagttccacgtgcgctatgcgctgccggccagcgatattattgcgccgaatctggttgagctggagatcctgtgcggtcatccggtcgccagcgtcagcgaggcagtggccgccgcgcgggagctgattgcccagggcccggaagtggtattagttaagcatcttgcccgtgcgggtctgagtatggatcgttttgagatgctgctggtgacggccgaagaagcctggcatattagtcggccgctggtggatttcggcctgcgtcagccggtgggcgtcggcgatgtgaccagcggtctgctgttggttaaattgctgcagggggcaagtctgcgcgatgcgctggaacacgtcaccgccgcggtgtacgagattatgctcgccaccaaaaatatgcaggaatacgaactacaggtagtagcggcgcaggatcgcatcgccgtaccggagcactgcttcagcgccacccggctgtaactcccagggcctgcccgacggtccgccgggcaggttcaggccttattttaagccttcagccgccagtgcggccgccaccgccggacgcgctgccacctgcgtcatccagctgccgatatgaccataggcagccatatccagttttatagcataggcccagcgcagcaccgtaaacagataaccatcggcaatggtgaagcgatggccggtcagccactgtttgtctgccagcgctgcatcaacgtattgcagctttttctcaagcagcccccgcgcgacaggcttatagtcctccggggtatccgggcggaacagcggagtaaagcttttatgcagctcggtggccacatagttcagccattcgagagtctgatagcgcgcaatcgagcccaccggcgccagcagatgacgatccggcacctggtctgcgatgtactgcatgatggctacgccctcagtgagcaggatatcatcatccagcagcagcgccggcacctgacctttcgggttgatcagcagatagtcttccccgttttccagccgtttttgggccagatccacgctctgcagggtaaaatccagaccgctttcgcgcagggcaatatgcgaggcaagggaacaggcgccgggtttgtagaacagtttcatgcgtgactcctcgtggctgcagttttctgtatgttagtcctgccaggggtaaaaaaaaagccgctaaactaacgttagcggcttaaaaataattagttttccctgcggcgtcaggcagccgcggtttcgcgtgctttaatgtccgcgctgtcgtcctgagtcatacgattcagtttcggcgcggtcagcagcatcagggcggcgataaccgcggtgacgataccaatctgcaggaatacgtgaccgtacacttccagcgacaccagcggatcggtgacattctccgggactgccatcaggttagcgattttcccggcgatgatcgccgcgcctgccgtggtgaggaaccagctgcccatgatgaagcccatcagacgctgaggaaccagctgagcgaccatcgccaggccgaggccggaaatcatcagttcaccgatagactgcagcgcgtagctcagaatcagccagttgaccgagacgataccggcgtcgctggcgaacttcgcccctaaaggcaggacgaggaatgcgccagagcacagtaccataccgatagcaaatttgtgcggcatcggcaggcggtcacccatcttgttgtagatggcggccagaatcgggctaccaatcatgatccagaacgggttcagcgcctgatactgttccggttcaaaggcgagaccgaggatcgagtgctccacgttacggatggcgaagaagttcagcgaggtcggcatctggctgtacaacacgaagaagacaatcgcttctaccatcagcaggaaagcgacgatcattttacgacgcggagcgcctttcaggcctatggtttctttggcgaaaatcacgacgatacccagtgcgacgacgcccagcaccatacgtgcgataccctggttatgcagcagccaggtggcgatagcgaccagcaccaccacgccagcgatggtcgccagcagtttacccatgtgtaccggggcaaagtccggtttagagccgtactgtttaacccatttctgacagaaggcgaagttaataatggtgatcaccatccccaccacgctgagggcaaacgctacgctccagccaaaacgtgcggccagccacggggttgccagcatagagaagaacgaaccgatgttgatggacatgtagtacatggtaaatgcaccgtccagacgtgggtcgtttttgtcatagcaggtagaaagcagggaggacgggttggctttaaacaggccgttaccgacggcgatggtcgccatacccatatagacgatagcggcgtcatggccggaccaggccaccagcgcatagccaatcgccagcacgatagcgcccagcatgatgacacgcgtggtacccagcactttatcacccagccagccgccaatggcgacgaggccataaaccagcgcgctaaaggaggagaacagagtaatggaatccgcttccgacatacccagctgttttaccaggtaaacggccatgatcccttgcaggccgtagtaaccaaaacgctcccacaactcgatcgagaaaatgagatagaacgcgcgtggttgtttgaaagcgttcagactcacgctttctgctggtttattgtttgcagtagacacatatacctctttttttacatcccatatttactggggggtgttcggggcgcaatctcgttggaccgccgcctttatagttattcttggagggaaaacggcaagtaatgttcactatcctggcgcatcaggcaaggcttttgtaataatctgttacacataatcagggtggtataatgctccagacatatgaatgttatacagcgttaaattttaccgtttcgatatcgttggtatttttatctttcgggttcgccggtttgccgtgaaaaggcgatatattctactgatctggcgtaagcatagtgatatggtccattatcttaaaaaatcatgggtcattatcctgacaatctttactcatccgttgtattgcctgacatttatttccattccagtaacattcaatcaacataaagttgcgagcatgatctggatcacaaatgcatagaaattttgcgctgataaaaaatgaatgaactagttgtttgttatataaccggataatcatccataatcatgatgattatgtggtgttaatggccggtgaaatagatgaatgcgggccataacccagagttaagctatgaccgcaatagagacgagacagtcaggcgtagactttatctttgtattcgcaaagatcttcaatcaggcaggagccgcagcgcggcttgcgggcaatacaggtataacgcccatgcaggatcagccagtgatggcagtcgaccttaaactcggcggggaccaccttcagaagcttctcttcaacctgttcgacgtttttcccgggagcgaattgcgtccgattgcagacgcggaagatgtgcgtgtccacggcgatggtcggccagccaaaggcggtattcagcaccacgttggcggttttacggcccacgccgggcagcgcctccagcgccgctctgtcttccggcacctcgccattgtgctgctccaacaggatgcggcaggttttgatgacgttttccgctttgctgttaaacaggccgatagtcttgatatacgatttcaccccatccacccccagggccagcatcgctgcgggcgtattggccaccggatagagtttggctgtcgctttgttgacgcttacgtcggtggcctgcgcagaaagcaggacggcaatcagcagctcgaatggcgaactgaaatgcagttcggtggtggggtggggatcgttttcccgcagcctggtaaggatcgccaggcgtttggctttgttcatattatgctttccctgtcacgtcggacggggcgacagagacggcccgggccgcttgcgccttccgctgtttgctacgttcatcgataagggatttaatcgccagcatcatgccgaggccaataaaggcgcctggcggcagcatagccagcaggaaaggggtgtccgtatggaaaacctcgatgcgcagcacctttgcccagctgccaagcaggctgtcggcgccgtcaaacagcgtgccattgccaaggatctcgcgtagggagcccagcacgaacatcgcgccggtggcccccataccgatagagaaaccgtccagcgccgacagcgccggcccttttttggcggcaaaggcttctgcacggcctaccacgatgcagttggtgacgataagcgggataaatatccccagcgactgatacagaccgaacgcataagcgttgattagcatctgcaccacgctcactaccgaggcgatgatcatcacgtaaatcgggatgcggatctccgccggggtccagcggcgcaggctggagatggtcaggttggtcagggtcagcaccagggtggtggccaaacccagcccgagggcgttggtggcggtcgaggtgaccgccagcagaggacacatacctaacagctgaaccagggcggagttatttttccacaggccctggacgatgacgtctttaacttcgctcatggttattctccacaggcggtgaattcaggaagttgcgcaggcagcgtttgtgcatataagcctgcgcgcttaacggcattgaccaccgcccggggggtgatggtggcgccggtgaactggtcaaaatcgccgccatcctttttgaccgcccagtggctatcgccctggccgtggatgactttcccggcaaaatgggtaatccagtccgacaggcgaagttcgattttatcccccaggcccggcgtttcatgatgctcagttacgcgggtgccgaggaccgtgccgctaaaatcggcggcaaccagcagctgtattgctccggagtagccgtccggcgcagtggcttccatcaccgcgccgatcggtcgatcgttatttttggcgatccacactttatgctggcctttgcccagcgccggggcgctgaccagatagcagctcttaagcagatcgttattatagcggtcggcaggtaaaacctggtcgaataacgccttttgctgcagggccgcctgctggtcgatggtgcttttggtcagctcattgatcgccgccgtcagcccggtggaaccggcggcaaacagcgccagcgtgacgccgtgtttacgcatcgtttttaacatcattgctctctcaacggtggccatatacgcgcgggcgcgtgtagtaatcgatcagcggcacggtaatattcgccagcagaacggcaaacgccacgccgtccggataaccaccgaagctgcggatgagccagaccagcaggccagcgagggcgccaaagatcagacggccgcggttggttgttgaggccgtcaccggatcggtcaggataaagaaggcgccaagcatggtcgccccggagagcaaatgcatctgcggtgaggccaggctctgcggcgaaaaaacccagccgagggtggcgcacaggccgaggctaacaaggaagctgaccgggatatgccagcggatcgccttctgccacagcaggaaaaggccgcctgccagccaggcgatattcacccactgccagcccagacctgccagcacgccgccgtagaccggcaattgcagcacctgctgaacgctatgtccggcatgcagggaggttttaaaggtatccagcggggtggcctggctgacgccgtcgatacccagccgcagactggccatgtcgcctccggcggcggtatggctggtgaagatcatctgcagcgcgtcgctgaatgccgggatatgggcggctatctcataggaaggcagccaggaggtcatctgcaccgggaacgaaatcagcagcacgacatagccgatcattgccgggttgaaggggttatggcccaggcctccgtacaactgcttggcaatgactacggcaaaggcagtgccgagcaccaccatccaccacggggccagtggcggaatactcaccgccagcagcaggccggtgagcagggcggaattatctttcagcgtggcagcaacaggctgtttacgcagtttgagaatagcggcttcggtcgcccaggccgtcagggcggcgaggacaatctgcagtacggtgccccagccgaaaaaccaggtctggaccacaatgccaggcacagcggcgagcagcaccagcagcataatacgcgaggtctgccgctggttatgggtatagggggagcttgcgattctgaaaaccatttattcctcgttaactgcctgctgtgttgctttacgcgcctgaacgcgggcgatagccgcggcgacggccgctttgcgcgggtcgtcattggctgcggctgacgcgagatcctgttgtgtggcctgctgttcggctttacgcgctttggcgcgggcgatggcggcttccaccgccgccttgcgcgggtcgaccggatcggcggccggggcgtccaccggcgcggcctgctgttcggctttacgcgctttagcgcgggcgatggcggcttccaccgccgccttgcgcgggtcgaccggttcggcggccggggcgtccaccggcgcggcctgctgctgcgctttacgcgcccgggcctcagccttacgcgcttcgcgggcggcaatcgcctcgctgttgtcaggtttggcgccggcctggatcacgatcggctgcgcggcatcgcgctgtttatcccgtacccgggccagggcggcgctaatcgcctcctgatctttggcggcaggctgaacggcggcttttttatgccgctcggcgcgcgcggctttctcacgctccaggcgcgcctgtcgggcctcgaatcgggctttggcttccgcagcgcgctgctcttcctgacgaatcgccgctatctcggccttttcctgacggaagtactgcaccagcggaatattacttggacatacccacgcgcaggcgccgcactcgatgcagtccgccagattatgggcagtggctttatcgtgctgctgacctttgctgaaccagtacagctgctgcggcagcagatcggccgggcaggcgtcagcgcaggcgctgcagcgaatgcagcctttctcttcctgcggttcgcccatctcgctggcggaaggcgccagcaaacagttggtgatcttcaccaccgggacgtcgagccacggcagggtaaagcccatcagcgggccgcccatgatcaccattggctcggcgctggggcagaagccggcatcgttcaatagatggcgcaccggcgtgccaagacgcgcccagacattgcccggtctggttaccgcttcgccggtgagggtgaccacgcgctcggttaacggctcaccgtcaaccaccgcgcgtttcaccgcataagccgtaccgacgttctgcatcagcacgccaatgtccgatgaacgaccgccgtgcggtacctgtttgccggtgagaatttgggtgagctgcttggcgccaccggagggatatttggtggggatcacgcgcagcgaaatgccatgggcgtcgcagagcaccgcccgcagcattgagatggcctgcggcttattgtcttcaatgccgatcagcacttcttcaggctgcagtatatgagcgaggatgcggataccctcgacaatctgcgccgcgcagtcctgcatcaggcggtcatccgccgtgatatagggctcgcactcggcggcgttaatgatcagcgttttaattttatctccgccaccgcgcagtttactgccggtggggaagcctgcgccgccgaggccagcaacgccaaactggtggatacgctcgatcagcgcttcacgcgtgcgggtctgatagtcgctccagccatcgcgctcgatccagcggtcttcgccgtcggcgtcaatgatcacgctcatctccgccagagccgacgggtgcgcggtagtgtgcggagcgatggcggcaatggtgccggaagtcggggcgtgaacgggcagcattcttccccagccgcgggtcagcggctggccgcgcagcacccggtcgcccactttaacgcacagttcgccctcggcgccaatgtgctgcttcaacgggataacaaagcgctgcggcagggaaacctgacgcagcggggtgccgttagactgggttttcatttcaggcgggtgaataccgccgttgaaatcccagaccttgtcttttcggaaagcggaaaatagcttaaacatgttgttccacaggaatatttcgcaccgggatcgtatgcagatcccatttccaggtctccggggtggtggccaccggaacgagtgaaatgcactgggtcgggcagggggcgacgcacaaattgcagccggtgcacaggtcgctcatcacggtatgcatggcgcgggtcgccccaacgatggcatccaccggacaggcctggatacacttggtacagccaatgcagttcggctcgtcaattaccgcgagcatgcgggccggctccgcttcctgtgcgtcgccgtcgacaggctgcgggtcgacgttcagcaaggcggcgatttttaacatcaccgcttcgccacccggcgcgcagcggtttattttctcaccctgtacgccgactgcttccgcataggggcgacacccagggtacccgcactgcccacactggctctgcggcaatagctcatcaattttttccaccaccgggtcgtcctgcaccgcgaaacgacgcgaggcgtatcccagtattaagccgaaaatcagccctaacaggctgatggcgatcacggctatccagactgcgctcattacaacttcaccaaaccactaaagcccatgaaggccagagacattaaaccggcggtaatcagcgcgatggcattaccgcgaaacggcgcggggacatcggccaccaccaggcgttcacggatcgccgcgaacagcaccattaccagcgagaagccgacggcggcggcaaagccgtacagcgccgactgcaggaaattgtggcccagattaatattcagcagcgctaccccgagtacggcacagttggtggtgatcagcggtagaaagatccccagcaggcgatagagcgccgggctggttttacgcaccaccatctcagtaaactgaaccaccacggcgataaccagaataaaggccagggtacgcaaataaaccaaatttagcgggataaggatccaggtatcaatcagccaggcgcaaatagaggccagggtcatcacgaaggtggtagcgagccccatccccattgcggtttccagctttttggaaacccccataaacgggcacagaccaagaaacttcaccagaacgaagttattgaccaggactgtaccaataaagagcagtaaataatcagccatcatgcgacctgaaacgaaaaaaagccgcttattatcgaataaaacgataccagcgacaacaggttaagtgtgggggtattacggattaacaaaagtccgttttacccgctgcgaacggcgaaaatagggcgccagcagcgcagcggccagcagcggaaacagcagctgacgcagggcaagcacatccgagaccggcgagaaggcaaaagcctttatcgccagcagcagggtgatgagcagccagataatatagtgtttcggcaccaccgagcgccgcttgaaaaaggcgatagtcagccagagcgtgtaataccacatggcgagtgcaaacagcagcgaggcgacccacagcgccatatggcccgcgctcatggcgcgcagtagggtataggtctgcggcgacatcagcgcattagcaaaaaacagcagcgataacgaggcgctcagcagcgccaccagcaaccaggccagcggagccagcagccatccgccgatgcgctctgcagattgagacgtcatgtttctcccctattcaacgccagtgaataaaatcaggccgggaagtataagcaactggcgtgaaggatgacagccttactgcacgaatcgccaaacggatttaggaacctggcccacatcgaacaatttaccaccggagaccagctctgcgcgacgatgatcggcggcgcgatacatattcacgatctcctgggtgtcagtcagggagtagttaaggtgatcaaatagtttttcaaggctttccagcgaactgattttgcgaaattttaataagtagtccagcacggtcattttcgtatccattttataatcggaattattgcgttgaatattatcagcattcactaaacctactctcaaccaacggcgccttctgctggggccgcgtggaatgaatcaggttatataaacccatgacaaggggcaaagccagccttgaagagcagggagaagtttaagaatattctaaaatcagaccgggcgccgaatggcgcccgcaagagaagattaacgctgttcgccgtgactggcaataacagatttgtaccaataaaaactcttctttcgtttccgcgccagattttgctggtgatcgacatagacaaaaccatattgcttttgatagccgttgagccagctcagcagatcgataaatgaccaggggtaatagccgcgcacatctgcccccagcgccagcgctttttcgagggcgctaatatggctgctgagataatcaatccgcgggtcgtcgaccacttccccgtcaataatcgggtccttcgcgccgaggccattctcggtgatatatatcggaatatcgccatagcgcgccttaatcatcataatgccgtcagttagcccctgcggccagatttcccagccccattcggtatatgtactctggggattacgcacgaaatagaataatccctccacgccaggctcgccgccggtagcgatctcaggcggctgggcagataccgtttcccggcgatagtaattcagaccgataaagtcgcagcggttgtcacggagcagcgcgtcgtcgcctggagcaaagcgaggtaccccccacagcgcctgggtctgcgccagcaggtcggcaggataggtgcctttcagcaccggatcgtacagccagtgagtatggatggcgtcagccagttcggtggccttaatgtccgcctcgctgtcggtgagcggggtatgcggttgcagtacgttgacgaagccaatctcgccggccacagccatctcgcgaaaggccttcaccgccagcgcatgggcgacaaacacgtggtggcaggcctgaatggcacgcgccggatcgcggaccgccgggggatggaggccgttaatgtagccgtgcccaatgaagacaatggtttcgttgaaggtagcccacagcttcacccgtgaaccaaagcgcgcatagcacaggcgggcgtactcggcgaaggcctcggcggtagtgcgcgcttcccagccgccctcatcctgcagggcctgcggcagatcccagtgatagagggtgatcatcggctcaatattgtgcgccagcagttcgtcgatcagatcgctgtaaaactggactcccgcttcattcaccttaccgcgcccggcgggcagcaggcggggccaggagatggagaatcgatagctttgcaggcccatctcggccattaacgccacgtcttcgcgaaaacggtgatagtggtcgacggcaatatcgccggtggtgccttcaaaggtggtacccggcagatgagagtagatatcccagattgacggtcctttaccgtcggcgtcgtgtcctccctcaacctgatacgctgcggtagcggcaccccataagaaattgtgcggaaaagcggccatgaaaaagctccctgtctgatgataaagggagtgtaataaaaccgcgaacatatgtgcaaccggtttctgaaaccggttgcacagttgcgaggcgggtcactgttttaacgcggagctacttcgtgtgcaccacatccgctggcggtggggactgatagttatctatatggtgtgcgataaccaaaagcagtgccgaaataccaaaaacaatccagccaataagttctacaatacgggtaaaaacagttgtcataacacttcaatatcctttgaacacagcgtgaaatgttactcgatggtcagcagatcacaaggggtatctgtctgatttctcacacttgcatgtaagtcgcaaagtaaggaatgataagttttgctcacggtttgtaaaattattctcattaacctggtgttgatatcagttgcataagcgaggcggtaagatgagcgatgcgatccgggtggggctggtggggttcggttacgccagcaaaacgtttcatgcgccgttgatcggcggcacgccgggtatggcgctgaaggcggtcgccagcagcgacgccgataaggtccatgccgattggcctggcgtgaaggtaatgagtgcgccgggggatctgctggacgacccggatatcgatctggtggtcatcgccaccccgaacgacacccactttccgctggcgaaagcggcgctggaggcgggaaagcatgttgtggtggataagccctttaccgtgacactgtcacaagctcgcgagctggaaagcctggcgaagcactgcggtcggatactttcggtgtttcataaccggcgctgggacagcgatttcttaacggtcagcgcgttaatcaacgaaggtcagctgggggaggtgtgttacttcgagtcgcatttcgatcgcttccgaccacaggtgcgccagcgctggcgtgagcaggcgggtcctggcagcggcatatggtatgacctcgcgccgcatctgctcgaccaggtcgtggtgctgtttggcctgccggtaagcatcacggtggacctcgcgcagcttcggcccggcgcgcaatccaccgactattttcacgccgtgctggcctatccgcagcggcgggtagtactgcatggtacgttactcgccgccgcggagagcgcgcgctttatcgtccacggctcgcgggccagctatattaagtacggtcttgacccgcaggaggagcggctaaaaaacggtgaacggctgccgcaggaggactggggatatgatatgcgcgacggtaccctgacccgcgccgaaggggatgaacgtagtcaggagaaatggctgacgctaccgggtaattatcccgcctactatgccgctatccgcgacgcccttaacggcgtaggggaaaacccggtcccggccagcgaggcgattcagataatgaccctgattgagttgggtatcgagtcggccagacatcgcgccacgctcagcctggtctgaggaggagcccggcagcacggctgccgggccggttatcagcctttggcaacccgctgaatgagggcggctttttcctgttcgccgaggaacgccagggtcaggccgttgatctgcgcctgacggatctgctcccggctcagccctgccgccggcgccgccacggtatactcgtgaatgatgtccacaccctggaccgccggatcgtcagtgttgaggctcgccagcacgccgtgctcaaggaactgcttcagcggatgctgggccagggaggccacggtgctggtttgcacgttcgaggtcaggcaggattcaatcccgatgcggtgctcggccaggtagtccatcagggctggatcctctaccgctttaaccccatggccgatgcgctccgcgcccagctcacgaatggcctgccagatactttccgggccggccgcttcgcccgcgtggacggtgatatgccacccggcgtcgcgagcctggttaaaatggttgcggaacagcgtacccgggaagccgagctcatcgccggcgaggtcgagggcagtgatgccctcgcggtgggcgagcagcgccgccagctcttcctgacaggcggcttcgccgaaggtgcggctcagaataccgatcagccgggcgtcgacctggaaatcgcggcatccctcttgaaccccggcaattaccgcctctaccacgccgtcgaccggcagccggtgggtcatcgccatatagcggggagagaagcgcagctcaacgtagtgcaggccatttcgcgccgcgtcttcgacgttctcatacgccacgcggcgacaggcttccagcgaggccaggacctttaccccccagtcgagcttggcgaggaaactaaccagatcgggctcaaggctggtgacctggacatgaggacgcagcgtgtcgagggtggttgcgggaagagcgatattaaattcgcggccaagatcgaggatggtttgggcccggatgttaccgtcaagatgacgatgaatgtcggttaatggcaatgaggaatcaatcatggtcgcactctttttttagttaaagtgcacgtcattatacaacatgaacataactgtttaaaagcattgaaaaaatgtatgcgatacaaatagctggcagcaatcaggtcagcattacggtctttttgactggcccctttaaaacgcagaacgaatatcatgattgacgcgatcctgaccagatcagaaatgcacacgcgctgaccgcggcgcccgcaaggcagaccgcctgccatccccagtgggaataaagctgtgtggcaacgatagcccctgtcgcgctgcccagcgaataaaaacacatgtaagccccaaccaggcggcttgccgctgcaggcctggcggcaatgatcaggctctggctggagacatgaacggcctgtaccgcaaagtccagcgcaatgacgccagctatcagccaaagcagagaggtttcggcatagccgataggaagccatgagatggtcagcagcgccagcgccaggccggtagtgcgctgagcccatccctggtcagcccacttgcccgctctggcggcggccagcatgccagcgaagccggctaagccaaacatccccgtctgggtgtgcgagagggaaagggcggtgagcggcatgaccatggtcgtccatagcatgctgaaagcggcgaagataaatagcgccaggatcccgcgctttctcagttgcggctcggtgaggtacagctgaaacacggacttcaataaggaaaggtaagtcggcttttgcggctgcggctgctgcgggggcgaaggcatgattttccagacgacccctgcaatcaccaacatcagacaggcagccgtgagatacacggctcgccagccggcgatatcggctatcgcgcctgagataaaccgagataacaggatacctgaaacaatgccgctggtcagggtacccaccgcctggcctcgtttctgcggcgtcgccagtactgccacccaggccaccagcacctgcaccaccacggccatcaggccgacgatcagcatggcgccaagcagcgttgctatattgggggataaccctgccgcgactaacgccgctactgaaagcaacagttgactcatcaccacgtatttacggttcaaccagtccccgagcggaaccaggaacagcaagccaatggcatagcccgcctgcgtagcggtgatgacgctgccaatcatgcctggcgacaccttcaggctgaccgccatcgagtcgagtaaaggctgtgctgaataaacattggctactgccagcgcgcaggttagtgaaaacaacgccgttatccctgtggtcagcatcgtgtcagggactgacgcagtttggatcctttggccggtacatctacttgccttacatttcataagagaccctctgtctggttgctttttaaaactagtgtacctatagaattagccttgctggtttttttttgcaactggtaaaggtgaggattaagctagatcagtagataaattgataaggagcgcgcagatggcaaagcaggaatcacttagaaccagtgagtgtccggtggcgagaacgttggaatcaattggtgaacgctggtgcctgatgattatccgcgaagcatttgacgatgtgcggagattcagcgagtttcaaaaaaatttggggctggccaaaaatatccttgcctcgcggctgaagcatctggttgatatcggtattttcgagattttaccggcatcggatggcagcgcatacaaggaatatgtcctgactgaaaaggggcgctccgtgtttcccattgttgtggcgctgcggcaatggggagagcgttatatgtttgagcaaggggaaacctattcggtcctgctggataacgcgcacggccagccccttcagtatctggatgtgcgttccgctcagggggataaactgcaaccaggcgactgtcatcgccggcgcattgtgtcagatacccgcgccgaataatggcgtgaagaatttgcaggataccagcgagaatacgagcgtaccgctaaagggtcatggaacaatcctgacgtgtttttttgcgaactgcttttgatgccaaagctccggacgcgtgaaagtgacccaccgccaaccgcaggaggcggtgcataaccatttacaattatattttatttgaatgtattcatgttacatattaaattctgcttactttatcgacgatgaggcaaggatgcggatgtggagagcgtaatccataacaatattgagggttttctgctgttgttattaagcatgtggccgattctgctggtggtattcattggcgtcgcaatttcattctataccatgctgttacgcaagacggcgctggcctgcctgcttttcgccctcgccatcggcgccgcaggctggagtctcgcttagccgctggcctcagggtttatccagcaggctcatactggaggtggcggcgccatcattcagattggcgggcgaatgccagtcgcgacccgccagcgcactgtcgctctgtccgctgccgacgccttgctgcgtcgacagcgatgaaccttccagtgcttcatccgcccctgaccgatcgggcagggaactggtatagccgccattattcgagtacgtatccatgccgttgacttcgttaggcaccgtgtcggtagtcgtaccgtcatcgttaatgcaaaaagagccgccaatgccgtttggctgacagtctgcagcaaaagccggactggccagcgcggtcagtagcaataacggtaagccgatttccttcattcttatctcccagggccgtgtggtctgccagacattctgtactatagcggcggcagtagcgcggtaagtaacaaaactgtgtaattttgtaatgaccggtggacggtttgtcgttcggccaggaaagagcgtgcgttaagcgtggcatagcggctcggcagaaagcggtaatcaattgttaattctacgtaaaggttaatgaaaatttaagggaacgccgctatgttggcagcatcatactttccataaaggatatgccatgcgcgataaatattccggcctgcagattgggattcactggctggtttttttgctggtagtagtagcctatgcggcgatggagctgcgcgggttttttccccgcagtgagcggccattgattaatatggtgcatgtttcctgcgggatcaccattttcgtgctgatggtggcgcgtctgctggtgcggctgaaatcgccggcgccgccgatcgtaccgaaaccatcgccgatgatgaccggtttcgcccatcttggtcacctggcgatctatttgctgttcattgccttgccgttgatcggcatggtgatgatgtactggcgcggtaacccctggtatgcctttggtctgaccatgccgtatgccccgcagagcgattttgagcgggtggataccctgaaggcgatccatgaatggttggccaatgccgggtactttgtgattggcctgcatgctctcgccgcgctgctccatcattactggtggaaggataatactctgctgcgaatgatgcctcgtaagcgctaaatcatcctctttcacttcctgaccccgtcccgcgacggggtttttttttgccttcaccgttaatagaatatagtatacccccctatatgatacggaggcgtaatcgtgccacattcacctgaagataaaaaacgggcgctcagccgcgtaagacgcatccgcggccaggtcgaagcccttgagcgcgcgctggagtccggcgagccctgtatgactattctgcagcagatcgcctcgattcgcggggcggcgaacggcctgatgggcgaaatggtggagatccacctgcaggacgagctggtcagcggcgacaccacccctgagcagcgggccgcgagaatggcagaggtcggtcatctgctacgatcctatttaaaataacatcacgacgaggaagagacagttatgaaatcacgcgcagcagtggccttcggccccggtcagccgttaaaaatcgttgagatcgacgtcgcgccgccgaaaaaaggcgaagttctggtgaaaatcacccacaccggggtgtgtcataccgatgccttcaccctctccggtgacgatccggaaggtgtcttcccggcggtgctgggccatgagggcggcgggattgtcgtggaagtaggcgagggcgtcaccagccttaagccgggcgatcacgtcattccgctgtataccgccgaatgtggcgagtgcaaattctgtaagtcgggtaaaaccaacctctgtcaggcggtgcgtgccacccagggtaaaggactgatgccggacggcaccactcgtttctcgtacaatggcgaaccgatctatcactatatgggcaccagcactttcagcgaatatacggtttgcgccgagatttcgctggcgaaagtcaatccgcaggcgcctttggataaagtgtgcctgctgggctgcggcgtaaccaccggtatcggcgcggtgcataacacggcgaaggtcaaggccggggatagcgtcgcggtctttggtctgggcggcattggtctggcggtgatccagggcgcggtgcaggcgcaggccgggcgcattctggcggttgataccaacccggataaattcactctcgctaaagagatgggcgcgaccgattttatcaatccgaacgactacgataagccgattcaggatgtgattgttgagctgaccgacggcggggtggatttcagcttcgagtgcatcggcaatgtaaatgtgatgcgcgcggcgctggagtgctgccataaaggctggggtgagagcgtgatcatcggtgtagccggcgccgggcaggagatcaagacccgtccgttccagctggtgaccggccgcgtgtggcgcggttccgccttcggcggcgtaaaagggcgcagtcagctgccgggcatggtggaagacgccatggcgggtaaaattcgcctcgatccgtttattacccatcgcctgccgctggagcagattaacgaggcctttgatctgatgcatgaaggtaaatcgattcgcaccgtgatccactttggcgaccagtaatcgccgacgctgaaggcgaatcgtcacccataaaaaagggcccggatgggcccttttgtgtatgtcgatcagtgatggtctgggagcgcgtaggcgatgatgtaatcgccgcgatccggtgactggcgggcgccgccggcattgataatgatgtactgcttaccggttttcggtgagacgtaggtcatcgggccggactggctgccgaccggcagacgcgatttccagatctctttgccgttcgcggtatcaaaggcgcgcaggtagaaatcctgggtgccggcgaagaacagcagtccggactgcgttgccagcgatgcgccaagggtcggcatgccgattggaattggcatgtgcatacgtatgcccagcggcccggtgtcttctacggtgccaactggcacctgccacaccagtttcccggttttcagatctaccgcggacatggtgccgaacggcggcttctggcacggaatgcccagcggcgacaggaaacgttcgcgcatcgcgccaaacggcgtgccctccatcggcacgatgcccatctcgatcccgctggcgtctttcgccaccttcgcgcgcggcaccatatagttggccaggcccagacgcatatcgttgacaaacatcaggctgttgtttggatccagcgaaacactgccccagttcatgccgccgagcgagcccgggaactgcagggaacgatcttcacctggcggggtaaagacgccctgatggcgcatctctttgaactgaatacggcacagcagcaggtcgatcggtgtcgctccccacatatcggactcggtcaacgtctggttgccgatcatcggcatccctaccgagtaaggttgcgtcggcgagtagcgttcacctttgacgttgcccgccggcaccggacgctcttccactttggccaccggctcgccggtctcgcggttgagcataaagatcatgccctgcttgctggtctgcaccagcaccggggtggtgccgcccttgccgtcaggcagatcgtacagcagcggctgagacggcaggtcaaagtcccacagatcgtggtgtgtggtctggaagtgccagcgcacctggccggtggtggcatccacggccacgatagaggagctgtatttatcgtccagcgcggtacgttcgccgccaaagaaatctggcgtggcgttgccggtgggcagatagatcagattcagcttcgcgtcataggacatcgccgaccagacgtttggcgtaccgcgcgtgtaggtctggccttccggcggaacaccggtcagcgctggattgcccggatcccacgcccacgccagtttgccggtgtggacatcaaacgcgcggaccacgcccggcggttcgccggtggagtagttatccgcgacgcggccgcccaccaccaccacattgcccgccaccagcggggtggaggtctgctgatagtaacccgctttcacttcacccatgccgacgctgaggtcgacaataccgcgatcgccgaagctttcgcacagtttgccggtatcggcatcaatggcgatcaggcgggcgtcgatggtcggcaggaacagacgacgggaacaggcggccggctgcgtgcctgacgcttgcgcggtttgcgcctggctatctgcgtaataccctaagccgcggcagcgctgccagttgggtgaagaggatttggagtcatagcgccatttctcttttccgctgtccacatccagcgccagcactttactgtaaggggtacagacatagagagtatcgccaatctgcagcggggtgttctgatcttccgcgccggagccgttgctctgcgggatatcgccagtatgcgctacccaggcaacctgcagctggttgacgttttgtttgttgatttggtcgagggcggcgaaacggtcgccgtgggtggtgttaccccagtgcgcccagtttttctgctgttcgcctggcgcgacgggcttgactggtaccgcttcagtcgcgctgaccagcggtgcggatttgaacatccagccaaagctcaccgccagcgccacggcgagaacggcggcgacgccataggccgggccttttttcgccggtgggctggcgaggaaaggccagaccagggcggccaggaaggccagtacgccgagcgcaaacaggcgcgagaagagcggccagtagttccagccagcgtcactaatcgcccagatcaccgaggcgataaacgccacggcgtataacagaataccgccgcggcggttgcggaaaatcaacaccgccgcgatgaccatgaccacgcccatcagcgcgaagtacagtgtaccgccgacgagggccagttttgccccaagaatacccacagccagaccgatgatgagcatcagtccggcgagaagccactgcaggatccgggggaatccgcgcggcgcgttgccagttgccatgtaatctccttaaccacaccagccacctcactgtgaaccaaatgaaacatgttgcttttgaatcatttttgaatgaagtggttttaaccttcataaaactgtatttgttgcttgattagatttcgagtgaaccatttggtgaaatcgagacatgatagatctgttaaagaagtttgcgcaaatgttaataaataatttcgcactaaatgattattttgccgaatatgtctaacgtcatggggagcggcgtcggcgcgtttgcaggttccccggccgctgcgggccggggagaaaggggggtcaggcaggcatggacttacggatagcgctgagcagcgtctgcgtacccggggtcagtgtcgcatcgacgcgggttaaaatgccgatgggctctccggcgccctgggtggcgatcggcagggcggttagcacgccacggcgaagatcgtcttttaccgccccggaagggacaaaccagacatagtcaaaatccaccgtcagctggcgcgacagggaggcggagagggtctcgatgcagccggcgggcatcttacagccctggctctggagcagcgcttcggcgttttgccgcggcacggtgcctttaggtgagaccaccaccggccactccatcacccgactaagggtcaccgtctcctgaagcaggggatgtcccgggcgaaccaccggcttcagggattcaaggaacaacagttcgtaatgcagcccgctcatcagctccgggtcggacatacgtccaatgccgatgtcgatctccccggattttaagccggcgagcagcatggtgttgttcatagtggcgacctgcagcgtgatatctttttgctgcttgtgaaactggccgatcaccgtcggcaggatccccagagcggcggtgggcagcgcgccgatgcgcacgatatcgttattcaggccctctttgcggttcagcgcctggccggccgaattaagggcgtcaagcaccttaacggcatgcgtcagaaactgttcgccgaccagggttagctgcgccccaagacgaccccgctcgaacagccgggtaccggtcagctgttctagctcgttaagcgttttcgagagtgctggctggctcagatttaatgtttcagccgcgcgccccagcgttccctgttgagcgacggccacgaaggtgtgtagatggcgcaagcgaatgcgctgactgaagagaccatttttttccatagtaagatgatgttaaaaacacagcggtgaaagagacaagcggacttgtttaaatttgataaccagatagcaaaatattattaacatttgggttggttacatgacaagatctttccctgtggttgaaaacgccttcgccccgcagaaacggggcgaaggtggtggtcaccgcgacggctaaatatcgaaaaagacggtttcgttctcgccctgcagatgaatgtcaaaacgatagaccacttccgtaccgcgaacctcgcgctcggcgattaaggttttgcgtctcacctcccactcgatgagattcagcaccgggtcgctggcgttggcctcgtgttcatcggcaaagtacatccgcgtattaaggccaatattgatcccccgcgccaccacccacaggttgacgtgcggcgccatcagccggccatcccgaccgaccaccgggcccggcttgatggtttcaaagcgccaaatgccggaggtgaaatcagagcaggtacgcccccagccgcggaaggccgggtcgacggctttctgctgttgacgatcgtcaggatggttatagcgacccgcggcgttggcctgccagatctccagcagcacatcgcggaccggcgtcccggagccgtcgagaacccggccttcaatggtgatgcgctccccggcggtatcggcggtagtgaggaccgggccaaaatttttctcaaaaatatgaaagcctgcggcgtccggcgccaggccgatatgaacatagggtcccgccgtctgcgaggcggtttcaggcagatactctttcatcgggcggccccctgagtgcgattttcaaacagcgtggcgcggtggccgcgcagaacaaggtcgaagcggtaggccagacaatccagcggtacggcggcgtgcatgtccagctcggcgatcagcgtgcgcacggcgtcgtcattattaatagtcctgacgatcgggcactgcttaatcaacgggtcgccttcaaaatacatctgggtgatcaggcgctgggcccaggcgtcgcccgagagagaaaaatggatatgcgccggacgccagtcgctggcctggttgcgccaggggtaggggccgggtttgatggtgcgaaaacagtaatagccgttttcatcggtaagcacccggccgcaaccgccaaaattcgggtcaatcggcgccagatactgatcttttttatgccggtagcgaccgccagcattggcttgccagacttccaccagcgtatttttcatcggtcggccgaatccatcgcgcacgtaaccgtggacgatgatccgctcgccgataggcaggccttctttggcatagttcaggattaggtcattatccagagggcccaggtcgtcgcggctaaataccgggccggtgatctctgacagcgagttctgcagagagatgagggcgttttttggcgagcgcaggacgctggttttatagcccggcgcgtaagcgggcgggtggctactgtaatcgcgatggacaacctcacgtggggaccatttgtcgttcatagggtactccgtgtagacggtagaggggcatattgttgtaatgtcgccagaagcagtgtgtgtaaatgtattgttaatttaaagtgaaattacagggtgtttttcataactatgggttatgttttgcgcaatgacctggaccggcggcaggttatcgccatcacagtttgtaaattcttccccccgccgcgaggcagctttcctacactccaggaagtattcactggaggtaacacatcatggcgaacaccatcacggctgatgagattcgggagcacttttcgcaggccatgtcggccatgtaccagcaggaagttccgcagtacggaacgctgctggagctggtggctgacgtcaacctggcggtactggaaaataatccgcagctgcatgaacagctcgctaacgctgacgagctggcgcgcttaaacgtggagcgccacggcgcgattcgcgtgggcacagcggaagaactggcgacgctccgtcgcatgtttgccatcatggggatgtatcccgttagctattacgatctctcgcaggccggcgtgccggtccactccacggcgtttcgtcccatcgacgatgccgcgctggcgcgcaatccatttcggattttcacctcgctgctgcgcctggagctgattgaaaatcgcgccctgcgcgagcgggccgaggcgatcctcgcgcggcgcaaaatcttcaccccccgctgcctggcgctgattgcgcagtatgaagcagagggcgaattcacctctgccgacgcgcgcgagtttgtccaggaggcgctggagacgttccgctggcaccggcaagccaccgtcgatgaggagacttaccatgctctgcatcgcgagcaccgcctgattgccgatgtggtctgtttcccggggtgtcatatcaaccatctcacgccgcggacgctggatattgaccgcgtccagtccctgatgccggagtgcggtattgaacccaaagcgttgattgaagggccaccgcgccgggaggtcccgatcctcctgcggcagaccagctttaaggcgcttgaggagccggtgatgttcgccggagaacaccgaggcacccatagcgcccgctttggcgaaattgagcagcggggcgtggcgctgacgccgaaagggcgcgcgctgtacgatcggctgctgcaggcggcaggaaccgggaaagataatctcagccaccagcagcatctacaggaggtgtttagcgaatttcccgacagcgaatttctgctccgtcagcaggggctggcctggtttcgctaccgcctgacgcccacgggtgaggcacatcgccaggcgtttcgcccgggcgacgatccgcagccgctgattgagcgcgggtgggtggtcgcccagccgattatttatgaagattttttaccggtcagcgcggcgggcatttttcagtccaatctgggcaacgaaacccaggcgcgcagccacgggaacgccagtcgcgaggcgtttgaggcagctctgggctgcccggtgcaggatgagtttgaactataccgacaggcggaggagcgcagcaaacgacgttgcggtctgctgtaaaatcagtaccctgctggcatcagccttacagggagcaggttatgcaacatccgtcgaaaccgttggcgaaaacccgtcagggaacgcttgccgggagcgcagaacaggggattcatatctggcgcggcattccgtacgccgcgccgcccgtgggcccgctgcgctggcgcgcgccgcagccagccgcccgctggcagggggtacgtccagctgagaccttttccgccgccagctggcaggacattgactactgccgcgagctcggcggcggcgatcctggcgccttcagcgaagactgcttatatctcaacgtctgggccccggccagcgcagcgcagccgctgccggtgatggtctggctgcacggcggcgggtttaccatcggcgccggcagcctgccgccttacgatggcaaagcgcttgccagccgcgacgtggtggtggtgacagttaactaccggctgggccatctcggttttttcgcccatccggcgctggaacaagaggcgggcgaacgtctctataatttcgcgttgctcgatcagattgccgctctgcagtgggttcaggagaatatccacgccttcggcggggatgccgccaacgtcacgctgtttggcgaatccgccggggcgcgcagcgtgctgtcgctaatggcctccccgaaagcgaaagggctgtttcataaagcgattattcagagcgggtatacgctacccgatctgccgcgggaaaaagcgctggaaaaagggcgcctgctggcggaacacttcgccttaccgcaagccagcgctgaggaattgcgggcgatcccggcggaggccttctggtcgctcaccgcgccgctgaataccgggccagcgcctattgccggagacgcggtgctgccgcagccgatgctggagaccttctttgccggccgccagcatccgataccggtgatgatcggctccaatagcgatgaagccagcgtgatggccgtgttcggcgtcgatattgccgggcagatccagaagctgcgccgagagcgccgtctggggctggggctgatcaaactcctctatcccggcgtgaagggcgatgaagcgctggggcgggaagtatgccgcgacatggccttcaccacccttggttatgtagtgatgcaggcgcaacagcgcgtgggtcagccgtgctggcgctactggtttgattatgtcgcggaagcggagcatgacgcctacccgcatggggcctggcatggcaacgaggtgccctacgtgtttgataacctgcggttgaccgacccggtgcggcagtacgccagcgaagcggatctggccttcgccgctcaggtcgctgactactgggcgcagtttgcccgcctcgccagcggcgagcagacgctttccggcgcggtgcgctggccggcgtgcctgcgcgggcgggatcgcctgttgcgcattggcttgcataagcgcgccgggtttaaagtggagaaccgctttatgcgcgccagactggcgctgtttcgccgggtgatgaagcatcacgtgacgctggaataaatcccataatgcgcaactgtcgccaccgaccggtggcgacgttatctcacacgaccaccaccggcttgatcaccttgccggacgccgaatcggcgaaggcctggttgatatcggccaacggatagcgggcgataagcttatcgatagggaattttccctgtttatagagttgcaccaacagcggaataaacagcgccggcacggcgtcgccttcaatcaccccgaccagcgattttccctccgccatcaggtcgttctgcacgttaagggtgatatctccggtaaagcccacaatcgccaccgttcccagcggtttcaccgcgtgtacggcctgcagaacgatagcggagacgccggtcgtttccaccgcgtagtgggcgcctttaccggtgatttgtttaatcacggcgacggcatcctgttccttgccattgatctgatgggtggcgcccagttcgcgcgccagggcgaggcggctggcatggatatccaccgcgataatctgcgaacagccggttaatttcgctgccatgatggcgctgagccccaccgcgccgcagccaaacaccaccagcgattcgccgaccaccggtttcaggcggttgagcaccgtcccgctaccggtctggataccgcagcccagcgggccgagcagggtgagatcaacctccgggtcgaccacgaccgcgttgctggcgcgggtgaccacatactggctgaaagacgactggccaaagaacagggacagatcctggtctcccagccggtagggggtggtgccatcctcgcgtcggccgccaaaattaagcgtattaaaatcttcgcaagccgaagggtggttgcttaaacaattttcgcagtggtggcaggcggcgtagctgagcactacgtggtctcctactctgatgccgctaaccgcctcgccgacgctggcaacgatcccggcgccttcatggccgaggatcgccggcataggcaccaccccggggttgtcgcgcatcacggcgtcggtatggcagacgccggtggcgacaattttcactaatatctcgtccttccccggcggggcgacctcgacgtctttgatgacaaaaggctgctggtagcccagcgtaacggctgctttcacttgcatggcatgactcctgaatgaattccctggagagcgtggcgggacagcccgaacggctctcccctgttggccgctaacgtgaagaaagatagcggttatcggggaaaagttagcaccaggcgcgatgggaatttgcgcgaatcgtgcctaaaaaacgcgcgcggcgaggagcgatacatggggtgaatattcagcactggagaatagatttcccttgaatagtcaggggtaaaaagcggcaggcagcgtgtatgcccaggctacacgtcagaggaaatgaaaaaaacagtctgttcctctggacagggcttttttaccttttttctgctggcaacaattggattattaatcgtttttgtctagagtgggcggaaattatcacgcagcgtgatgacgcgttgcgaatcaattcacccgtgcagaaggacgctttctcaggcatgaaccgcagacgttttcttaaatcttccatggctgttgccgccgtatgcggaacgtcaggagtcgcttccttattcagtcaggccgcttttgccgaagacgcgggcattgccgacgggcaaacgcgtcgttttgattatgctgttctgcaggcgatggctcacgatctggcgcgccagccgtggggcggcgccccgcgcgatctgccgccgacgctcgccaatctcaccccgcaggcctataacagcatccagtacgatgccaaccactcgctgtggaacaatattgaagagcgtaagctggacatccagtttttccacgtcgggatggggttccgtcgccgcgtgcggatgttctctttagacgccagcacccagcaggcgcgcgagatccacttccgtccggagctgtttaagtacaatgacgccggtgtggatacccgtcagctggaaggacagtctgacctcggcttcgccgggttccgggtgtttaaagcgccggagctggcgcgccgcgatatcgtggcgttcctcggcgccagctacttccgcgcggtagacagcacctatcagtatggcctgtcggcccgcggtctggcggtggatacctttaccgataccccggaagagtttcccgactttacgtcgttctggttcgaaacggtcaaaggggacgccacggtgtttaccgtttacgcgctgctggacagcccgagcatcactggcgcctacaagttcaccatccactgccaggatacccaggttatcatggacgtggaaaaccacctgtacgcccgcaaggatatcaaacagctgggtatcgcgccgatgaccagtatgttcagctgcggcaataatgagcggcggatgtgcgacaccatccatccgcaaatccacgactccgatcggctgtcaatgtggttgggcaacggggaatgggtctgccggccgctgaataacccgcagaagctgcagttcaatgccttccaggacaagaacccgcgcggctttggtctgttgcagctggaccgtgatttctcccactaccaggatgtgatgggctggtataacaagcgtcccagcctgtgggttgagccgcgtaaccagtggggcaaaggggcggtcagcctgatggagatcccaactaccggcgaaacgctggataatatcgtctgcttctggcagccggaaaaggcggtgaaggcgggcgacgaactggacttccgctaccgtctttactggagcgcgcagccgccggtgagcactccgctggcgcgcgttctggccacccgcaccgggatggggggcttccccgagggatgggcgccgggtgaacactacccggataagtgggcgcgtcgttttgccatcgactttgtcggcggcgatttgaaggcggccgcgccgcgcggtattgaaccggtgatcaccctctccagcggggaagcgaagcagattgagatcctctacgtcgagccgttcgatggctaccggatccttttcgactggtatccgaccaccgactcaaccgacccggtggagatgcgtctgttcctgcgctgtcagggagaagccatcagcgaaacctggctctatcagtatttcccgccggcagcagataaacgcaactacgttgacgaccggatcatgaaataaccctgagtcacccgacgcccgcaggcagtccctgcgggccagaagagagcgctatgaccgcagatatcccagcagtacctgagtcgatcccggtaaccgacgcgctgacgctaatcgccattgatgagcgctacgttagcgacctgcaccagctggtggtcaaaaaccagcgctggctacagcagtcgctcagttggcccgccgaggtgcgcagcgaagacgagacccgccgccatgtgcagggcaacgtgatgctgcatcagcgggattacgccaaaatgtttttgctgtttctcgataagcagctagtcggcgtcctgtcgttcaatcagatcgagccgcagaataaaacggcctatattggctactggatcgatgaagagcaccaggggcaagggctgctttcccgttcattacaggcctttatccgccattatgccgccagcgggctggtgcgccggtttgtgatcaaatgccgggtggcgaacacccgcagcaaccaggtagcgttgcgcaacgggtttgttctggaaggctgtctccgacaagccgagtatctgaacggtagctatgacgatcagaatatctacgcccgcattattgaccgcgatgaggcattaaagcgcgcctaacagcggcgtgcgggtgatgtgctgctggccgtcaagcgttttcgggccgcgcagatgaatggcctctccctcctgtgcggcaatctgcacctcgtcattgatggagacctggtgctcaacgatcacatcgccgatgatgactgtccgcccctggatcagcacatcgtcgtcgagcagaatcggaccacctcgcagctgcgcctcgccgccgaccatcgcccgatgcttcagcaggcagttgccttcaatcaccgcattctctgccacctgcgaactgtagcgcacggtgggaatggcatcctctccacgaccggcgatcagacgcgcgtgcccgtatacccgggcgttatcgcatacccagacgtcgttttcttcgttcccttcaagtcttgcctggtcaaacacttccgcccgatgttcgacaaacgcatgctcaacgaaggcatcgccgtagatttgcgcctggtggagaatgcgcgaggcgctgacggtggctcgctgatagatctgcaggactttgtcgcgatcggcggttaacccgcgcgcggcaatcacctggcagtgggggagaagacgcgcctcgtcggcaaggcgacaataaccgcgcacctggctctgcgtaaccgtgacgttgtcactgatctgcgcgtgatggctgatctgcgaggcgtgaatgcaggcctgtccgccgatggtggcctcatggctgaccacgcagaacccggttaagcgggcgtcgtcacggatgcgcgccccggcgaagaccacgctgttgacatcgtagatccagcactccccctgctggctgagagcgcattcctcatccacccagccgccttcgctgcccgctttaacgtcagcgaaatcaataagcgccacgatctggcgcagggtgacgctttgtttgccatgctcttcctcataacaatactgccgggtctgttcgctgagacggtatttacgcatggccgatccttattacttatggttaacataaacatagcaaagatcgccatagcgcgcgggataaggttcctttagaatgcaacttcaaattaaattgatatcatcaataaaatgaataaaacgcaaacgccgcggcaggtgctaaacctgccggcgggttattttggcatggtgctcggcaccatcggaatgggcttcgcctggcgttacgccagcaccctctggccggtcagccgcagcattggtgatgggctggtgacgctggcgatggcgatgtgggtcctgctcagcatggcgtttatcagccgggcgatccgctttccggcgagcgtgctgcgggagatgcgtcatccggtgagcagcagcttcgtcagcctgtttccggccaccacgctgttggtggcgattggtttggctccctggtgctggccgctggcgatcgggctgtttgtgccgggcgtggcgctgcagctcgcctatgccgcctggcaaagcggtgggctatggcgggggaaccatcctcgcgaggccaccacgccggggttgtatctgccgacagtagccaataattttatcagcgcgatggcctgcggcgcgctgggattttccgatgccggactggtgttcctcggcgccggggtcttctcctggctgagcctcgagccggcgatcctccagcgtctgcgcagcgcaggcgagctgccgacgccgctgcgcacctcgctggggatccagctggcgcctgcgctggtggcctgcagcgcctggctcagcgtcaacggcggggaggccgataccttcgctaagctgctgtttggttacggcctgctgcagctactgtttatgctccgtctgatgccctggtatcttcgtcagccgttcaatgcttctttctggagcttctcgttcggcatttccgcgctggccaccaccggtctgcatctcggccaggccaggggagacggcttttttcatcatctggcgatgccgctatttatttttagcaatctggttgtcggcctgctgctgctgcgtacagcgttgctgttggtcagcggaaaactgttgctccaggtcgaccgggaaacactcctgaataagaaggaaggatcatgacaatgcgtgacgcggattattttagtcaaaaatacagcctgacccgcacccattccgaggtgctgcatgccgcgacgattgtgccgccggggcgggcgctggatctgggctgcggcaacgggcgtaacagcctttatctggcggcgaacggcttcgcggtgacggcgtgggataaaaatccgatgagcgtcaacaatctggaaagtattcgcgctgccgagcgactggataatctgcaaacggcggtgaaagacctcaacagcctgagctttgacggcgagtatgacctgatcctctccaccgtagtgatgatgttcctcgagcctgacaccatcccgggcctgatcgccaatatgcagcgctgcaccgccgccggcggctataacctgattgtggcggcgatggataccgaagactatccctgcaccgtcggcttcccgtttgcctttaaacctgatgagcttcgtgattattaccagggctgggagctgctgaaatacaatgaggacgtcggcgagctgcatcgcaccgacgccaacggcaatcgcatcaaattgcgcttcgccaccctgttggcgcgcaagcctgcctgattcgccgcggcgtgggaagctgagcatggcccgcgccgcattccccgccagagcctgggcaagacagagacccgttgcggcgaaaatgagcctggaaaaccgcgcgataccccttttaagtgattatttattaacgtaatgttcaggcaatcaatatttataaatcttccttgacgaagccctttttttgtcacaaaactagtgggtcctatttgctataacgtctgccgaaaaaaactgcatttacagggatctctctatgcgtactcgcgttttactgaaagtcgccgctctggcgggaatattggcgttgaccggctgtgcggcgaaagtggcgcaaccggatcagtattcgggcttcttaaaagattattccagtttgaaagaaacgacctctgcctccggcaagccggagctgcgctggatcgatccgaacttcaatccggccaactatgacaatattgtttatcacccggtgacctactatccggtaccgaagccgaccacccaggtaggggagaaggcgctgcaggatattcttaactacaccaacaaagagctgaaacaggctatttccgagcgtaaaccgctggccactaccgccggcaagcgcagcctcatcttccgcggggcgatcaccggggtggactccagcaaagaggggctgcagttctatgaagtgatcccggttgctatgattgtcgccggcacccaggccgccaccggccatcgtaccatggacaccgatctgtactttgaggcggaggtcattgacgccagcaccaataagccggtcatcaaggtcgtacgtaaaggggaaggcaaaaccctggcgaatgagaatacaccgctgaccgtcgataccctgaagcaggttatcgatgatatggcggtcgacgccgttaaattcgatccctctcagcgttaatcgtgccagcgccgtctgacgacggcgctgtttttcttcagcctcctcaggccagccttcggcgcagcaatagctgttccggtttggcaaacatcaccatgttacccagcaggattagcgccagcccgatcacggcgctgctgtgccagacatacccttcatagacggtggaaatggataaggcgaccagcggaaacagcagcgtactgtaggcggctttgctggcgccgatgcgccccacgagagtgaaataggcgccaaaggcgatgaccgagccgaacagcgccaggtaaagcagggcgcccagatagctgacggtccattctggcataaaattatcgccgcgcagcagagcgatcgcccccatcaccagcgtgccgtagagcatcgcccagctgttggtggtcagcgtttccagcccgcggcgctggtggcgaatactgaacatattgccgagcgaaaaaccgtaggtacccagggcgctcagcccgatcccccacagcagcgaggcgttcagtccgttggccagcaggtcgtcccagaacaggatgacgataccggcgagacccagcgcggcggcggcccagaagcggcccggcggctgctggcggaaaaagagaaagctgttgatggcgtgaaacagtaccgccatcgaaaagatcaccgattccagaccggtattgatccaggcggcggcggtataaaaacaccagaaattaaagcagaagacgcagcagccctgcagcaggcagcagagatgatctttcgcgcccagcggccgcaggcgtcgtgtgacgagcagaatcgccagcatcgtgacgctggctacggcgaaacgccagaaaatcgataccggcgcggccaccggtccctgttgtaaaaaaatcgcgatccacgttgtaccccagatcacgacaacgagtgcatagagtaatgcgttcaccctggttctcctctacctgttaatgggaggagtatgccggctgccgcctgctgcggctttcaccggtttgttgtcggcttgcaaattcttgcgcttatttgccatccgctggcggtgaggactggaaaccgcgccggagtctccctagactagggcttttacagacaatgtgtgaagacgatgggttacgggacatttgaaacattacggcgacagaacgcggtgctgaagggaaccgtggagctgaattccggtattcaactggccgcctggtataacaattgcgataccgtgacggtgcgcagcgaccatcataccttaagtctgtacgtggctgatggctacgaaagctatcaaaagacgccgcacggctggaaaaatggcggcggcccggaccgtttttgtctgatgccgaaaggcgatgaaagcgtatgggatatccgcggcgatctgtcgtttgtgcatctttactgtaccgatgcgcacctgcgtcgcgtcggcgaggaggtgtgggaccgcagcccggcgaacttcaccctgcaggaaaagaccttcgccagcgatgataaaatcaccgcggtatatcgtcagtttttgctggctaacgactggcggcagccggcgaaccagctgaccctcagcgccgccagcagcttgctgcttacccatctgatccagcactattccaccgtgcagtggcgtttgccgacggtcaccggcgggctggcgccaggcgtaaagcgtcacgtactggcctggatcgatgctcatctcgatcagcccttgaccctggccgacctggcgcagcaggcgggtctgagtgagtttcattttgctcgtatgtttcgtcagtcgctaaatatggctccgcatcagtacgtcatgcagcagcgaatggcgaaggcgcaaaacctgatctgccatagcgcgctgccgttaaccgagatagcgctggcctgtggttttagctcccccagccatttcagccatcgggtcaaagccgccaccggcctgacgccctcccagctacgggcggcgcaacgcggatagcacgccgtaactcaccccgccgagcaccacgccccagaaggcggagccaattcccgccagcgtcaccccgctggcggtgaccaggaaggttaacaccgccgcatcgcgttcactggcctgatgcactgcctgaaacagactcccgccgatggtgccgagcagcgccagacccgccagcatctggatccacgccggcggcagggccgacatcagggcggtgattgacccgccgaacagaccggccagcagataaaaaccgcccgcggctatggccgccagccagcgctggttcggatccgggtgcgcctccgggctctggcatatggcggcggtgatcgccgcgatgcagatggaataaaccccaaacggcgccagcagtagtgccaaccccccgcaaacgacgatcagtgcggagaccggtacggtatagcctgatgcctgcagggtggcgaaccccggagcgttctgcgaggccatggtgacgaggaagaacggcagaccgacgctgagcaaaagcgccggagtaaactgcggggcgacccattccggcgtcacaaatgccagcggcacgggggcgctagccacatccccggacgccgccgcaatcagcgctccaatcaccagcgcggccaccacggcgaagcggggccacagcgctttacacagcagccaggcggcgagcatcccgccgcacagcggcagatgatcctgtaagccggcgaaggcctgcaaaccaaaccgtagcaggatcccagccagcatcgcggcggccagcgaatggggaatgatctgcatcagccgggcaaacaggccggtggcgccgcagataacgatcagcgcgttggcgaaaataaagatccccacggcctcggcgagggtcaccccctgcaggccgctaactaacagcgcagcgcccggcgttgaccaggcggtgagcacaggaactttccgccaggcgctcagcgctagagtgctgatgcccatggcgaggccaagagccgtcatccagccggcgatctgcccgggggtagcgccggccgcggcggcggcctgccagatgatggcggaggagctggcgtaccccaccaacacggcgacgaagccagcaaacagagtgggaagcggaagactaaacgagcgcatcgatgattctcatgtgcgttataacatccattcactgtatcattgtgcgttataacgcacaagtggtggttcgcgcagctaccctgggagaaaaactcgccgccagcggcgtacgatgccgttaaacgtcctgaaaaaatcagacaaatggcggtatactttgcgcagtaaaaacaggaggaaggatgaatattgcgcaacatctggcggcaacgcttaaaaccctgcgccagcagcgaggctggagcctgtcgcgactggcggaagagaccggggtgtcgaaagccatgctcgggcagattgagcggaatgaatcaagtccaacggtggcgacgctgtggaagattgccaccgggctgaacgtaccgttttcggcgttcatcgtcccggacgccagcgccgcgccctccgcgtttgatccgcagcagcaggcgatggtggtgacgccagtattcccgtgggatcccgagctgcgctttgaccatttttcgataacccttgcccccggcgcgctgagcgaatcaacgccgcatgagaaaggggtgattgagcatgtggtagtgataagtggtacgctggatttgtgcttacaaggggagtggcactcgctgcaggcgggtgagggtaggcgtttcgccggcgacgcgacgcatgcgtatcgtaaccgcggcgcccaggcggcccatttccattctcttatccattatccaaaagaaaaaaccgcgagcgaacccgcggccagacaagatgactgatgataaccactcacaacgtgacgaggaaaatccggaatacgtgatgacagtactcttcgccgtgatttgagggaaatatcttttccgtcaatactttgttgaaaagtgaaaattcgtcgtcgcgcgaaggcggaaaaggttttcgtctgcgcccggttctgactacaatagccgccatttcgacccccttatactggataacaacacgcgtatgcgcctgcacaatcatcgtcttgaacttcttagtcctgcccgcgacgccggtatcgctcgcgaagcgatccttcacggcgccgatgccgtttacatcggtggacctggctttggcgcccgccacaacgccagcaacagtctgagcgatatcgccgggctggtgcctttcgctcatcgctttggcgcaaaggtatttgtgacgctgaacaccattctgcatgacgatgaactggagccggcgcagcggctgattaccgatctctacgacgcaggcgtcgatgcgcttatcgtgcaggatatggggatcatggagctggatctgccgccgattgagctgcacgccagcacccagtgcgatattcgcagtgtggaaaaagcgaagtttctctccgacgccggcttcagtcagatcgtgctggcgcgcgaactgaacctcagtcaaatcaaagccatttacgaccacactgacgccactatcgaattctttatccatggcgcgctgtgcgtggcctattccgggcagtgttacatttcgcacgcccagaccggacgcagcgccaaccgcggcgactgctcgcaggcttgccgcttgccgtataccctgaaggacgatcaggggcgggtggtggcctatgagaaacatctcctgtcgatgaaggataacgatcagaccgccaacctggcggcgctgatcgacgctggcgtacgctccttcaaaattgaaggccgttacaaagacatgagttatgtgaaaaacatcactgcgcactaccgtcaaatgctggatgccattatcgaagatcgcggcgacctggcgcgcgcctcggctggacgcaccgagcatttctttatcccgtccacggataaaaccttccaccggggcagcactgactactttgttaatgcccgcaaaggcgatatcggcgcctttgattcgccgaaatttatcggcctgccggtgggtgaagttctgaaggtaggcaaagaccacctcgacgttgaagtcagtgaaccgttaaccaacggcgatggtctcaacgtgatgattaagcgcgaagtggtgggcttccgtgctaataccgtggaaaaaaccggcgaaaaccgttatcgggtatggccgaacgagatgccagcggatctgcataaagtgcgcccccatcagccgctcaaccgcaacctcgatcataactggcaacaggcgctgctaaagacctccagcgaacgccgcatcgcggtagacgtgacgttgagcggctggcaggagcagctggttctcaccatgacctgtgaagatggcgttagcgtgacccacacccttgacggggagttcgccgaagctaaccaggcggagaaagcgctggccaacctgcgtgacggtgtcacaaaactggggcaaaccatctactatgcgcgcgatgttcaggttagtctgccgccgctgtttgtgcccaacagcctgctcaaccagctgcgtcgggaaactgcggagatgctggatgaagcgcgcctcaacgcctggcagcgcggcacccgcaagccggtctccgtaccgccgccggtctacccggagacccatctctccttcctcgccaacgtctataaccacaaggcgcgggcgttctaccagcgctatggcgtacagctgatcgacgccgcctatgaagcgcacgaagagaagggcgatgtgccggtgatgatcactaagcattgtctgcggttcgccttcaacctctgcccgaagcaggcgaaaggctccatcaagagctggaaggccacgccgatgcagctgatccatggcgatgaggtcctgaccctgaagtttgactgccgtccgtgcgaaatgcacgtggtcggcaagatcaaaaaccatatccttaaaatgccgcacccgggcagcattgtggcctccgtcagcccggacgatctgatgaagacgctgccgaagcgcaaaggggcctgattcgagtcgatgctattggcaggatgcccgcggtttacggtcgtcctgccagcggtgatgttcgcgcaggtctgcggcggcctcctcgtgctggctgcgaagctcatcgctatccgcttcgtgcagcagctgctgttcgagactttgcaccggaaagtactcgtgtccctgacgatgggccaacagatgcccggaaaataatgcgcacagcaacagcagggcgcttatgcttctctttaacataccttttctcgacggaacaatggcgtggacatactatgtcaggcgcaatgcaggctttttttcgggcatctcaaagaacggcaagagtttgtcaacgatggctgacgaaggatgaaaaaaggcctgacgcggaaggccaggccagagtgttacgctttcggcggcagcggtttcccgctgtgctcgctcccttttggcggctgcttgccgttgtgctgcggctgtttaccgtcgtgctgcggctgtttgccgtctcgttgtgactgtttgccgtctcgttgtggctgtttgctgttgtattgcgcttgcttgccatcgtgttggccgtttttcaccggcggtttaccctgatgctgcgcgcctttttccggcggcggcggcgggttgtcggcagcgaaagcccatgacgacattcccagcgtcattacggcggagagtatagctaacttcttcatagcaatatcctttcttcagatgtatcgccgtatttcatcaggcaaaagtgaagataagatggagaagtcccttttcggacctctctgcatccaccctcagacttttagccctgcggcggtcatcagcaggcgaaacagcaggcttatggcggccagcgtcagtacgctacctccccagagcgcgatcagccacagcagacgtttaggccaggcagtatgcatcagtgatatccctccccaggctgaactttgccgcggaacacgtaatagctccagcaggtgtagccaagaatgaccggaataatcagcagggcgcccaccagcataaagccctggctttgcgggggagcggcagcctgccacaacgtgatggccggcgggataatatgcggccagatgctgatccccagtccgctgaagccgagaaagaccaggcccagcgtcagcgtgaagggcgaaacatggcggtcgcgctgatgcagcgtgcgccacagccagccgctaacgaggatcaccagcagcggtaccggcagcaggaaatagagattcggcaggctgaaccagcgggcagcaatcgccgggtgcgccagcggagtccacaggctgatgacggcaaacaccgccagcagggcacccagcaactgccgcgatgcgctgcgcattctctgctgcagcgcaccttcacttttcatcaccagccaggtggcgccgagcagcgcataggccacgcacagtccgagtccgcagaacaggctgaacggggtcagccagtcaaacatgccgccactgaaggcgcgaccgctgacggtgaaaccgttgatcaccgccccgaccaccacgccctggctgaaggttgccagcagggagccgccaaaaaaggcgcgatcccagaatggccggtgcgacggcgtggcctggaagcgaaactcaaaggcgacgccgcgaaaaatcaggccgatcagcatcagggtcagggggatcgacagggcgtcgatgatcaccgcgtaggcgaggggaaaggcgccaaacaggccggcgccgccgagcaccagccaggtttcattgccatcccataccggcgcgacgctgttgaccattacgtcgcgatccccgccgccccgcaccgtgctgaacagcaggccgatgcccagatcaaagccatccatgacgatgtacatcagcgtggcaaagacgataatcacgaaccagatcaccgataattcgatacccattagcgggactccttctgcagataaccttcagtggcggcggacagcgggcgggctggcgtaccggttgtcgccgggagcatctcctgcggccccttgcggatcaggcgcagcatatagctgtagccgacgccgaagacggcgctgtacactacgataaaggtcaataaactgaccgacatatgcagatcgccatgagcggaaacggcatcggcggtgcgctgaacgccatacaccacccagggttggcggcccacctcggtggtcacccagccggcgagaatagcgatcaggccggatggccccatccacagggcaaaacgcagaaacggccgcgagtggtatagccggtcgccgcgacgcagccacagggccagcacgcccagcagcagcatcaacatgcccagcccggccatcaggcgaaatgaccagaacaccacagtagaattcgggcgctcctcaggagcgaactctttcaacgccggcacctgtttatcaagactgtgggtgaggatcagactgcccagggccggtatctcaagcccgtagcgggtgcgctgctggtccatatcgggccagccaaacagcagcaacggcgttggctcacccggcggattttcccagtgcccctcaatggcggcgattttcgccggctggtgcttcagggtattcaggccatgcatatcgccgatcagcgcctggacgggggcgaccagcagcgtcatccatagcgccattgagaacatcttacggatcgccggcgactgattgccgcgtagcagatgccaggccgccgaggcgccgacaaacagcgcgctactgagaaacgccgctactgtcatatgcaataatcggtaggggaacgacggattaaagatcaccgccagccagtcgacgggcacgacctggccatcaacgatctcaaacccctgcggggtctgcatccagctgttagaggcgaggatccagaaggtggagatgatagtacccagcgccaccatgcaggtggcgaaaaagtgtagccccggccccacgcggttccagccgaaaagcatcaccccgaggaagcccgcttccagaaaaaatgccgtcaggacttcataggtcagcagagggccggttatgctgcctgcaaactgtgagaaaccgctccagttggtgccgaactggtaggccatcaccagcccggaaacgacccccataccgaagttgacggcgaaaatcttcgaccagaaatggtacagcgagcgccagacgggattttttgtttttagccataagccttcgagcaccgccagatagctggccagtccgatggtaatggcggggaagataatatgaaatgagaccgtaaaagcgaattgaactcgcgccagatggaatgcatcaagaccgaacatgcaggactccacaacaaaattgattcagcgcaattttaggtggggtgacgactgaggggcagaggcagtcacgccattttttatcataacagttggccgctgttatgatttttcagctgttgccagggcgagaaaatatccttgcgcaaccttgattaatccctgcggaaggtgattaggcgtctattccgctgtctgtcatattattgctaacggctggctacgcggccctgccgccggtatggcgtagtcacctggtcggcataatatatccttaccacccgccgtagctcatattttggcttacgaaatccgccacggatttttactctgatttattgtcactcattagcatgagaataagtaaaaacgctgagccggttaatcgtaaattaaataataataaattgtcggctccgcggctaatttgtactgtatgagctcgggaataaataaaagggaatgccaatgtctgaaaaaggattacagagtctgtgcattacgcttggcgtaatgattatcttctggtttgttttaatctcgctattctgggtggtgatattttaaacccatcccgtgctatcacggcgacgcggccgccgctgcagatataacagttacaggaaactatgatttttttataactgatatatgataatgggacgttatcgtacggggacggccgcaatgaaaaagtatcaacagttggcgcagcaactgaccgagcagatcgcccttggcgtctggttgcctggcgatcggctgccgtcgctgcgcgagcaggtgatcagcagcggcatgagctttatgaccgtcagccatgcctatcagctgctggaaagccaggggcgcatcgtcgcccgtccgcagtcgggttattatgttgccccccagccggtgaagctccgccagccggcgccgcctgcccaggtcactcgcgatgaagccgtcgatatcaatacctatatctttgaggtgctccaggccagccgccaggcgtcgatgctgccctttgcctcggcctttccggacccgcgtctcttcccgctgcagcagctcaaccgctcgctggcgcaggtgagtaaaaccgccaccgccatgagcgtcattgagaatctgccgccgggtaatgcagaacttcggcatgccattgcccgtcgctatgccctgcaggggatgaacgtctcgccggacgagatcgtcatcaccgccggggcgctggaggcgcttaacctcagcctgcaggcggtgaccgagccgggagactgggtggtggtggaaaacccctgcttctacggcgccctgcaggcgctggagaggctgcgtttgaaagcattgtcggtggccactgacgtcagggaaggcattgatctgacggcgctggaggcggccctgcaaaactatccggtgaaggcctgctggctgatgaccaacggccagaatccgctcggcttcaccctcagcgctgaaaaaaaagcggcgctggtggcgctgctggcgcgctataacgtgatgttgatcgaagatgatgtctacagcgagctctattttggccgcgaaaagccgttaccggcgaagttctgggatcgccaggagatgacgctgcactgcagctcgttctcaaaatgtctggtacccggctttcgtatcggctgggtggcggccggcaaacaggcgcggcggatccagcagctccagctgatgagtacgctttccaccagttcgccgatgcagttagccctggtggattacctgtccaccaagcgctatgacgcccacctgcgccgtctacgtcgtcagctggcggagcgtaaacagcaggcctggcaggcgctgctgcgccatctgccgccggaggtcatcgtccaccacagcgacagcggctactttctgtggatcgaactaccggaaggggccgacgctagcgcacttagcgcccgggcgctggcgtcgcacatcagcattgccccagggaaaatgttctccacctccgacagctggacctcgtttttccgttttaataccgcctggggctggggggaacgcgaagagcagggggtgaagcgcctgggggagcttattcgcgaacagcttgcctgaccctgtcgtttatttttctcatcataaacattctgcgaaaataagcgaaagaggatttttatcgaggccggtcattattttaccggcgctcaccataggaaatatgcatacccctcctcattccctaactcgttgtctataatccataaagtcctgcttgtgttggcgatttttacgtaatgcgtcccgggtcacaacctgaataaattcccctgggggcgttaatccgctgactacccttatttcaggagatatttttacggcacggctgccgctaattcctttgtgacaggagtaacacctgatgagcaaaaaaattgcccgttgcagcctttatgtgctgggtatggcttgtttgaccgttcaggcggcagagccgctcacctcgctggataaaccggaagggcggctcgatattattgcctggccgggatatatcgaacgcggtcagaccgacaaacagtacgactgggtgagtcagttcgaaaaggacaccggttgccaggttaatgtcaaaaccgctgccacctctgacgagatggtcagtctgatggccaaaggcggctacgatctggtcaccgcctcgggtgatgcttcgctgcgcctgatcatgggcaaacgcgtgcagccgatcaacacggcgctgattgccggctggggctcccttgatccgcgtattgcgaagggggcgtggtttaacgtcggcggtaaagtctatggcacgccgtatcagtgggggccgaacctgctgatgtacaacacccgcgtattcccgacgccgccggacagctggcgcgtggtgttcgtcaagcaggatctaccggatggtaaaaccaaccaggggcgggtgcaggcctatgatggcccgatctatatcgccgacgccgcgctgtttgtcaaagccacccagccgcagctggggatcgaagacccctatcaactgaccgaaacccagtacaacgcggtgctgaaagtcctgcgcgaccagcaaccgctgatccatcgctactggcatgacgccaccgtacagatgaacgacttcaaaaacgaaggggtagccgcctccagttcgtggccctatcaagccaacggcctgaaggcggaaggccagccggtcgccaccgtgttcccgaaggagggggtaaccggctgggcggataccaccatgctgcacagcgaggcgaagcacccggtctgcgcctataaatggatgaactggtcgctcacgccgaaggtgcagggcgatgtggcggcctggttcggttcgctgccggtggtgcctgagggctgtaaagccagcgcgctgctcggtgataaaggctgtgagaccaacgggtatgagcagtttaaccgcattcacttctggaaaacgccggttgcggaaggcgggaaatacgtgccctatagccgctggactcaggactatattgcgataatgggcggccgctaaggatcggaggcaaacaatgacgtacgcggtcgagtttcagaatgtatcgcgcctgtatggcgatgtgcgggcggtggatggggttagcattggcatacgcgatggagaatttttctcgatgctgggtccgtccggctcgggtaaaaccacctgcctgcggctgattgccggttttgagcagctctccggcggaaccatccatatctttggtcaaccggccagcgaactgccgccctggcagcgggatgtgaataccgtgttccaggactacgcgctatttccccacatgtcgatccttgacaacgtcgcctacggcctgatggtcaaaggcatggcgaagaaagcgcgccatgcccgcgcccaggaggcgctggagaaggtggcccttggctttgctcatcatcgcaagccctcccagctctccggcggccagcggcagcgggtcgcgattgcccgggcgctggtgaaccagccgcgggtgctgctgctcgatgagccgctgggcgccctggatttgaaactacgcgagcagatgcaggtggagctgaaaaagctgcagcagtcgctggggatcaccttcatcttcgtgacccacgaccagagcgaagcgctgtcgatgtcggatcgcgtggcggtgtttaacaacgggcgcattgagcaggtggatgccccgcaggatctctatctgcaccccaggaccgcgtttgtggccggttttgtcggcaccgccaacgtttttgcagccgaggcggcccgacgattgtgcgggatggcgggcagctggtcgctgcgtccggagcatgttcgcctgcagggcggcggcgaggtgcaggtgcagggcgtggtgcaggcggtgcagtatcagggggcggcgacgcggatcgagctccgcctcgcggatggcgacaaactgctggtcagccaggccaacatcgatggcgcggcggcggccagcgttccgcgaaccgggcaaatagtacaggcgtcatggtcgcgctcggcgatgaccccgctggaaagcggaggctgagatgaccatggcaataactcctgcgcagaccgggcgcatatcggggatcttctggcgccgaccggcgctgggcctgtttttactgctgctcgggccgctgatgtggtttggcatcgtctatctgggatcgctgctgaccctgctgtggcagagcatttatacctttgacgacttcaccatgtcggtgaccagcgacttcacgctggctaacctgcgggcgctgttcaaccctgccaactacgacattattgtgcggaccctggtgatggcgctgtgcgtcacgctggccagcgcgctgctggcgctgccgatggcctggtatatggcgcgctataccagcggcaaaatgaaggccttcttttatatcgcggtcatgctgccaatgtgggccagctatatcgtcaaagcctatgcgtgggtgctgctgctggcgaaagatggcgtggcgcagtggttcctcggtcatcttggactggagggggcgctgaacgcgctgttgagcgtcccggcggttggcggcaataccttgtccacctccggccttggacgctttctggtgttcgtctacatctggctgccgtttatgatcctgccggtgcaggcggcgctggagcgtattccgggatcgttgctacaggcctcggccgatctgggcgcggccccgcggcagacctttcgctacgtggtgctgccgctggccattcccggcatcgccgctgggtcgatcttcaccttttcgctgacgctaggcgactttatcgtgccgcagctggtgggcccgccgggatactttatcggcaatatggtttactcgcagcagggggcgatcggcaatatgccgatggcggcggcgtttaccctggtgcctatcgtcttgattgccctctatctggcgttcgtgaaacgtctgggagccttcgatgcactctgaacgcgcgccctggtatctgcgactggcgacctggggcggggtgatattcctccactttccgctgctgattatcgccatctatgcttttaatacggaagatgcagcctttagctttccgccgcaggggctgacgctgcgctggttcagcgaggcggccgggcgcagcgacattctgcaggcagtgacactgtcacttaagatcgccgccctgtcgaccgccattgccttagtgcttggcacgctggctgcaggagccctgtggcgcagcgccttttttggcaaaaatgcggtgtcgctactgctgctgctgcctatcgccctgccggggatcattaccggcctggcactcctgacggcgttcaaagcggtcggccttgagcctggcctgctgacgatcgtggtggggcacgcgaccttctgcgtggtggtggtgtttaacaacgtcatcgcccgcttccgccggacttcgtggagtatggtggaagcctcgatggatttaggcgctaccggttggcagacctttcgttacgtagtgctgcccaatctggggtcggcgctgctggcggggggaatgctggcattcgctctgtcgtttgatgaaattatcgttaccacttttaccgcggggcatgaacgcaccttgccgctgtggttgctgaatcagctggggcggccgcgagatgtgcccgtcaccaacgttgtcgcgctgttggtgatgctggtaacgacgataccaatcttaggggcctggtggctcacccgcgacggcgataacgacgccggaaacgggaaataaaaccatgaaacaggataatgctatgcaacacaacctattgataaacggtaagttagtggcaggtgaaggcgagaaggttccggtatataaccctgcaaccggcgaagtgatcctggagattgccgaagcgacagcggcccaggtcgatgccgccgttgaggcggcggaccgggcattcgatgcctggagtcagacgacgccgaagacgcgtgcggaatgtctcctgaagctggcggacgccatctcggcgcaggctgaaaccctggcgcagctggagtcgctgaactgcggcaagccgctgcactgcgtgattaatgatgaaatgccggccatcgccgacgtcttccgcttcttcgccggcgccgctcgctgcctgccggggatggcggccggagagtatctcgaagggcatacctcaatgatccgccgcgatccggtgggcgtggtggcctccatcgcgccgtggaactatccgctgatgatggcggcctggaagctggccccggcgctggcggcgggcaactgcgtagtgataaaaccctcggagatcaccccgctgacggcgctgaagctggcggagctggcaaaagatatcttcccggagggggttatcaacgtgctgtttggccgcggtaaaacggtgggcgaccccttgaccgcccacgttaaagtgcgaatggtctccctgaccggatcgattgccaccggagcccatatcattggccataccgcctcgtcgattaaacgcacccacatggagctgggcggtaaggcgccagtgatcgtttttgacgatgcggacatcgatgcggtggtggatggggtgcggaccttcggtttttacaacgccggccaggactgcacggccgcctgccggatctacgcccagcagggtatctatgaccagctggtggagaaacttggggcggcggtggccagcctgaaaatgggggcgccggaggacgctgccaccgaactgggtccgctgagctcgctggcccatcttgagcgcgttagcgcggcggtggaagccgcaagggcgctgccgcacattaaagtggtcaccggcggcagtcgggctgacggcgcgggctattacttccagccgacgctgctcgccggcgcccggcaggaagacgctattgtccagcgcgaagtgtttggtccggtagtcagcgtgacgcctttcagcgatgaagcgcaggccctgagctgggcgaatgactctcagtatggcctggcctcctcggtatggacgaaagatgtcggtcgcgcccatcgtcttagcgccaggctgcagtacggctgcacctgggtcaatacccactttatgctggtcagcgaaatgccgcacggtggccagaagctgtcaggctacggcaaggacatgtcgatgtatggccttgaggattataccgtggtccgccatgtgatggttaagcatagctaaaggattgaccatttagcgccaggcgactattgcgcgatgggtgtgttaggccgctaatagtcacaatggcaaaaattgtcaaaactcaacccaggggatatgagattattctgatgccccttcaagagctaagccatcatgagtgccggagataagcgccggatggggtccgccagtcaccctgggcgcacagcgcccggcgggtggggcggcaacatcgcggttcgcgaccgaattgcggcccctgtctgtcggcaggggcttttttgtgctcgcagaagagcgaagagatgagccggccagtcgcgccggggtaacgagaataccgctttaactactttcagcgcttggtttttttgctgggcaggctggcgctgcgccggtcacgaatgtaggaaataagattatacaccgccgcgaccagcaggattagcgcgatgaccagcgtgatgattccggacatatccacctcgaaattcacagcgcgaactgcgctaaagcattaccaatggttatgaatgtaagtattatctgacgcgaaggcaaatgatatttgttgtcatttagcgctatttctggctcttatccgtgatgacggagatgaagaggttatgttacaacggcttgccatcgccatttatcttcttacgatgacggcccgcgcgatatattgcgcctgtggcgaaggcggcgatccttttccccttgccgacggcgaaatattttccttattagcgaaattaactcccctgaacagaaagtatttcacggctagagataagcttttaatatttacggttatcgcatgatatttgttctgaatattttatagccctgaggcagaggcaaataccggatgccgcccggcagcgcgccccgggtttgactttccgccgccgctcatgcgatcatttagggcatattaggttttgacgttgatgtcgctgtgaaaatttttgcttttattctgctggctatcggcgctgtggcgctgagctatggtaatgccccggcgaaacgaatccaaagctgtgagaagatgggcgtagggcaggccgtctgcgccgccgccgaatgggatagtgaaaaagtcaatgtactgccgcgctataaccccagtcttaataaggtaatagctgccgcgcagttagcccccgccgcccgacagcaagataacaactctgttgttcgcgcgtaaaaaagcagccttcggggctgcttttttaggtttcgttgctgaattaaatgattaaaaccagccaaatcttacggacagcaggctgataagcgcgaacgcggcgcagacattaatcataacgacggttttactggagacatccatagcgccaccctaatgagtaagtcctaaaggtatagtacggcgccagcggttgcgctatcagattaagacgaatcaggctttattctgaatattcagcccgtttctgattttgttatacaggtatctctgaatcacgacgtcatggcagataatcatcccaccatggaacgcccctcagggaaggaaaaagtaagaatgacgttatatcaaaaaatgttggtgttttacgccattatgggcgtgatatgcgccgtgattagctggtttttaaccaaagagagccggatgatccgcctgctggcggccctgctgatcggcgccacctggccgttcagcttcccgatggcgctgctcgtctcgctgttttaaccctcaggcgctagacggcagaaaagggtagcacaaaggatgaggttactgtataaaaaaccagtaaccttatcatggaggcatacaggtgaacggtttttattcgtccgtcgctggcgccacgctgcgctggcacgatttcccgggagatggccttccggtggtgtttatccacggccttggctgcgcgtcatcctacgattatccccgcattgccagcgatcctgcgctccgcgaacggcgcaaaatactcatcgatctgccgggcttcggctatagcgataaaccgcgcgcgtttagttacaacatacatgagcaggctttagttttggagcagttcctcagccacctgcgcctgcagcgcttcgcgctgttcgggcatagcatgggagggagcatcgccatcgaagcggcggggctactgggcgagcgggtgcccacgctgttggtctcggaacccaacctgttcgccggcggcggcgagtacagcaggcgcattgcggcgcagtcagagacagcctttgtcgctgacggctatgccaggctgctggcggaggagcgctcgccgtgggcgggttgtttacaaaacagcgccccctgggccgtctggcgggccgccagcagcctgatacgcggcagcgacacgccctggtttacccagctatgccagctgcgctgccagaaaatgctgatcgtcggagagcggtcgcttccttatgcggatagcgacctcgttcaggcacaagggatcccggtcggcatcgtgccccatgccggacactcgatggcgtgggaaaacccgcaggggctggcgcagcttatcgccagccatagttaagaggcgctgggcctcagaagggaagctcgcggggttgggtctggatcgttatccagcgcagctcggtgaattccgcgatcccggcccggccgccaaagcggccatagccggaggctttgcaaccgccaaacggcatttgcgcctcatcatgcaccgttgggccattgatatggcaaatcccggtatgcagacgttgcgctacgttccacgctctggcgctgtcgcggctgtagaccgcagcggaaagaccgtactcgctgtcgttggccaccgccagcgcctcctcttcgctatgaacgcgaataatcgctttcaccggaccgaaggactcttcacgccacaggcgcatctcgcgggtcacgccgtccagcagggtcgggctcatatgggtatcgttggctctaccaccggtcagcaggcgagcgcctttcgctaacgcatcgtcaatgagcgcgttgcagcgggcgatggtgttcatatcgacaaccgggcccgtgagggcggcaggcagggcggcggcgcgcctggccagcagcgggataaacgcctccgctacggcattgtcgacaataatgcgctcggtggacatgcagatctgcccggcgttggcgaaggcgccaaaaacagcgcccgccgccgcttgctcaatatcagcatcgtccagcaccagcaggggcgcttttccaccgagctcgagcaccgctggtttcagatactgtccgcaggtgcgggcgataatgcgccccaccggtgtggagccggtaaagttaacgcgccgcaccgccgggtgggcgatcagcgattccaccagcgccggcgcatcttcaggcgcacaggtaagatagttcaccacgcccggcgggaagcccgccgcgtcaagggcgtcgataatcagtccctgagtggcgggggaaagttcggcgcccttaaggatcaccgtgttgccacaggccagcggcgtcgccagggcccgggtggccagaatcagcggcgcgttccacggcgccatgcccagcaccactcccgccccctggcggacgcccatcgccaggttacccggcacgttggacggaattatttgcccttcaatctgggtggtcagcgccgccgcttcacgcagaatatctgccgccagatgaacgttaaatccggcccagtgcgcggtcgcgccggtctccgccgccatggcggcgataaatttcgcctcccgcaacagcatctgttccgccgcctcgagcagtaagcgacgtcgttccgccggcgcagtatcgcgccacagcggaaaggcgcaggccgcggcttcgacgcagcgtttgccgtcggcgaggctggcggcagcggccaccgaggctgcctcatcgtgggccgggtggcgtcgggtaaaggtgcggcggccttcggcatcgtgccactggccgtcaatgtacagattgcaggtgattgtcatggtggaaacctcttgttctgcggttcccccagtgtaccgggcggcactgacgggaagcgtgagccgggcggttatcgcacatttttttgcaggaattttgtgtggctcacaacatcccgaagccctctggcgtaaaaagcagcgcaacgtcgattaaaccagcaaattccacgcgttttgcataaggtgatagccattgattatttgccgccgtcaggcggctgtgctgttattactgttcttataatcaataatcaggacttataaccatgtctacagggaaaaccacgctggcgctgctgctgagcgcactgctgccggccggcgccgcctgggccgcaggcaatgacactctggtctactgctcagaagcctctccggagtccttcaatccgcagatcgccagctccggtccgtcgttcgtcgccagctcgcaggtactgtataaccgtctggtgagctttgacccggtgaaaaatacgccgatcccgtcgctggccaccgagtggcacgtctctgaggatggcaaaacctggacctttactctgcgtcagggggtgaagttcaacagcaacaaattcttcaaaccgacccgcgattttaacgccgacgacgtcctgttctccgtgctgcgccagatggatcctcagcatccttatcataaggtgtcgcaggggaactatgaatacttccacgacgtgggcctcgataagctgattaaatcggtgaaaaaggtggatgattaccatgtccagttcgagctcaacgagccgaacgcggcgtttcttgccgactggggcatggacttcgcctctattctgtcggcagagtatggtgaggcgatgctgaagaaaggaacgccggaaaacgttgataactggcctgtcggtaccgggccgtatgcgctgcagcagtataaagtggattcgcaaatccgctatattgccaatccccactactgggaaggcgaggtaccgaccaagcacttaatcttctccattacgccgaacgtcgagactcgtctggcgaaactgcagaccaacgagtgccagattattcccgcgccgtcgccggtacagttcccggtgattaagggcaataaagatctggcgctgcatgcggttgaggcgctaaacgtcggctatctggcgtttaacaccgagaaaaaaccgtttgataatgtgctggtgcgccaggcattaaactacgctaccgacaagcaggcgatcgtcaaggcggtattcctcgattccggcagcgtggcgaaatcaccgatcccgtcgacgatgctcgggtataagaaagatctcccggactatgactacgatccgcagaaagccaaagcgctgctcaagcaggctggtctggagcaaggcgcggaagtgaccctgtggtcaatgccggtccagcgcccctacaacccaaactcaaaacgcattgccgaaatgatccaaaacgactgggcgaaagtgggggtgaaagccaaaattgtcagctatgaatggggcgaataccttgccggtatgcgtaaaggggagcacgacagcgccctgtatggctggatgtcggacaacggcgatccggacaactttgctggcacattgctcagctgtgataatatccagactggctccaacgccgcccgctggtgtgataaatcctatgacgcgctggtaaagaaagcgctgttggtgagcgatccgcaggcgcgggccaaactctacgaacaggcgcaggagattttttatcagcaggcgccatggatcaccctggcgaccgggaaaaccttctatgcgacgcgcagcaacgtcagcggctacaccgtcagcatgatggggagcgatttttccaaagcgaagctgaattaagcgaaaggagaacaggatggcacatctggatgaggttatcgtcaaagtcgatgacaccctggccgagggcgttatcgcgcatatgaatgagctgctaatcgccctgagtgatgatgcgcaactcagtcgtgaggaacgctatatccaacagcagcgtctgcgcaccgccatcgcccatcatgggcgacagcatcaggaagagcaggacgcgcgccgcgagcagttgaccaaaggcggcgcgatcctctgaagatgcgctcagaactggcgtctggccaccagccaggcgcccaccaccagcatcaccgccccgcataacggtccgatcagcgcccgcaccggcacgccgtgggcgcgaactaaatccatgatcaacccgcccaccagctggctggccaccagtaccgcaatggtcgtcgccgcgccaacgttttgataaccgctgatgctggcgaagacgaaaaaggaccccagcaggccggggatcagcgtccaccatttcacgctcagggccagctcctgaaagccggcgacgccctggcgcagcagtaacatcgtcacgaagataacgatcccgaccagcgaattgagcagcatagcgataaggatcgtcgacgccgactgggtgatgcgcaccatcagagtgttctgcactaccaggccaacgccggcggcgatcaggcaggcgagagtgagcgacgcgttcatgctttgccgtccgggtcctgacgcgcatccagctgcagctgcataaaggtcagatccagccagcggccaaatttggtgcccacctgcggcatctgcccggtggtgataaagcccagcgtttcatgcagatgcagcgaagcgtgattctgcgactcgatgccggcgaccatcacatgtttattcagccgtcgcgcttcggcgatcaaggcgaccagcagcttgcggcccagccctttcccctgatgttcgggatgaacgtacaccgaatgctcaacggtatggcgaaagccgtcaaacgcccgccagtcgccaaacgaggaataaccggtaatgacgccgtcttcctcgctcaccagtaccggaaatccagccagctggcgggcttcaaaccaggcgatgcggttatcggtatccacagttttatcattccagatggcggcggtatggacgacggcatggttatagatctcggcgatcgccgcgcagtcgtctttaatggcagggcgaatggacatagcaaacctcaatttttcgtacactatagtagtacaatattattacaataatgaacgtcacgctgtcatccgttttcagcataattttaacggctaacccgggaataacgcgtctcggtggatggttgtgtaatgggggggcgcacactatagtgttacgttatgaatactatagaagacaacctcaatcagcgcatcagcgcgcgcatccgcatcgagcgcgagtcccgcggctggtcgctgaacgacctcgccgaacgggccggcgcctcgcgggcgatgatccataaaatcgagcgcggcgaaagcagcccgaccgcctcgatgctgggccgcctttccggcgccttcggcatcagtatgtcgaccctgatcgcccgcgcggaaatgcaggagggcaagctgctgcgctttgccagccagccggtatggcgcgacccgcaaagccactatctccgccgccacgtttcgccgcgcagcgatttgccgatcgatctggtgcagattgagctgccgcccggtagcgatgtgccgatgcccgccgcgtcctatgcgcttgcccgccagctaatctggctgcaacagggcgagctggtgtttgtcgaaggcaatacccgccatgagatgcaggcgggggattgtctggagcttggcccgcccaacgattgtcgctttattaatgaatccgcagagacctgcgtctatctggtggttcgccttaatcaatcgccatccggctcttaatggtaaagcacgttgcgcataaagcagctagcctcagtacagtctgctaacaagaggagtttgctatgacagatcaaccgcaacgccatcgccgctgggtactggcttcccgcccccatggtgaaccgacggcagagaatttccgcctggaagagagcgaagtgccgacgccaggcccgggtcaagtgctgctgcgtaccgtttatttatcactcgacccgtatatgcgcgggcgcatgagcgacgcgccgtcctattcgccgccggtggccattggcgcggtgatggtgggagggaccgtgagtcgcgtggtcagctcaaatcatgccgattatcaacccggcgactgggtgctgggctacagcggctggcaggattatgaactctccgacggcagcggactggtgaagctgggtgacaatccgcaacacccgtcctggtcgctgggagttctggggatgcccggcttcaccgcctacatgggtttgctggacatcggccagccaaaggcgggcgaaacgctggtggtcgccgcggcgaccgggccggttggcgccacggttggacagatcggcaaaattaagggctgccgcaccgtcggcatcgctggcggcgcggaaaaatgccgctatgcggttgagaagttaggctttgatctctgccttgaccatcgtgcggatgattttgccgaacagctggcccaggcctgcccgcagggtattgacgtttattatgaaaacgtcggcggcaaggtttttgacgcggtgctgccgctgttgaataccgcagcgcgggtacccgtctgcgggctggtgagcggctataacgccaccgggctgccggacgggccagatcgtctgccgctgctgatggcgaccatcctcaaaaagcgcatccggatgcagggctttattatcggccaggattacgggcatcggatcgccgagttccagcagcagatggggcgctgggtgcaggaggggaaaattaaatatcgcgaacagctgatcgacggtctggaccaggcgccgcaggcgctgatcggcctgttaaaaggtgagaacttcggtaaggtagtgatccgcgtcgcggcggacgactaacctggcgggcttcgacttaacaggcccctttttccgccagggtaaaggggcctggcatagaggtcaggcgtagaaggctaaccgctgggcgagcagatcgacaaaggcttcgcggtccacatccagcatcagggtggtattgggccgattaccggtcagatggtagtaatcgaccaccgtcattccctgggtatatttgccttccgtttctacgccaacccagcgttcgatcgtggtaaagatctccggcttgaggagccaggcgatggtgcagggatcgtgcagcggcgcgccgtcgaagccccacttttcatctttgtggtaggccataaagaagtcgagcagttcggcgacgatggtcgacaccgggttgccaatctggcggaatcgctcgatatcggcgggaaggatttgcgccttatgggtgacgtcaaggcccgccatcaccaccggggtcccggactgaaagaccatttccgcggcctgcggatcaacgtagatattaaactccgccgccggctgccagttgcccagccccatggcgccccccatgatcacgatgcgggcgatcttcgcgtgcagctccggatggctggcgagcagcaacgccacgttagtctgcggcccggtggccaccagggtcaccggctcctggctttcccgcagcacgctggccatcagctcgacggcggtgcagttctgcggcgcaaaggccggctcaggcaggctcgggccatccagtccgctctcgccgtgcacgttatcggcgatgatcagatcgcgcatcaacggcttccacgcgccgccggcaaccggaatgtccggccggttcagcagcgtcaacatacgcagcacgttgcgcagggtcttctccggggtctggttgcccgcggaagcggtgacggctttcacctccagctccggcgaggcgagggcgaggaccagggcgatcgcgtcatcatgtcccggatcgcaatcaatcataatcggcagtgccatagcagctccttgttggcgatgttctgtgaccagactaacgctgcgagtcggggcagacgagatggtgtgcagaatagtgtgatggagaccacgattgctgcgaggcaacgcgtatcgttacgcgaccgtccgtaaacatggtgccacgttttgcggtggcgcaagatggcgcccggcgcgacgcgatataatagaaaaattgctaatccttacggatattaatggtttgcttttcggtgggcgggttcttatccttaagaaaactcaagaggttattacgatgaaagatgtagtagataaatgcagcaccaaaggctgcgccattgatgtcgggacgatcattgataacgaggactgcgtctaccgggccgagaaggtgttcccaaaccgcgaagaagcggaatccaccgtagccgccgtgcgcgaacgtgctgccgccgcagcgccggccagtgaaccgccgcatgtcgattacaccatcgtcgccgctggcgacgcagtgaaactcgacctctccatcgccttctcctgccaggcagaaaagatcattttcgagttatccctgcgaaatctgctttaattcgctcctgtagcggaagcgcgatgctctggcgggcagacgccttccgctgatgctgcacgctgcccgcccggcgacctgagccgggtgagcgcggttagtcttgaaagacgacgtttccgccaaccatggtcatcaccacgcggctggcgccaatctcctcatgggctacggcgaagatatcgcggtccagcacctgaaaatcagcgactttgccgacctctatcgatccgcgtaccgcttctttcccttcctgataggccgcattgatggtgtacatccgcacgccgtccgccacgctaattgccagttccgggcgaataacgttgccgctggaagatgatttgcgggtgaccgctgcctgaaccattttgcgccagttcaccagcgccataatgccatctgacccgccggcgacgatgaccccaaggtcgatgatatcccgtagccctttgcagatttcccccttgatgccacagtagcgggcgcgctgttcatagtcatatgccgggccgccgggtgagggttgttcggaaagcagaatgccgtattttgccgccatcacgaaatcttgccgatcgcccattgagccgtgcagcacataatgccgtcggctctcccccggatagcgctgaatcgcctgcacgaagctgttaatcgtgacttttaccgccttatcgccgaccgcatggactgccacctgaaaaccgcgctggtgagccagcagaatcatctgctttagcgcctcaacttgtgcttcctcggtcgcctcggggccaccaaacaccgagcgtccgcgatatcccggccggtcggcgtaatcctgattcatccacgctgtgtgcgatgtgggaacgccatcgcagaacagttttatggtccgacagtccagccagtcccggtcggtgaactgggagaaatcaaagctatccagatcgcgcttcagggtggcgcaggactgaacgccccgctcggcggagtaaaaggcgatggatacccgggcggtgagttttccttcatcctgcagttcacggtaggcggcgatggcgcgatcccccgcagcgcccacctcgcgcgtgttttcccccggacccatggcgccttccgtgtagctggcatacccttcgctgttcatcaggcgctgggctgccagaaggttctctttgagggccgctacggtcagacggggcatcgtgccggatgcgagatgcagggcgggcaggtcgatgaaattgccgtccagttcgccactggccgttcgccccagatgtccgccgaggggatcaggggtgctggcgtcaagaccggagagggccagcgcccggctgttgacgatgcaggagtgaccgtcccacagggcgagcagggtgggatgatcggccgtgacgtcgtcaatatcccagcgcgtcagagagcgctgctcggccgcacactccttgattgcgtttggatccagaccgcagacacgaatccatgccccggcgggagtgcgggctgcctggtcgcgcagtctttcccgcagtactgccagggaacgcacgtcctggcagttcaggcaatgccagctgtcagcgagccagccgatatggatatgtgagtcatgtgcggcgggtaaaatgagtttgcccttaaggtcaatgacctgcgtctggggaccaatatgctgctgaatatcctggtcttcaccaacgttaataatccatccctgcttcacggcgatggcgcgcttaaaactaaaatgtgcgtccaccgtggcgaccttgccgttaatcaatacgcagtccgcataaacgacattatccatttatccctccctggctgataaaagtgccgatcaatataaatagtaaccatggtgattatgttgtggctatatgactacgaagggggtggagtgtcaagcgcgggtcgttggcgggtgtccgcctggcggtggaatagacggtaaggaaaagcgcttcgcccgccgatcgcgagaggcatcggcggggaaggggcgtgttattcgaagcgccaggcgaggttcaggccgatgccgtagttacgtcccggggcaggctcgtagtaacgtccgttagactcgttaacgatgacagacccgacgtactcccggtcgaacaggttgtcgatgcgaccgaacagatccatatccatcctgccgtagctccatttatagccagtcgtcaggccaaccaccgtccaggagggcgctttggcggtgttttcgtcattggccatgatatcgctcatatagcgaatatcgctcccggcgtaccaaccttgctccggctgatagccaaaggaggcgtagcccatattgcgcgcgatccccggaatgcgattgccattgcagctggcgtcgtcgcagacgttagtgcgataggtcgcgtccagccaggtccaggccgccttcagacgccagctctcgccaaactgctgatccagccccagctccatcccctgacggcgggtcttgccggcgtttttataactggtgcgcccgccgctgctgctgtcgaccacaatctcattatcggtattggtctggaacagggcggcggtgaacagcccattgccgatccgcgtcttgctgccgatctccaccgtgtcgttggtggagggtttcaggccgaagttgaggccgctctggttatcggagcggtaggagagttcgttaatggttggcgtctcgaagccgcggccggcggaaagatagacgttccacgcgtcggtcagggcatatttcagcgagcccgccggcagccatttgtgatagctggcatcaccgctgtcatcgccattgcctggggtgatgtagtagtcgttcgagtcgaaccataccgagctgtagcgaaccccggcatcgagcgagagtttgtcagtgagctgccactgggtctgcaggtaggggtcgacgttccacatcaggttgcgttcgttacggcgcagcgcgccctgttcgccatactgcggcgcgccgttgaccatcacaaagttttcataccctttgcgccgctcgctcatgttttcgtagtcgagaccggcggtgagcgtgacgggcaccagcagctctccgcgatgggtcagccgggtatcgatcccctggtagtgacgggtaaggtcgatcaccccgccggcatggctcggcttcagctgcggcgcgcgcgggatcgactggaactgagtggtttcacgttctccagcgtacatcataacgctgagatcgtcctgggcactgagctggcgctcatagcgcaggccggcctgggtctgtcgggtattcttgcgggtattatactggtcgccgcgcggcgactggcgcgggttatcgcgccattcatcggcggtcaggccaccggcgtcattggctttgatatccacgctattcagcagcagagtcagcttactgacgtcgttgatgcgcacccccagccgggcgttcgccagatttttgcgcgcgccgctgtgatcgcgatagccatgggtggtgaagcgattggttgagaccgtgtaatccacatcgcctgcgtggctgccgtcgccaacggcgccagtggctttcatcccgtagtgccaggtgccgaagctgccatagtagctgctggcttccacggtgggcggctgggtgccggtctggctggtgacgttgatcaccccgccggacgagttaccgtacagggcagagaaggggccgcgcagcacctcaatggtgtcaacgctgccgatatcaatatttgaggtctgcccctggccgtcgggcatggtggccggaatgccatccacatagatgcgcagtccgcgcacgccataggttgagcgcgagccaaagccgcgaatcgacagctgcagatcctgggcatagttttgccggttctgcacctgcaggcccggcacggcgcccagcgattcagagagattgacgcgcggcgcggcctggcgcatctcatccccattcaccacgctgacggcggcgggggtatccagttcagaaaccgtggttggcgcggcggtcaccaccatggtttgttcatcagcggcctgggctgcggcaatgagcggcaagagcagggccgggagggcggcgtgacgcacggacaggattttcatcgataatactcaaagacgaaccaaatggaacatatgtatatatgttacctcgtttgtaaaatatttgaaaattattaactgctgctggttaacggatagtgctcgccaagcatgaatttaccgcacaacaacaattaacgctccactttgatataaataatgattactattcgcattcaaaaataagggtaaagccaggactttaccgccggaagcgatgtcgggtcagcacatactggtttatcaaagggagtcgtcatgtcattacgtcattttgccgcgccgcgtctgcgccattcactgctcgtcacttctctgctgctggcaggcagctttagcgcccacgccgcggaagagatgctgcgcaaggccgtcggaaaaggggcctacgaaatggcctacagccagcaggagaatgcgctgtgggtcgccacatcacagagtcgttcgctggacaaaggcggggtggtttaccgtcttgaccccacaaccctcgacgtgacgcagattattcacaacgatctgaagccgttcggcgccactatcaaccatgccaccggcacgctgtggtttggcaataccgtcgacagcactgtcaccgctattgacgccaaaaccggcgccgtgaaggggcgcctggtgctggacgagcgtcagcgcagcgaaaccgtgcgtccgctgcagccgcgcgagctggcggtcaatgagcagaccaacacggtctacattaccggtctgggcaaagagagcgtgatttgggtggtagatggcgcaaccctgaagctgaaaacgaccattaccggcaccggggcaatggcgacgggtctggcgatcgatccgcaggctaagcgtctgtataccaccaacgccgatggcgaactgctgaccatcgacagcgagagcaacacgattgcgtcgcgcaaaaaattgcaggatgacggcaaagcgcatttctatcttaacctgagtctcgataccgccggccatcgtgcctttattaccgacagcaagcagccggaagtgctggtggtcgatacccgcgacggcaaggtgctggagaaaatcgccgcgccggagtcgctggcggtactgtttaacccggcgcgcaacgaagcctatgtgacgcatcgtaaggccggggaagtcagcgttatcgacggcaagagctacaaggtggtgaagacctttaaaacgccgactcaccccaacagcctggcgctctccgaggacggaaaaacgctgtacgttagcgtgaaacaggcttccagccgtgagaaagaagccaccgcgccggacgatgtgatccgcatcgccctgtaagacctcagcgcgacgaaaccggaaaacggtggtcgcgctccgcatgccgccgggccaggcccggcgactcaccctctgttacaaacgcctattggcctgacaaaccagatggttatacacttaaccctttcccgccacgtgcgggcagtggtaatcagtggagataaaatgaaaaagccattcatggtgatttgcgccggcgcgatgctggcgctgctggcaggttgttcgtcaaactacgttatgaccacgaagagcggtcaaactatcgttacccacggcaagccgcagctggataaagaaacggggatgaccagctatatcgatgagtcaggtaataagcgggaaattaacagcagcgatgtgtcgcagctggttgaagataattaagttctgacctcccggtttgcccgcgatggacaaaccgggagtcctgccagttacttcctcagcgtcggcgccgtgctgtgaatctcatgcacgcgtttacgcacaccaaaccagccagccaccagcaataccgccagcagcggaattgatcctatggtgtaggtaccgttcggataatcgaaggccatcagcaccagcacgctgaacaggaacagcagcgtcagccaggaggtgaacggcgcccccggcattctgaagctgacctttgccgctttcccttccttgatcgctttgcgcagacgcatctgacacaccacgataaagccccaggaggcaatgatccccagcgaggcgacgttgagtacgatctcaaatacctgagatggcaccagatagttgaggaaaaccccgactacatatacccccagcgtcgccaggatcccggcgtaagggacgtggtgacggctcatcttcgacataaacttcggcgcggagcctcccatcgacatcgagcgcagaatacgcccggtactgtagagacccgagttaaggctggagagggccgcggttaacaccacgatgttcatcacgctgccgatatatggcacgcccagctttgagaagaaggtaacgaacgggctctgtccggcctggtaggcgttccacggcagaagcagcaccagcaacaccaccgaaccgacatagaacagaccgatacgccagatcacgctgttgatggccttcggcaccattgtctccggatccttacactctccggccgcggtccccaccagctcgatggaggcgaaggcgaagaccaccccctgcaccagcaccagcgccggcaggaggccgtgcgggaagaagccgccgttatcggtgatcagatggaagccggtggcattgccgtccagcggcttaccggagccgaggaaaatggtgccgaccacgagaaaggcgacgatcgccagcaccttaaccagcgcgaaccagaactccatttcggcgaaccacttcacgccgatcatattcatggtgccgacgatagccagcgcgccgagggcgaagacccactgcggcacatcgccaaacgcgccccagtagtgcatatacagcgccacggcggtgatatcgacaatcccggtcatcgcccagttaacgaagtacatccagccggccacgtaagcggctttttcaccgaggaactcccttgcataagagacgaagctgccgctcgaggggcggtggaggaccagttcgccgagggcgcgaagaataaagaaggagaagatgccgcagaccagatagaccagggcgagcgctggccctgccatttgtaaacgtgccccggcaccgaggaacaaaccggtaccgatggcgccgccgatggcgatcatctgtacctgacggttgcccatcgctttgtgataacccgcttcatgtgagttaagccagtggcgttttgcagcatgatgctccgctgcattttcgtgtttcgtattcattgatgtatcagtttcctgtcaatgcccatgtttgcagccggaatggaggacggctggcacattatgctggctttctcatcattctgacgtaggagataagctcagacatggcgctgaatcctacacgtaacctaatagttacgcacctaaaacatttaccgagagcatttgacagatttatcaatgagatcagcgtcgcagagtttccagtaacagcgtgaaagcgctggtatgctggcgccggctggggtaatagagatggtagccggggaaggcgggggtccactccgccagcacccgcaccagccggccgctggctaaggcctccgccacgcagtcatccggaacgtaggccagcccaaggcccgcctccgccgcgtcgatgcgctgcggcaggctgttgaggatcagctgtccctccacccgcacctgaatctcccggtcatcgcgggcaaattcccaggcgtaaagtccccctcgtgtcggcaggcgcagattgatgcagcgatgttgggcaagatcccagggcgtttgcggcgtaccggcccgctgcagataggccggcgaacccaccaccgccatccgcatatccggggcgatgcgcacggcaatcatgtcttttgccacctgttcgccgagacgcaccccggcgtcgaagcggtcacccacgatatccgtgagcccattatcaacagtgatttcgatgttaatatcaggatattgcagcataaatggctttagcgccggccagagtaccgcgctggcggcatgctccccggcggtaatgcgcaggttgcccgccgggcgttctcgggtgtcgcgcaatgcagccagggcctgctcgatctcttccagatgcggaccgaggcgctgaatcagtcgctcgcccgcttcggtcggcaccacgctgcgggtggtgcgggtcaacagccggacatcgagccgcgtttcgagatggcgcatggcatggctgagcgccgactgcgacacgccaagctgggccgccgcgcgggtaaagctgcgttcacgcgccaccaccataaaggagagcagatcgtttacgttctcttttagcataatctttccggattgatgaatactgctcacaggtacgcagagtgtatgcccggcctgaggattgtgccagcctgatggccggacgcagtggagcagaatggttatggcggatgatttattcctctgtgcagggcaggtattgtaataggcccaaaaaacgccagcgccaggtgaaccgacattcgctggcgcggcatgaccggggggacggcagcccgaaagatgatcaagagtatcgccaggcagagtctggtaaccgggagaaacagagatgaatatcaacgtggtcggcaccagcggctcaggcaaatccactttggcccggcgcctggcgcaccggctggaattaccctggatcgagctcgatcgcctgtactggcggccgaactggcagggcgcgccggatgaggcatttttcgccgccattgccgccgcgacggccacgccgggctgggtgctggatggcaattacaatcgcagccgcagcgttaaatggcgtgcggtggatttggtgatctgggtagattatggtttctggcgcacgctgcgccaggcggtgtggcgggcgacgagccgggcgtggcggcatcaggagctgtggccgggcacgggcaaccgcgagagctttcgccgttcgttctgcagccgggaatccattatcctctggacgctgaaaacctggcggcagaatcgccgacgctatctggccgatatgcaggatccgcaatatcgtcatattcgcttcgtccgggtgcgcagtccgcggcaggctgaggcgctgctccgcgagctggaagcgcagcggccaggcgggcatatctaattttcagcagtacacatgtgaattaattgtttctcaatagttagctgagattttaataatgcaggcacgtactttcatatgagcctgcgaaatgtcttatcgaatcagtatcctggataaaagtccgcttgccgccggggaaaccgccgcgcaggcgctggcgcgtacattaacgctggcgcaacacgccgaagcctggggctaccaccgcttctgggtcgccgaacaccacaataccgatcagctggcgagcccctcgccggagctggttatcgcctggctgctgggccacacccggcgcattcgtcttgggtccggcggcgtcatgctccagcactatagcccctataaggtcgcggaaaactttaacctgctggccgccctcgcgccgggtcgcatcgatctcggcgtcggcaaagcgcctggcggactgccgctttccacccgcgccctgcagcagggcctgcatcaggaggagaaagggacctttgccgaccagctggcgcagctggataactggctgtcgctgactgagcccggtggagaggagagcctgcgcgccacgccgatcccgccgcgtcgggccgacggtttcctgctcggcgccagcctggagagtgctgaactggccgcccgtcttgactggaacttcgtgtttgcggcccatctcaatggcgacagcgcgctgcgccgcacggtgatcaaccgctggcgcgagctcagcccgcgtgaggcgattgtcgccgtgcaggtggtggtggccgacgatccggccaccgccgccgcgctggcgcagcaggtcgaggtgtggggcgtcgagctggagaacggccagcgggtgaccgtcggcagtgaggcgcaggccgtcgcctttgcccgccaggctggcagccggccgacacgcatccaccgccgcgaatcttcactgatctccggtactcccgaacaggttaaagcccggcttgacgcgctgcaggcggaagaacagttggatgaactcatcattgatacccccattagcgacgggccagcgcgcctgcactccctgcgcctgctggcgcaggctcactacggcaaggaggtgctgaatgtcctttgaacaacaactgattagctggcggcgcgagctgcaccagaacccggagctctccctgcaggaggtagccaccaccgcgcggatccgcgactggctgcagagcggcgggctgactctgctgcccttcgatctgaaaaccgggctggtcgccgaagtcggcagcggcgacaaggtgattgccctgcgggcggacatcgacgcgttgcccatcgaggaggcgaccgggctgccttaccgctcgcaaaatgaaggggtgatgcatgcctgcggccatgatattcacaccagcgtgatgctgggggcggcgctgctgctgaaggagcgggaagcggaactcccggggcgggtgcggatcctgtttcagccggcggaggaaaattttggcggcgcgaaaaccctgatccgcgccggggcgctggaggacgtgtcggcgatctttggcatgcacaatgagcccggcctgccggtgggcgaatttgccacccgcggcggcgcgttctacgccaacgtcgaccgcttcgtcttcaaagtgaccgggaagggggcgcatgccgcccgtccacatgaaggaaaggatgcgatcctgctggccagccagctggtgacggtgctgcagagcgtggccagccgggaagtgaacaccctcgactcggtggtgctcagcgtgacgcggatccagggaggcaatacctggaacgtgctgccggagagcgtcgagctggaagggacgctgcgcactcacagcagtgaagtgcagcagcgggtcaaggcccgggtcagcgagattgccgccggtttcgccagcgcctttggcgcgcagattgacgtcttctggtacgccggcccgacggcgctggtcaacgacgcccgctgggccgatttcgccagcgaggtggcagcccaggccgggtatcgcacccaccatgccgatctgcatctcggtggcgaagattttgcggtctatcttcagcatattcccggggcgttcgtcagcatcggcagcgccagcgaatatggtttgcaccatccggcatttaatccggatgaacggctgattgcgcccgcggcgcactatttcgcccgtctcgcggaagaagcgttacaacacatttaacgaatgacaggggaaggggtagctatgtctgaaaatcgacaattgcgtctgggaaccatattgcatggcgcatcgggaaatatgtccgcctggcgtcatccggcggcccaggcggacgccagtattaattttgatttcgtcacgcagacggcgctaaaagcagaagcggggaagctggattttatttttgtcgccgacggtttatatattaacgaaaaatcgattccccattttttaaatcgcttcgaacccttaacggtactttccgcgctggccgcgatcacccggcgactggggctggtggggaccttatcgacttcctacagcgagccgtttactaccgcccgccagttcgccagccttgaccatttaagccagggacgggcggggtggaacgtggtcacttccccgctggaggggtcggcgaaaaacttctcccgggcccaacatccggatcatgcgctgcgctatcgcattgccgatgaatatctgcaggtggtgaaaggcttatgggattcatgggaagaagacgcctttgtgcgcaataaggagactggccagttttttgataaaaataaactgcatacgctcgatcaccacggcgatttctttaaagtcgccgggccgctgaatattgcccgcacgccgcagggccgaccgattattttccaggccggcgcatcggacgacggcaagaaattagccgcacgccacgccgatgccatttttacccatcaggactcgctggccgaggcgcaggcattttatcgggatgtcaaaagccaactcgccgcatatcagcgcagtccggaccaactgcatattttccagggcgtcagcgtcatcgtcggggatgacgccgaggatgcggagcggcagtaccagaccaccgcggcgctggtctccatcgaggatgcgctgaattatctcgggcgctatttcgaacaccacgatttctcgcagtacccgctcgacgaacctttcccggatattggcgacctgggacaaaacagtttccgcagtacaaccgacgagattaaacgtcacgcccgcgagcggggattaaccctgcgccaggtggctctggaggcagccagcccgcgtccgcgctttaccggcaccgccagcgatgtcgctgatggcctgcaactgtggttcgagcagcatgcggcggacggcttcattattcagggtggcacgccggaaaccttcccgcgctttgtggatgaggtggttccgctgttacaggcgcgcggactgttccgtcgcgactatccgggcaccaccctgcgggaaagtctgggtctggcgctacccgctaatcaattccaaaaataataaaagagaatcacgctatgcagaaaacaacactcttgctggccgtcgcgttggcatttagcgcctcatcgtggggtcaggacgtcaagatcaatggcaccggagtgagcctggaggccaacaaaacgccgattcacacagcgaaaaatccgcaggccattgccctgttgccgcaagatctgcatctggcggtgccggggaaattcaccgtcgcggtggcggccctgaactctccgccgctgacggtctttgccgatgacaacaaaaccctgctcggcagcgaggcggatatcgcccggctggtggcggagagcctcgggctggaagtaaacgtggttcccacttcatgggaagactggccgctgggggtcacctccggcaaatatgatgccgcgatcagcaatattaccgtcaccaaagagcggaaagagaagttcgatttcgccacctaccgcaaagactcgctgggcttctacgtcaaaagcaccagtccgctgagcaagattgacaaagcggaagatatcgccgggctaaagattattgtcggctccggcaccaaccaggaggcgatcctgctggcgtggaacgcggagaacgtcaagaaggggctggagccgtttatcccggtctacaccaaggatgatgccgcccagacgctggccctgcagaccggacgagccgacgccttcttcggccccaacgtgattggcgcgtggaaggcggcgctgaccggcaaaaccaaactggtgggtagcgtcgatggcggctggccgaaagcggcgcatatcgcggtaacgctgaaaaaagacagcgggctggtgaatgccgtccaggcggcgctgaacggggctatcgccagcggggactacgccaaagtgcttaaccgctggggcgaaggggtggaaagcattccgcaatcggaaatcaatccgcccggactgggcgactgacaggaggcgcgatgagcgaagcattccgcgatatttctccggaggctccggagctgcagccgattattagcgggctgtttgccgaatatgccgcccgctacggcgactatttttcccgcgatgcggaagtggagttaagtgagtggtatgtgccaccgcaggggctgtttattgtccttgagcgtgagggcgaaattatcgccaccggcgcgtataagccgaaggatcgccacaccgcggagatcaaacgtatctggacgcaccgccgtctgcgccagcaggggctggcggcgaaggtggtccaggagctggagcgacgggcggtgctggccgggtacagccatatctacctgaccaccggtttccgtcagccggaggcggtaaagctctatctcagccaggggtatgaggcgcagtttgacctcacgagagacccggaagagtacagtcagccgacgtacgatggccggctgcggttcactaaagcgctggcggtgagcgcctacagccacagcgcctgaggaggcattatgcattcatctgaaacgatcaaagtggtgccggcgcgctatccgctgcgggtggtcggggctctggtcgccctgctggtgctggcggtggtgatccagtcggtggcctttaacccgcgctgggagtggggcgtcttcgcccgctggttcttcgacccggtgatcctcgaggggctggggcaaaccctgctcctgaccctgctcggcacggtgctaagcgtgatcttcggcggcctgctggcgctggcccgtttgtcctcatcgtggctgctcagcagtctcgcctggggctatatctggctgtttcgctcgctgccgctgattgtggtgctgatcattctctataacttttcctatctctacgacaccctgtcgctggggatcccgtttaccggcgtgacctgggccagctatcagaccattaacgtgctggggcaattctccacggcggtggtgggcctgaccctggtgcagagcgcctataccgcggagattattcgcggcggctttctcggcgtcgaccacgggcagtatgaagccgccgccgcgctggggctacccgcctggcggcgcacgctgcgcattattctgccgcaggcgctgcgcaccatcctgccatccggcttcaacgagatcatcagtctggccaagggaacggcgatggtgtatgtcctggcgatgccggaactgttctacaccatccagatgatctacaaccgtacccaggaggtgatcccgctgttgatggtcggcgccgcctggtatctggcgatcaccagcgtcctctccgccattcagtatctggtggaacggggcctggcgcgcagcgagcgccgctcggcggtaaacagcgcccgcagcagccgtctggatcaacccgcacgtcaaccacagccgcaggaggccgctcatgcccagctctcataatggccatatctctatcaccggagtcagcaaatactatggccgccacaaggcgctggacgatgtgtcgctggagatccccccgggcacggtgacggtgatcctcggcccttccggttcgggcaagtccacgctgctgcgcaccataaatcacctcgaacgggtcgatgagggatttattcagattgacggcgactatatcggctatcgccgcaaaggcgacaagctgtatgagatgaaagaaaaggaaattcttcgccagcggatcaacgtcggctacgtgttccagaactttaacctgtttccgcacctgacggtgctggagaacctgattgaggcgccgatcgcccaccagcaggtcacgcgcaaagaggccattgcccgcgcctatgagctactggacgtcgtcggactgcgcaataaagccgacgcctggtcgcggcatctctccggcggccagcagcagcgtatcgccattgcccgggcgctggcgctgaacccgcgggtgatcctgtttgatgaacccacctcggcgctggatcccgagctggtgggcgaggtgctggatgtcatcaagaagctggcgcgatcgggcaccaccctggtgg

SEQ ID NO: 65 - DNA, 139178 bp, Unknown
  source: /note="Description of Unknown: KP2-Mcoc1 Bacteria Sequence"
cactttacccggccgagtatcgttatcaaacctaacgccaatgcccggccgtgtggcgataccaccggttacctggcgaacccgaaggaggtgtgagatgggaaacggatggcatgaatggccgctgatggtctttacggtcttcggccagtgcgtcgtaggcggctttattgttctggcgctggcgctgatgacaggcaagctttcccgtgagcaggagcagcgcgtggtgggcagcatgttcggcctgtgggtattgatggggatcgggtttattgcctcgacgatgcaccttggctcgccgctgcgggcctttaattcgctgaatcgcgtgggagcctcgtcgctgagtaatgaaatagccagcggggcgatcttcttcgccgtcggcggaattggctggctgctggccgtgtgcaaaaagctgcctgccggcctgcggagcctgtggctggtggtgaccatggtgctgggcgtgattttcgtgtggatgatggtgcgggtgtacaacaccatcgacacggtgccgacctggtacaccgtttggacgccgctgagcttcttcctgacgctgtttatcggcggtccactgctgggctacctgctgctgcgcgtcgcgggcgtcgatggttgggcgctgcgcctgctgccggtggttagtttgctggcgctgctggtcagtattatggtggtcgtgatgcagggaagtgaacttgccactatccgcagctcagttcagcaggcctccgccctggtgccggattacgggttgcttatggcctggcgcgtggtgctgctggccctggccctggccctggcctgctggtgcgtgccgcagattcgcggccgcaaaccggcggtctcgctgctcggcctggcctttgttctgatactggcgggagagatgatcggccgcggcgtattctatggcctgcatatgaccgttgggatggctgtcgccagttaaccacctccatcatgccggtgcctaaccaccggcatgatgaaaacgtgctgtcgatagatgaaatttttcaactgaaattaacttcggcatttattaataaactagcaaaaacaatagcgtattatctgttgtctcacctttttccatcctctggataaaaaacttctatcgtagccgacaaaaccgcgtcacgcctgatttcaggtggattgacaatgtttttagcagtggcatgatgcgctcgcgatctgaacattcctcacggtttttacccatgaccatctacacccggccagtgcaaatgctgctctgtggcctgcttttattgaccctggcgatagcggtgctgaatacgctcgtcccgctctggctcgcccatgaaaacatgccaacctggcaggtcggcatggtggggtcatcctattttaccggcaacctggccggtacgttgctggccggctgggtgatcaagcgcctggggtttaaccgtagctattatctcgcatcgttaattttcgccgtcggctgcgtagggctggggatcaccgttggcttctggacatggctgagctggcgttttatcgccggcgtaggttgcgcgatgatctgggtggtggtggaaagcgcgctggtttgcagcggcacttcccgcagtcgcggtcgtctgctggcggcgtacatgatggtctattacgtcggtaccgtactgggccagctgatggtcagtaaattacccaccgatttaatgagcgtcctgccgtgggtgaccggcctggcgctggcggcgatcctgccgttgctgtttacccgcattatggggcaggcagaagagccgcatgaaacggtacgtatctggccgatgctgaagctacgccaggcgcgccacggggtcaatggctgtattatttcggggattgtcctcggctcgctgtatggcctgatgccgctgtggctgaaccatcagggcgtcagcgactccggcatcggcttctggatggcggtgatggtgagtgcggggatccttggccagtggccggtagggcgcctggcagaccgctacggtcgcctgctggtgctgcgggtacaggtctttgtggtcattctgggatgtctggcgatgcttagtcaggcggcaatggccccggcgctgtttgtgcttggggcatctggtttcacgctgtatccggtggcgatggcctgggcctgtgaaaaagtggagcaccatcagctggtggcgatgaatcaggcgctgctgatgagctataccatcggcagcctgctgggcccgaccctgacggcgatgctgatgcagaacttctcagacaacctgctgtttatcatgatcgccagcgtgtcgtttatctatctgctgaccctgctgcgcaaagccgggcatcatccgacgccggtggcgcacgcctgaccctgcaacgcgcagcgcatgctgcgcgtcatctgctgcaatcgcataggcttactgccgcagagaggacaagtcgtttttcatgagaatgaaacggcggggcggacacagcttcccacgccgttgcaggccggcataagcgcatcaccggcccgggcgggattagtacattactttgtgaccatactgctcaaggatgccttttacccgctccatggtctctttcttcggcggatggacgccgtccagcttgtactcttcgcccatcgctacccatttgtgtttacccagctcatggtagggcagcagctcgattttttcgacattgcccatatcgcgggtaaattcgcccaggcggtgcgcggaatcatcatcgtctgaccagccgggaaccaccacgtagcggatccagacattgatattcttcttcgccagatactgggcgaattccagcgtacgatggttagagacgccgaccaggttctggtgaatctcatcgttcatctgcttgagatccagcatcaccaggtctgttacctccagcagctcgtcgataaccggatcgtagcgacgtacgaagccgttggtatccaggcaggtgtggatgccttctttcttacacgcgcggaaccagtcgcgaacaaactccgcctgcaggatcgcctcaccgcccgaggcggtgacgccgccgccggaagcattcataaagtgacgataggtcaccacctctttcattaattcttcaacggtgatttctttgccgccgtgggtatcccaggtgtcacggttatggcagtacaggcagcgcatcaggcagccctggaaaaaggtaataaagcggatgcccgggccatcaacggtgccacaggattcaaaggagtgaatgcgaccaataactgacattgcggtgttttctccagatgtggcccatccggggccgtgttggtgcgcagctcagcggctgcgtcgagtctgttttgacaggtacccaaagtatagataactggcaaagcaggctggggcggggaatgcttgttaaaaaggccccactgatgtggggcctttattgtacgccttttcagtcagacagggaattacatggtctgagtgaaggtacgggtaataacatcctgctgctgttctttggtcagggagttaaaacgtacggcgtagccagatacgcggatggtcagctgcggatatttttccgggttttccatcgcgtcgagcagcatttcgcggttcatgacgttcacgttcaggtgctgaccaccttcgatggacgcttcgtgatggaagtaaccatccatcagacccgccaggttggtcttacgaacttcgtcgtctttacccagcgcgttcggcacgatagagaaggtataagagataccatctttcgcgtaagcaaacggcagtttagcgacggaggtcagagaggctactgcgcctttctggtcacggccgtgcatcgggttagcacctggaccgaacggcgcgccagcgcgacgaccgtctggggtgttaccggttttcttaccgtacaccacgttagaggtgatggtcagaacagactgagtcgggatagcgttgcggtaggtgtgcagtttctgaattttcttcatgaaacgttcaaccaggtcaacggccatgtcatcgacgcgagggtcgttgttaccaaactgcgggtattcgccttcgatttcgaagtcgatagccagaccgtcttcgtcacgaatcggtttaactttcgcatatttgatagcagacagggagtcagcagcaacggacagaccagcgataccacacgccatggtgcggataacgtcacggtcgtgcagcgccatcagagaggcttcgtagctgtacttgtcgtgcatgtagtggatgatgttcagcgcggtgacgtactgtttagccagccagtccatgaagtgatccatgcgatccattacttcgtcgaagttcaggacgtcgcctttgatcggttcagatttcggaccaacctgcattttcagtttttcatccacgccgccgttgatagcgtacagcatggttttcgcgaggttagcgcgagcgccgaagaactgcatttgcttaccaacaaccatcgggcttacgcagcatgcgatagcgtagtcgtcgttgttgaagtccggacgcatcaggtcatcgttctcatactgcagagaagaggtatcgatggacactttagcggcgaatttcttgaagctcagcggcagtttttcagaccacaggatagtaatgttcggctccggagacggccccatggtgtacagggtgttcaggaagcggaagctgtttttggtcaccagagtacggccgtcaacgcccataccgccgatggattccgttgcccaaatcgggtcgccggagaacagttcatcatattccggggtacgcaggaagcgaaccatacgcagtttcatgaccaggtggtcaaccatttcctgcgcgtcttgctcggtgattttacccgcctgcaggtcacgctcgatgtagatatccaggaagctggaggtacgaccgaaggacattgccgcgccgttctgagatttcacggcagccaggtaaccgaagtaggtccactgaatcgcttcctgagcggtggtcgccggaccagagatgtcatagccatatttagcggccatctctttgatctggcccagtgcgcggtgttgttcagcgatttcttcacgcagacggatggtcgcttccaggtcttcgccgctttccagtttcgcttgcagagagttgaactgggcgaatttgtctttcatcaggaagtcgataccgtacagcgcaacgcgacggtagtcaccgatgatacgaccacgaccgtaagcgtccggcagacccgtcagcacgccggatttacggcagcgcaggatgtccggggtatagacgtcgaaaacgccctggttgtgagttttacggtactctgtgaagatttttttcagcatcgggtccagctcgcgattatacgctttgcaggaaccttcaaccattttgataccaccgaacgggatgatcgcacgtttcagcggcgcttcggtctgcagaccaacgattttttccagacctttctcgatatagcccgcgtcgtgagaggtgatggtggaagccagggcagtgtcaaaatcaacaggcgcgtgagtgcggttttcctgttttacaccttccattacggtgtcccacagcttggtggtcgcttcagtcgcgccagccaggaaggattcgtcgccttcatatggggtgtagtttttctgaataaagtcacggacgttgacttcattctgccagtcacctttcgcaaaaccttcccaggctgtggctaacttttcattaagctcggacatgtaacacctaccttcttaagtggattttttatttactgcctgaaacaacccttagtgatggtcgttgccacgcaggtaaatgacccagtatgtcaacccgaccagcagacccccgccgataatgttcccgatagttaccggaatcaggttatcagtgatgaagttcataacggtcaagtgagagaaactttccggagtcgaaccgatggcggtccagaattccgggcttgcaaagttgcggattacgatacccatcgggatcataaacatgttggcgatgctgtgctcaaagccgctggcaacgaacatcgctaccggcaggaccatgatcatcgctttatccatcaggctacgaccggaatagctcatccatacggcgagacaaaccatcaggttagcgaggatacccaggctcacggcctccacaaaagtatggtgcattttgtggtcggcggtctgcagaacgtttagcccccagccgccgttggcagtcatatattcgcctgataaccacatcagcagcacaaacagcagcgcgcccaccaggttaccaaaatagacgttgagccagttttttgccagttgcccccaggtaattcgaccgctggctttggccaccacgatcagtaccgtagaggtaaagaggtcagcgccgcagataacgcacagaatcagacccagagaaaaacagatcccaccgataagtttggcaatcccataaggcatcgcggcagtgccggtggtcgcggtgatatagaatacgaaagcgatggagatgaaaacgccagcggtgatcgccagataaaacgtcttcatcggatgcttcgttgctttatagacacctgcttcttcggcgactttcgccatcgcggcagggagcaaaagatcaaaagggttgtcagctttcacactaactctctctttatataagttggcggtgagatactaacaaagcattatagaagggaaattgatatagatcatatctcaccggaactatatgcctttttagtgtgtggtttttattgaaattatccgtaagctaatgaaatatatagagaaaataatttttaaattttatagataatgttgaattttttcttttttacccccatttttgagttaattaaaatggagtatttttattaaatttaacaattgataaatgatgaaatggcgttatttaacattaattaactttacaactacaaattataggaggcgctttctcagggttaaataacggagccgctgagggctccgttgtaagcattaacgatggcgcaagctgggcttattttgcccaaaacgccgctttcgcccgctgcagtttttcataggctttcagcagcgactgatgggccgggaaggcctgcagatcgctatcgaccgcctggagaccatagaacggcgcttccccgctcagcgccgcgctggcggcttcgaccgcgtcggcgccgtacatacggatgaaggcgttcaggtactgcagcggctgacgctcttcttcctggctcagcagcagcagggtttgcagacagcgatagtagttcgcgcgctccgcgctgaagaccgaagcattaaattccatggtccactcggtccagatcagcgcctgttccagatcgccgccggccagggccagcatcgctttcagctcgccgacgcgcagggtataccagccgttgtcttttccggtggcgagccccagcagttcgcgaacgcgggtgaaatcatccagaccctcatcgtccatctgctcgatcagcgccaggtaatcttctttatcccactcgctgcccggcagggacagaatggtgtcccgcagatgagcgcccatgctgttgttcgccagccacaggtcttccgccgggtatatgtccgacatccccgggacgatgatacggcaggcgtaaacgcccaggtgctcgtagtcggcgatgtacacttctttatcttcggccttgaagatggccatcagggtggcgaactcttcttcggtagtaccagagaagctccagtcaacgaatggatagtcggcgtcctgcttgaacatatcccaggagatcaggccgctggagtcgataaagtgggtttcgaggttcgcgtgctcggcgacctcttcgtcatcgaaggttggcggcgtgaagacatcgaggtctttcaggctgcggccctgcagcagttcggtgacggttcgctccagcgccacgccaaagtccgggtgggcgccgaaggaggcgaagcaggtgccgttagccgggttaaacagcacgacgcagataaccggatatttgccgccgagcgagccatcataggcaaagatcgggaaaccttcagcttccagtttggcgatcgattccacgacgcccggatagcgcgccatgacttccgccgggatctccggcaggctgatgctttcagcgatgatgcggtttttaatgtgacgttcaaagacctctgacagaccctgtacccgcgcttcgttgcgggtgttaccggcggacatgccgttggagacgtacaggttgccgacaatattcatcggaatatagacggtttcgccgtcggactggcgggtaaaaggcagaccgcacacgccgcgctcatcgttacccgactgcagatccaccagcatactggccgttaactgatcgtcaggatcgtagaacgcgcgcaggcgggcatccagcagaccttccgggacttcatcatcctcagtcagcgggaaccacttttcgttcgggtagtgaacaaacgggccgttagcgatagtgtcgcctaaccagaagtcggcgaagaaatagttagtggacagacgttcgaaatattcgcccagcgcggaggccagggctgcctttttggtggcgcctttaccattggtaaagcacagcgcgcacgctttatcgcgaatgtgaacggaccacacgtgcggcaccgggttcagccacgaggcctcttcgatatcaaatccgaggtcgagcaatttctgctggaagcgagcgatggaatcttccagggcggcatctttgccgggaataaacgtttgggtcatggcgatcacttttgtcgtacggaaagcgcgcaatgatacggcttttatctgacaggtgctatctccatcatctggctatgcttagaggcatctttaatacacagggagatggaaaatgaaagcctttgactggcagcggatggcgctcgataaagtaccggtggaattcctggcggaggtggcgttgcgcagcctctataccttcgttctggtctttattttcctcaagattaccggacggcgcggcgtgcggcagatgtcgctgttcgaggtgctgattattttgaccctcggctcggcggcgggtgacgtggcgttttatgacgatgtgccgctgctgccggtgctggtggtcttcgttacgctggcgctactgtatcgcggcattatgtggctgatggggcatagcgaaaagctggaggatctactggaggggaaacctatcgtagtggtggaagagggacagttggcctgggagaagctgcatgcggaaaacatgaccgaattcgaattttttatggagctgcgggtcaacagcgtcgagcagcttggccaggtccggctggcaatcctcgaaaccaacgggcagatcagcgtgttttattatcccgatgaagaggtgagggccggattatcgatccttccagcgcattgtaccacacgctataccaccattccgcaagaggggatctatgcctgcgtgcgctgcagcatcgtaatggcgatgcaggcgggagaaaaacgaatatgtccgcgctgcgcaaatgcagaatggtcgaaggccagccgggcgaaacggcttacctgacagcaaatatgtcggttttattacgtcaagccgatagattctgttgtgtgacggcggccgcgttttaccgtcggcgagttttagccattgcggaccttgtcactgaatgataaaaccgatagccacaggaataacttatgcccgcggcggttcgcgggcaaaacaacatagcaacgtggtgaggggaaatggctcaggtctataacttcagttcgggcccggcaatgctgccggcggaagtactcaaactggcgcagcaggaactgtgcgactggcacggtctggggacgtcggtcatggagatcagtcaccgtggtaaggagtttatccaggtggcagaagaggcagaacaggacttccgcgctctgctgaacatcccttccaactataaagttttattctgccacggcggcggccgcggccagttcgccgggatcccgctgaacatcctcggcgataaaaaggtcgctgactatgtggacgccggctactgggcggccagcgcggtcaaagaggcgaagaaatactgcacgccgaacgttatcgacgcgaaaatcaccgtcgacggcaagcgcgctgtgaagccgatgagcgagtggcagctgaccccgggggcggcctatctgcactactgcccgaacgaaaccattgacggtatcgcgattgatgagacgccgaacttcggcgacgacgtcatcgtgaccgccgatttctcctccaccattctttcccgcgaaattgacgtcaaccgcttcggcgtaatctacgccggcgcgcagaagaatatcggtccggctgggctgacgctggtcatcgtgcgtgaagatctgctgggcaaagccagcgtggcctgcccgtcaattcttgactacaccgtgttaagcgagaatgactcgatgtttaacacaccgccgacgttcgcatggtatctggctggactggtgtttaagtggctgaagcagcagggcggggttgccgcgatggataaaatcaaccagcagaaagccgaactgctctacggcgtgatcgataacagcggcttctatcgtaacgatgtggcgcaggccaaccgttcgcgtatgaacgtaccgttccagctggcggacagcgccctggacaaactgttcctcgaagagtcgtttgctgccgggctgcacgcgctgaagggccaccgggtggtgggcggcatgcgtgcttccatctacaacgccatgccgctggacggcgtgaagacgttaaccgactttatgctggacttcgaacgccgccacggttaatcgcctgtttctttcttcctccccgcggcctgtctgcggggtttttattctgtttgtttgagagtgaagtttgatggaatccctgacgttacaacccatcgcacgcgtagagggcaccgtgaacctgccaggttcgaaaagcgtctccaaccgcgcgctgctgctggctgccctggcccgcggcacgacggtgctgaccaacctgctggacagcgacgatgtgcgccatatgctgaatgccctgagtgcgctgggggttcaatataccctgtctgccgaccgcacccgctgcgaagtgaccggcaacggcggcccgttgcgctctgccgcggcgctggagctgttccttggcaacgccggtaccgcgatgcgtccgctggcggcggccctgtgccttggcagcaacgatatcgtgctgaccggcgaaccgcggatgaaagagcgtccgatcggccatctggtggatgccctgcgtcagggcggcgctcagatcgactatctggagcaggaaaattatccaccgctgcgcctgcgcggcggttttcagggcggcaacgtcgaggttgacggcagcgtctccagccagttcctgaccgcgctgctgatgaccgcgccgctggcgccgcaggataccgtcatcgtcattaagggcgatctggtgtcgaaaccctatatcgacattacgctgcacctgatgaaaaccttcggcgttgaggtgggcaatcagtcttatcagcgatttgtggtgcgcggcaagcagcagtatcagtcgccgggagattacctggtggaacgcgatgcttcctcggcctcgtatttcctcgccgctggcgccattaagggcggcacggtaaaagtcaccggtatcggccgcaacagcgtacagggcgacattcgtttcgccgacgtactggagaaaatgggcgccaccgttacctggggcgacgatttcatcgcctgcacccacggcgagctcaaggcggtcgatatggatatgaaccatatcccggacgccgcgatgaccatcgccaccgccgcgctgttcgcgcaagggaccactaccctgcgcaatatctacaactggcgggtcaaggagacggaccgtctgttcgccatggcgaccgagctgcgtaaagtgggcgccgaggtggaagagggggaagattatatccgcatcaccccgccggcaaagttgaagtacgcagaaatcggcacctataacgaccaccggatggcgatgtgcttctcgctggtagcactgtctgatacgccggtgaccatccttgatcccaaatgtacggccaaaacgttccctgactactttgagcagctggcgcggatcagtaccctcgcctgagtaaaactttgtcatcccgcgggctgatgtcctgtcagcccgctataattgcgcaaaacttctgcttttcatttcctgtagtccgtaatttacaagcaatgctcactttccggcgtattgatgcgtataatgcgcgtcgtttatattccatgcgccttgctgaaggagaaaaagatgacggcgaatattccggtaatcaccattgatgggcctggcggtgcgggtaaaggtacgttgtgcaaggcaatggcggaagcgctgggctggcatctgttagattcaggcgcgatctaccgcgttctggcgctggcggcgctgcatcatcatgtcgacgtggagtccgaagaggcgctggtgcccctggctgcccatcttgacgtgcgttttatttctactgacggcaacctggaagtggtgctggaaggggaagatgtcagtagcgaaattcgcactcaggaggtcgcgaacgcggcctcgaaagtggcggcttttccgcgcgttcgcgaagcgctgctgcgccgccagcgcgccttccgcgaactgccggggcttatcgccgacggtcgcgatatgggaacggtagttttcccggacgcgccggtgaaaattttcctcgatgcctcggccgatgagcgggcgcatcgccgcatgcggcagttgcaggaaaagggctttgatgttaactttgaacgtcttttgtccgagataaaagagcgtgacgatcgcgaccgaaatcgcgccgtggcgccgcttgtcccggctgccgatgcattagttctcgattcaaccgaactaaacattgagcaagtgattgaaaaagcgctacaatatgcgcgcgaaaaattggccgttgcgtaggccttaaccggtaacgcgccgaagcctccgaattatagcagtaccccgcggcaatggatggtcagcgggtatgtgaaacaaccccatccggcatggagccaggtggacgttaatattaacctgaagattaaacatgactgaatcttttgctcaactgtttgaagaatccttaaaagaaatcgaaacccgcccgggttccatcgttcgtggtgttgttgttgctatcgacaaagacgtagtactggttgacgccggtctgaaatctgagtccgccatcccggctgagcagttcaaaaacgcccagggcgagctggaaatccaggttggtgacgaagttgacgttgctctggatgcagtagaagacggcttcggtgaaactctgctgtcccgtgagaaagctaaacgtcacgaagcttggatcacgctggaaaaagcttacgaagacgctgaaactgttaccggtgttatcaacggcaaagttaaaggtggcttcactgttgagctgaacggtattcgtgcgttcctgccgggttccctggtagacgttcgtccggtgcgcgacacgctgcacctggaaggcaaagagcttgagttcaaagtcatcaagctggaccagaagcgtaacaacgttgttgtttctcgtcgtgccgttatcgaatccgaaaacagcgcagagcgcgatcagctgctggaaaacctgcaggaaggcatggaagtcaaaggtatcgttaagaacctcactgactacggtgcattcgttgatctgggcggcgttgacggcctgctgcacatcaccgatatggcctggaaacgcgttaagcatccgagcgaaatcgtaaacgttggcgacgaaatcactgttaaagtgctgaagttcgaccgcgagcgtacccgtgtatccctgggcctgaaacagctgggcgaagatccgtgggtagctatcgctaaacgttatccggaaggtaccaaactgaccggtcgcgtgaccaacctgaccgactacggctgcttcgttgaaatcgaagagggcgttgaaggcctggttcacgtttccgaaatggattggaccaacaaaaacatccacccgtccaaagttgttaacgttggcgacgttgtggaagtaatggttctggatatcgacgaagagcgtcgtcgtatctccctgggtctgaagcagtgcaaatctaacccatggcagcagttcgcggaaacccacaacaagggcgaccgtgttgaaggtaaaatcaagtctatcactgacttcggtatcttcatcggcctggacggcggcatcgacggcctggttcacctgtctgacatctcctggaacgttgcaggcgaagaagcagttcgtgaatacaaaaaaggcgacgaaatcgcagcagttgttctgcaggttgacgcagagcgtgagcgtatctccctgggcgttaaacagcttgcggaagatccgttcaacaactacgttgctctgaataagaaaggcgctatcgttgttggtaaagtgactgcagttgacgctaaaggcgcaaccgtagaactggctgacggcgtagaaggttacctgcgtgcttctgaagcatcccgtgaccgcgttgaagacgcaactctggttctgagcgttggcgacgaagttgaagcgaaattcaccggcgtggatcgtaagaaccgcgtagtgagcctgtctgtacgtgcgaaagacgaagcggaagaaaaagacgctatcgctaccgtgaacaagcaggaagacgcgaacttctccaacaacgctatggctgaagcgttcaaagcagcgaaaggcgagtaatctttgtcattcaggtaataacaacctgaatagcgacgagtttacttgacagattgcaggattcgtcctgtaatcaagcacaaagggcggctacggccgcccttgtttaagctgttagctaatttttgccttgaaggaaaccggaggaataatgaccaagtcagaattgattgaaagacttgccagccagcaatctcacattccggcgaaagcggtggaagatgctgttaaagaaatgctggaacatatggcctcaacgcttgctcaaggtgagcgcattgaaatccgcggtttcggcagcttttctctgcactatcgagcacctcgcaccggacgtaacccgaaaactggtgataaagtcgaactggaaggtaagtacgttccgcactttaagcccgggaaagaattacgtgaccgcgccaatatttatgaagggtgagttgcacgacgtgcagcctgcctgacgataaagaaagcaccttcgggtgctttttttgtgcccgccatttacggccatcctcacaaaaaaagcgtgcccggctgcaagcgaggcgattgtctggaatgcgccgcgcaagcctgaattcgccgccaggacgccagcaccgctttgcgtaacactgtccactcacagggaggtgtttatgcgtctaccatggcttgccggatgcgccatcattgcaatgctgccgcttctctggctacccgtcttgccgggcccgtacagtctggcgggcgcgagcgcactggcgctggcgctgattcgtctgcatggaagggccgtcgccggagtggcgatgacgcttctgctggtggtctggggagtattgagcgcgcatcaggcgctgtggccgacccggcaccttaccggcgccatccggcaagcggaagtgatccttagcgagacggatggccagaccttgcaccgtggacaaatggtgcgcctgcggggccgctatctgtttcccccggtaggcgtaacgctgtacggggaacttgcacctgcgccagcctgtgcgggtcaacactggctgatgacgctgcgcctgcgcccggtgcacgggcagctcaatgacgggggcttcgacagccagcgctatgcgctggcgcagcaccgaccgctgagcggagggatcgtcgccgcttccgcgctggatgcccgctgcagtctgcgcgcccgctatctgacgtcgctgacccggcgactgcagacttatccctggcgcgcggtgatgttgggattaggaatgggggagcggctgtctctgccgacggagataaaggtcctgatgcagaacacgggcacttcccatctgatggctatctcgggtctgcatatcgctctcgcggcttctcttatcatgctgttgctgcgcggcgtgcagtatattctcccgggacgctggattggctggcggttgccccttgtcgccgggctggcgggcgccgtcggctatgcctggctgaccggtatgcagccgccggccctgcgcacttgcttagggcttgcggtctgttgtgctttacgtttgtcgggtcaacgctggacggcgtggcaggtgtggctctgctgtctgggagcgatactggttgccgacccgctggcggtgctgtcgcaaagcctgtggctatctgccttcgccgtggcggggcttatcttctggttccagtggctcccgttgcctgccggccgctggcgctggccgtggaagaccataattgctcttgttcatttgcaggctggcgtgacgctgctgctgctgccgctgcagttgttgctattccatggagtcagcctgacgtcgatggcggctaatttgctggcggtaccgttagtcaccctgttggcggtgccgcttattctgaccgcgatgctggtgcatctctcggggccggatatagtggagtcgctactctggctggcggccgatcgcgtgctggcgctactgttttggggattacgacgtttaccggacggctggttgacgctggatgctcgctggctgtggatcagtatcctgccgtggctgttggtgatgggctggcgttttcagagctggcggcattcaccggcgctgtgtctcagcgtgctgtttttactgacgcggccattcagccgacaaccgcctgcggacgaatggcgggtgacgatgctggatgtcggacaggggctggcgatggtgatcgagcgtcacggtaaggcattgctttacgataccgggccggcttggccgcagggtgatagcggtcaacaggtgattatcccgtggctgcgctggcaccatctgcagttgcaagggattatgctgagccatgaacatctggatcatcgcggcggccttgattcagtgctgcaggcatggccgcaggcgtgggtgcgcagcccgttaggctgggcgcatcatctgccgtgtcatcgcggtgagcgctggcaatggcagggactcaacttccaggccctgtggccgctaccgggcagcacggcaaagggtaacaatcattcctgtgtggtgcggatcgatgatggtcgctccagcatcctgctcaccggcgatatagaacgtcaggcggagcaggcgatgatcagccgttactggcggcatctgacgtctacacttattcaggttccccaccacggcagcaatacctcctccagcgcgctgctggtccgccgggtggatggcgcggccgcgctggcctccgcttcgcgctacaatgcgtggcggatgccctcgtacaaggtggttcagcgctaccgccagcggggttatcgctggttcgccacgccgcagcaggggcagataacggtggttttttccgcagaagggtggcaaatccatagcttacgggatcaagttttaccgcgttggtatcatcagtggtttggcgcgcccgccgataacgggtagaatatgcggctatttcaacacaagctggtttattgaatgcagaacgataaagatctctccacgtggcagaccttccgccgactttggccgattatcgcgccgtttaaagccgggctaatcgtagcggcggtggcgttggtgcttaacgcgggcagtgacaccttcatgttatcgcttcttaaaccgttattggatgatggttttggtaaaacggatcgctcagtgctgctatggatgccgctggtggttatcggcctgatggtgctgcgtgggatcaccagctacatctcgagctattgtatttcctgggtttccggcaaagtggtgatgaccatgcgtcgtcgcctgttcggccacatgatgggtatgccggtggccttctttgacaagcagtctaccggaacgctgctgtcacgcatcacctatgattctgagcaggtcgcctcctcctcttccagcgcgctgatcaccgtggtccgcgaaggggcatcgattatcggtctgttcgtgatgatgttctattacagctggcagctgtcgctgatcctgatcgtactggcgccgattgtgtcggtggcgatccgcgtggtctccaagcgttttcgcaatatcagtaagaatatgcagaacacgatggggcaggtcaccaccagcgccgagcagatgctgaaagggcacaaagaggtgctgatgtttggcggccaggaagtggaaaccaaacgttttgataaagtcagcaataaaatgcgtctgcaggggatgaagatggtttccgcctcgtctatctccgacccgatcattcagcttatcgcctccctggcgctggcctttgtcctgtatgccgccagcttcccgagcgtgatggacaccctgaccgccgggaccattaccgtggtcttctcctcgatgattgcgctgatgcgtccgctgaagtcgctgaccaacgtcaatgcccagttccagcgcgggatggcggcgtgccagacgctgtttgcgatcctcgattccgagcaggaaaaagacgaaggtacgcgggtcattgagcgggcgaaaggcaatctcaagttcgagaacgtcacctttacctacccgggtcgcgaagtggccgcgctgcgcaatatcaatctcgatatcccggaagggaaaacagtggcgctggtggggcgctcagggtcgggtaaatcgaccattgccagcctgatcacccgcttctacgatgtcgacgaggggcagatcctgctggatggccacgacctgcgcgagtacaagctgagctcgctgcgcgaccaggtggcgctggtttcacaaaacgtgcatctgttcaacgataccgtcgccaacaatatcgcctatgcccgtaccgaagagtacagccgcgagcagattgaagaggccgcgcgcatggcctacgccatggatttcattaacaagatggataatggtctggataccatcatcggcgagaatggcgtgatgctgtccggcggccagcgccagcgtattgctattgcccgcgcgctgctgcgtaacagcccgatcctgatccttgatgaagccacctcggcgctggataccgagtccgagcgtgccattcaggcggcgctggatgagctgcagaaaaaccgtacctcgctggttatcgctcaccgtctgtcgaccattgagcaggctgatgaaatcgtggtggttgaagacgggcggatcgtggagcgcggaacgcaccatgatctgctggagcataagggcgtgtacgcccagctgcataagatgcaattcggcgaatgatcgcgcgcatctggtccggggaatcgccgctgtggcgcctgctgctgccgctctcctggctgtatggcctggtgagcggggtgattcgcctcagctatcagctggggtggcaaaaagcctggcgcgcgccggtgccggtggtggtggttggtaacctgaccgccggcggcaatggcaaaacgccggtggtgatctggctggtggagcagctgcagcagcgcggtattcgcgttggcgtcgtgtctcgcggctacggcggtaaagctgaacgctatccgctggtgttggacgacagaaccagtacggcgctggcgggtgatgaaccggtgttgatccatcagcgtaccggtgccccggtcgctgtcgctccgctacgcagcgacgcggtaaaagcgttgctcagcgcgcacgatctgcagatgattgtgaccgacgatggtttacagcactataagctcgcgcgggacagagaaattgtcgttattgacggcgtgcgccgctttggcaacggctggtggctgcctgccgggccgatgcgcgagcgggcgtcgcgtttgcaaagcgttgatgcggttatcgttaacggcggcgtggcgcgtccgggtgagatcccgatgcggctgcgcccagggatggcggttaacctgcttaccggcgaacgtcgcgatgtctccaccttcacgaacgtagtggcgatggccggcatcggccatccgccgcgcttcttcgccaccctcgaaagctgtggcgtccagccggtcaaaaccgtggcgctggcggaccatcaggcgctgagccaggctgatgtcgccgccctggtgaccgccgatcagacgctgctgatgaccgagaaagatgccgtgaaatgtcgcgatttcgccgctgcaaactggtggtatttaccggtcgacgccataatggccgatgaacgcgcacagcggttgcttgcggacttagcgacgttggcgcaacgttaactgacgcgccggctttgctcgccgctgtgctggaattcctgacggagaacctgcatgtcggtattgcaactatcgcttaacgaggcgcgccacctccatctcgcggcgcaggggttgttaaagaagccccgacgtcgcgctcgcccgaaagacattctttccaccatccagcagatgtcgctgctacaaatcgataccatcaacgtggtggcccgcagcccctacctggtgctgttcagccgtcttggcagctatccgcagcactggctggatgagtcgctgcgcaacggcgagctaatggaatactgggcgcatgaagcctgctttctgccgcgcagcgatttcgccctggtgcgccatcgcatgttgaatcccgacaatatgggctggaaataccatcgcgcatggatggaggagcatgccgggagtattgccgagctggtggcgcatatcgggcaaaacggcccggttcgctcggcggattttacccacccgcgcaaaggcgccagcggctggtgggagtggaaaccgcataagcgccacctggaagggctgtttaccgccggcgaagtgatggtggtggagcggcgcaattttcaccgcgtgtatgatctaacccggcgggtgatgccggactgggacgacgagcgcgacgcgctctcccgcgaagacgcagaggccattatgttgcgcaatagcgcccgtagtctcggcatcttccgcgcccagtggctggccgattactatcgcttgcgccagccggcgctaccgggtctgctggcggcctggcaggaagaggggctggtggtgccggttaacgtggaagcactcggcgagatgtggctgcatcacgaggcgctggcgcagctggagaccgcgcccggcggtaagctgaccgccagccatagcgccgtgctctcgcccttcgacccggtggtctgggatcggaaacgcgctgagcagctgttcaacttcagctatcgcctggagtgttataccccggcgccgaagcgtcagtatggctacttcgtactgcctctgctgcaccagggaaaactggtcgggcggatggacagtaaaatacatcgcaaaagccgggagctggagatcttcgctctgtggctggaggagggggtgaagatcacccgtggtctggagcaggggctgcgccgggcgattaacgacttcgcacgctggcaatcggcagagcggatcctgtgccgacgcctgccggaagggctgtttgtcggccaggagcaggggtgggaaatcgacgccgattgatcccggcgcctgccttcctgtgatatgctgctgagaaatctatccggtccatcaggaggaaacatggatcaccgtttacttgaaatcatcgcctgcccggtctgtaacggcaagctgtattacagtcaggataagcaagaacttatttgcaaacttgatagcctggcgtttccgctgcgcgacggtatcccggtgctgctggagacagaggcgcgtccgctggcgctagaagagagtcactcatgagtttcgtggtcattattcctgcgcgtttcgcctccacgcgcctgccgggaaaaccactgcaggacattaatggtaagccgatgattgtccatgtgctggagcgcgctcgcgaatccggcgcggatcgcattattgtcgccaccgatcacgaagatgtcgcccgggcggttgaagccgccggcggcgaggtctgtatgacccgcgccgaccatcagtccggcaccgaacggctggcggaagtggtggaaaagtgtgcgttcagcgatgacaccattatcgtcaatattcagggcgatgagccgatgatccccccggcgattgtccgccaggtggcggagaatctggctgccagcagcagcggaatggcgacgctggcggtaccgatccatgatgcggaagaggcgtttaatccgaatgcggtcaaagtggtgatggatgccgagggttacgcgctctatttctcccgcgcgactattccctgggatcgcgatcgctttgcccaaacccgcgagaccatcggtgactccctgctgcggcacatcggcatctatggctatcgcgccggctttatccgccgctatgtcagctgggcgccgagcccgctggagcagattgaaatgctcgagcagctgcgagtgctgtggtatggcgagaaaatccatgtcgccgtggcggccgaagtgcccggcaccggcgtggataccccggaggatctggagcgcgtccgcgctgagctgcgttagtcctctgtcccctccttgctggaggggatatccccgtcggtttttcgctttttttacccctttttgatcttatccgatgacaagccaggtgcgggcgctcattatgaaaccagtagtgttcataggggtaatcgacaatggaacagttgcgaaccgaactcagtcatcttcttggcgaaaagctaagccgggtggagtgtgtcagtgaacaagccgctacggcgctgtggttcctgtacgatgcgcagggaaacccgatgccgctgctggcgcgaagtttcaccacgcccggcgtggcgcggcagctggcatggaagatctcgaccctggcgcgtaatggtacggtgcgtatgccggtggtttatggcgtcatgacgcacgaagaacatcccggaccagatgtgctgctgcttgagcgcctgcgcggcgtaccggtggaggcgccgacgcgcaccccggcgcgctgggagcaactgcaggagcaaatcgtcgaggggctgctggcgtggcatcggcaggacagtggcggctgcgtgggaatggtcgacaatacccaggaaaacctatggccgaactggtaccgccagcgggtagagatattgtggagcaccctgaacctgtatcaggacaccggtctcaccatgcaggataagcgccttttgttccgctcccgcgagtgccttccggagctgttccgcgatttcaatgataatgctgtgctggtgcatggcaacttcactctgcgcagcatgctaaaagatccgcgcagcgatcagctgctggcgatggtggggccggggatgatgctgtgggcgccacgcgagtatgaactgttccgccttgctgaaggcggccaggcggaacagctgctgtggcgctacctgcagcaggcgccagtttccgaggcctttgtctggcggcgctggctttatctgctgtgggatgaggtggatagtctggtcaacaccgggcgctttgatcgcgcccgttttgacctcgctgcaaaatcactcctgctctggctcgcctgagctgcctttcagccattgccagacgcgaccaagggtttcatagccgacccggtcgctgtgcatcagccacactggagaaggaatggcccgctcccacggattgagcggcgaggtcaccgccagctgattggccggcgcaggaagcggatccaggccggcatggcgaaagaatatcatcgcccgcggaaggtgtgacgccgaggtgaccagcaggaagggcgcgtcgccgatggcgcgcttcaccgccagcgcttcctcttctgtatctttcggccgaccgagcacaatgatatcgctgcgaggtacgccaaggctctccgccactctcgccccggcttccgccgtgctgacgggattcgttttcgccgccgcgccggtaaagatcattttcgaaccgggattcgcctgccacaggcggatgccctccgtcaggcgcggcaggctgttattgataagattagagcttggcgcccactccggattccaggtatagccgccgcccagcaccaccacgtagttcaccggctgctcgccgcgccaggtggggtaggtatcttcaatcggtttcagcaggctgtcggccacgggctgaaggctcagcagcgtcagcagcagccagccgaggctcacgcatagcttcccggtacgctgaaagcggctgaaccataacagcgcgatcccgataccgatcagcaacagtaaggcgggtagcggcaacagcaggccgccgacgatcttttttagcgtgaaaagcatgccagatggttccttttttaaccatataaccaaagttatgttcggatcttataacagatcgcttcattctcggcgcgggtatgacaaaatagcggttttgtgttggcttgtggagtcactcgtgcaggatcgcaatttcgatgacattgctgaaaagttttcgcgcaatatttacggcaccacaaaaggccagttgcgtcaggcgatcctctggcaggatctggaaccgctgttggcgcagctggggccgggaccgctgagggtgctggatgccggcggcggggaagggcaaacggccatcaaagtcgcgcaactgggccatcacgtgacgctgtgcgatctctccgctgagatggtggctcgcgcccgccaggcggccgccgataaaggtgtgatcgacaacatgcattttgtacaatgcgcggctcaggatattgcgcagcatttggaaagcccggtcgatctggtactgtttcatgcggtgctggagtgggtggcggagccccaggaaatactgcataccctgtggtcgacgctgcgtgctggcggtggactgtcattgatgttctacaatgctaacggcctgttgatgcacaatatggttgccggtaattttgattacgttcaactgggcatgccaaaaaagaaaaaacgcacgctgtcgccggattatccgcgtgaaccacagcaggtttatcactggctggaagagattggctggcagatcgtcagcaaaaccggcgtgcgggtgtttcatgattatctgcgtgaaaaacgccaacagcatgacagctatgcggcgctgctggcgctggagacgcgctactgtcgtcaggagccgtatctcagcctgggccgttatattcatgtcaccgcgcttaagagccaggctcatagccgcagatgcaaggataaagtatgagtgaattttcccagacagtccccgaactggttgcctgggccagaaaaaatgatttttcaatctcgctaccggtcgacagactctcttttctgctggcgatcgccactctgaacggtgaacgactggaaggggaaatgagcgagggtgaactggtggatgcgttccgccacgtcagtgatgcgtttgagcagaccagcgaaaccatcagccagcgcgccaataacgcgatcaacgatttggtgcgccagcgtctgctgaaccgctttaccagcgaaattaccgaaggcaatgcgatctatcgcctgacgccgttggggattgggatcaccgattattatatccgtcagcgcgaattctcgacgctgcgtctctcgatgcagctgtcgatcgtcgccggcgagctgaagcgcgcggcggacgccgcggaagagggcggtgatgaattccactggcatcgcaacgtttttgcgccgctgaagtattccgtagcggaaattttcgacagcatcgacctgacgcagcgcattatggatgagcagcagcagctggtgaaagacgatatcgcgcagttgttgaataaagactggcgcgcggcgatttccagctgtgaactgctgctgtcggaaacctccggcaccctgcgcgaactgcaggatacgctggatgcggcaggggataagctgcaggcgaacctgctgcgcattcaggactcgaccatggcgcgcgacgatctccattttgtcgatcggctggtgttcgatctgcaaagcaagctcgaccgcatcgtcagctggggtcagcaggcgattgacctgtggatcggctacgaccgccatgtgcacaagtttatccgtaccgctatcgatatggataagaaccgcgtcttcgcccagcgtctgcgccagtcggtacagacctattttgatgaaccgtgggcgctaacttacgccaacgccgaccgcctgctggatatgcgcgatgaagagatggccctgcgcgatgaagaggtcaccggcgagctgccggcggacctcgaatttgaagagtttaacgaaattcgcgagcagctggcggcgctgatcgaagcgcagctggcggtctataaagagaaaggaataccgctggatctcggcctggtggcgcgggagttcctggcgcagtatccgcgcgggcgtcacttcgacgtggcgcggatcgtcgtggatcaggcggtacagctgggcgtcgcccaggcagatttcaccggactgccggcaaaatggcagccgattaatgattacggagccaaggtacaggcgcatgtcattgacaaatattgaacaagtgatgccggttaagctggcgcaggcgttggccaatccgttatttccggcgctggacagcgccctgcgcgcgggccgtcatatcggtctcgacgagctggataatcacgcatttttgatggattttcaggattacctggaagagttttacgctcgctataacgtcgagctgatccgcgcgccggagggattcttctacctgcgcccgcggtccaccacgctgatttcgcgctcggtactgtccgagctggatatgatggtgggcaaaattctttgctatctctatctcagcccggagcgcctggcgaacgaagggatttttacccagcaggagctctatgacgagctgctgaccctggccgatgaatccaggctgctgaagctggtgaacaaccgttccaccggttcggatctggaccgccagaagctgcaggaaaaaatgcgggcctcgcttaaccgcttacgccgtctggggatggtgtggtttatgggccacgatagcagcaagtttcgcattaccgaatcggtattccgctttggcgccgatgtgcgcgccggcgacgacccgcgcgaagcgcagcgccgtctgatccgcgacggggaagcgatggccctggaaaatcacctgcagctcaatgatgagaatgaagaaaaccagccggatagcggggaggaagagtaatgattgaacgcggtaagtttcgctcgctaacgctggttaactggaacggcttctttgcccggacctttgatcttgatgaactggtgaccaccctctccggggggaacggcgcgggtaagtccacgaccatggcggccttcgtcacggcgctgatcccggatttaaccctgctgcacttccgtaacaccaccgaagcgggggccaccagcggctcacgcgataaaggcctgcacggtaagctgcgcgccggggtgtgttactcggtactcgatgtgatcaattcccgccaccagcgcgtggtggtcggcgtgcgcctgcagcaggtcgccgggcgcgatcgtaaagtcgatattaaacctttcgccattcagggactgccgacctctatcctgccgacccagctgttgaccgaaacgctgaacgatcgccaggcgcgcgtcgtgagcctcaacgagctgaaagataaactcgaggcgatggaaggggtccagtttaaacagttcaactcgatcaccgaatatcactcgctaatgttcgatctgggcgtggtggcgcgtcgcctgcgttccgcctccgatcgtagcaagtactaccgcctgattgaggcctcgctgtacggcgggatctccagcaccattacccgctcgctgcgcgactacctgctgccggaaaacagcggcgtgcgtaaagcgttccaggatatggaagcggcgctgcgggaaaaccgcatgacgctggaagccattcgcgttacccagtccgaccgcgatctgtttaaacacctgatcagcgaagccaccaactacgtggcggcggactatatgcgtcacgccaacgagaggcgcattcacctggataaggcgctggagtatcgccgcgatctcttcacctcgcgttcgcagctggcggctgagcagtataagcacgtcgacatggcgcgcgaactgcaggagcataacggcgcggagggcgatctggaagccgattaccaggccgccagcgatcacctgaacctggtgcagactgcgctgcgtcagcaggaaaaaatcgagcgctacgaagcggatctcgacgagctgcagatccgtctggaagagcagaatgaagtggtggcggaagccgtcgatcgtcaggaagagaacgaagcccgcgctgaggccgccgagctggaagtggatgagctgaaaagccaactcgccgactatcagcaggcgctcgatgtgcagcagacccgcgccattcagtataaccaggcgctgcaggcgctggagcgcgcgaaggcgctgtgccatctgccggatctgaccccggagagcgccgacgagtggctggaaaccttccaggcgaaagagcaggaagcgacggagaaaatgctgtcgctggaacagaaaatgagcgtggcgcaaaccgcgcacagccagtttgaacaggcttaccagttggtggcggcgattaacggcccgctggcgcgcaatgaagcctgggacgtggcgcgcgaattgctgcgcgacggcgtgaaccagcgccaccaggccgagcaggcgcaggggctgcgcagccgcctcaacgagcttgaacagcgcctgcgcgagcagcaggacgctgagcgtcagctggccgagttctgcaaacgccagggtaaacgctacgatatcgacgatctggaaacgctgcatcaggagctggaagcgcgcatcgcgtcgctggccgacagcgtctccaatgctcaggagcagcgcatggcgctgcgtcaggagctggagcaactgcagtcgcgtacccagacgctgatgcgtcgggcgccggtctggctggcggcgcagaacagccttaaccagctgtgcgagcaaagcggcgagcagtttgcgtccggccaggaggtcaccgaatacctgcagcagctgctggagcgtgaacgagaggctatcgttgaacgtgacgaggtcggcgcccgcaagcgcgccatcgacgaagaaatcgagcgtcttagccagccgggcggttcggaagatccgcgcctcaacgccctggcggaacggttcggcggcgttctgctgtccgagatctacgatgatgttagcctggacgatgcgccgtacttctccgcgctgtacggtccgtcgcgccatgcgatcgtggttccggatctgtcgcgggtagccgagcagcttgaggggctggaagattgcccggaagatctctatctgatcgaaggcgatccgcaatcctttgacgacagcgtattcagcgtcgacgagctggaaaaagcggtggtggtgaagattgccgatcgccagtggcgttattcgcgcttcccgtcgctgccgctgtttggccgcgcggcacgtgaaaaccgcattgaaaccctgcatgccgagcgtgaatcgctgtcagagcgttttgcgaccctgtcgttcgatgtgcagaaaacccagcgcctgcaccaggccttcagccgctttatcggcagccatctggcggtggctttcgaggacgatccggaagaagagatccgcaaactcaacagccgccgcggcgagctggagcgtgcgctgagcgcccatgaaagcgataaccaacagaaccgtgtgcagtacgagcaggcgaaagagggcgtgtcggcgctcaaccgcctgctgccgcgcttgaacctgctggcggatgatacgctggccgaccgcgtggacgagatccaggaacgtctggacgaagcgcaggaggccgcgcgctttattcagcagcacggtaaccagctggcgaagctggagcctattgtttcggtgctgcagagcgatccggagcagtttgagcagctgaaagaagattacgcctatgcgcagcaaacccagcgcgatgcgcgtcagcaggcttttgccctggcggaagttgtgcagcgcagggcccacttcagctactccgattcggcggaaatgctcagcggcaacagcgatctcaacgagaagctgcgccagcgtctggagcaggcggagtccgaacgcagccgcgcgcgcgacgcgatgcgtgcccatgcggcgcagcttagtcagtacaatcaggtgctggcctcgctgaagagctcgtatgacaccaagaaagagctgctcaacgatctgtataaagagttgcaggacattggcgtgcgcgccgacgccggcgcggaagagcgtgctcgcgcgcgtcgcgatgagctgcacatgcagctgagcaataaccgctcccgacgcaatcagctggagaaagcgttgaccttctgcgaagcggaaatggacaacctgacccgtaaactgcgcaagctggagcgcgattactgcgaaatgcgcgagcaggtggtgaccgccaaggcgggctggtgcgcggtgatgcgtctggtgaaagacaacggcgtcgaacgtcgtctgcatcgccgcgagctggcctatctctccgccgatgagctgcgctcaatgtcggataaggcgctgggggcgctgcgtctggcggtcgccgataacgaacatctgcgtgacgtgctgcgtatctcggaagatccgaagcgtccggagcgcaaaattcagttcttcgttgccgtataccagcatctgcgcgagcgtattcgtcaggatattattcgcaccgatgatccggtggaagcgatcgagcagatggagatcgagctcagccgcctgaccgaagagctgaccaaccgtgaacagaagctggcgatcagttcccgcagcgtggccaacattattcgcaaaaccattcagcgcgagcagaaccgtatccggatgctcaaccagggtctgcagagcgtctccttcggccaggtcaacagcgtgcgtctgaacgtcaatgtgcgtgagacccactcgatgctgctcgacgtgctctccgagcagcatgagcagcaccaggatctgtttaacagcaatcgtctgaccttctctgaggcgctggccaagctctatcagcgtctcaacccacagatcgacatggggcagcgtacgccgcaaaccatcggtgaagagctgctcgactaccgcaactatctggagatggaagtggaagttaaccgcggctccgacggctggctgcgcgcggagtccggcgcgctgtctaccggggaagctatcggtaccgggatgtcgattctggtgatggtggtgcagagttgggaagatgaatcccgtcgcctgcgcggcaaggatatctcgccttgccgtctgctgttcctcgatgaagcggcgcgtctcgacgcccgctccatcgccaccctgttcgagctgtgcgaacgtctggagatgcagctgattatcgcagcgccggagaacatcagtccggaaaaaggcactacctataaactggtgcgtaaggtgttcaataatcacgaacatgtgcacgttgtggggctgcgcgggtttgctgcgccgctgccggaagcgctgccgggaacggccgacgcctcgtgacgatgcagctcactactggcgggtaagcgctgaaaagggcaacgttaagttgccctttttgctatccagcttgctatgccagggtggtataatctttaagcttctttacattaggtaaggcaaaagccttttcgtctttatatactgtgttaaagcccacgaatttgtgggcggcaatgtgtgacaacagggggcaagggatgttgcttaagaaacggtatggtcgtccattgtcagcgctcagtctgagcctggcaatggcatttgctccgctgttcaatgtccaggccgcagagcctgaagtcgtaccaggtgatagctccgctacgcctggagagctttccgtcgcgctgtcgcaaagcgacgggcaatcgccggcggtcgcgaagctggccggtgagcagccgctgtcgatggaagccgcggcgaacagtcgcgcccagatcgaagcgctattgccggctggctacaaacccgtctttatgaatccgctggtctcgctatacgccgccagggatatgaaaccgatgtgggaaaaccgcgaggcggtgcaggcgttccagcagcagctggcggagatcgccatcgccggttttcagccgcagtttaccacctgggtcagtctgctgaccgatcctgccgtcagcggcatggcgcgcgatgtggtgttgtctgatgccatgatgggctatctgcactttatcagcggcatccccacccaggggacccgctggttatatagctcgacaccgtacaagatggcgaccccgccgctgtcggtgattaaccagtggcagctggcgctggataatggctccctgccggcgtttatcgccggcctggcgccgcgtcatccgcagtatgaggccatgcaccagtcgctgctggcgctggtggctgattcacgtccatggccgcagatgaccggcagcggctcgctgcgcccgggagaatggagcaatgatatcggcgcgctgcgcgagatcctccagcgtaccgggatgttggaaaattccgccaatatcgttctgcccggcgacgtggtgagtccttcggcgaagaaaaagagcaagcccgcggcgcgcggtgtgtacgatcgccagctgggggagggcgttaagcgctttcaggccatgcaggggctgggggcggatggggtcatcggccaatccacccgtgactggctcaatgtctcatcggcacagcgcgctggcgtgctggcgctgaacattcagcgtctacgtctgctgccaggcaaactatcgaccggtatcatggtgaatattcccgcgttttcgctggtctattaccaggacggcagtcaggtgctggcctcgcgggtgatcgtcggacgtccggaccgcaagacgccgatgatgagcagcgcgctgaacaacgtagtggtcaatccgccgtggaacgtaccgcccaccctggcgcgcaaagatattctgccgaaggtgcgtaataatcctggctatctggagcagcatggctacaccgtgatgcgcggctggaacagtaaagagaccatcgatccttaccgggttgactggtcaaccatcaccgagaacaatttaccgttccgttttcagcaagcgcctggggcacgtaattcactggggcgttacaagtttaatatgccgagttcggatgctatctatctgcacgatacgccgaaccataatctgtttcagaaggatgtccgtgcgctcagttccggctgcgtcagggtcaataaagcctcggagctggccaatatgctgctgcaggacgcgggctggaatgacacgcgcatttccgacgccctgaagcagggggatacgcgctatgtcaatattcggcaaaatataccggtgaatttatattacttaacggcgtttgtggacgctgatggacgtacacaatatcgaacagatatttacaattacgatatcaccgcgcgatccagcgcacaaattctgacgaaagcggaacaattaatcaggtaaatgaagtagttcaatggattttgttgtcctagcactgggtaaaaaagggcgctgcacctctgcagcgcccgattttcctggggtgaggctgccttgacgttggcaataatgcccggtaaggtgcctttcgtgcgccagaagtgcatatacatatcattccgctcaatgcgtagcgcggttagcgcgaacgttctcctttgccgggcaacatctcggtcgtggcgagcgatagcgagctgatcctggcatcgcgcaaagcggaaaaagtatataacgattcattgactgtagacctgattatcatggacaaatttgacgctaatcgccgcagattgctggcgttgggtggcgctgcgctgggtgctgccgccattctccctgcgccggcatttgccaccctctcgaccccccgtccgcgtattttgacgctgaataacctgcataccggtgaatcgctcagggcggagtttttcgatggcagaggctatattcaggatgaattagcaagacttaaccattttttccgtgactatcgcgcgaataaaattaagtccatcgatccaaatctgttcgatcatctttatcggttgcagggactacttggcaccaacaaacctgtccagcttatctctggctatcgttccctcgataccaacgatgagcttcgcgcacgaagccgtggtgtagcgaaacacagctatcacaccaaggggcaggcgatggatttccatattgaaggtatttcgttaagcaatattcgcaaagcggcgttatctatgcgcgcaggtggtgtaggatattacccacgtagtaactttgtgcatattgataccggtcccgtaaggcactggtaacgaaaggagcgtcatgaactatcgtattattccggttaccgcgttcgcgcagaactgttctcttatctggtgcgggcaaacccggctggcggcgctggtcgatcctggcggcgatgctgaacgtatcaaagcggtggtggcggaggctggcgtcacgctgatgcagatcctgctgacgcatggccacctcgatcacgttggcgccgcggctgaactggcgcagcattatggcgtaccggttattggtccggaaaaagaggatgagttctggctggaaggattaccggcgcaaagccggatgttcggcctggaggattgccaaccgctgcgtccggatcgctggctcaatgaaggcgatgtggtcaatgtggggaatgtggcgctgcaggtgctgcactgcccgggccatacgccgggccatgtggtcttttttgatgacgcctcccgactgctgatctccggagacgtgattttcaaaggcggggtgggacgcagcgattttccgcgcggcgaccatgggcagctgattgcggctatcaaggaaaagctgttgccgctgggcgatgatgtgacctttattcccggccatggtccgctgtcgacgctgggtgaggaacgccgtaataacccgtttctgcaggatgagatgccggtctggtaacagacatgacgcgaacacataaaaaaggccgcattcgcggcctttttctttataccgaatactatcgcttacagtacggcgacgatggcttcgcacagcggcgccatattgtcaggcgtcatcccggccacgttgatacgtccggaagctaccgcatagatggcgaactcttcacgcaggcgcagcacctgctctttagtcaggccgctgaatgagaacatgccgttctgctggctgataaagctgaagtcgcggctcgcgcctttctcctgcagggtattgacgaacagcagacgcatacgctggatgcgctggcgcatatcggtcagttcctgctcccagattgcccgcagcgcatcgttgctcagaatggtggcgaccacggaggcgccatgcgcaggcgggttcgagtagttggcgcggatcaccgacttcatctgactgaaggcgcggtctacagtctcttgatccgcggcgaccagagtgcaggcgccgacgcgctcgttgtacaggccaaagtttttcgaataggagctggcgaccagcagctctttatgtagagcagcaaaagcgcgtagcccttcagcatcttcttccagaccgcgggcgaagccctggtaggcgaaatcgaacagcggtagccagcctttttccaccgacagctgcgccagctgctgccactgatcgagcgtcggatcgataccggtcgggttgtggcagcagccgtggaacagtaccacgtcgcccgcctgggcttcgttcaggctggccagcagaccatcaaagtccagcgcgtggttagccgcgtcgtagtatgcgtattcgcgcacttccagcccggcagaagtgaatacgcttttatggttcggccagctcggattacttacccacacacgtttcacgtcggtgtttttggcgaggaagtctgcggcgacacgcagcgcaccggtaccgcccggtgtctgcgcggtgcgggcgcgtttatcagcgataatcgcattgcctttaccgaacagcagctcctgggtgcagcgaccaaattcaggaatgccatcgatgcccagatagtttttagtcgtttcattttccagcagatactgctctgcttttttgacgctggtcagaacgggcgttttaccggtttcatccttgtaaacaccaattccgaggttaattttttcagggcggtcatcggcacgaaacagatcggccagacctaaaatcgggtcggctggggcggcggtaatgttctcaaacatgacgaggttccattgtgattactgaagggaaatccgctatcaggttaacgggagaataacgaattgccaaccgtttgcgacaaaaagcgcgaaggttttcgaaagagacgatctttgtctcacgaatacagaaaagcaggaccgaagtcctgctttgaaggcatatcacgaaggggtgtactgcagattagaactggtaaacgatacccacggccgcctggtcgtcagtggcgacaccagccgctttggtgtaatcgttgtcgtccagctggttgaatttatacgcagcgtagacgttcatgttcttgttaaagtagtaccaggtacccacttcgatgtatttaaccagatccgcatcgccgccggagaagccagcacgcgactgcaggtccttgcctttggtctgtacgtagccgatggacggacgcaggccgaagtcaaactgatactgtacaactgcttcaaagttctgagttttaccggcgaagtggttatcttcttccggagtcatgttgtaagtctgggagtacatgacggccgcatagatgttgttagcgtcatattttgcagaggtcgcccaggcttcggctttgtcgccattgccgtcagctttctgatcgacgctacggttagagctggagtagcctgcagacagtgcgataccgttgtcgaacgcgtaggtggctgcggtgctgaagccgtcgccattctgcttgcgaatcgcacggtcgtggtcgtttttaccctggtactgcagcgcgaagctcagaccgtcaaccagaccgaagaagtcggagttacggtaggttgcgacgccgttggtacgaccggtcatgtagttgtcggtgtagttccagccgtcaccgccccattcaaccagcatatcggttgccgcttcgacgtcgtagatcgcgccgtagttacggccatagtcgaatgaaccgtattcgcccgctttcaggcccgcgaacgccagacgggtttttgtggtctgggaaccttcaacattggacgcgtccatgttgtattcccactggccgtagccgatcagctgatcgttaatctgagtttcgcctttcaggccgatacgggcataggtgggatcgtcgctgctggtgtcgccattggtggtccagacgtgctcgccgaccatttttccatagaagtccagtttgttgccgtttttgttatagatttctgcagcgttggctgcaccggctaccagcagggcagggatcaccactgccagaatattgcgcttcatcattatttattaccctcattaatattttttatatgaacacgtgccactgccgtcaataagttctgtcaataaaaacttacagaaccattgatgagagtttggtgtctgaaggcatctttccatccgcgacaacgtttcgctagccggaaaatgctacgaatatctcatatgagtaacaaaacgaaaaatcatgtaactaaatgtgtatttaacggaactttgtgaacttaatcaaaattccgttccaccggataagggcaaacgccattacttatctatctatatgaattatttatgattaatttggctaagcggcaattcgttcattttgtgtattgaattcgtattctttttattcagtctctgtctttgcaagatgtgcgggtaaaggtcaaaaaatgagcaaatttatcagccattttgctctgttatgaacataaagtgcgatctacatcaccaggatgcaccgaaacagtgcgtaacataattgtgatttccaggccttgatgtttaaggttgttgaattttactaacagtaattgacataaaaaaaaggccagcttgcgctggcctttcagattgatgtcagaaaaatttagaatgtcgcgttgcgcggcgtccgcgggaacggaataacatcgcggacgttctgcacgccggtcacgtaagcgatgaggcgttcgaagcccagaccgaagccggaatgcggcacggtgccgtagcgacgcaggtcgcgataccaccagtagtcttctttgttaagacccatctctgccatacgcgcgtcaagcacgtcgagacgctcttcacgctgggaaccgccgataatctcgccgatgcccggcgccagaacgtccattgccgcgacggttttaccgtcttcgttaaggcgcatatagaacgctttaatgtctttcgggtagtttttcaccaccaccggcgctttgaagtgctcttcggccaggtaacgttcgtgctcagaggagagatccacgccccagtacaccgggttctcgaactgtttgccgcagttttccagaatggtgacggcgtcggtgtaatccacctgagcaaaatcagcggtgataaagcgctgcagacggtcgatagcgtctttatccacgcgctcggcgaagaactgcatgtcgtccgcacgctcttccagtaccgctttgaagacgtacttgagcatcgcttccgccaggccggcaacgtcgttcaggttggcgaaggccacttccggctccagcatccagaattccgccaggtggcggctggtgttggagttctcggcgcggaaggtcgggccgaaggtataaatcttcgacagcgcacaggcgtaggtctcgccgttcagctggccggaaacggtcaggaacgactctttaccgaagaagtctttgtcgaaatcgactttgccctgatcgttacgcggcaggttttccagatccagcgtcgacacgcggaacatttcgccggcgccttcggtatcggaggcggtgatcagcggggtggaaacccagaagaagccctgttcgttgaagaagcggtgcagcgcctgcgccagggtgtgacgcacgcgggctaccgcgccaatcaggttggtgcgcggacgcaggtgcgctacttcacgcagatactcgatgctgtggcgcttggccgccatcgggtaggtgtccgggtcttccacccagccggtcacttccacgctggtcgcctggatctcaaagctttgaccctgaccctgagaagccacgactttaccggtgacaatcaccgagcagccggtggtcagacgcagcacttcctgattgtaattgggcagagaattattaataacggcctgtacaggatcaaagcaggaaccgtcatagacggcgaggaaagaaaagccagctttagaatctcggcgggtacgcacccatccgcggaccgtgacttcgctgtcaacggcaacgcggccctggagtacgtcggctacaggcacaacgctcataataatctctctatgtagtccaataaaaaagtctcttcccccaacagcggggggatatctatgttacctgtcatcttccatcagacaagtagatttcgcacagggaagggtggatttcggaaataaatacccctccggggcgttctttggctcaccatttcgacttttacacgacttactcgataatgaccgtcatttcctgcttcgcattttgcatcgacacgatggtccggaaagacttgatatttcccgaggcaaaaaagagttcacgggttagcgcttcgtattccgccatatcacggacgttgatcacgagcaggaaatcgaagtcgccagtgacatagtagacctgctgcacttgcggacaggtaacgaaacgctgtttatcctcctcaagcagatcgagacgttcattctcaatggtcacctgcaccataatggtgattggtcttcccactttactggcgtccactaagctaacactgcctttaatcacccctgcatcctccagtgcagcgatacgccgattgactgccgaaggagacaggctgatccgatcggcgatctcccgttgcgacaagcgattattacgctgcaagagcgtaagaatttttttatcccatgcgtcaagtttcatcatatatctcgtcctgcaagcctgtgatcaacctcactaatgcaacgttgttgcgtatgaatgataaaacagagtgaaaattgcggcgcgatgggcaactttgcgccaattaaccgccgggcgcagtgtaccatcacaggcagtgggaaagcggtatatcgcgacaaaaagcctctcacattctgacttaaccaatttaaagcgaccgtcctgtctcaggccgcacggatccgtgcacccgtcgtttaggcggaatggtcgcaaataacgttatcgtcgcaggacgatatgaaaatagaggtgcctgaatagtggacacaattaaatttcaacttaacgcccggcggcagccctatggccagggagcagacttgagtctgctgaatgaaagcgtggggaacgaagtgctggcattccatcaaaaatttcctgattaccgggtcacgccgctgcgtaagctggaatttttaagccagcggctggggctgggatcgatccatataaaagatgaagcgcagcgattcggtttgaatgcgtttaaaggattaggcggatcttatgcgatggggaaatatctcgccgctctgcttgagcgagatattaatacgttgagctttgccgagcttaattcaccagtgattaaggcgcgtatcaaggacatcgtatttgtgactgctaccgacggtaaccacggacgtggcgtggcgtgggcggctgagcagcttgggctgcgtgcggtggtgtatatgccaaagggctcgtcaccggtacgcgcgcagaatattcgccggcatggcgccgaatgcacgattactgaactgaactacgacgacacagttcggctggcggccaaaaccgcgcgcgagcagggatgggttctactccaggataccgcctggcagggctacgagcagatccccacatggatcatgcaaggctatatgaccctcgctgttgaaatctggcagcagctggcagaaagcggagcgtcgatgccgacgcatctgtttttacaagccggggtcgggtcgtttgccggtagcatcatgggatatttcatcgaaaagatgcagcagcaggctcccaccatcatcatcgttgagccgcacaaggcgaactgcctgtttcgctcggcaaccattaatgacggactgccgcacagcgtcggcggggatatgtcaaccctgatggccgggcttgcctgtggtgaacctaatatcaccagctggccaatgctccgcgaccatgccacctgttttatttccgccgacgattgtctggcggccaacggcatgcgcctgttggccgctccgcgaccaggtactgacgaaccttttgtctccggggaatccggcgctattggcacaggagtgctttatgcgctgatgactcaaccggcgtatcgcgagcttgccgaatcgctgcgcctgaatgccgatgcacaggttctgttaatcagcacggaaggagatacatcacccgatgtctatgaagacatcgtctggtttggccgtaatggttgagcgctatcgacaataacaagggggccatcttaccttccctacaagccctcggtatgacaagcgttctgactcataacgaaaacatacgcgctttcgcgtcatgcatagagagaacctgaccgatgaatactgaaaatataattatcaataaaggatattccgatcccgcaaagtggcatagcgaagataccgtttgggtccttggcctgttcggtaccgccattggcgctggggtgctgtttctgccgattaatgccggaattggcggcttctggccgctgctgattgtttttgtcctcgcttttcctattacttatctggctcaccgcggtctggcgagattcatttactcttccaatacgccggaaagcagtattaccgatgttattggcgagcattttggcgcgctggcgggaaaagtatttaccgtcatctatttcttcgccgtctataccattctgattatgtatgcggtggctatcaccaacaccgcgcagagctttatcacccaccagttggcaatggccgagcctccccggtcgctggtggccatcgttctgatcctcgggctgatgtttatcgtccgtttcggacagcgtttgataatgcgggtgatgagcaccctggtttatcccttcatcatctcgcttatttttatggcactttttctgattccgcactggaacggcgcaattttgcaaaccgtaagcttcagcgccacgggcgatgggcaggggatcatgttatccctgtggatgaccttcccggtactggtgatgtcgtttaaccactatcccatcatttcgccgatggtggtgcgccagaagcagcgttacggtctggcgctcgctgagggtaaatgtgcgcagatccagcgctacggtatcctgctcatgacggtggtggtgctgttttttgttctcagctgcgtgttaagcctgtcgccgcagcaactggcggaagccaaagcccagaatctgtcgattttgtcctatctggccaatcagtacgatacaccgattattgcctggctatcgccgattatcgcctttgtcgctattactaaatcatttcttggccactacatcggcgcctatgaatcgctgcgcgacctgattctggaggccgccgccgcacgcggtaaaaaaccaggtattcgcctcgtcgacgcggtcatcctggtgtttatggtgcttacctgctggttcgccgcgtacaagaaccccagtatcctcggtattatcgaatgcatcagcggtcccaccggggcggcaattctgctgctgttgcctatgtacgccattcataaattaccggtgcttgccccctggcgcggtaaagcgagcaacgttttcgtcaccctgatcggtcttatcaccgtatctgccattttttacggcatgttccaataaccaccataattagcgagatgttatatgagtcattatctgcagattaacggccaacggcttatcgattccctgtatgcacttggcgaacatggtgcgctgccaggcggcggcgtatgccgcctggcagcgactgccgaagataaagccggcagggactttgttgtagcccgcatgaaggcgctgggcctgagcgtgtcaattgatgctatcggcaatgtcaccggcgtttatcacggcgaggagacgttgccgatggtgatgatggggtcacatatcgataccgtcgccaccggtgggttatacgatggcaactacggcgttatggccggccttgaggtgattgccaccctccaggatgccgggatccgcacccgacgaccgttggcggtaaccttctttactaacgaggagggggtgcgatttcagcccgatatgatgggcagcgtggtgtttgccggcgagtatccgttggcgcaggcgctcgcggcaaaagatctcgacggtatcacgctcgatgaagcgctgcgtaacattggttataaaggcgaacgtcagccgggagatatggcggtagatagctacgttgagctgcatatcgaacagggaccaattcttgataaagagcagattgatattggcgtggttaccggcgtacagggtatttcgtggcaggaatttaccctgagaggcgtatcgaatcatgcgggtactaccccaatgtccatgagacgtgatgccgggctggcggctgcgaaaatcgctgtttttgcccgtgagctggcgctaagccttggtggtaatcaggtagctaccgttggacatttcagcgtgaagcctaatctgatcaacgtcattcccaaccatgtcgtcatgtcagtggatctccgcaataccgataatgcgatcttatgtctggcggagcagcaattagccgaatttgtcgcgaaaacgtcgcaggaagagggcgtggagataaccagccgctcactggtgcgctttaatccggtcatttttgccgatgagatcgtcaatgcggtggaagccgaggcggagcgtcaggcgctcagttaccgacgtttgccaagcggcgccggacacgatgcacaatttatggcgtcggtatgtcccgccgggatgatttttgtcccctgcgtcgatggcattagccataacgtcaaagaacatagcgcagccaaagatctgattgctggcgccaatgtgctgctgcaggtggttttacagcgcgcccagcgtatggactaatgtttacaggagcagagaatgaatcagcaacagctaaagcagcagcttatcgcctggcgtcactatttgcatgcccatccggaaagcgccttcgaagagcagaatacttcacggtttattgccgaaaagctcgaagctatgggcattgaggtgcaccgcgatattggcaaaaccggggtggtggggagattgaaatgcggcgacgggaagggcgttatcgctattcgtgccgatatcgatgccattcaattgaccgaacagggagactggtcttaccgctccatgaccgccgagcggatgcacggctgcggacatgatggtcatacctgcattgcgctgggcacggcgcagttgttattgcagcggcagaattttaacggcacggtctgctttgtttttcagcctgctgaggaacctggctatggcgccagagcgatgatggacgatggcgttattgaacgctttggcatagaggaaatctacggtctgcataatatgccgggtatgaaagccgggactatcgccacgcgagtcggtggcattatggccagtgaagataactttattattcgtattaaagggcagggagcgcatgcggcgcggccgcatatggcgaaagatccgctggtcattgcggcggaaatcatcctggctttgcagacaattgtttcgcgaaatgttgatccgaacgtgccagcggtcatttcctgtactgaactgcacaccgatggcatccgcaatgcgattccgacgcacgtcgaaatcaaaggggatacgcgcagctttgcaccggaggtgcagatgctgctcgaagaacgaatgcgtaccattagcgaagcgatttgcgcgatgcacggtgcgacgtgccagttcagctatacccatgaatttgcgccaacggtgaactggcagcaatgcgttgatgtagcggtcaccgctgcgattaacgtggtaggggctgagaaggtggacggcaacgtcgcacagatgatgatttcggaagattttggcgcttttctgcaaaaaatccccggctgtttcatctttttaggcaacggcgatagttcagatgctcagggcaatacaccgttgcataatgcctgctacgactttaatgatgagatattgctaactggcgcggagtattttgccgaggtcgtcagaacccgtctgccgcaggagtgatattgattggcccgatagcagaatgccgtcgggccatgttttttagcttgcctttttaatcggcggcaggtcgaacgcttcgcgcagggcgcggacgaaggccttatcgtggcagatggttttccccgggctgtcggagagtttcgccaccggcttgccgttacattccaccagcttaatcacgatattgagcggtttaacctgcggcagatcgcaggttaatcgggtgccgatcccaaagctgagcttcacccgcgaggcgaagtggcgatacagatcgacggctttcgccaggtcgagattatcggagaagaccagcactttgctcagcggatcgatacccagcttctgataatgggcgatagctttttctccccattccaccgggtcgccggaatcgtggcgcaacccctgatagcgggtggcgaattccggaccgaaatcgcgcaggaacgcatccatagtgatgcagtcggtcagcgcgatgcccagctggtcgggatactcttccagccaggcggcaagggccgcccgctggctgctggcaaggctggggctgatctgctggtgggcctggaaccactcatgggcctgggtacccatcggggttaaattcagacggcgcgccagatcgtaattgctggtgccgacaaaccatggttcctgctgcagacgccgcacaataccttcctgcacctcgcgtgagaaacgacggcgggtgccgaagtccatcagacggaaggcgctcatgtcgaggtcagcggtcatggtggcgaagtcgcctagcttatgttccagcgtgttgagcgcctgatcgacgcccatctctggtgaacgatagcgatggaccaactcgcttatcaccgccagcagcgggacttcccacatgatggcttcccgccatgggccggtaaggcgaatgttcagcttaccattgtcattgctgaccgttacctggctcgggtcatagcgaaaatcgcgcagccagttgaggtaatcctggcgaaaaaagggaagggtggacagccagcgatattcatcatcccgcagcctcaggtcgcgcatggactccacctgctcgcggatcgcgtcggcatagatgccgagcaggtcgtctccgcggcagcgaaactccgccgccacatgcacatcgccgtagcggtggaagacagcctgctgcatgtgcagcttataggcatccgtatcaagcagcgagtgcagtacaggagaagtgaattgtgtcatggtgcgcagtagcatcctctcactggagcgttccatcgaaaccaacgcggaaaatggaggcggagtatacctttattacccgactctgtcccgcgatggcgagcaatggtgacgctgacggtcatttgcgaggcctagtttaatatattgaacatggatcacaccacaagctttgcgtcgggtcgagggcatttcgtgccgcgagtgttaacaaaatgtagcgatttccgtgtttcacgttgaaaagatgaagattctgcatagcgcgattgacacaacaggaatagactgggacgacactttaccgaagatgctaaaggttttttatgacacaacagccccaagccaaataccgccacgactatcgtgcgccggagtatctgattagcgatatcgatttgacctttgacctggatgccgcaaaaaccgttgttacggccgagagcaaggtctcccgccacgcggctgcgtctgatgtgccattgcgcctggacggcgaagatctgaccctgatcgctctgcaggtgaacggccagccgtggagtgactataaagaagaaaacaatcagctggtgatcggcggcctgccggagcatttcaccctgaccatcttcaatgagatcagcccggcggcgaacaccgcgctggaaggcctgtatcagtcaggcgaagcgctgtgcacccagtgcgaagcggaaggtttccgccatatcacctggtatctggaccgtccggatgtgctagcgcgctttaccaccaaaattatcgccgataaagcgaaatacccgttcctgctttccaacggcaaccgtatggcggaaggggagctggagaacggtcgtcactgggtacagtggcaggatccgttcccgaagccgtgctatctgtttgcgctggtggccggtgattttgacgtcctgcgcgattcattccgcacccgctctggccgcgaagtggcgctggagctgtacgtcgatcgcggcaacctcgatcgcgcgccctgggcgatgacctcgctgaaaaactctatgaagtgggatgaggagcgctttggcctcgagtacgacctcgatatctatatgattgtcgccgtcgacttctttaatatgggtgccatggagaacaaaggactcaacgtctttaactccaaatatgttctggcccgtaccgataccgccaccgataaagactacctcgatattgagcgcgtgattggtcatgaatatttccataactggaccggcaaccgcgtcacctgtcgtgactggttccagctcagcctgaaagaggggctgaccgtgttccgcgatcaggagttcagttccgacctcggctcacgggcggtgaaccgcatcaacaacgtgcgcaccatgcgcgggctgcagtttgccgaagacgccagcccgatggcgcacccgatccgtccggatatggttatcgagatgaacaacttctacaccctgacggtctatgaaaagggtgccgaagtgatccgcatgttgcacaccctgctgggtgaagaaaacttccagaaagggatgcagctgtactttgaacgccatgacggcagcgccgccacctgcgacgatttcgtgcaggcgatggaagatgcctctaacgtcgacctgtcgcacttccgcctctggtacagccagtccggtacgccaatcgtcaccgtgcatgacgactataatccggagaccgagcagtatacgttgaccatcagccagcgtacgccgccgaccgccgagcaggccgagaagcagccgctgcatatcccgtttgccattgagctgtacgataacgagggcaaggtgatccccctgcagaagggtggccacccggtacacccggtgcttaatgtgacccaggccgagcagacgtttgtcttcgataacgtttatttccagccggtgccggcgctgctgtgcgaattttcagcgcctgtgaaactggaatacaagtggagcgatcagcagctgaccttcctgatgcgtcacgcgcggaatgatttctcgcgctgggatgcggcgcagagcctgctggcgacttacatcaagctgaacgtcaaccgccatcagcaggggcagccgctgtcgctgccggtgcacgtagcggatgccttccgcgccatcctgctggatgagaagattgatccggcgctggccgctgagatcttaaccctgccgtcagccaacgaaatcgccgagatgttcgcgattatcgatccgatcgccatcgccgccgtgcgcgaagcgctcacccgcaccctggcgaacgaactggcggacgaattcctcgcggtttataacgccaataagctcgacagctatcgggtggagcacgccgatattggtaaacgtgctctgcgcaatacctgcctgcgctatctggcgtttgcggaaccgacgctgggcgataagctggtggcgacgcagtatcaccaggcagataacatgaccgacgcgctggccgccctgtcggcggcggttgccgctgagttgccgtgccgcgatgcgctgatgcaggagtacgatgacaaatggcatcaggacggtctggtgatggataagtggtttatcctgcagtccaccagcccggcagccaacgtggtggaaaccgtgcgcggtctgctgaaccaccgttcgttcagcatgagcaacccgaaccgtgtgcgctcgttaatcggcgctttcgccagcagcaacccggcggcgttccatgctgaagatggcagcggctatcagttcctggtggagatgctgaccgagcttaaccagcgtaacccgcaggtggcgtcgcgcctgattgagccgttgattcgtctgaagcgttatgatgagaagcgacaggcgctgatgcgcgccgcgctggagcagctgaaggggctggagaatctctctggcgacctgttcgagaaaatcagtaaggcgctggcgtaacggtggcataaccccggattgcggcgcgccttgcgccctgtccgggttacccgttagcgtggtgatgttgtcgggcggcgcgatgcttacccgacctggaatacacggctgatttggcgttggtagcccggctgtgcaacgcgcgagccggggacatgtcggatgacgatatgcccccgttcagacagcagacagttacgccggtcagccatgactaaacaaacgcggcgcacgctcgctgtcgccgcgtttcatcacccgatccagtacttcagcctccagctcggccagcttcgccgaaccggtgcgccgcggtcgcgggatatccacgcttaaatcgaggccaatcttcttctcttcaattaacagcacccgatcggccatggccaccgcttcactgacgtcgtgcgtgaccagcaggaccgtaaagccatgctcctgccacagggagacgatcagctcctgcatctccagacgggtgagggcatccagcgcccccagcggttcgtccagcagcagcaggcgcgggcgatggatcagcgcgcgggccagcgcaacgcgctgcttctgcccacccgacagcgcggccggccactcctgtgcgcggctttcaagtccgacgctggccaacgcctgcagggcggcgtcgcgccaggcgccttttaaccccagccccacgttatcaatcactgttttccacggcagcaggcgcgcatcctgaaacatcatccgggtgtcgtcctggatcgccgccaggggcgtcgcgccagccagcagttcgccggcgtttggtttttccagacctgccaacaggcgcagcagggtacttttgccgccgccgctgcggcctaccaccgccacaaactggccgctgggaatatgcagatccagctcgttaagaatggtgttgtcgccatagcgtttcgtcaccccgttcagcagcagcgggatacctgggttgagacgggcagtgttcatgcgttagcctcctgaagatgatacgccggattccagcgcagccagagccgttccagcagctgggcgcagacgtcggccagtttgccaaggatggcgtaaagaatgatcgccactaccaccacgtcggtttgcagaaattcacgcgcgttcatcgccagataaccgatgccggcattcgccgagatagtttcggcgacaataagcgtcagccacatcagaccaagggcaaaacgcacgccgaccataactgagggcagggcgccgggtaatatcacgtgacggaacagggcgaagccggataagccatagctgcgcgccatctcaaccagcccacggtcaatattgcggatcccgtgccaggtgttgatatagatcgggaacagggtgcccagcgagacaaggaagatcttggcggtctcatcgatgccgaaccacaagatcaccagcgggatcagcgccagatgcgggacattgcgcagcatctggatcgaggtatccagcagacgctcgccccagcgagacaggccgctgatcaggccgagtattagcccgatcgagccgccgatggcgaagccgaccagcgcccgccatgagctgatggccagatgctgccacagctcaccgctggccgagagggtccagaacgctttcaataccccctccggcgagggcagcacccgcgtcgacagccagccgacggacgaggccagctgccagacaatgaccgtccctaccggcagcagccagggggcgaggcgtaacaacaggggatgggttgattttgccatcacggtctcctcagctttgcgctactttacgcggaataaactcgttggcgaccgcttccccctgcaggcgcaggctttgcggctgcgggatggacggcaccgcgacgtcaagcagggggaacagaagctctccgacccggtacgcctcttccagatgcggatagccggaaaagataaagctatcgatacccagcgcggcgtattcattgatccgttcggcaacggtggcggcatcgcccaccagcgcggtcccggcgccgccgcgcgctaaacccccgccagcccacaggttggggctgatttccagcttatcgcgtcgcccgttgtgcagggccgccatcctttgctggccgacggagtcggttctggcgaaagccgcctgggcgcgggcgatcgtctcgtcgtcaagatgggagataaggctgtccgccgcctgccacgcttcctcgttggtttccctgacgatcacgtgcagacggatgccaaaacgcacctggcgaccatgccgggcggctttctctcgcacctgagctattttctctgccacctgggccggcggttctccccaggtaagataaagatcgacctgctcagcggccagctcctgcgccacctcagacgagccgccgaaatagaggggtggacgcggctgctgcagtggcggaaacagcagtttggcgtcgcgaacgcgctgatgcttgccgttaaaggtgacggtttctccctccatcagcttgcgccagatgtgggtaaattcagccgaggcctcatagcgctcggtgtggtcgaggaagacgccgtcgcctgccagttcggcaggatcgctgccggtgaccagattgaacagcgcccggccgtttgacagccggtccagggtcgccgcctgacgcgcggcaaccgtcggcgataccacgcttggcctgagggcgacaaggaatttcagccgctgcgtcaccgggatcattgaggccgcgaccagccacgcatcctcacaagagcgtccggtcgggatcagcacgccggtgaagcccagccgatccgccgtctgcgcgatttgctgcagatagccataatcgaccggacgggcaccctcttcggtacccagataacgaccatcaccatgggtcggtaaaaaccagaacatattcagactcatgatttcgctccttgtgtggcggtgggctgccagatgcgggcccggatatcaactttttttggcaccagcttgttctcgtagaacaggtctgccgtctgctgctggcgagcggcggtttcggcgctcaccggggtaaccgcggtggggggacgatggtccagatagctggcgatcaccgcctccggtaagcccatcgttttcgccagcagcgtaatgctttgcgcgcgttggctgtgggtcagggcatcggcctgagtaaaggtgtcgagtacgccttcaatgaaagcgccattgcgttcagcgtagggccgggaagcaagatagaaggatcccgtctgtttcagatcggttccgtcagtgagtacccgggcgccgccctgcagcagcgcggcggagtagtacggatcccagatggcccatgcgtcgacattgccctgctggaaggcggcgcgcgcatcggcgggggcaaggtaaaccggctgaatatcgctaaatttcagacctgcgagctgcagggcgcgcagcagcagattgtgggagctggagcctttctgaaaagcgacctttttcccttttaactcagcaacgttatgaatcgggctgccctgcgccaccaggatcacctccgccttgggcttgggcggctccgcgccgatatagaccaaatcggcgcctgccgcctgggcaaagataggcggaatatcgccggtactgccgatatcaatgctgccgacgttcagcgcctccagcatctgcggaccggccgggaactcaatccacgagatatgggtttgcggatagcgctgctccagcagctgatggctcttcgccagcaccatgctgacgctgcctttctggtagccgatgcgcagagcgtcaggcgccgccggggcggcgtgacccagcgtagagaatagcagcagtccgcccagagtcagggcgcggagaggattaagcatgctccaccccacgcagagatgttaacgacggcgcacggctgctggggcgatgcagcgcctgccagaaggtctccagggcgtcatcaaggcgccgctgcagattcgcggtaaactgcggcttatgctggtaatcggtcacctggctgtcatcagcgaagacgccatggaggatctcctgggccttgagggcattcagcactggcttcagcgcgtagtccaccgccagcatgtgagcgatggtgccgccggtggccagcggcagcacaattttgccctctagcgctcgctcaggcagcaggtcgagcagcgttttcagcgcgccggagaacgaggctttatacaccggcgtggcgatgatcaggccatcagccccggccagctgttcattgagcgtctgcagcgccgggttgtcaaaacgagcgtacaggaggtcttccggggcaaagttctgcagatgccagtggcagacttcgatatcggcggcggtgagcgtctctctggcgtattccagcaaggcactggaacgggaagggtaacgcgggctgcccgcaagcgtaatgacgcgcatctctctctccttataactaaatgtttgcatttatctataattgataacatttatagtgagtgtgacagagggccattatttccctaaatgatttatccgcggttagatagccgaaaagcgcataatggcgcgcggggtaggtaatcgtttgcgctgatgggggattttttgtcgcaggtcaattccctttccgcaacagatcgcacataatacgcccccggtttgcacaccgggaatccaggagagttcatgtactaccccttcgttcgtaaagccctttttcagctcgatcctgagcgcgctcatgaagttacctttcaacaattacgccgtgtcaccgggacgccgctggaaatgctggttcgccagaaggtaccggccaggcctgtcacctgcatggggctaacctttaaaaacccgctgggtctggcggccgggctggataaaaatggggaatgcattgacgcgctgggcgcgatggggtttggttcgattgagatcggcaccgtgacgccgcgtccgcagccgggcaacgataagccaaggatcttccgtctggttgatgccgagggattgatcaaccgcatgggctttaataaccatggcgtcgataacctggttgagaacgtgaaaaaggcgcattttgacggcgtgctgggtatcaatatcggcaaaaataaagatacgccggttgagcacgggaaagatgattacctgatttgtatggaaaaagtctatccgtacgccgggtatatcgccattaatatctcctcgccgaataccccagggctgcgcacgctgcaatacggcgaagcgctggatgatttactctccggtattaaaaataagcagctcgagctgcagcagaagcatcaaaaatatgtcccggtcgccgtaaagatcgcgccggatcttttgcctgaggaattgatccaggttgccgatagcctcgtgcgtcataatattgatggcgtgattgcaaccaataccaccctcgatcgttccctggttcagggaatgaaacattgcgatgagaccggcgggcttagcggtcgtccattacaattaaaaagcactgaaattatccgtatgctctccgctgagctgaatggccgtttgcctatcatcggcgtgggcggcattgattcggtgattgccgcgcgggaaaagattgccgccggggcatcgctggtgcagatctattctggatttatttttaaaggtccgccgctgattaaagaaattgttacccacatctaatcttttcctcctctgaatcccacccagggctttatttccggccctggttgttttatattccctcactgttgcttatttaaacattttagacttttcttaattttagaaaatattctgcggtaagtcgcaacaactttgcagaggcgtatgaaaggggacagggggaaaaatgcggattaaacctgacgataactggcgttggtattacgatgaagagcacgaccgcatgatgctcgatctggccaatggcatgttatttcgctcgcgcttcgcccggcgcatgctgactccggatgcctttgccccttcgggattttgcgttgatgacgccgcgctctatttctcttttgaagaaaaatgtcgcgatctcgagctatcgaaagagcagcgggcggaattagtccttaacgcgctcaccgccatccgttttctcaaaccgcagatgccgaaaagctggcactttatcgcccatacccatcactggcagccgagcggcggcgacgccgcctgcgtttggctgagcgataccggcgagcaggtgaatttactggtggtggagccgggcgataacgccgcgctctgtctgttggctcagccgggtctcacccttgccggccgcgtcatgcagctgggcgatgtcattaaaatcatgaatgacagactgcagccggcgcagagcgcggtcagctacagtctggggcaggcggtttaaggcgccaggcgtagcgctgttttcggtacacagctgcaggcgagaatagtgccatccccggcaaccgcgtttttctttaacggactcacttctccctcttccagccggatgcggcagctgccgcagatccccgcccgacacgaatagggtacgcgaatgccctgttgttccagttgctccagcagcacctgctggttattgccggtaaactgttgaccctgccattcgatggcaaccgtagcctgctgctgcgcctcgggagccggggtatcgtcgctttcacctgccccgtaggctttcgccgggccgcgggtaaggatttccccttcatctcccacccggatcaccccgctgttgcgggcaatcaggttctggccaaaatcgacatcgccattgtccagcgcggtacgaaaacgctttaaggtttccagcggctccccggcgggatgcttctgaccgcgctccgggctgacggtggtaaaaatgcagcggctgcacggcttagcgacatcaaacaccacctcgccgatgcggatcactttccagctatcttcatcccaggccgccgcgccggtgaccacaaggttagggcgaaactgttctatgcttacgctggccgggcagcgctgttgcagatcgcgcagggaggcctcgttagccagcaggtaagggtagccgtcggcgaaggagagcggcaccgcatcatggcgctttacccggcgggttagctgcggccccagccagcgcagctggacatcgcgcttgaaaaagccgctgagccactggttaacggcggcgggcgcgatgagggcggtaaaatggttgccccagacttcggtcggctcggcctgcgtggcgaaatcgctaaaacgcaccacggcgctgctgccgtccggtgcggtcaggtgaaggccatcatgcagcggcgccggaataaatttcaccatttgcggaaactggcgagcggtaataaaggtcccgtcggtttcggtgaccataaacaggcgatcgaaggccaggccgctgatatcagcaaaggcgtgggtcaggcccatgccgcgcatggatttaacaggatgaataaaaagtcgcgatagcgttaccatacgctgcctccgggttccaaaaataagcctataactttatgacatagggcacatattggctataatgcgcaccaattttctttaagtaaaagtgacgatatgaattctctgtttgccagtacggctcgtgggctggaagagctgttaaaaactgaactggaagggcttggcgcgacggactgccaggtagtccagggcggggtccattttcagggggatacgcgcctgctgtatcaaagcctgatgtggagccggctggcttcgcgcatcatgctgccgctgggcgaatgtcgcgtatacagcgatctggatctgtacctcggcgtacaggccattccgtggacggagatgtttaaccctggcgccaccttcgcggtgcattttagcggcctcaatgacgagatccgtaacagccagtacggcgcgctgaaggttaaagacgccattgtcgacagcttcacccgtaagaatctaccgcgcccgaacgtcgatcgtgagtcgcccgatctgcggatcaacgtctggctgaacaaagagacggcgcacatctcgctggatctgagcggcgaaggcctgcacctgcgcggctatcgcgatggtaccggaatggcgccgatcaaagaaaacctcgcggcggcgatcgtcatgcgctctggctgggtaccgggtacgccgctgctcgatccgatgtgcggctccggtaccctgctgattgaagcggcgatgctggcgaccgaccgcgcgccgggcctgcaccgcggccactggggctttggcggctgggcgcagcacgatgacgccatctggaaagaggtgaaggcggaagcgcaaacccgcgctcgtcagggattggcagcgtatgagtcacgcttctacggctcagacgtcgacgcgcgcgtaatcgagcgcgcgcgccgcaacgcccgccgcgccggcattggcgagctgatcgattttgacgtgaaagacgtcgcccaactgaacaacccgctgccgaaaggcccgtacgggacggtgatcagtaacccgccgtacggcgaacgtctggaaagcgagccagcgctgatcgctctgcacagcctgcttggccggataatgaaaagtcagttcggcggctggaacctgtcggtattcagcgcttcgccggagctgctgagttgcctgcagctgcgtgccgacaagcagtttaaagccaagaacggcccgctggactgcgtgcagaagaattatcacctggcggagagcgaaagcggcaagccggcgatgctggcggaggattttgctaaccgtctgcgtaaaaacctgaagaagtttgaaaaatgggcccgccaggaaggaatcgaatgctatcgcctgtacgatgctgatctaccggaatacaacgtggccattgaccgctatgccgactgggtggtggtccaggagtatgccccgccgaaaaccgtcgacgcgcataaggcgcgccagcgtctgttcgacatcatcgctgcgactatcgccgtactggacatggcgcctaacaagctggtgctgaaaacccgtgaacggcagaaggggaaaaaccagtatcagaagatggcggagaagggcgactttattgaggtacaggagtataacgcgcgcctgtgggtcaacctcaccgactacctggataccggtctgttcctcgaccaccgtatcgcccgtcgcatgctcggccagatgagtaaaggtaaggacttcctgaacctgttctcctataccggcagcgccagcgtccacgcaggcctcggcggtgcgcgatccaccaccacggtggatatgtcacgcacctacctggagtgggcggaacgcaacctgcgtctcaatggcctgaccggccgcgcgcatcgcctgatgcaggcggacgtgctgggttggctgcgggagagcaccgagcagttcgatctgatctttatcgatccgccgaccttttccaactccaaacgaatggaagatgcgtttgacgtccagcgcgatcacattcgcctgatgaccgatctaaaacgtctgctgcgtaaaggcggcaccattatgttctcgaataacaaacgcggtttccgtatggatcatgacgggctggcggcgcttggcctgaaggcgcaagagatttcgcaaaaaacgctgtcgcaggattttgcccgcaaccgtcagatccacaactgctggctgattaccgcagcctgaaaggaataaataatgtcactgattagtatgcacggcgcctggctttccttcagcgatgcgccgctgctggataatgccgagctgcatattgaagataacgaacgcgtctgcctcgtcggacgcaacggcgccggtaaatctaccctgatgaagatcctcaaccgcgcacaggggctggatgacggacgcatcatttatgaacaggacctgatcgtggcgcgtctgcagcaggatccgccgcggaacgttgctggtacggtgtacgattttgtcgccgaagggatcgccgagcaggcggcttatctgaaagcctaccatgacgtgtcgcatcaggtgatgaccgatccgagcgacaaaaatttaaatgaactggcgcgcctgcaggagcagctcgataacctgggactatggcagctggacagccgcattaacgaagtgattgagcagctgggccttgacgccaatgcgcagctggcgtcgctgtccggtggctggctacgtaaagcggcgctgggccgcgccctggtcagtgggccgcgcgtgctgctgctggatgagcccactaaccacctcgatatcgaaaccatcgactggctggaaggtttcctgaaaacctttaaaggcacgattatctttatttcgcatgaccgttcctttatccgcaatatggcgacgcgcattgtcgacctcgatcgtggcaagctggtgacctatccgggaaattacgatcagtatctcctcgataaagaagaagccctgcgggtcgaagaactgcagaatgcagaatttgaccgcaagctggcccaggaagaggtgtggatccgtcagggtatcaaagcgcgccggacccgtaacgaaggccgagtccgcgcgctgaaggcgatgcgccgcgagcgcggtgagcgtcgggaagtgatgggcagcgcgaagatgcaggttgaggaggcttcccgttccggcaaaatcgtctttgagatggaaaacgtcaactatcaggttgacggcaaagtgctggtgaaggatttctccgcacagatccagcgcggcgacaagatcgccctgatcggccccaacggctgcgggaaaaccacgttgctgaagctgatgctcggccagctgcaggccgacagcgggcggatccatgttggcaccaagctggaggtcgcctacttcgaccagcaccgcgcggagttggatccggataaaacggtgatggacaacctggcggaaggcaaacaggaggtaatggttaacggtaaaccacgccatgtgctgggttatctacaggacttcctgttccatccaaaacgagcgatgaccccggtacgtgcgctttccggaggggaacgtaaccgcctgctgctggcccggctgttcctgaaacccagcaatctgctgatccttgatgaaccgactaacgacctcgatgttgaaacgctggagctgctggaagagctgatcgatggctatcaggggaccgtgatgctggtgagccacgatcgtcagtttgtcgacaataccgtgaccgagtgctggatcttcgaaggcggcggtcgtattggccagtacgtcggcggctatcacgacgcccgcggtcagcaggcccagtctttggcgcaaaagcagacggtcgttaaaaaaacgacggaagtcgctcagccaaaagcagaaactgtcaaacgcggcgggaacaaactaagctataacctgcagcgcgagctggaacaactgccgcagaagctggaggctctcgaggccgaactgcagacgctgcaggatcaggttgccgatcccgatttcttcgggcaaccgcacgatcgcacgcagcaggtgctggcgcagctggccgaagcggagcaggcgctggaagcggcctttgaacgctgggaatatctcgaaggattaaagaacggcgcctgagccgaggagttgtcatgtgcgatcatcatcatgctgcgcgacatattctatgtccccaatgtgatttgctggtggctttgccgcagcttgagcatcgccagaaagccgcctgcccgcgctgcggtacaacgttaaccaccacgtgggacgcgcctcgccagcgtcccacggcgtatgcgctggtcgcgctgtttatgctgctgctggccaacctgttcccttttatctatatgaaagtgggcggcatcagtagcgaaatagagctgctggaaattcccaacgtactgtttaccgaggattacgccagtctcgggactttctttttactctttgttcaattagtgccggcgttttgcctggtcaccattttgctgctggttaatcgggtcagaatgcctgccggcctgaagacgttccttgcgcgaattctctttcaactgaaaacctggggcatggcggagatctttcttgccggcgtgctggtgagcttcgtcaagctgatggcctacggtgatatcggcatcggtctgagctttgttccctggtgtatgttttgcctgctgcagttacgtacttttcagtgcgtcgaccgccgctggctatgggatgatattgcccccatgccggccattacccagccgctgaaggtcggggtgaccggtatccgtcaggggctgcgctcctgtgcctgctgtacggcggtgttgccggtcgatcagaccgtctgcccgcgctgtaacagtaaaggaacggcgcggcgcaaaaatagcctgcagtggacgctggcgctgctggtgacgtcatttatcctttatctccctgccaacattatgccgatcatgatcaccgatctgctgggcgataaaatgccatcgaccattatggccggggtgattttactgtggagcgaaggttcttatccggtggcgctggtgatctttatcgccagtattatggtgccgacgctgaagatgatcgctatcgcctggttatgctggaacgccaacggcaacggcgcgcgagattcggagcgcatgcatctgatctatgaggtggtggaatttgttggccgctggtcaatgattgacgtttttgtcatcgccgtgctctctgcgctggtccgcatgggagggttaatgaatatctatccagccatcggcgcggtcatgtttgcgctggtggtggtgatgaccatgttttcagccatgacatttgatccccgtttactgtgggatcgtgagccagattcaagccatgaggaaatacaacaacatggaaaataagagcggagaagcgaaagtgcagaaggtgaagaactggtcaccggtgtggatcttccctatcgtcactgcgctgatcggggcatggatcctgttttatcattacagccatcaggggcctgaggtcacgctgatcaccaccaatgcggaagggattgaagggggaaaaacccggatcaagagccgcagcgtagacgttggggtggtggagagcgcaacgctgaccgacgatctcacccacgtggaaatcaaagcccgcctcaattccgggatgcagaagctgctgcacaacgattccgtcttctgggtggtaaagccgcaggttgggcgcgaggggatcagcggtcttgggacattgttgtccggggcctatattgaactgcagccgggaacgaaaggttcggtgccagcgcagtatccgctactggattctccgccgctggcctcgccggatgccaaggggatccgtattctgctggaaagcagcaaggcgggccagctgtcgccgggcgatccggtgttgttccgcggctatcgcgtggggtcagtggaaaccagcaccttcgacacgcagaaacgtcgtataacttaccagctgttcatcaatgcgccgaacgatcgcctggtgaccaccaacgttcgtttctggaaggacagcgggatcgctgtagatttgacctcggcggggatgcgcgtcgagatgggctcgctgtcgacgctgtttggcggcggggtgagcttcgatattcctgaaggactggacctcggcgagccggtggcgaataaaacggaataccatctgtttgacgatcaaaagagcattcaggattcagtctttaccgagcatatcgattacgtcatgttcttcaaagactcggttcgcggcctgcagccgggcgcgccggtggagttccgcggtatccgtctgggcaccgtcggcaaagtgccgttctttattccggggctgaagcagcgtttgaacgatgactatcgtattccagtggaagtgcgggttgaaccgcaacggctgattaatcagcttggcggcgatccgaatattcgcgcccacattgacgatctgatcaaccgcggactgcgcggctcgctgaaaaccggtaacctggtgaccggcgcgctgtatatcgatctcgacttctatccgaaggcgcccccgcgcgggaaaatacaggagtttaacggctatccgattatcccgaccatcagcggtggactggcacagatccagcagcgtctgatggatgcgctggataagattaataacctgccgattaatccgctgctggagcaggcgaccagtaccctggcgcagagcgagaagacgatgcagcacgtgcagaccacgctggataatctgaataagatcacctccagccagtcaatgcagcagctgcccgccgatatgcagacgacgctgcgtgagctgaaccgtagcatgcagggcttccagcctggctctgcggcctacaataagatggtggccgatatgcagcgtctggatcaggtgctgcgtgagctgcagccggttctgaaaacgctaaatgataagagcaatgcgctggtatttgaggcgaaggataaaaaagatccacagccgaagggagcgaaacaatgaaaaaatggttactggcggcagccgtatgcgtactgacggcgtgcagtagcggcggggaaagcaagacatactatcagctaccggttgtgcagggcggcgcgcagagcgacgccagtcagggggcacgtctgctgtgggtagagcaggtcagcatcccggattatctggcgggtaacggggtggtctatcagaccaccgacgtgcagtatgtgatcgccaataataatctgtgggccagtccgctggatcagcagctgcgcactacgctgctggcaaatctcagccagcagttgcccggctgggtagtgtcgtcccagccgctggggagcgagcaggataccctcaacgttgcggtcaatggctttcatggtcgctatgacgggcgggttatcgttagcggtgagtggctgctgaagcatcagggacagctgattaagcgcccgtttaacatcgtcctcaggcaggaacaggatggttatgacgcgatggtcaagaccctggcgcaggcgtggagccaggaggcggctgccattgccagcgagcttaatcgtctgccataagtaaaattcatcataatgacctgccgcgcggttcacctgggccgcgcggcatttttttttgccaggtcagtttgttaccggcggctacgccgagcgaacaaaaaatgaactcttatataggtcacaaatatgacactggcgtgaattttgcgcattgacgttgccttcttttcgcggtattcgtaacccgtggctgcacaatttgcgaccactgttttcttttccaccagatcaaagaatgagggaaacgaggcatgaagagacaaaaacgagatcgcctggaacgggcacaccaacgcggatatcaggcgggtatcgcgggaagatcgaaagaaatgtgtccataccagagcctgaatcaacgctcatggtggctgggaggctggcgagaagccatggaggacagggtactaacggcctgacactgtctctttaaaaaagaagcctccgcatagcgggggcttcgccttttaatcgctgctgaatgttatcagaaagcggaagtatcctggaacagacccactttcagatcgttcgcggtgtagatcagacgatcgtcaaccagcacttcaccatccgcaagtcccataatcagacgacggttaacaatgcgcttgaagtggatacggtaggtgacttttttcgcggtcggcagaacctgaccggtaaatttcacttcgccaacgcccagcgcgcggcctttgccttcgccgcccagccagccaagatagaacccgaccagctgccacatagcatccaggcccaggcagcccggcatcaccggatcgccgataaagtggcaaccgaagaaccacaggtcaggattgatgtcgagttctgcctcaacataacctttatcgtagttaccaccggtttcggtcattttgatgacgcggtccatcatcagcatgtttggtgccggtaactgcgggcctttcgcgccgaacagttcaccacgaccagaggcaagaagatcttcttttgtataggattcgcgtttatctaccatgttttcagtaagccttattttaagttcgggacgcaggatagctaacacgtgtaagctgaacaagtccgatcagttagaacttgtcccacctaaccagcgtagcggccacggaaaacgatggcgagtctcttgctgggtcgcctgcgctatccgctcctgaatggtttgtcgcagcgtctgtccttcaccgtcccacatcagctgggtcaacatcggcagcgcttcggtaatatcgtcaatggcccagatagcaaactggttgtcggcaacggcctgacgtagctcgtggctcaggctgagatgacgaacgttggcggcagggataatcactccctgtttgccggttaaaccgcgctgctgacagatagtgaagaagccttcaattttctcgttcaggccgccgaccggctgcacgcgaccaaactggtcgacggagccggtgatcgcgatgctctgatttatcggtacgttggccagggcgctgattaaggcgcagagttccgccatggaggcgctgtcgccatccacttcactgtaggactgctcaaaggtcagcgaagcagtgaagggaagctgctgctccagctccagctcggacatcagaaaagcctgcatgatcatcatgcctttcgcatgaatgttaccgcccagctcggctttacgttcgacgtcgataaattcgccatcgccaatgtgcacgacgcagctgatgcgtgaaggttcaccgaacgcgcgtggatgaccggggaattcgatcaccgacagggcgttgatctgcccgacgcattcgccttcggtttcaatcaggatctgttcctgcaggatttcatcctgcatacgctccgccaggtagccttcacgccatacccggcgcgccagcatggtctgcatcgcttcgccggtaatctcctcgccttcgcagaaggcggcagcctcccgcagctggcgggttatccatagcggactgagcggcagggtctcctgatcgccggtatagcgcgttccctcatcgatcagcagaggccaggcatcggctgccgggcccggcagctccagctgctgcgcattctgccatacccactggcaccaggcctttagcgtgtcggcgtcagcaaactgcagagtgtcttcatactcgctatagatcgcctgcgcagccagctccggctccatttcctggaaatcggccagcgattcgcgttcgcccaccaggatgattttcagactcagcggcatggagggaatgctgaccggcagcggacgcgattcatccatagaaagccagtcaaagcgctgacgagtcaccatatttttcagacgcacccacagcagcggttgcgccagcagtgtacgtagcgaaagcacaagcacgccgccgttggcctgatggaccagcccaggctggagggtgattgcaccgttaaactggcgtacgcagccaaacagctgttccgcttctacccaatcggccatcacgaccggggcagtgctggcgaaattatcctcagcgccctgcgccggtgcgagcgtcacctgagcgtcggttacctcatagcggacgccgtaaagcggtgcggcaggctcgtgcagagtccgggtttcagccgccagccattgcagatattccggctcttcaggggctttcaccagcatgaaggaggagactgccggcgtgtacagcagctgctcaagcccatagaacaaacgcggctgcagatcgcccgagagggagggggccggatgggaaagttcagcttgagcaaacagcgcctggtaagcttccagatcaggcgcaaggtcggttcgggtcagtttcgtaatggtcaaagtcgctgttttttagttagatgtaaagcgcgcaattatacctgatgccgcgaccgagcacacggaggattatggttaccctgattattacccggtcgcagacttcacgaataatgatttatattcagcacatcagaaaaaaactgatatcctgaaatgagttacacggtcacattgagatcgcaatgaaatatcaacaactggaaaatcttgaaagcggctggaaatggaaatatctggtaaagaagcaccgggaaggtgagctgattacccgctacattgaggccagcgctgcgcaagctgcggtagatgacttgctgacgctcgagaatgaacctgtgctggtgcatgcctggattgagcagcatatgaatccggcgctgatgaaccgcatgaagcagactatccgcgcgcgacggaaacgtcattttaacgctgagcatcagcatacgcgtaagaagtctatcgaccttgagtttgtcgtttggcagcgtcttgctggcctggcgcagcggcggggcaaaaccttgtctgaaaccatcgtccagctgattgaagatgccgagcacaaagagaaatatgccagcaaaatgtcgagcctgaagcacgatctgcaggtactgttagggaaagaatagccaggtaggatcgtcgacccgcctgctggtggttgccctggccgggggctgcttcacagctctcagccgctaaagtgggcgagagggcataaaaaaaacccgccgaagcgggtttttttatcggttataacttaagccgccggctgagttacaacttctttgtagcctttaacttcgatctctacacgacgatccggagccaggcaatcgatcagggcagcgcgagctttcacgttgtcacaggtgttgccagtaaccgggttggattcacccatgccgcgagcggagattttgccagccgggatgcctttagcaaccaggtagtcaacaacggactgagcacgtttctcagacagctgctggttgtaagcttcggaaccgatgcggtcggtgtagcccagaacaacagcggaaccgtctttcggatccatgttgctcagctgagtgtacagctgatccagagcctgctgaccttccggtttcagggtagctttgttgaagttgaacagaacgtcagacttcagggtgaagtgcttggtagccacttccggagccggagccggagccggagcaacaaccggtgcagcatcttcctgaccgaagcggtaggaaacgcccaggctcagcatgccgttatcaggacgggtacccacggtgcccgcgtcgccgatgttgttaacccactggtattccagacgggtagcgatgtcacgagtaacagcccactctacgccgccagcaaatactggggaaacgccagtgtcgtgttcgctacgggaaacgccggtagaagcgtagttgcctttggagtcagcgcgccaaaccatgccgcccagacgggtgtagatgtccagatcgtcagtgatcgggtaacccagtttagcggtcagctgaacgccctgagctttgaaagcaccgttgtcaacgctgcctttatatgccatacggcccagccagtcataacccatttcgaaaccgaggtacgggttaacctggtaaccaccgaacgcaccagcaccaagctgatcgttacgggtcggaccgttgttgttctggaaaccgttaccgtagaaaccggtgtcgtgatactgggaccaacccagtttaccacctgcataccaggtgttatctttcggagcggcctgcgctacggtagcgaagccagccagtgccactgcaatcgcgatagctgtctttttcattttttgcgcctcattatcatccaaaattcgccatgaagttacaaaagacctcacggttaaatccttcaccgggggcgtgacttgttgttaactatgctgatacatgcagcgtaagccgatcacccctggcgatgtaaagtctacaacttagttcgaaacttacaagtgtgaactctgtcaggcatatgaaaaaaaagggttgtgtacacaatatttaacaaatatggttgattttcgtacacgaaaaaaagacagaaatccccgtgtggcaggcattccgcgaaaaagaccataaaaaacgctgtacctttcccagcggtaaaaaaaattccaggaataatcctaatttcactcaatgatacaaatttgagtgaatttttagcccgctgagttgtctgccgagcgtgccctgatttcgcaccgggcgcatgatgaatcccatcgcggaccctacctgggcagcgttaacgagacgttcgtgttcgtcagcggttaactcctccgccagccagcagataaccacactataattacctgtgcgcagggcacggatcattgagtctatggtatggctgggagagagctggctaatttgcatgaccttggacagcggcagaccggcggactgaacccattcgcggctgagcttttgttgcggcgtgagccacagctgccagcgcgactgttgacccagctgctgtaataaaggtagcagcaataactgcgtcatcatgggttgatcttcacgatagacaatttcactgatcagcccattggtgttctgttcgccagaacgatgagcgtagtggcctgccggagcagaagcctgtgctgaacggtttgcgtgagctgaagtaaacatagtctatcccgcctttagttactgtatgcatatacagtatcttcgccaggggaaaagatcaaccgcaatttgccattttgctgccgggaatttaatcgcttctcgtggttccttatctgtcaaaagaagcccctgcattatccaatccttaacgcgcgctaatggtttcatttctccctgtcgattgctgcaacgcttgcgattttctgaaagcgtctcgcaaaaccgcattctggtgaaaaagtcggcgaaaatcatcttgctgctgcccgggaagtcccttatgttttctcttagcggatccgttaacaacttaagtttaattacatgattaacaaaggaatgatcatgagaaaactagtttgtccgcggctcccgcaatttcaggcctgcgtctcaccgctgggtcaactgcatactcgtccgctctttggcggctacagcctggctattgatgatacggtgtttgcgatggtggccgaggggaacatttatctgaaggcctgcgagcagagcgctgcttatcgggtggaacatcgtaatcctctgttaacgctgcgccgacacggccgcatagtgccgctgaagtattatcaaattgacgacactttatggcgcgatgagcagcagctttttcggctatcgctactgtcgtggcagagtgcgcagcgcgaaaagaactaccgacgggcgtcgggccgcctgaaggatttacctaatatcagctttcatatggaattgcagctgattcacgcgggcataccggacgttaggacgttgcgggaagttggtgcgcaggaggcatggttgaggctacgcgtaaataatgcttctttatcgctgagcgtattgctggcgctggagggggcgattgccggggtacatgccgccgcgctcccgacgccacggcgtcaggagcttctcgaatgggcggctacccggtagcggaaaagccttgttattcggtttgggcgtggacccgttgctgcaggcggcagatttcaggcagcagcgccagcagcaggccaatctgctgtaagaccaagggttccttactgtccgcgcgcggttccagatgatggatccggctttgcaggctgttcaaagcctgttgcacccgctgttcatccgcgggggtatggtgcaaggcgtcatccacataacagactgcatcatccagcagggcgaggatttccggcgtggacagtttttcccgatgcgcgccaagagcggagatgtagctggtgaacgtgtggttaaggcatagcagacgaaaggcggtttctcgctgggtggcatccgcgcgtggttcagtcgataagttcgagacgacggaggccagctcagcatcacggttgtaggcgtcacgacgcgcgacacggtaggccagccggttgtcgcggccctgatgatactgctccagaatcgcgtccagatagcggcagttcgcgttcattgcccggtccagcacccgcggcaggttgcggaatttccagtccggccagatgaagctgacagctgcccaggcgatggcgcagccgatcagcgtatcaatgatacgcggcagcgcgacttcaaagccctcgccaagcaggttaaagcacagcagcaccagcagcgtaataaacatcgtggcatgggcgtactgcacgttacggaaggcaaaaaacagcacgccggtcaggacgatcaacagcagttgtccttcaacagagggaaccagcagcaggaccggcaggccgatcgccaccccaaccagcgtgccgataatcctcagcgccaggcgatggcgggtggcgttatagttcggctgacagacgaacaggctggttagcaggatccagtagccatgctggagtccggtaaactggataaaggcatagccggcgcagagcaccaacgacatacgtactgcgtggcggaaaagggccgactctggcgacatattgcgctgcaggcgcagccagatatcgctcagaccgccaagtctgtcgtcggccagcagcgtctcggtattactcccggcaggcgcggtggtttgcaccgattcaatggtggccagctgagcatcgatagcgcgcaggttattcagtaaataccctagggcgttgagctgctcgtcggatgcgccgccggcgcgcacgcgctcaagtgccgcatcgagatgcatgaacgcccgttcaaaatgggcatcatgctgatagggttcgcgtaacagaatcgcccgcgacagtttctggcaggcctgcgcctgcatcgaaagcattcgctggaaacggaacatcacatcgctatagcgaaattgatcgcgtagggtttgatactgaatatgcgatgagctggcgcgttcatgaatatcctgggccacaaagtagtactgcagggtgcggcgggtgccgcgctggccccgatcgcctcgcagtcgggttagcagcgagaccttggtttggttaagcgtagctaccagctggccattagcgagcgccagatcgtacagcggcgcctggctctcatcctcaaggtcaggatcaaacagccgggatttgagctcaagatagcgggccagttgctcatagctacgcgccaggttgtcctgcaatggacgaatcggaaagatcaggtgcccggacagcgtcagcaggttgtaccacacggcccccgccagcaggaacaacggctgcagataccaatgatcgtacagcgtgacgccgagcatggtgtagatggcgataagcagggcgccgaaggcaatggtcgcatagcgctgaccgaggccgccaagcaaaataaagccgatggtagacacggttaaaccaagggcaaacagcggcggccacggaaacagcagctccacggaggcggaggcgataaaaaagcaaaccagagtaatggcaagattacgcagacggccagccagacggtcgtcaaggtcggtcagagccgcagccacgacgccgagggtgagggggatggtcagtttgacttcgccgatccaccagggaaacagcgttgtgccgcagagcgcgataaaaattcgtacgttataaagccaggcgctgttccaggtgtagcggcgtagcagggggctaatcatgtccgtgttccgttcggttactgaaagcgacgacgcgcattggcttcacgcgcagcacgcgcggtttccacagaaacgacccggcgacccaccggccagagggcgatggcggcgattttgaaattcgcgatccccaccgggatgcctatgatagtcaggcactgagctataccgctgaaaatgtgcatcaggcagagccaccagccgaaaaaaatgaaccacagaatgttcagaacggtaccgccggcgttcagtagaccgtttttgcgccccggctcgagctcgtcaacatgaatcgcctcgttaccgtagggaaataacgaaaggcgagtgatttcccagcaggaacgagtcagcggcagcgtgacaatcagaatgatgctgaccagggtggcgagtagccagcctagagtggtggcgaaaccgccaaggataaagttcaaaatattcagaatggtacgcataaagcctcggttttgcccggtggataataagacctgatgattgtaacgtttttttgcgctggagcacctggtccggggcggttaaactgaaaaacaatccaccctgattgaaaatcgacattatatggaacttaaagcgacaacattgggcaaacgcatggctcagcacccttatgatcgggtgcagctactgaacgccggggtaaaagtttccggcgatcgtcatgagtatcttatccctttcaatcagttattgtcagtgcattgtaagcgcggtctggtctggggcgaactggagtttgtgctaccggacgggaaagtcgtgcgtttgcacggtaccgagtggagcgaaacgcagcgcttttatcatcatttacatacgctctggcagcagtggagcacggagatgagcgatatcgccgccggcgtgctgaagcagcagctggcgacgatcgagcacactcgcgcagaaggcaagtggctaacccgtcagcaggtggcggatgttcaggataatatacgccatgcgttgactggtttgccgatgcccaccagtcggcttgatgcctttgataactgccgggagctgtggcgggagtgtcagcgctggttaggcgatattgaagcgacgcgtctggcccataaccaggcctttaccgaggcgatgctggagcaatatcgcgaattttttgatagcgttgagtcgtccccgctcaatgcgtcacaagcgcgtgcggtagtgaacggcgagcgctccctgctggtgctggcgggagcgggcagcggtaaaacctcggtgctggtggcgcgagcgggctggctgctggcgcggggagaagccgcggcagatcaaattttgctgctggcattcggccgccaggcggcgcaggaaatggatgagcggatccgcgagcgtctggcatcagatgatattaccgcgcgtactttccattcgctggcgttgcatattattcagcagggcagcaaaaaagtgcccactatcagtaagctggaaagcgatactgcggcccgccacgcattgctgctgaaaagctggcaaaagcagtgccaggagaaaaaagcgcaggcgaaaggttggcgcctgtggctggaagaagagatgggctggcaactgccggagggggacttctggcaggacaaaaaggtgcagcggcggatggccagccggcttgaccgctgggtgagcctgatgcgcatgcacggcgactcccaggcggagatgattgccggggcgccggaagcggtacgcgacctgttcagtaaacgggtgaagctgatgtcgcctctgatgaaagactggaaagcggcgctcaaggccgagaatgcggtcgatttttccggcctgatccatcaggcggtcaatattctcgataaaggccgcttcgtcagcccatggaaacacattctggtggatgaatttcaagatatttcgccgcagcgagcctcgctgttggccgcgttacgccggcagaatagccaaaccacgctctttgccgtcggggatgactggcaggcgatctaccggttcagcggggcgcagctttctctgaccaccgcattcaaccactactttggcgaaggggattgctgtgcgctggataccacctatcgctttaacgggcgtatcggcgaaatagccaatggctttatccagcaaaatccgcatcagttaagcaaaccgctgaacagccttatggcaggtgataaaaaggccgtcacgctgttagccgacgacaagctggacgatcttctggataagctgagcggttacgttaagcccgagcagcgcatcctgctgcttgcccgttatcaccatctgaagcctgaggcgctcaacaaagcggcgacgcgctggccgcacctgcagcttgattttatgacgattcatgccagcaaaggtcagcaggctgactttgtcattgtgttgggactacaggatggggaggatgcgtttccggccccggcgcgcgagtcgattatggagcaggcgctcctgccgcagccggaagattttccggatgcggaggagcgtagactgttgtacgtggcgctcacccgcgctcgtcaccgggtatggctgttatttaacaaggcgcaaccttcgccgtttgtcgagatcctgcaggcgctggatgtgcccatggccaggaagccgtaatcgcggctcgattatttcaggcgctcggcaagatagcgtggataatccgggatcagaatatcgagcggttgaccgaagtgcggcgactggataataaagtcagcggtggagacgttagtggcgaccggaatgttccagacggtggccaggcgcagcaacgctttgacatccgggtcgtggggaacggcgttcagcggatcccagaagaagatcagcacgtcgattttgccttctgaaatgagggcacccacctgctggtcgccgcccatcggaccgctcagcatggcattaacctccaggccggtagcccgggagacgagattaccggtagtgccggtagcatacaaaatatgttgcgccagcagcgcctgatggcgagcaacccatttcatcagcatatctttgcagtgatcgtgagccaccagcgcgatatgtttttgcgcaggcagggtacgtgttgtcagttccatattttcattccacattttgacctgcaaacagattactgaatgtggctgtcgctgcaagcatcggggatgaaaattttgctgaatctgtgggttaggctggatggccccctgctgcggattagcatacacttaagtgaaatagcaggaggaaaccatgaaagagaatgatattgctggcatcctgacctcgacacggacgattgcgctggtcggagccagcgacaagcctgaccgtccgagctaccgggtcatgaagtatctgctggatcaggggtatcacgttatcccggtttcgccgaaggtggcgggcaagacgctgctgggacaacaggggtatgcgacgctcgccgacgttccggaaaaggtcgacatggttgatgtcttccgtaattcagaagcggcgtggggtgtagcgcaggaggcgatagccatcggcgcgaaaacgctatggctgcagctgggggtgatcaatgagcaggctgcggtgctggccagggaagccggattgaacgtggtgatggatcgttgcccggccattgagctaccgcgactgggattagcaaaataacaaaaaaccccgcctggcggggttttgttttagttgcgaaggcgcggagcctgcagctgctgacgaatcgttttggccagttcgtcgagggacggctgttccgggtgttcgtcgcgggtttcgctgctcagctgcgcttctgccagataggtgtgaatcggctggccatcatcatcttccatcaccacatggtaccagggcgccgcgcgcaattcgtcattggcggcaatttcatcctcttccggctccgcgagcgaatactcgggatcgacatcgacgatgacgcccaggtagcccaagagcgtatggcggacctgttggccgataccgaatttgctggctatcataggcacctcctgggaaacatgaatactccctatatgaggctcatgtttcgtttttcaagttacatgacgcgacaggcaaaccccttcagatacagcccttccgggtaggttgcgatcaccgggtggtcggcagcctgacggaactgttctataaattgtacatcacgcccggcatcaattgcggcatcggcgatgattttctgaaataaatcggtggtcatcagcacggagcaggagaatgtcagcagcacgccgccggggttcagcagctggatcgccagcatattgatatctttatagccgcggcaggcgcccatcagctggcttttattttccacgaacttcggcggatccatcacgatcacgtcgaatttctctccctgatcgcggtatttacgcagcagtttgaacacgtcgtcgcgcacaaactccgctttggacagatccagtccgttgatctccacgttctggcgggcaacgtcgagcgcctcctgagaggtatccacgctggtgacctggcggcagccgcccatcagcgccgacaccgcaaagccgccggtgtaggagaagcagttcagcacccgtttatccgcgacatagcggcgggtggccaggcggctgtcgcgctggtcgaggtagtagccggtcttgtgcccgccctggatatcgactaacagcttcatgccgtgctcggtgatcggcagcagcgccgggggcagttcgcccaccaccggcccctgggccagctccagtccctcttttttacgcacggcgacatcgctgcgatcgtaaatggcgcagtccgggaacaggttctgcagggcgctgatgatggcggcgcgctggtattcggcgcctgcgctgagcagctgcagcacgaaaaagttgccaaagcggtcgatagtgacgcccggcaggccatcggactcgccggcgatcaggcggtagctgtcgaggccatcgcgctcggccagccaggcacgccaggtttgcgcctgctgcagacggcgttcaaagaaggcgctatcgatggcttcattgcggtcgaaggtccacacgcgggcgcggatctgcgacgacggcgagtaagcgccgcgggccagccattttccctgatggtcaacgatatcgatggtttcaccgctgcgggctttaccttccatgcgggcgacgccgccggagaatatccacggatggcgacgcagcagggatttctcgcgtcctttggctaacactaagcgggggaatagggaatctgtcatggggctacctttaagcaacgggaatgtcggcaccgaaaaatggcgcgtagattagcacacctggcgcacgcaagcatctttcgcccggctggcacaggtgagcgtttcggcacaaaatgcaggcgcttcggcacattcagctggtgcggactctcataccctgttttctcaccccaacgaggagcagacgatgaaaaaagatatccgcatggctgtggcgatggtagcggctgtgagcagcggcgcgatggccgcgccgtttagcgtaagcagcaatgatatgcgtgacgggcagccgctggcccagcagcactggtttgccggtttcggctgtaccggaggcaatgtctctccgcagctggcatggaaaaacgccccggcgggcacacgcagcttcgcggtcaccgtccgggatcccgatgcgcctaccggcagcggctggtggcactggacggtggtcaatatcgccagcagcgtcttttcgctgcccgctggcgcgggagataaaaacagcgctacactgccgggcggagcggtccagggccgcaacgattttggctatgccggcttcggcggcgcctgtccgccggcgggagataaaccgcaccgctatcgctttacggtatgggcgctggatgtccccacgctgccggtggatgccggggccagcggggcgctggtcggctatctgttacatagccatgctctcgccagcgcacagttgacggcgatggccgggcgttaaaataaaaggtcggtctgatggagagtatccactttcagcataacgccttaaccgcggcggagatcaccacccgacggctatgcagactgcatcgcgtgcggctgttctccccggcgctctgtcgggtgaaacgcggcagcaaagtgattgtgcaaggggagagccgggtgctggcgactccgcaacagctgattgttttgccagctgacgtggaactggaggtgattaaccagccggagaatggcctattttgctccgatctgctatcgctgacgcccgagctgctgacgaggtttaagactcgttatctcagcgaaccaccgccagggcgcctgacctcgctctgcgcaccggtgacgacagagctggcgtttatgtggcaaagcgttctgcaggcggtgcgggagggattgtccgtcgcgctgcagcagcaccagaccatggggctgctgctggccctgcatgaggctggctatgcgggcccgctgctcgtcgagcggcagcaggatctgtcggcgcaggtgcggcagctgattatgctggcgccggcgcaggcatggagcgtgtcgcgggtggcgaaaatgctctttctcggcgagtccacgctgcgccgtcggctgcagcaggaatcgcagagttttcgccagatcgtcgaggaggtgcggatggcccacgccctggggcagctgcagaccacctcgcggccaataggcgaaattgcgcagaacagcggatatcagtcgggatcgcgctttaccgcgcgcttccgtcagcattatggtttactgccgaagcatgtacgctgagcgaatttgctatcctcagcgtatagcgtgagcgaaaaggagatgattatggccagtatctgcacaatggcatgggtttacggttcggttcagggcgtgggatttcgctattccacgcagcgggaagcgctgcagctgggggtgaccggttatgcccgtaatctggatgacggcggggtggaagtgcttgcctgcggcgaggcggagcaggtggaaaaactcatcgcctggctgaaagccggggggccgcgcagcgcgcgggttgaccgagtgttaaccgagccccatcaacccacccgcagctgggacaaattcgcgatcctctattagatgcacttcaccggcttcggcaagccggcgattttagtcgcctgtttggcgggtcctttcgggaacaggcgatagagatagcggctgttgcctttctcttcgccaaacttgttggccatcgccttgaccagcatacggatcgccggagaggtgttaaattcaaggtaaaactcgcgcacaaagcgcactacttcccagtgttcaacggcgagcgttatcccttcctgcgcggcaatgacttccgccatcgcctcgctccactgggtggtatctttcagatagccttcgctatccgtttcaatttcgttgccttcaaaaataaacatgatttttcacataccgcctgaaactggccgcagtgtagcaaaaaaaaaggccccgcataagcgaggcctctgttaagcaggggagcggttagtcccggctggcgaagcccaggatgctcagcaggctgacaaaaatgttgtacagcgagacatacagactgaccgtcgcgcggatatagttggtttcaccgccgcggataatgttgctggtctcgaacaggatggcgcccgaagagatcaggatgaacaccgcgctaatcgccaggtgcagcgccggcagctgcaggaacaggttagcgaccataccaatcaggacgaccaccacgccggccatcagcatcccgccaaggaatgacatgtctttacgcgtcgtcagcacataggccgagcagcagaagaagaccagcgccgtgccgcccagcgccaggccgattaaatcgcccatgccggcagaaagatacgcgttcagcatcggcccaaggatatagccgaggaacccggtgaaggcgaaggcggaaataatcccggtgggtttattcgccgttttgtaggtcaggaacatcagaccgtacatccccacgagggtcaaaatgagacccggcgaagggagcatcagcactgtgctggcggtggcggtgatagcggaaaacgccagcgtcaggctgagcaggaagtaggtgttacgcagaaccttgtgcgtgctgagcagcgaggaacggtcacgcgatgatgtaattatgcgatccatgagtcactctcttatgacagatgtaattagggataaagaataagaaaaacaagcgtgaagccctaatgcttttacccatctttacttagtttttaccgcttttgcctggcataaaattctatatagatagggaaaagcgatatattttcgcttttcgcgtcgctgagccgatcgaaatcttataggtcactgaaaaatattgccttatggcagttctgcgactaagtgtggaagagggggattaccccgtacgtcaaaggcaaagggaaatgacattacacaaaaaaaatcacatcacccgaacactcctggctgtcagtatgctggctatgagcggcggggcgctggcggcgcaggtgccgccgggcacccagctggcggaaaagcaggagctggtcagaaataacggcagtgaaccggcgtcactcgatccgcataaagtcgagagcgatgttgaattcaatatcattagcgatctctttgaagggctggttaacgtgtcgccagcgggggcgatccagccgcgactggcggaacgctgggaaaacaaagacaacctgttatggacctttcatttacgccccggtctgacctggtccgacggcactgccattacagcgcaggatatcgtctggagctggcaacggctggtctcgccggcaacagcctccccctacgcgagctaccctggcaatatgcatatcgccaacgcccgcgagattgccctcgggcaaaagggacccgagacgttgggggtgaaagcgctgaacgacaccacgctgcaggtcactctgacccagccgaatgccgccttcctggcgatgctggcgcacccttcgctggtaccgatcgacaaagtgctggtggagcggtatgccgataaatggacccgaccagagcatatcgtcaccagcggcccgtataagctgtcccaatgggtggtgaatgagcggctggtggctgaacgtaatgcaaagtactgggataatgcgcataccgttattaataaagtgacttacctgccaatctcttcggaggccgccgatgtcaaccgctacaaagcaggggagattgatattgtctatacggtgccgatcaatcagtttgcgcagttgcagaaaaccatgggcgaccagctggacgtttcgccgcagctggcgacctattactacgaattcaatactacccggccgccgtttaacgaagcccgtgtgcgtcgcgcgctgaatatggcgcttgataaagatatcattgccgaaaaagtgcttggccagggccagcgcccggcctggctgatcggtcagccggatatcggcggcgtgacgctgcataacccggactacgccagctggccgcgtgagaaacggattgccgaggcgaaaaaactgctggcgcaggcggggtatgatgaaagccatccgctggtctttaccctgctctataacacctctgagtcgcaccagcgtatcgccattgccgccagctctatgtggaagaaaaacctcggcgtcgaggcgaagctacagaaccaggagtggaagacgatgctggataccatgcatacgcataacttcgacgccgtccgctacgcgtggattgccgactacgacgatgccgccaccttcctcaatactttccgtaccggggatagcgagaacaccagtcagtacagcaaccctgcttacgatgaggccctgcgcaatgcggcgaaagcctccgacgtggcgacccggggcaaatactatcagcaggcggaagatctgctggcgcaggatgttcccgccattccggtctatcactatgtacgtacccatctggtgaaaccttgggtagggggcttcacgccggataagctggggtattactacaccaaagacatgtacattaaaaaacacccatccgccagcggcgatgggcgttgattttctgtgcaaactgcctgaaattcagacgaataacacaaaattgtttgtttttaaggcagttgatcaaaatgatgctttacagcatccgccgaggtgtttatagtgcgcctcacaccggaagtgtggccgagcggttgaaggcaccggtcttgaaaaccggcgacccgaaagggttccagagttcgaatctctgcgcttccgccatataaaagaaggggttaccgaaaggtaaccccttcttgctttgtccggtcggtcgtgcatgacccggacagcgaccgacgacgttttcattcccacagcgctgacggatacatagcccgtcgcatggcaggacttttcacaacgcccgcttattcttcgacaatccgcgccttcggtttgctcagcaggagcatgaccagcgcgacgtagggcatcggcttccagaaatagtagccctgcagcagatgaatattctggcgattaagataatcccgttgggcctcggtttcgacgccctcggcaatgatgcgcagtgacagcgtccgcgccatctctatcacgcagtccagcagcttgcttgtcggcgcctccccggttacccggccgacaaaactctgatcgattttgatatagtcgaaaaccagctcgtggagacaggaaagcccggaatagccggtgccaaagttgtccagcgcgatggaaaacccgcgggagtgtaacgtattgagcttgtccacaaccgccccgttgagcaacagcggctcctgctccgtgatctccagcatcagcttcaccgctttaccctcaaagccgcgctgatagtgcaggcagtcatcgataaacgtcggcgcgttaatatatgacacgctgatattcaggccaatatgaaacccatccggtagtttactaaagtgtggtctcatctgcgcgttgacctgcgccatcaggctgcgggttaggggaataattaagccggtacgttcggccagcggaataaattccgcgggcgagcgcgctggcgtcgtgctgttttgccagcgggcgaggtaaatacctcctggtgtgggtccgcagccagcggcttaacatcgccatatctggcaatcatttggttctgcacccagagtgccagcccgttgtcatcggtatcgctatatagcgcatcgcgcagatggatgtcgctgatcgtgacaatcaccctgatcggcgctaagcgcgtctgatagatcagcaccggccgcttattgaccatcattctggccgggagcagtaacagagggtcatcaggcaaagactcagggctaagtgtcaggacccggttgccagttaatgacgaacacgccagcaagaaataccatcagcgccagggaaaaggcaatcactcgcagccggtggatgaagagacggcgttgtttcttggcgatcgcaccgtcagccagccggcgtggcagcccggcgcgatggtgcgactgacggtcagcggcaaggcgcgggtatttagcggctaatccctgagcaggcggcgccggctatcgccggtgccgcacagaaagctaatcaggcggaggatgaagccgatagtatccgcgccactgacctcgtcgccatggagtggtagtacgttggaacaattccgcggggtcagtccatctcaccgccgttttgccggtgtgcgctttacaaatccagcactaaccggccgcctttggcgcgcgagcagcagatcagcatactctgctggctggctttctcttcctcgctgtaatactgatcgcggtggtcggcttccccctccagaatcatcgtttcgcaggtgccgcacaccccttctcggcacaggcattcgaccttcgccgctttgttattctcgatcacctgcaaaatggtcatatcctgcggcacggtaaattcgcgtccggaacgcgccagcaccagggtaaatgcctctccgcttttatcctcaaggataaactgctcaaagtgcagctggctggcgggcacctgatggcgttcggcggcggctttcaccgcctcgttaagcgccgctgggccgcaggtatacacgtgggttcctggctcgaggtcggcgaacaggcgcggtaggtcgagacggctgccgagcgctgatacatgaacattgacccgatcgcgccatggcgcagcgctgagcgcatcgacgaaagcattactgtcggcgtcgtgaaaacagtaatgcagctgccagtcggcctgccgctgttccagttccggaatatgcgataagaatggcgtaatgccgatgccgccggcgatcagcagatgttttcgcgcctgtggttcgatggcgaacagattgttgggcgtggacaccgtcagggtatcgcccgggcgcacccgctggtgcataaaacgcgagccgcctttggaaggcgactcaagacgcaccgcaatctgccagctggaggtatccagcggcgagctcatcagcgaataggcgttactgtagcgctgctcgccatcctgcatctggacgataatatggctgccgccgctgaatgccggcagcggggcgccggtcggcgacaccagcgaaaaacgcttcacaagaggggtgatctgttcaacatcgcgaacgaccgcctcaaacatttgataatcagacatcgctgaactccattaaaaaatcccggcgtggctagcgccatcgccgggagagcagatttacaacccctggcagagatacttcatctccaggtaatcttcgattccgtgttccgacccttcgcggccaagaccggactgctttaccccgccaaacggtgcgacttcgttggaaattagcccggtattgataccgaccatcccgtattccagctgctcggagacgcgccagatacgggcggcatcgttgctgtaaaaataggaggcgaggccgtagatggtgttattcgcctgtttgatgacctgctgctcatcgtcaaatttcaccaaagcggccaccgggccgaagatctcttcctgcagcagcagtgaccccggctgtacgtcgccgatcaccgtaggggtgaagaaattaccgcccagcggatgcgctttaccgccagttaacagcgtggcgccgcggctcagggcgtcgtcgagcagggactgcactttgcgcccggcgtcggcgttgatcagcgggccaatctgtacatcggactcgctgccatcgcccactttcagggcggcgacgcgggcgacgaatttatcgcagaattggtcgtagatggcgcgatgaatatagaagcggttgacgcagacgcaggtttgcccggcgttacggaacttggcgatcagcgcgccctcgaccgctttatcgatatcggcgtcgttaaagacgataaacggcgcgttaccgccgagctctaaggagagctttttgatggattccgcgcactggcgcatcagcacgcggccaacttcggtcgaaccggtaaaggagagcttacgcacccgctcatcgccggtgaacaccgcgccaatctctcgcgactggccggtaacgacgttaatgacgccctgcgggatcccggcctgattcgccagctccgccatcgccagcgcggtaaacggcgtttcgttagccggcttaatcaccatcgtacaacccgcggccagcgccgggccggccttccgggtgatcatcgccgccgggaagttccacggggtgatcgccgcgcagacgcctaccccctggcggatcaccatcaggcgtttatcggcgccgggggaggggattatctcgccgttggcgcgtttcccttgttcggcaaaccactcgataaacgaggcggcataggcgatttcgccttccgcttccgccagcggcttgccctgctcggcggtcattatctgcgccagcgcggttttgttttcgaggatcaggcggtgccagtttttcaatagcgcggcgcgctgggcggcggtgaacgcgcgccagcccggcagcgcggccgcggcggcatccactgcctgttgcgcttccgcacgccccatattggggatctggccgagcgtcgcgccggtggagggattgctgacggcaagcgttgtaccgtctgcggcgtcgcgccagcttccggcaatcagcgcctgctggcgaaacagatttgagtgaaatacggacatggccaactccttcaataattacggctggaatacctgggcgaccagattgtggaaatgcgcgatcccgtgctcggagataccgctgccgctgttatccgccataatgcgcccctggccgcgatagccgcgggacttcagccccttctgcacgctttccaccaggcgtaaatcttccgggcggaacacgtcgcgataccactcaatcagcgctttctgatcgtcagtcagctcttcgttggtgaaatagatgtcgtaattctgcagagtggtctcttcatccaccgggaattcatagataacggtcatcatgcccttgatcggcgtgacgttgaacatggtgcacggccacagccagaaaccgtgaaacgcggcgtcggtaccctcttcgaatttaaacgactgctcggacggtttggcgaagccatactgcagcgtccatttgccgtgcatggtgtgccagtagcggtcaacctggacggaatccgagaagcccgggtgcgccggaccgcagtggtaacattccagatagttatcgacgatatttttccagttcgccggggtgagggtggtaaagcgcgccgccagtttcagatcatgcacgtccggacaggcttccagcactttgtcctgcagccccggtagctgcgtttccacactctccgcttccggattcatattgataaacacaaagccggcatactcttccaggcgaaccggcaccagcgttgccttttcgctatcgaaattcgccacgttttcgcagttgcgggcgtgggcgagattgccgtccagcttgaaggcccaggcgtgataggggcaggtaatcacgtttttggctttgccttcgccgctcagtagctggtggccgcggtgcgggcagacgttatagaaggcgcgcagaatgttgtcgcggccgcggacgataacgatattttcgccgatgatctcccgggtaatgtaatcgttcggccgggcgacctcgctgccgtgggcgacgcaaatccagctattggcgaagatgcgctctttctcgtgctcaaacgcctggctgtcggtataaaaacgggccggaatggtccaggcatcctgcggattagcgcaaaagttaatcggcagggtgaagtcagggctcaaattgctcatgtagggtctccttgtgattattgtcagtaagaggttttacagcgactggccgtcgcctttgagtaccgcgccaaccggcagcgtctcggctttaataatgggctcgggggtatgggtttctatctgatggaccggaacgtgggcgtagtcctgttttaaccagcgcacgaagccgccggttttaatcagtaaaatggccaggaacggtagggcggtcagcaccacggtggttttcatggtctcaagcgaagcgccggtaaacagaatcgacagcgggatgagggtgatcaccacgcaccagaacaggcgcatgccgcgatccggatcctcgccttcgcgcaggttgcgggtactggtcgccgccatggtgtaggccaccgcatccatgtgcgaggcgaggaatacaatcatcacgaacagataggcggcgaggaacagcttacctgccggcagcgacatcaggacctgctggacggcggtttcgccgccgagagtctgcatcacctgtggtacgttaatcacgccgttaacgaactggtgcatggcgtagctttccatcaccccgaagaaaaaccagcagccggcggtgctaccgaggagcagtccccagatcacctctttgattttgcgcccgcgggagacgcgggtgacgaacatcgccacgcctggggtgtaggagatccaccacagccagtagaagacggtccagttgcgggtaaaggcgccgtcgccgagcgggtcggtaaacaggctcatctgcaggaagttttgggtcgtcaggccgacggcgttaatgacgttattggtgatgaattcggtcggaccaaccagtaataccaccaacggcagcagaaacgccccccagccgaccattttgctcaggcgctgcaggccgttgttgatgccaatccacgaactcatgcagaaaataccgccggagagcaggatcacaaatgcctgcacggtgaagttatccggcagtcctgtcagcgctgacaggccgcgggtgaaggtggcggcggtgactaccagcgaaatggttaacgcgccgacggtagcgatcaggaacatcagatcgaccagacggccccagaaaccttgcggattaacgccggtgatcgccgaaacgatcccggagaggctgaggcctttatttttccgcacgtggaagtgataggccatgatcagcgaggcgagggtataggttgcccaggcgcttacgccccagtggaagaaagagtaagggatgctgtattccagcgctttcggcgattgcggggcaatgttaaggcccggggtctggtagtaataagcccattcggcaacgccccagtacagcgtggaggagccgagaccggcgcagataaacataaacagccatgagagggtactgtattcgactttaccttcgccgagacggatattgccgtatttgctggtggccagatacaacaccagtcccagcgccagcagcaccagtacctgtaccgtggaacccagcaggcgggtcacgccgttaaaaatcgaatcagccgcctgcgcggtttgctgggggaagagacttaatgtagcggcgatgaaaacaatggccgccaggctgatggcaatcagcggcacatcttttttctttacgttgctcaacatgagtgatctcctgggcatgattgcccgtcggtggctttagcctgtcgttgttatcacgctgtagggtcagggttcgcagcaagatgctattaacaattggattatttcttcgttacatgaattaaacaattggccgtttcgtgaagcaataaaacacgaaacggaaataataaaaggtgaattggcgcaggttctgtcctttcaggaattaataaggttcaccgctgtgatgcggttcacttgtcaatcgtggggtattctgcatagcgaaaagagaggggagttggcggaccaggcgcgcgggttttcccgggtagcggctgcgccttacccgggctacttgctgtgccgttttttgccgggtagcggctgcgccttacccgggctactcactacattatcgtgccattgtagccccggtaagcgcagcgccaccggggagcggcggggtaattacgccaaaatggccttgcagatagcctcgctaacctgctgcgttgaggcactgcctttcatgtccggagttttcggtccacaggcgatcgtctgctcaatcgcagccagaatgccatcgtgagcggcgtggtagcgctcatcgccgttgccgaggaaatcgagcatcatcgccccggcccaaacggtggcgatcgggttggcgatatttttaccgtaaatatccggcgccgacccgtgaaccggttcgaacagcgacgggaaattgcgctccggattgagattggccgatggcgcaataccgatagtgccggtacaggccgggccgagatcggagagaatatcgccgaacaggttagaacccactaccacgtcgaaacgctccggctgcagcacgaaacgggcgcacaggatatcgatatgctgcttgtcccagcgaatttcgggatagtttttggccatctcttccacccgctcatcccagtagggcatgctgatcgccaggccattggatttggttgcggaggtcagcgttttgcgtgggcggctttgcgccagttcgaaggcgtagcgcaggatccggtccacgccgcggcgggtaaagaccgactcctgaatcaccacttcatgctcggtgccttcattggcgcggccgcccagggcggaatattcgccttcggtattttcgcgcaccacgtaaaaatcaatatcgccggcctttttacccgccagcgggcaggggacgccggggaacaggcgcaccgggcgcaggttgacgtattggtcaaactcgcggcggaacttcagcagcgacccccacagcgaaatgtggtcgggaacggtatccggccagccgacggcgccgaagtagatggcatcgaagccctgcagctgctcgcgccagtcgtccggcatcatcttgccataatgggcgtaatattcgcagcttgcccactccatctgctcgaagctcagcgacagatcccaacgctgtgcggcggcttgcagcacgcgaatcccttcaggcagaacttctttgccaattccgtcacccgggatggcggcaatacgacaggtttttttcattccggttctcactttttaacgatgatgtttgaccacctgcctatcctataattgactggttcataattaatcacgctaactggtgaaacataaaacacagatcatgaataatctgccgctgctaaatgatttacgcgtctttatgctggtcgctcgccgggccgggttcgccgccgccgccgaggagcttggcgtatcgccggcgttcgtcagcaagcgggtttcgctgctggagcaaaccctgaatgtgatgttgctgcaccggaccacccgtcgggtcaccattaccgaagagggggagcggatctatgaatgggcgcagcgcattttgcaggatgtcgatgagatgatggatgagctttccgacgtgcgccaggtgccgcagggaacgctgcgtattatcagtagcttcggctttggccgtcgggttgtcgccccggcgctgtcggcgctggctctccagtacccgcagctggagctgcgtttcgatgtccaggaccggctggtggatttagtcaatgaaggggtggatctcgatattcgcgtcggcgacgatatcgcaccgaatctgattgcccgccagctggcggccaatcaccgcgtactctgcgcctcgccgcagttccttgcccgccatgcgccgccgaaacagctgagcgatctggccgcgttaccctgcctggtgattaaagagcgcgatcatccgttcggcgtctggcaattgcatagcaaagagggccagcacgccatcaaggtaaccgggccgctctcctccaaccatggtgaaattgtgcatcagtggtgtctggacgggcaggggattgcgctccgttcgtggtgggacgtccgggagaatatcgccagcggacatctggtgcaggtgctgccggactactggcagccggccaacgtctgggcggtttacgtctcccggctggcgacgtcggccaaaatccgcaccaccgtggagtttctgcgccactactttcagctgcactatccgcagcatgagccgacggccagcgccgtcggcagaggcgattaaaccccaaggcggtcgcgcaggctgtagtaggcggcgcccatggcggtaaaaggaatgcgcaggctgcggccgcccgggaacgggtagtgcggcagtttggcgaaggcgtcgaaacgctcggcgtcgccgcgcagcagctctgaaatcaagcgtccggcaaggtgggtacaggtcacgccgtggccgctgtagccctgcatgtagtaaatattgttatcgagacgcccgaactgcggcatccgcgacagggttagcaggaagttgcccgtccagcggtagtcaatcttcaccccctgcagctgcgggaaggttttcagcagtttcggcataatcagccgctccacgtcgtccggatcgcgcgcgccgtagaccacgccgccgccgtacagcagacggttgtcgccggtcagacggtagtagtccagcaggtagttacagtcttccacacagtagtttttcgggatcagcgagcgggcgacctcttccgacagcggagcggtagtgaccacctgggtgccgcacggcatgctgcgtttcgccagctccggctccagtttatcgccgagataggcgttgccggcgacgatcacgtagcgcgcggtgacctggccgcgcgcggtgctgaccaccgccgggctggtgtgctggatgcgggtgaccggcgactgctcatacacccggccgccgttcaggcgaatggcatccgcttcgccgatggcgaggttcagcgggtgaatatggccgccgctgtggtcgagcagggcgccgacgtagcggtcgctgtccacttcgcgacgaatggcttctctgtccagcagctccagctgggtgttgccgtagcgctcccagttggctttctgctcttccagggtttccagctgtttatggttcatcgccacgaacaggccgcccgggcggtaatcgcactggatctgataccgctggatgcgttcgcggatgatatcgccaccttcgaacatcatactgccgagcatttttgccgcatccgggccgtagttcttttcaatgacgtcgatatcgcggctataggagttgaccagctgcccgccgttgcggccgctggcgccgaagccgatgcgcgccccttccagcaccaccacgtcgtagcccatttcggccagatgcagggcagacgagaggccggtgtagccgccgccgacgacgcagacgtcacagttgatggatccctccagcgtcgggaacggttcatacttgttggcgctggcggcatagtagctagtggtatgttcagtcatgatcaagactccagggcaatccagatggttttcagttcggtgaatttttccagcgcgtgcagcgatttatcgcgcccgttgccgctctgcttgtagccgccgaacggaacggtcatatcaccatcgttatagttgttgacgaagaccgagccggccttcaggcggcggctcatgcggtgggcgcgggagagatcgcgggtccacaccgcggcgcccaagccgtagtcgctgtcattggcgagctttagcgcctcttcttcgcttttgaagcgggtcaccaccagcaccgggccgaagatctcttcccggctgagggttgatgccgggtcgacgtcaacgaaaatggtcgggccaacggcggcaggccacgggtttttccgtccgtcgaggaacagggtgctttggctttcgccgccgcgaataaagctatgcacgttgtcggcatgggtattgtcaatcagcatgcccatggtggtgtccggatcgagcgggttgcccggctgccagtgttgtgcctcatctttcagccgcgccaggaattcgtcagcgatgctctcctcgagcagcagacgggtcccggcgatgcacacctgtccctggttgtagaagatgccgccggcggtggcgcgaaccgcttgttgcagatccgggcaatcggcgaagacaatgttggcgctcttgccgcccgcttccagccacacgcgcttcatattgctgtcgccggcgtctttcagcagctgcttgccggtgcgggtggagccggtgaaggtgatgacttcaacatcaggatgcagggccagcgcctgcccggcctcgtggccaaagccgctgaccacgttcaacacgccgtccggcaggccggcctctttcgccagcccggccagacgcagggcggtaagcggcgatttttccgagggtttgaggattacgctattgcccgccgccagcgccgggccgagtttccagcaggccagcagcagcgggaagttccacggcaccaccgcggcgatcacgccaattggttcgcgaacgatcatcgccagctcgttgctgccggtgggggccacttcgccatagactttatccagcgcttcggcataccagcgaatggcgcgggcggcgccgggaatatcgtcgcgcaggctgtggcgaatcggtttgccggtatccagcgtttccagcagcgccagctcttcacgatgggcctccatcagatcagcaaagcgagtgaggatcgctttacgctgtgcgggggaggcctgcgaccagtcgccgttatcaaaagcctggcgcgcggctttcaccgcccgttcgacgtcggcttttttaccgcgggcgacctgggctaatgtctgctgcgcggcagggtcgatagtctcaaaggtggtattatcggccgcggcgcaatattcgccgttaataaataagcgtgtttcaatggccaggtttttcgctttttcctgccagtaagccaggtgctgaaaattcatcatgactccttaaaaacattatcggcaaaataatcagtgcggcgttttcaggctgcacggggcactgcgccgggcgcagggcatagcgtatccccggagttgaataccgttttattctcctgagttttgacaggttgtttgcaacccgaattattcaggagcgagtcgccattcactggcgttaattatttcagggccaacaggaaataatattccgtacggcgcagacgttattactacgagttcttcgccgcgacgaaaatagattttccgtcgcgacaggcctgaagtaagcctgaacctcgttcaggcgaaataatcagaatgtggtgggggtgtgggcactgatgatgcggcagatgcctgccgaggtgttgctgaagctgtgcggaatgccggtattaatggcatagctttgtccagccaccaggtggtacgactgaccgttaatggtcagcacgatctcaccttccagtatggtgcctatctcctcaccctgatgcttaatcctctccccggtcgtggttccaggctggtaagtttcaaaaatcatcgccagcgtacggttcggatttccgttatgaaccagcttcatggaaacgccctgacttcccatctcaatcaggtcatcctgattaatgaccacctggggttcgtccggcttttcgggttcagaaaagaattccgagagcgacagcccatagactttcagcagcttttgcagcgtactgatggcaggactgactttatcctgctctatggtgctgatggcactatgtgttaacccagacagttcggcggcacgacgctgtgagagacccagctgctggcggatctctgacagacgtttccctggcgccagtccgtcatcgctcatatttgcatttccttaacggtagtggtcagcgccgccgcttttcagcatgatggccctgacaggcggtgataaaaccatcaaacaacatacgcgacagggcgtattcgctactgttccattctggatgccactgtacgcccagcgcgaaaggatgatcgttcacgctgaccgcttccaccagtccatccggcgctcgcgcctccacgcgcagctgcggactgagggtttttgccccttgcccatgtagcgagtttacccaaaacgtgttgcagcccggtatcaattgcgacagcaatcctccttcctgaacctcaacctgatgggacggcgcatactgctgctcgacgggcagttcaggatcttcgcgatgttcaaggagctcaggctgctcgaacagacgacgatacagagtcccgccggtggcgacaaccagttcctgcagtccacgacagatggcgaaaatggggatgcgcctttcgagcgcggcgttaatcagcgccatgctcagaagatcacgcccggggtcggcgtcaggctcatcgccgttttcaccataaaggtgcggctgcacattgctggggctgcctggcaggtagatcccgtccagtttatcaacgaccgcgttcagtagctccggctccgccagcgcatgcggcagggcaatcggcagtccgccggcgttaacaattgcattcaggtacttttcttgcaaggtctgggtctggtgacccttaagcctgtttctacacatcacgacgccaataactggcttgtacattatattttccatgatcgccctcacaaagtggactaaattatgaccgctatagcgggtttaacggccatatcgttcaatattttctcaatctagcagtggaaatagccctttgcaaacttaatttaacatttgacaaacaatttatttgcatacacagtcgatggggtggacattatatttaacggtctgagtgcaggaccgaaacccaaccaacggcggtgaatcatggaaaccaatatcgtagaagttgagaattttgttcagcaaacggaagagagacgggttagcgcgttcgcgaaagaagtgaagcgctacctcgaaacctaccctgatacccagtatgtcgatgtcctcctcactgacctgaacggctgcttccgcggcaagcgcatcccggttgccggcctgagcaaactggagaaaggctgttatttcccggcctcggtgtttgcgatggatattctcggcaatgtggtggaagaggccggtctgggccaggagatgggcgagccggatcgcagctgcatcccggtacccggcaccttaaccccttcggcggctgacccacaatcgatagcccaggtacagctaaccatggttgatgaagatggcgctccctttgacgttgagccgcggaacgtactcaaccgcctctggcagcagttgcgccagcgcgggctgttccccgtggtagcggtagagctggagttctatttactggaccgcaaacgcgatgccgaaggctacctgcagccgccgtgtgcgccgggcactgacgatcgcaacacccaaagccaggtctactcggtcgataaccttaaccacttcgccgacgtgctcaacgacatcgacgagctggccaaactgcagctgatccccgccgatggcgcggtggcggaagcctcgccgggccagtttgaaatcaaccttcaccataccgataacgtgctggacgcctgcgatgatgcgctggcgttaaaacgtctcgtgcgtttgatggcggagaagcataagatgcacgccacttttatggcgaagccttatgaagagcatgccggcagtgggatgcatatccacatcagcatgctgaacaataaaggggaaaacgtgctggtggacggcgatggggaagactctgcgctgctcaaacgcgcgctggccgggatgatcgatctgatgccggcctcgatggcgctgctggcgccgaacgtgaactcgtatcgccgcttccagccggggatgtacgtcccgacgcaggcttcgtgggggcataacaaccgcaccgtcgcgctgcgtattccgtgcggcgagcggcagaaccaccgcgtggagtatcgcgtcgcgggggcggacgccaacccgtatctggtgatggcggcgatttttgccggcattctgcacgggctggataacccccagctgcctttacaggaagaggtggaaggtaacggtctggaacaagagggcctgccattcccgatccgccagagcgatgcgctgtgggagtttatgcagaacgatcacttgcgtgagcgcctcggcgagcgtttctgccatgttttccatgcctgtaagcatgatgaattactgcagtttgagcgtcttatcacagaaaccgaaattgagtggatgttgaaaaacgcctgatggtcgccccgcgaggggcccataagtttggtaatcagtagcatcatacggcctgagcggagcctggccgacgtttttgctgggagcccagccatttcccggatgtcgcgttaaggagcgcaggcggcaacggggcttcagttaacgacacagtgtgtgacgaggaaatgagatgatgcagatgttcaaatatccgcagggagagggaggccgctcaggccgcattggatgccagccagctaccgcttaccggtccgtcttacccttttatctatgccttacccctttgctaagcaggtttgtcacgcggacgttgggcccgcaaactgttaacagcaagggggggatgggcgatggctattaatcctccggcgcataacgccgctcaggcgggcagaccgcgtctgcgtaaatccctcaaactctggcaagtggtgatgatggggctggcctatctgacgccaatgacggtgtttgataccttcggcatcgtctccggcatcagcaatggccacgttccggcgtcttatctgctggcgctggctggcgtgctgttcaccgccatcagctacggcaaactggtgcgtcagtttccggaagccggttccgcctatacctacgcgcaaaaatccatcagtccgcacgtcggctttatggttggctggtcgtcgctgctggattatctgtttctgccgatgatcaacgtcctgctggcgaagatctatctctcggccttgttccccgaagtgccgccgtgggtgtgggtagtgacctttgtcgctattctgaccgccgcgaacctgaaaagcgttaacctggtggccaacttcaataccctgttcgtgctggtgcagatttcgatcatggtggtgtttgtcattctggtggtgcaggggctgcataaaggcgagggggtgggtaccgtctggtcgctgcagccgtttatcagccagaatgcgcatctgatcccgattattaccggcgcgaccattgtctgcttctcgtttctcggcttcgacgcggtgaccaccctgtcggaagagacccctgacgccgcgcgggtgatcccgaaggcaatttttctcaccgcgatgtacggcggcattatctttatcgtcgcgtcgttctttatgcagctgttcttcccggatattcatcgctttaaagaccccgatgccgcgctgccggagattgcgctgtacgtgggcggcaagctgttccagtcgattttcctgtgcaccacctttgttaacaccctggcgtccggcctggcctcccatgccagcgtctcccgtctgctgtacgtgatgggccgcgacaacgtcttcccggagcgcatttttggctatgtgcatccgaaatggcgtaccccagcgctgaacgtgattatggtgggcatcgttgcgctgtcggcgctgttcttcgacctggtgaccgccaccgcgttgattaatttcggcgcgctggtggccttcaccttcgttaacctgtcggtgttcaaccacttctggcggcgcaaggggtacaacaaaacctggaaggatcgactgcattatctgctgctgccgatggtcggggcgttgacggtcggggtattgtggatcaatctcgaggccacctccctgacgctcggcctggtgtgggcggcgcttggtctgctgtacctgacttatctgacccgacgcttccgcaaaccgccgccgcagtttgatgccgctaaagcggagcaggcctgggagtcataggttctgaggcataaactgaacgaaggcaggcccgcaggcctgctttcgttttggcttcggtaagggacagtacaggacggtaaagaaatcagcagaaaacggtggggaacggaaggtattatttcttctttttatggacaggtaactgactggcgcgccgctctttgaggtacgacaccaggctgtagatggcgacgcccagcagcgccaccgcgacgataaagagaataagacccgacatagaccaacctaatattctgtttggaaagggaaaaagatacagggctctgtgtgaagataacatcgggatatgtctgaaagatgacgcctcatcgcgagaatatccggcggcggggttgtgataaaatgtttcccgcagggatgtgaccgcctgggtttcagctgaaatggcgtaacactccgttaagtgattttacagaagtgcggcctacagcgagttacgctgaccgcgaataagaacgatctgagagtcagtcatgtataagaaaaccctcagcctgctgggcgtagcgttggcgctgtctgccttcgccagtcaggctgaaagtgaacgtcaggcgagccgcgagcggatcgtggagcaggtcctcaagccgtgtgaaggcaaaaaggcgggcgataaggtggtgattaccgatcgccgcggcggcgagcacgaggcgatctgtaccctgacggcggttccgctaccggagtagcgcccgccgcacggtgccgcttatcgataccgcggcgcaggctgtccggttcgcgcgctggtaaacagcgccactctggactgctcaaaagtctcccacagtcccaggtcatgaaccggtggtaaggtgacctgttcccccatctccagccccctgagagcggcgtcaaccagatcctcggtggtcattaccgtgccgctgggcagagcgtccagcgccacgccggaggtcggccacagatcggtagcggtcgccgccggcaataccgcctgaatacgcacgccgctgtcggcaaactcctcctgcaggccgcgggtgaagctcaacacccaggctttgctggcgctgtagactgcgctgcccggcagcgtatgcagcgcgaggatagaggcaatattgatcagcgtcccccggtgtcgtggggtgaaagcggccagcgcggcatagctcagacgcagcagcgcggtggtgttgagcgtatgaatcgcctggtgctcgcgtggcgtactggcgagaaaacccgccaatttcgcggtgccggcgttgttaatgaacaggtcgatggcgggatcctgctgcagacgctgctctacggcggcaatcccgtgctcttcgctaagatcggctttgaggatgcttgcctggatggcgtagcgcgcctgcagctggtcggcgagcgcctgcagacggtcttcacgacgggcggcgaggatcaggttgtagccgcgggcggcgagtcgttcggcatagatcgcgccgatacctgaggacgcgccggtgataaaagctgtgtgcgatggttgggtcatgagaaatgcctcgtaaaaggttgcattattaaaccaaattcagcatgagatattaggtttaataatgcaaccattttgccaggactttttcatttttgcctgtcgagggcagcgtttagtcgttcagcgggatagcgatggtgatgtccgccggggccagctcacggccatccgccgcctgcaggaccagcttacgcaggggctggcgctgctggcggtcaatgagccgggtcgccggttcgtcaggatcgaacagatagtcgtctgcccactgggagagggcgaccagcaccgtttgcagggcacggcccttatcggtcaggacatactcctgccaggcgctgccgtcggaggccggctgcaggcgcaggatgccttcatccaccagcattttcagccgcccggcgagcatgtttttggcgataccgaggtttttctggaattcgctaaaacggcgcaccccgcgcagagcatcgcggacgatcagcagcgaccaccagtcaccgataacgtcgagggagcgggcgatagggcaacagctgttttccagacgggtacgtttcacgaaagcctccaggttaattgtttcattataaaactctttgccctgcaggggaaattttcggctacggtctaagtttgcgagcgattaccaggaaaaatgtcataaatccggcacaattaacgcgatgataataaatgactaaggatgaagggatgaaaaaacgtctacttgccgccgccgttgccggcgcggtgatgttatccgctggcgctcaggcgcaggacacggccgccccggaggggtatcagctgcagcaggtgctgatcatgagtcgtcacaacttgcgtgcgccgttggccaataacggcagcgtgctggagcagtccaccgccaaggcctggccgcagtgggatgtgccgggcggccagctgaccaccaaaggcggtgtgctggaggtgtatatgggccactatatgcgcgaatggctggcgcagcagaagctggtgaccagcggcgagtgcccgccggaaaacgcggtttatgcctacgctaacagcctgcagcgcaccgtcgccaccgcgcagttctttatcaccggcgcgttcccgggctgcggcatcccggtgcatcaccagccgcagatgggcaccatggacccgaccttcaacccggttattaccgacgactccccggcgtttcgcgagaaagcgctgcaggcgatggaaaaagagcgccagggaatgcagttgaccgagagctacaagctgctggagacgatgatcgattaccgcaactcgccctcctgcaaagagaagaaggtctgttccctgagcgagggtaaagatacctttagcgccggttatcagcaggagccgggagtgtccggaccgttgaaggtgggcaactcgctggtagacgccttcaccctgcaatattatgaaggcttcccgaaagatcaggtggcgtggggggagatcgccagcgataagcagtggcaagtgctgtcgaagctgaaaaatggctatcaggatagtctgtttacctcggtggcggtggcgcaaaacgtcgccaaaccgctggttaaatatatcgataacgcgctggtgggcgagggagccagcaaggcgaaagtcacgctgctggtgggacacgactcgaatatcgcttcgctgctcaccgccctggattttaagccctatcaactgcccggccagtatgagcgcactcctatcggcggcaaactgctgtttcagcgctggcatgacagcgccggtaatcgcgatctgatgaagattgagtatgtctatcaaagtaccgagcaactgcgtaacgccgacgcgttaaccctgcaggccccgccgcagcggatcactctggcgcttaacggctgtccggttgatgaccagggattctgcccgctggagacctttaaaaaggtgatcaacgaggcggcgaaataacgaaaaaaacccggagcactccgggtttttttagcaggttagggtgagcccaggtggggataaacctcctagacgtttttacgctcaatcgtctgttcgccccagaacaggctgtctttatcggttttggcaaaggccagcgccagcacttcgtcgctgccttcctcccagatttgctccgccagtttctcatcgtagtgggcgacttcgaaaatcgcctcggcaatttccggtgaggtgttacgtaaacttgcccattcgccgacgcgatgtgcttttgcttcttgagttggcatagtgctcctcctgcagaagattagccgtgcagtttaacggccagtttggcgacatgttcaccctgatagcgggcgatggctaactcttcctcgctcggctgccgcgagccgtcgccgccggcgatggtggttgcgccataaggggtaccgccgcgtacctgggagatatcgaatagctcctgggcgccatagccgatcgggacgatgatcatgccgtggtgggccagcgtcgtccaggtcgaggtaatggtttgttcctggccgccgccggtaccggttgagctaaatacgctggcgattttgccatacagagcgccggacgcccacagaccgccggtttgatcgaggaaagtacgcatctgaccggacatgttgccgaagcgcgtcggggtaccaaagatgatggcgtcatactctgccagctcctgcggcgtggcgacgggcgcgttttgcgttttcccgcctgctttggcgaatgcttcagcctgcatggtttccggcacgcgcttcacaaccacctcaacgccgtccacccggttcgccccatcggcgacggcgtgagccatggtttcaatgtgtccatacatggaataataaagcaccagaattttagccatttccatcactcctcggttgcattataagccagcaaaatagctggtacctttaaagataaagcctccgccggagagtgcaaatccaacgggcatttgtttgatttataacaaaatgacaaagcgttatttacttttccttgcaccgcgcggcctgaaaggaagtgaaggaggaagcgttgcgcctgctattttggccgctgcggcgaggatgtagcatcaggatacatttttgctgactattttttcttcgccagcagagtcggttaggagctgttcgcggcgcgaggaagcttttttcgcccggctttgtttctggatattacattcgccgccgtcagccgcagtcattcactaaccttatagatacgcggcaggacagcggcgtcgccgctcccgcgtaatgcactatgatgtctaacctaatggaggtcagtaatggcaaaccatcgtggcggttccggcaactttgccgaagaccgtgaaagagcatcagaagcaggacgtaaaggtggccagcatagcggggggaattttaaaaatgaccctcagcgcgcctcagaggctggcaaaaaagggggtaaaaacagtcatggtagtcgtgaaagttaacgcgcgactcgcactgttctctttgatgcggtgttaatctccccgacccaaccgcatcgccctcgccgccggcatctgccggcggtttttttatctgtcggtggttgcgctcccgccgggcggattgcacactggtcgcccgttaatcgtcatggctgtcttatgtcttcgttaaaattctccgttagccgccaggaagcgctccttatcatgatcaccatgttctggggagggacgttccttgccgtacagtacgcggtgagcctcagcgggccgctgttttttgtcggtttgcgttttgcgactgccgcgctgtcggtgggcctgctttcgctgcgcactctgcgcggtctgacgtggctggaggtgaaggccggggtagcgattggcgtggcgattgcgctggggtatggcctgcagacctggggactacagaccatctccagcagtaaatctgcctttatcaccgcgatgtatgtgccgctggtgccgctgctgcagtggctgtgcctgggacgtatgccgggggtgatgtcctgcgtggggattgtgctggcctttattggtttaattctgctggccgggccggaaaataatctgctggcgcttggcgtgggggagatgatcactctggcaagcgcggtggcgatcgcggcggagattatccttatcagcgcctgggccgggaaagtcgatgtccgccgggtgacggtggtgcagctggcgaccgcgtcgctggtggctttcgccgccatgaagccggcgggtgaatcggtgccgtcgttgacgccggccctgctcggcgtcgcgctggggctggggattttcagcgcgatcattcaggtgaccatgaactgggcgcagcgcagcgtctcgccgacgcgggccacccttatttataccggtgaaccggtatgggccggtatttttggccggctggccggtgagcgtctgccgctgctggccctgctcggctgcgttttgatcctcgcgggagtgctggtgagcgagctgaagtggaagcgcaagtcgccgccgcaggtttccacaaacgacgatgcgcagccgctcacggacctggccgatcgccgcgagccataatattttccttctgacccgacagcggcgcttatcctggctggtactcgtccggctctgattgtctccaggcccgtgcaagcgcagcgccgccgggcggtcaggttccgtgcccgtggtggtgccggatggcggcataaatgccttatccggcctacaggatcacaccacccaggcccacaccgctccctgcgccaacgccgcgctaatgtggcttacaccggcgttaccctggcctccttcgcctcgcgcgtcccgcgatgaagcagcgcgtgcagcaggatcgccccgaaggtggctgtgccaatcccgcccagcgtaaagccgcccagcgacagcgcgaaatcgccggcgcccagcaccagggtcaccgacaccatgatcaaattgctgttttgactcagatccacccggttttgcacccagatccgcgccccggcgacggcaattaagccaaataccacgatcgaggcgccgccgatcaccggcccgggaatggtgtggattaatgcgccgaacttcggcgagaaacccaacagcatggcaatcagcgccgcggcgacaaacaccagcgttgagtagaccttggtcaccgccatgacgccgatgttctccgcataggtggtgaccccgctgccgcccaccgaaccggagagcatggtcgccagcccgtcgccgacgaaggcgcgccccatgtacgggtccatattgcgcccggtcatcccggcgacggccttcaggtgcccgaggttctcggccaccaggatcaccgcgaccggcgcaatcaacatcatcgcctggccgttaaaggatgggggggtaaagtgcggcagcccgaaccacgccgcctgggcgaggggggagaagtccagcggtttgccaaggcccaggccgttagccagcagggcgtacagcgcgcaggcgacaatcaggccgaccaggatcagcagtcgctgcagcatcccgcgggtaaataccgccactatgccgatgcagagcacagttaacaccgccatccagctgtcgaaggcgctggcggagacgctgcgcacggcaatcggcgccaggttcaggccgatagccatcaccaccgcgccggtcaccaccggcggcatcaggcgctcgatccagcgggtgccgatcttcatcaccaccagaccaatcagggtgtagaccagcccgcaggcgatgatcccgccaagggcgacgctcagatgagggttcagcccctggccgttaaagccggtaatggcgatcaccaccccgacaaaagcggcgctggagccgagatagctcggcacccgtccgccggtgacgacaaagaacagcagggtgccgacgcccgacatcagaatagacaggttcgggtcgagccccatcaacaacggcatcagcaccgtcgcgccgaacatcgcaacggcgtgctgcacgcccatcaccagcgtttgcccggccgacaagcgttcatcgggggcgacaacgccggattcggcggcgggggaggtcagcttccagcgaggaaaatcgaagagtgccatgatgatatcccgggttaaaggttaacaagcgggtcgcataagcgtgtgatagccgcggtcaaaccacatcagtccccggggctccgggtgacgggtaatggccacgacgtgacaaaacagaatgtcgtgcgtcccgacgctgacgcgctggtcgatgcggcagtcaaagctgaccagagccgcctccagccgcggacagccggtggcgccggtctgccagtcggcggcggcaaaacgctcgtccattgccgttttaccgccaaacagcgtcgacagggcctcctgtccggccgccagggtattgacgcacagcgtgtggtgttcgctgaacaccggccacaccgaagccgagcggttcaggcagaccagcagggtcggcggcgtgtcggtaacgctgcagaccgcgctggcggtgaaccccgcccggcccgccgggccatcggtggtaataatgttaaccgcggcgccgacgtgggccatggcgtcacggaaactcgctttgtccgttaactccatcgtaaactccttatgccagcaggcaggcttcatcaaaggacaggcgcggcaggcggccgtacagcttgccggggtcgccatagccgatattcaccagtagattgcttttccagccgttgtcggcaaaaaatgccgcgtcgactttttcccggtcaaaaccggacattggcccggtgtcgaggcccagcgcccggcaggcaaaaatcagatacgccgcctgcagggagctgttgcgaaacgcggtctcttccgccagctgcgggctggaggtaaaccagctgcgggcgtcaccgtggggaaacagggtcggcagccggtcgtagaaggcgctatcccacgccacgatggcggtcaccggcgcctgcatggttttctgcagattgccgctggagagcgtcgggcgaagtttctctttgccttccgcgctgcgcacgaacacgatgcgcgctggcgaacagttggcggaagtcggccccattttcatcaggtcccagacggcctgcagctgcgcatcgctcaccggcttatccagccagccgttgtgggtccgggcctgggtaaacagcgtctcgcaggccgtgtggtttatcgcgtcgttcatcgggtctccctggcgaccggcagcatagcggacagcccgtcgcgtaaaatggtattaaaggtatcggcgtcggtgacgttacaggcatggccgccccacggcatttccacgagctggctgccggggatcgccgtctgcagcacgcgggagcaggaggcggggaccagcaggtcgtcagcggcgctgataatcagcgtcgggcaggcgatggccgacgcacggcgtgaaaaatcagcctgcttcagggcctgcagccgcttcagcagattctctttgccctgaaaatggctgatggcaagcgcatcttccgcttcgaggcgcggcaggcgcgcggccatccattccgccgggtagagaaatagcggctgcgcttcgacccacgcctgcgcgccgccggcatgcagcagacgctcgcgcacctggaagcagcggcgggtatgcggcgacagcgacagccagccgttgaccagcgccagggcgctcaccgcctcggggcgatcgagcgccagctgcaggccaatcagcgcccccagggcgtggcccaccagcgcgaagcgggcgatccccgccgcccgcagagcgctgaacagctccccggccatcgtcgccaggctgtagccggcgggcagcggaccggcgttctccccggtcccgttatggtcataactcaccagctgatactgttcctccagcgccgcgcgctgcgccagccagtagccgccgcccccgcccagaccggcgctgaggaccaccaccggcgcgccgggccacggagccggagcaatattgagcctcatcatgtcggggtaccgatatgggcgacgctggcgatttccaccagcgcatcgggcttcaccagtccgcactgaatgcagaagcgcgccggtttatcgccggggaagaactcggcgtagacctcgttaatcgcggcgtaatttgtccagtcggtgataaagatgctgttgaaagtcacatccgccatactcccgcccgccgtttcgataacgctcctgatggtctccagcacgtggcgggtttgcgcctttgggtcgccgatgtgcaccacattgttttgcttatcaaacggcagggtgcccgagacgtagaccaccccgtcggcgagcgtccccggaacaaagggggcaatcggcgcggtggtgcctggcggaataatcacctgtttaggcataacgtttctccttggctaaagccagcggggcggcgggggacagcgcgtggcagaagctctcgacgtcgctgacccagccgaaaaaggtttcaatattgaacagcgccgcctgctgggcgaaggccgggccggcctgatgggtggcatcctccagcacgatgccgaagtattcgagaaagaagccatcgcgcagcgtcgattcgacgcagacgttggtggcgatcccggtgaacaccaggtggcgtatgccgcggctgcgcaaaatgctgtcgagcggggtgttaaagaagccgctgtagcgcggtttcggcaacacgatatcgccttcctgcggcgtcagctcgtccaccagctgataatcccagccgcctttcgccagcagcttgccctgcagctccggacgctgacgcatcgttttcagcgcgttggatttgtgatagttcggcgagcccgggccgccggcttcaacatactgatcatcccagccattctggaaccagataatcaacatacccgcggcgcgagcggcggcgacggcggtattaatattgtcgataaccggccgggtagcggagacgtcaaagccggcgagatccagataaccgccctggctggcgtaggcgttctgcatatcgaccacaatcagcgcgctctgctgcggcgcgaaggtcagggattccgggcgagcgggaagggtaatcatcaggccacctcacgggtaacagaagcaatgtggttccggcagcgcatcagcggctgaatgcgttcgccaaaggcgtcaatgccggcaagaaaatcatcaaaagtcagcagcacgccgtcggtgccgggcacgctcgctacttcatcaagcatacgggcgacgctggcatacgatccgaccagggtgcccatgttaatgttgaccgccgaggtggggtcggccatctggcgcacgttggtatcgctgccggagcgggtatctttctgactctgctcggtgagccacgccagcgcttcttcatcggcgcccgctttgtaatgttcccatttggcgcgcgccgcctcgtcggtttcgtcggcgatcaccatgaacagcacataggaccccacgtcgcggccggttttttccgccgcctgcatcatgcgtgcggcggtcggggcaaaggccgttggcgtgttgacccctttgccaaagcaaaagttgtagtccgcatgctgggcggagaaggccatcccggcatcgctctgcccggcgcagatcaccttcatcggctgcgacgggcgcgggctgacccggcagtcgttcatggtgaagtagtcacctttgaaatcgctgcgcccggtgccccacaggtcacggagcacctggacgtattcggtgagatagtcatagcggctggcgaaatagtcatctcccggccacatgcccatctggtcatattccggtttttgccagccggtcaccagattgacgccaaaccggccgccggagatggagtcgatagtggaggccatccgggcgacaatcgccggcggcagcgtcagggtggcggcggtggcgtagatctggatcttcgaggtcaccgcggccaggccggccatcagggtaaaggactccaggttgtgatcccagaattcagttttcccgccgaagccgcgcagtttgatcatggagagcgcgaagtcgaaatggtagtgctcggccttctgcacgatggccttattcagttcaaaggtcggcatatactgcggggcatgggtggagatcagccagccgttgttgccaatgggaacgaaaacaccaattttcatacctacctctctgcagtcatggaagatgggttgcgatggtgcggcatcctgcctctccctggaccacctcgcagaaaaggtaaagcaaaggcgatgccagttttataaatgctaatgttattaatgtgttacttttgagttgctaaaaaggacgataaaaaagtggactggatggtcaaaatcagtgcacgaaaaaacggcagtcatgcgcaatcagggtgcatggggtcgtgtcggcgcagggcttttgctatgctggtggcgtcaactgaaggagaggatgtatggcacagggcgcggtgaagaaaagcggcaaacgttcacaagcggtcagcgccaaaaaggaggccatcctggccgccgcgctggaggcattttcgcaatttggtattcacggtacgcggctggagcaggtggctgagcgcgccggggtatcgaaaaccaatctgctctattactacccttcgaaagaggcgctgtatgtggcagtcctgcagcagatcctcgccatctggctggcgccgctgaaggcctttcgtgaggatatcagcccgctggtggcgatccgtgaatatattcgcctgaagctggaggtgtcccgcgatcatccccaggcctcgaagctcttctgcctcgagatgctgcagggggcgccgctgctgatgggcgaactgaccggggatctgaaagcgctggtcgacgaaaaatcggcgatagtctccggctggatcgaccgcggcaagctggcgccggtcgatccacagcatttaatctttatgatctgggctaccacccagcattacgccgacttcgccacccaggtggaggcggtcaccggcgccacgctgcaggatgcggccttttttgaacaaacggtcgataatgtccagcggatgattatcgaaggcattcgcgtccgttaattggcgggcggcagcgggcagctttgatcgccatcctcgcactgtagcagcgaggcgaggaaagactcccgctccacgctcttatcggtcatgcactggctgaccagcattggctgcatgctgccgccttcggcgccggacgcgagaaaggcgcagtcggcgtcgcggagggcgatccatgcctgctgcgcctgcttcagtaatgtttgttgtttacccaccgcccgctgcagggcctgctgccaggtgtcgttcagttttttatcggccgcctgatactgcgcggccgcgcactgattcatttcggtttgggtgttggcgctgctgcactcgtccgccagcgccgcgccgctggccagcagggccatcacggcaaataacgtgcgtttcattgttctgctcccataaaaaagctcccgtccgggagccttaattaaacacagctgacgtcggctgtcattagctgatcgcagcgcagactgattgcccggatggcggcgcaccgcgccttatccgggctaccctttggcggtggtaggtagccccggtaagcgtagcgccaccggggggcccgttttagccgatggtcatcaggctggcgttaccgcctgccgccgcggtgttaacgctcagcgaacgctcgatatacagccgctccagcagcagattggtttcgccgcgggcgaagccctgcacggagacaatcgccccgtcgcgcgccgccacctgctcgcacagctcgcgcagctggtcggaatcgccgtggtagataaccgcgtcgaaggcctggccaggcaactgctccgctttggcaaagcgaatgcgctcgctgacctcccgcggcagtttcttcgccagatcgcgctgcagggcgctgtccggccacagtacttcacaacccaccgccagcacagccgccagctggatcagcgcatcctgttcgttatccgctacgcacagcacgcgctcgcgcggcatcagcgtcagggtgttgcgctcgccggttggccccggcagcaggcgttgggtgccgctttgcgcctgctcgctgtactgctggcacagcgcctgcagctcaggacggcccgcggcccactgctgcagcgcctgcagcggtttttccagcagcgttttcagctgggcgtccagcggacgctccgcatcctggcgggcgaaggttacgccaaccgcgtcctgtggacggctggagagcagacggtacagatacagcggaccgccggctttcggaccggtaccggacagcccttcgccgccgaacggctgcacgccgaccaccgcgccaaccatattgcggttgacgtacaggttgcccaccttggcgctgccggtgacctgggcgatggtttcgtcgatacgggtatgcacgccgagggtcaggccgtagccagaggcgttaatctgctcgaccagtttgtccagctcgttacggttatagcgcaccacgtgcagtaccgggccgaagacctcttttttcagctcgtcgaagctgtcgagctcgataagcgtcggcggcacgaaggtcccgtgacgccattcgcgggcgtcttcgctattctcgcgcaccgcctggtagacggtgcggcctttggcgcgcatcgcctgaatatggcgttcgatattctctttcgcttccgcatcgataaccggaccgatatcggtggtcaggcgccccggattgcccatccggcactcgctcatggcgccgcgcagcatggttaaggtgtgatcggcgacctcttcctgcaggcaaagcacgcgcagggcggagcagcgctggccagcgctgtcgaacgcggaagccagcacgtcgatcactacctgctcggtgagcgccgacgaatcgacgatcatcgcgttcatcccgccggtttcggcgatcagcggcgtcgggcggccctggggatcgaggcggctggcgatattgcgctgcagcagggtggccacttcggtggagcctgtgaacatcacgccgcgtacgcgctcatcggaggttagcgcggcgcccacggtctccccgcgacccggcagcagttgaataacgcccggcggcacgccggcttccagcagaatcgccacgccctgggcggcgataagcggcgtctgctcggcaggtttcgccagcacgctgttgccggccgccagcgcggcggcaatctggccggtgaagatcgccagcgggaagttccacgggctgatacagaccaccggacccagcgggcggtgagtttcattatcgaaatcgtcgcgcacctggcctgcgtaatagtgcaggaagtcaacggcttcgcgcacttcagcgatggcgttgctgaaggttttacccgcctcgcgcaccaggatccccatcagggtcggcatctggctttccatcagcaccgcggcgcgctcaagaatggcggcgcgctcctgcggcggagtggcgaaccagatcggcgcattgttgatagcgctggtcagcgcctgctgcacttcagcgtcgctggcttcgcggacgtagccgacgatatctttcggctctgccgggttaaccaccggctgcatttcgccttcggccaccggctgctccagcatcggcaatgcctgccatttatgcagcgcgctgttgagcagggaagaggagagggaggccagacggtgctcgttcgccagatcgagaccggcggagttgctccggccgctgccgtagagatcgcgcggcagcgggattttcggatgcggcaggccggcctggccttcctgctgcgccagtttttctaccgcgctgaccgggtcggccaccagctcgtccagcggcagggtattgtccgcgatacggttgacgaaagaggtattggcgccgttctccagcagacgacgcaccagatacgccagcagcgtctcgtgggtgcccaccggggcgtagatccggcacggacggttcagcttgccgtcagcgaccttgcccactacctgctcgtacagcggttcgcccatgccgtgcaggcactggaactcatactggcccgggtagtagttctggcctgccagctggtagatagccgccagagtatgggcgttatgggtggcaaactgcgggtaaatcaggttcggcaccgccagcagcttcttcgcgcaggcgaggtaggagacgtcggtgtaaaccttgcgggtgtataccggatagccttcgagaccttccatctgcgcgcgtttaatttcgctatcccagtaggcgcctttcaccagacggatcatcaggcgacggcggctgcgggtggcgaggtcaatcaggtaatcaatgacaaacggacagcgcttctggtaggcctgaatcacgaagccaatcccgttccagccggccagttccggctcgaagcacagtttttccagcaggtcgagggagatctccagacggtcggcctcttcggcgtcaatattgatgccgatgtcatactggcgcgccagcagggtcagcgatttcagccgcgggtaaagctcttccatcacccggtcatactgcgcgcggctgtagcgcgggtgcagcgcggagagcttaatggagatacccggaccttcataaatgccgcggccgttggaggctttgccgatggcatggatcgcctgctgataagaaaccatataggcctgggcgtcagcggcggtcagggcggcttcgccgagcatatcgtaggagtagcggaaccctttttcttccagcttgcgggcgttggccagcgcttcggcgatggtttccccggtgacgaactgctcgcccatcaggcgcatcgccatatccacgcctttgcggatcagcggttcgccgctcttgccgatgatgcggttcagggagcgggagaggctggtctcgttatgggtcgacaccagttttccggtgaacagcagcccccaggtggcggcgttgacgaacagcgacgggctgcggccgatgtgcgactgccagttgccgttgctgattttgtcgcggatcagcgcatcgcgggtggctttatccggaatacgcagcagggcttccgccaggcacatcagcgccaccccttcctgtgaagagagggagaactcctgcagcaggctctgcaccataccggcgcggccgctggcggttttctggttgcgcagtttttccgccagctgatacgccagcttgtgcgcctgttcgcccagcggctgcggcagacgggcctgctccagcagcatcggtaccgcgtcggtttccggacgtcgccaggcggcggtgatcgccgcgcggctcaccgactgcggcaggatctgctcggcgaattcgaggaacggctgatagggctcttccgttggttcgctggcgtcatcgctttcgttggcggccccggagagcagggccggcagctcaggcagcgtctcgtcgttctccagtttttccagataattaaagatggcctgcttaatcagccagtgcggcgtgcggtcaatacggctcgcggcggatttaatgcgctcgcgggttgcgtcgtcaagcttaacacccatggtggtggtgcccatgctcaaaactcctgtcatttatcgttaggcttatgcggttgcatggaaatatccactatgttgcaactttgtgcaaccttgttaattgtggcttgtgacggaagccgtgaaatggctaatttgttaaaaataacccctaaaatagcagaaatttaaccccgggctcatagggtatttgtatgcgtgagttaacacttttgtttggtgcaacctttaaaaacgtgagagagtgcaacctctaacaaattgacgttttgcgccgtcggtttttcgtgtaaatgctgtgttaaatcgtttgtgaaaaaccgaagcttccgtcaggatacggtcgcccaattaaacaatgcgccattaccccgttccggtagtggaaaaaaacgacgaagttggacgctgtcgataaaaattctggagactttgcatggctattagcacaccgatgctggtgacatttattgtttatatttttggtatggtattgatagggtttattgcctggcgttcgaccaaaaacttcgatgattatattctcgggggaaggagtctggggccatttgtgaccgcgctttccgcaggggcgtcggatatgagcggctggctgctgatgggtctgccaggggcgatttttctctccgggatttccgaaagctggatcgccattggcttaacgctgggggcgtggattaactggaagctggtggccggtcgcctgcgcgtgcataccgaggtgaataataacgccctgacgctgcccgattattttaccggccgttttgaagataaaagccgggtgctgagaattatttcggcgctggttattctgctgttctttaccatctattgcgcttcaggaattgtcgcgggggcgcgtctgtttgaaagcaccttcggcatgagttatgaaaccgcactgtgggccggggcggcggcgacgattatctataccttcgtcggcggcttcctcgcggttagctggaccgataccgtgcaggccagcctgatgatttttgcgctgatcctcaccccggtgatcgtgattatttccgtcggcggctttggcgattcgctggaagtgattaagcagaagagcatcgaaaatatcgacatgctgaaagggctgaacttcgtggcgattatctcgctgatgggctgggggctgggttatttcggtcagccgcatattctggcgcgctttatggcggcggattcgcaccacagcatcgttcacgcacgtcgcattagtatgacctggatgatcctctgcctcggcggggcggtggccgtcggcttctttggcatcgcctacttcaataacaacccgagcctggcgggcgcggttaaccagaacgccgagcgcgtgtttatcgaactggcgcaaatcctgtttaacccgtggattgccgggatcctgctgtcggcgattctggcggcggtgatgtccaccctgagctgtcagctgctagtctgctcgagcgcaattaccgaagacctgtataaagccttcctgcgtaaaaacgccggtcagaaagagctggtgtgggtgggccgtatgatggtgctggtggttgccctggtggccattgccctggcggccaatccggaaaaccgcgtgctgggtctggtgagctacgcctgggctggcttcggcgccgcctttggcccggtggtcctgttctcggtaatgtggtcgcgcatgacccgtaacggcgcgctggccgggatggtgattggcgccctgaccgtgatcgtctggaagcagtttggctggctgggcctgtatgaaattattccgggcttcgtcttcggcagcatcgggattgtggtctttagcctgctggataaagcgccgtcggccagcatgcagcagcgctttgccgaagcggatgcccactaccatacgccgccgccggtacgcgccacggctgagtaagatcatctgatgctcacgagcccgccgctggcgggctttttattgcctggtgccgtgccggaatattataacccttgctaattatctgaaaatccgctgatatttcctgactaataacaatgaggatagcaaagatgacgttcagacagggtgcaatggcgctggtgctggcagggttactcagcggctgcgtggcgggtggaagttcatcgaccagcgcgccgaagcccggcgtctgcccggcggataagtccatggtgcaaaccacgctttacttcggtctgagccgcccggcggggaaagacatcaccgctgaagagtggcaacagtttgtcgaccgtgacgtcacgccgcgctttcgcgacgggctgacggtgtttgatgcccacggccagtggcttggccagaatggtcaggtggtgcgggagcagagcaaggcgctgatggtgatccatgggcatgacgcgcagagcgaggccggtattgaggctctgcgccagggctataaatcacgcttcgcgcaggagtcggtgatgcgtgtcgaccagccggtctgcgtgcagttctgagtaaacggcgggggcagccccgccgtttgttttacagcaccagcccggcgaagctggcggaaagcaggcttaccagcgtggcgctatacaccagccgcaggccgaagcgggagacgatattgccctgcggttcattcaggcctttgatcgccccggcgataatgccgatcgaggcaaagttggcaaacgacaccaggaataccgagagaatgccgagcccgcgaggggtcatgctggcggcaatcttttgcagctcaatcatcgccacaaattcgttagcgaccagtttggtggccatgatgctgccggcgtttagcgcatcgctcagcgggatgccgataagccacgccagcggataaaagacgtagccgaggatctgctggaagctgagaccaaacagggtggcgaatagcgcgttaatggcgctgatcagggcgataaaaccgatcagcatcgccagaataatcatcgccactttaaagccggccagaatatattccccgagcatttcaaagaaactctgcgattcatgcagcttctcgagttttatttcctgctcgctgcccggccgcgtcgggttaattaccgacagcacgataaaggtgctgaacatattgaggatcagcgctgcgacgacatatttggcctccagcatggtcatataggcgccgacaatcgacagcgatacggtcgacatggccgtcgccgccatagtgaacagtcgccgtgaggagaggtcgcccagtacgcccttgtaggcaatgaagttctccgattgaccgaggatcagcgagctgacggcgttgaaagattccagcttacccatgccgtttactttcgacagcagggtgccaatcacgcgaataaaaatcggcaggatccgccagtgctggagaataccaatcagcgcggaaataaacacaatcggacacaggacgccgaggaaaataaaggctaagcctttttcgctcatgccgccaaagacgaaattggtcccttcggcggcaaagcctaacagcgaagcaaaaaagccggaaatattttttaccagccacaggccgctttcggcgtgcaggaaaaagaaagcgagcgctatttcgataataatcaactggagaatataacgaatacgaattttttgtctgtcgtagctgacaagccaggccagggcgaggatcaccgccagcgccagcaggaaatgaaaaaatgcagtcatgttgttcttttcgcaagtcaataaggccgccatttagccatagccgctacggcgggtaaatatctggcgtaaaaaatcctttgcttattctttcccttcataacaggcgaatattttcataagtcattatttgtcagcgatttatttacaactgatcatcattctctgcacatttcgcttgtgtttctgagcattgtaatgataatcactatcataaatattacctgtttttgcattcgttgacggtgctttacatttaagggtattggcatgtttgtcccatttctcattatgttacgcgaaggcctggaggcggcgctgattgtcagcctgatcgccagctatcttaaacgcacccagcgcggcaactggattggcgtgatgtggattggcgtgatcctcgcggcggcgctatgtcttggcttaggcatttttatcaacgaaaccaccggtgaatttcctcagcgtgaacaggagctgttcgaagggatcgtcgcggtcattgcggtggtgatcctgacgtggatggtcttctggatgcgcaatgtctcacgcaacgtcaagcagcagctggagcaggccgtggacaaggcgctgcagcgcggtaatcaccacggctgggcgctggtgatgatggtctttttcgcggtcgcccgtgaggggctggagtcggtcttctttctgctggcggccttccagcaggatgtcggcatctggccgccgctgggggcgctgctgggtctggccaccgctatcgtgctgggcttcctgatctactggggcggtatccgccttaaccttggcgtgttcttcaaatggaccagcctgtttattctgctggtggccgctggcctggccgcgggggcgatccgcgccttccacgaggcgggcctgtggaacctgttccaggataccgccttcgatctgagcaacgtgctgtcgacgcatacgctgttcggcacgctgctggaagggatcttcggttatcaggagacgccgagcgtcagcgaagtggctgtctatctgctttatctgatcccggcgctggtgctgtttgccctgccgccgcggaataataccactgcctcgcgggctgcctgaccgggcgctgcgagcttataagcgacactctacttaccgaaagggatgatcatgatgattcattttcgccgtaatgcgctgcgggtgaccgtggccgcgctgctcagctctgcatttggtgctcaggctgcggatatcccgcaggttaaagtcaccgtcaacgacaagcagtgcgagccgatgcaggtgaccgttaacgcgggtaaaacccagtttattattcagaaccacagccagaaagcgctggagtgggagattctgaaaggggtgatggtggtggaagagcgcgaaaacatcgcgccgggctttactcagaagctcaccgcgaacctgcagccgggcgaatatgacatgacctgtggcctgctcaccaacccgaaaggcaaactgatcgtcaccggcgccgccaccaaagacgcggcgaaagcggatgcggtgctgagcctcggcgacgcgatcaccgcctataaagcctatgtgacggcggaaaccgcgcagctggttagcggcaccaaagcctttaccgacgcggtgaaagccggcgatatcgaaaaagcgaaagcgctgtacgccccgacgcgtcagcattacgagcgcatcgagcccattgccgagctgttctctgaccttgacggcagcatcgacgcccgcgaagacgacttcgagaaaaaagcggaagatccgaaatttaccggtttccaccgtctggaaaaagcgctgtttggcgataacagcgtcaaggggatggaaaaatatgccgatcagctgaacagcgatgtgctggagctgcaaaagcgtatcagcgagctggcgttcccgccgtcaaaagtcgtgggcggcgcggcaggattaattgaggaagtcgcggccagcaagatcagcggtgaagaagatcgctacagccataccgatctgtgggacttccaggccaacattgacggcgcgcagaaaattgtcgacctgctgcgcccgcagctgcaaaaagagaacagcgcgctgctggcgaaagtggacgccaactttaagaaagtggacagcatcctcagcaaatatcgcaccaaagacggtttcgagacctacgataagctgaccaccgccgaccgtaatgcgctgaaagggccgatcaccaccctggcggaagatctggctcagctgcgcgggatcctggggctggactaagtcgatggcacaacagaaaccccacgacgtgaacgaaccgtcacgtcgtcgcttactgaaagggatcggtgcccttggcggcgcgctggccatcgccggcggctgcccggtggcccatgcggcaaaagcggaaagctccccggggacgctggcacctgacgcgcgtcaggaaaaacagcccttctacggcccgcatcaggcgggcatcctcacaccgcagcaggcttcgatgatgctggtggcgttcgatgtgctggcggccgataaagccgacctcgagcgtctgtttcgactgctgacccagcgtatcgcctttttaacccagggcggcccggcgccggacacgccgaatccgcggctgccgccgatggattccggcatcctggggccgtggattgccccggataacctgaccatcaccgtctcggtcggccattcgctgtttgatgagcgttttggcctggcggataaagcgccgaaaaagctgcagccgatgacccgcttccccaacgattcgctggatgccgccctgtgccatggcgacttgctgctgcagatctgcgccaatacccaggatacggtgatccatgccctgcgtgatgtcatcaaacatacgccggatctgctgagcgtgcgctggaagcgggaagggtttatctccgacagcgcggcgcgcagtaaaggcaaagagactcccatcaacctgctgggattcaaggatggcaccgctaacccgccgagcgacgacagcgcgttgatggataacgtcgtgtgggtgacagccgatcaggacgagccggcctggaccgtgggcggcagctatcaggcggcgcgcatcatccagtttcacgtcgagttctgggaccggacgccgctcaaagagcagcagaccatctttggccgcgacaaacacagcggtgcgccgctggggatgaaaaacgaacacgataccccggattacagtaaagatcctaacggcgaagtcattgcgctggatagccatattcgtctggccaatccccgcacgccggaaacccagtccagcctgatgatgcgccgcggctacagctattcgctgggggttactaacgccggacaactggatatggggctgttattcgtttgctatcagcacgatctggaaaagggttttctgacggtgcagaaacggcttaacggcgaggcgctggaggagtatgtcaaaccgatcggcgggggctacttctttgttttacccggcgtagtggatgaaaaacactatctgggagagtcgctgctgcaggcctgataccaaccctgcccgtaagggcagggcgttttctgctgtttttctcatttttcttatatttcctgccatgtgttatatttctgtaatacaaatgaccgatagtctcctacacttgcttaagaactatttgttgcgtcattgtgaaaaataagttgcattaagaatcttttttgatgtacttattacatacgcggtagttcccggcagtgtgacgtttcactatggagatcgcgaatggtaaggtcccgtaccggacaacgtaaaacctcagaccgtactcttcagcacggaagccccgcttccggcagcgattttcttactctttctctctccgcttcgcattattacaaccttggcagggtacgcggtgcgcgtagccgcgactcgttgtcagttctaccggcaagcaatggcttacaaggaagccaaacctcaatcgttcgtgcgcatagtcgcgtcgatgttgacgcgtgtgatgtaaaccaacaacgcaaggtgctatccatgggaagacaaaaagcagtgatcaaagctcgtcgtgaagcaaaacgtgtgctgagacgggattcacgcagccataagcagcgtgaagaagaatcggtcacatcgcttgtgcaaatgagtggcgtagaagcaattggcatggcgcgggacagccgtgatacttccccaattgaggcgcgcaatgaggctcaggcgcattatttgaatgccatcgacaataagcagctgattttcgctaccggcgaagctggatgcggcaagacctggatcagtgcggcgaaggcagctgaagccctgatccataaggatgtggacagaattattgttacccgtcccgttctgcaggccgacgaagatctcggcttcttaccgggagatatcgccgagaagttcgctccctatttccgaccggtttacgatgtgctggtgaaaaggctgggggcttcctttatgcagtactgcctgcgtccggaaatcggcaaggtggaaatcgcgccgttcgcctatatgcgcggacgtacctttgaaaatgcggtggtgattctggacgaggcccagaacgtgaccgcagcgcaaatgaagatgtttttaacccgcctcggggagaacgtgacggtcatcgtcaatggcgatatcacccagtgcgacttgccctctggcgtgagatctggcctgagcgatgcgctggcgcgttttgaggaagacgagatgatcggcattgtgcgtttcaccaccgatgactgcgtgcgctcggctctctgccagcggacgctgaaagcctattattaatcgtcatactgtgagcaaggcccgggctagcccgggctttgttgtttttgggcatcctcccggcggcgctgcgcttagccgggctacctggcgggtagggtctggtagcccgggagaggcattgctgccgaccccggggatgtctgcggtgccacatgcgaaaaaaaagcccgtacatgcgtacgagctcttcttaaaatatggcggtgaggggggattgactcgcttcccggcggtactgcgcgtggccggactacctggcgggtagggtctggtagcccgggagaggcattgctgccgaccccggggatgtctgcggtgccacatgcgaaaaaaaagcccgtacttgcgtacgagctcttcttaaaatatggcggtgagggggggattcgaacccccgatacgttgccgtatacacactttccaggcgtgctccttcagccactcggacacctcaccatattgtcttgctgctcaccttgggtgggcaacggggcgctactatagggagttgcgttaaaacggtcaagcatattttcttctttctttgccgttcgctcacgcaatgaacaatgccccgctgcggctcagcggggcgggcgttttagcgctgggaatccagctgttcgttattcttcacgacgtcctgcgctttgctgtagctttcgatcagcagctggtaggccgggaagactttggtgtacacctccgcccattctgcggcgtccgggcgattccaggtgcgctgcagctcagaggcgatggcggcggtatccattggcactacgccggcctgtaccacgcgagccagggtgatctcttgcgccattttgctgtaggtgccggaagcgtcaatcacggcaaacactttataaccgtcggcgacagcggcgatagccgggaaggccatgcagacgctggtgatggtcccggcgataatcagcgttttacgaccggtcgctttcaccgcggcgacgaattccgggttatcccaggcgttaatctcacctttacgggcgatgtatttcgcatgcggcgcgttttcatgaatctccgggatcagcggaccgttcggcccctgcggcacggaggcggtcgtgatcaccgggatcccggcaagcgacgccatcttggccagcgcggcggcgcgagcgcgcagctctggcatcggcatatcgccgacggtctggaacagaccgctctgatggtcaatcaacagcattgcggtatcgttaacatcaatcaccggacgagcaccgttaaagttagcgggagtagacatagtattcacctcaatcagttagatttggccaaagcggccgctgttaaaatcgcgtacagcttctgcgatctgcgttttgttattcatgacaaacgggccatagcccacaatcggctcctgtagcggttctccggccatcagcagaacttttgccggggcggtcgcctccagatgcactgcgtcacctgcctggctcaggacggccagctggccttcgcgagcagattcggaaccgttaatgatcacttccccttccagcaccaccagcgcggtactccagccctccggttggcgcagcgtgaggtcgtgcccctgattcagctgcagatcccacacgttaagcggtgaaaaggtatgggccggaccgctgacgtcgtcatactggccggcaataacccgaacctgtccggcgccgttcgccagcgccacggtggggatcgtcccagcggtaatgctctggtagccggggggcgccattttgtctttcgcgggcaggttgacccacagctggatcatcttcagctcgccgccgctgcgggtgaaggcctccgagtggaactcttcgtgcaggatcccggcgcccgccgtcatccactgcacgtcgcctggaccaatcaccccgccgcgtccggtggagtcgcgatgctctacttcaccggcgtagacgatggtgacggtttcaaatccgcgatgcggatgctcaccgacgccgcgtttttcgctgcccgccgggaaggtgtacggcccggcatagtcgagcagtaagaaggggctcagctgctggccgtgcgtctgataggaaaacatcgagcgaaccgggaagccgtcgcctacccaatgctgcgcaggcgcggtgtagactcctgtgatctgtttcatggctttctcctgtgtatcggtatctgatgtgaataagcttatatccgggacgacgtatgcggtagtgagcaaaaatgacctatactgttccaaaaatggaacaatggaggaaggatgcaggatctcaatgacttcgcctggtttgtccaggtggtagaccatggcggtttcgccgcggcggggcgagcgcttgaccagccgaaatccaaactcagccgccgcattgcgcaactcgaggagcggttgggcgtgcgtttgattcagcgaaccacccgtcagttcgcggtcaccgaggtcgggcagaccttttatcagcattgcaaagcgatgctgattgaggccgaggcggcgcagcaggcggtcgagacgctgcgcgccgagccgcgcggtagcgtcaggatcacctgtccggtcaccttgctgcatgtccatatcggaccgatgctggcgcgatttatggcgcgctatcctggggtaacgctgcatcttgaggcgaccaaccgccgggtggatgtggtcggggagggcattgatgtggcgatccgcgtccgtccccggcccatcgaggatagcgacctggtgatgcgcgtgctggcggaccgcgggcaccggctggtggccagcccggatctcatttcccggctcggacgtccgcaggcgccgtccgagctgagcgcctggccgggactcagcctgggagcgaacaagcatcagcataaatggcagcttaccgggcccgggggagcgagagcggaagtgtatttcacgccgcgaatggtgaccaccgatatgctggcgctgcgcgaggcggcgatggccggcgtaggcgtggtgcagcttcctttattaatggtgcgcgatcagctggcgtcaggggaattagaggtggttctggacgagtggcagccgcggcgggaagtgatccatgcggtatttgcctcacggcgcgggctgctgccctccgtcagggcgctggtggactacctcagcgaagagtatcagcggatggaggaggattagcttcgggattggcttttctcgaggggctccccccccccggcagagaatattaaagaaaagagcccgtgcttgcgtacaggctctcatcttgaatatggcggtgagggggtccgccatattagtgtccggtaatgtacaccataattatatttttccattagtatacaatatgttgtcattattctttgtccggtaatgtattgatgttttgtttataatctgtcattttatgcagtacaggatgcactacagaagaatgatgataatgccaaagaaagccagaggactgtctgttcttgctgtttccagacttaaagctgatgggcgttatgctgttggtggggtggatggattatacctgcggattgcagggcgctcccgcgcatgggtcctgagtgtggcaatgggaacccgaattaacaaagcaggtaagacggttccccggcgtctgaacatggggcttggtccctgtcaggaagtttctctggcagaagcgcgtgacaaggcgcgtgaggtgcgtaagcaaattcgtgatggcattgatcccctcgaagaaaaacacgcccgtaaagcgtttcacgaagctcaggcgcgtaaacaaaaaaccttccgtgaatgcgctgaagctgtgctggaaatcaaaggtaatgagttaaagaataaaaagcatgtggctcagtggcgttccacactggaaacctatgcttatcctgttattggtgataaagcggtcagtgaaattaccaaaatggacttgttggcaatcctcgaaccaatatggctaactaaaaacgaaacagccagtcgtgtccggggacgtatcgaaacggtaatggattacgccaaagcaaaagagtatttcgaaggtgataaccctgctgcatggaaaggtgtactaaaacctctgttgccaatgccaagtaaagttcagaccaaaaaacatcatgcggcattgccttacaaagatgcaggctcatttatggcagaactgcgtcaacgggccgggatttcagccagagcactggagttttccatactgaccgttgcccgttcgggtgaaattcgaggcgctgaatggtgtgaaatcgatctggatgcgaaaacgtggattattcctgctgagaggatgaaagcagcgaaagaacatcgcgtacccctgtcagatactgctgttgaacttcttaaagccttaccacgatttacagataacaatcttgtttttccggcacctcgcggtggacaactgtcagatatgtcattaacagcagtattgaaacgcatggggcgtagtgatttaacccagcacggatttcgatccacatttcgtgaatgggcgggggaaaccacatcctaccagcgtgaagtgattgaacacgcccttgctcaccagttagcagacaaggcagaagccgcttaccagcgtggcaccttatggcctaaacgtgttgcgttaatggatgactggacaagctattgttctgtagcgtaaaacagctaaaaacagactgatggatagcagataatgaaaagaagtgaaatcaggaaagcgattgaatcgtggtttgacattgaacgctatgacgcaattgaacagctcactctgcagcagttctatgttgagattgaacggcgtatcttggcttacaggatgttgttgagccgaaataccataccgaccctgaacagattattgctggatgattagcgctataagatcctcagaggtgaaatctttttcagtggtgataccgctactcttggacatgagcttgccagaacctatacagtaaaccctacgactcgaagccatgcgcaattttacgcgaaaacgctggcattaaccgaagccacccccgaaatttcgtcgttaagccagtccgaattcctgtcagagtatctgaaagagacaccactgaaaaaccttgcccgtatcactgttgatattcatctggaagaggcatcaaccgaagacatcattgaacatctgaaggtgctgatcccgcaatggaagagacggcttaagatgaaggctccagcggatcgagagtatcgtttcggtaaaagcacgttcagaaaagttattgaatatcgccttattccgatgatggatctgattttttggggtgctgataataatgataccaagatcccactttccctgatgtcttcactgcttcatgaggacagtgataatgatcgtgatgaaggaatgctcaaggcaacggattacccactggcaatggcgttcctgacagatgaaagctatctgaagtcgcttgaagattacatcatgcaaaacaatcacttaaaagatacacctgttgataagcatgttgaggatgataagaagaagaaaaaagcagccaagtaaaaagggttacgttcgccgtgagcgaacgtgatcgcattcagccataacgaacctctttctgttcatctcccttcatatttttcaaaaaactcttttatgaacgcccctaaaacgtcataagcgaattcgctattattgttctcgtcgaaacaacatagagaaaaacgaaatctcatagagattacgtaaaataagagaggacaaacaatgaaagaaaatactgaaaacaacgtaaagcgatttatccgtgttccagatgttctaaaccgagtggggttcagtcgcactaccttatatgagcgtattaaggaagggaactttcctgacagggtaaaaataggaccaaggtgtgtcgcttttgttgaaagtgagatagatgaatggattgaagctactattcgaaactcacgtcagaacgcagcataaaaaataaataccgtttccgggtgaatagatatctttcgctcagggactcttattatcttaatcaataaaagggcaatgtatgaaaatagaatttaatacgacagagcagtttatcagtgaagcagcggattcgtataaccgttatatgaataaacgactacggaaccagcctgtgcatttctaccacctactgaaaaataagggggatatgaacgaagtgattgaaaatattatcgataaaacaaagagccgcttttatggggctgaaggtgaacaaaaaagtaacggatctccgggagcgttaactatgtgaaagtaaagcaacaccttcgtcagctttggattgtctttaagtgtgtataccgctgattcatccataaaaatatctactttaatattaaacaaaaaaggaaataaaaatgaatatatttaaaaataaatctactgaaatcttttatgttgtgtccttgcatatctacgcggagctttttaactcaaaggataaaacaaccagtaatatgattataacgcatgtaatggatcatgagtttgtcagtaaactaatcgatctggcgatgagaaatgcggagaagcatcttctgaaaaaagcatggaaaaagaacgctgatgaaaaactgtctgaggtggattttaaagaggttaagcaggcattagccaaaatgcattacactgttctggcggaatcaatatgttgatgtgttctgaagtctatctgccccttcatggggctgataacaaatctgatttgaaagctaaaaatggcaatgaaaacatactctatacaaggagccaaaatgattgatgaatttcatgtgatgtatatgtataaaaaaatccaagcagaagctgcaaccaccgacattaaaacacttgaacagcttttgaaaaagttcaggagggtggtcaatgaacgtcgtgaagaatactatcaggaaataggtgagaaaaaagcgcgtaagttgaaaatgaaaagagcacaaagattgcttgagaaaatggtgtgcgaccgagtttcgccagaagatttaagggcgtgactattagagatatttttgacataatcacatgaaaatgataatcattattgtctattgtgtctttttgtcgatagataggtgagcgaagggaatctggagggaactgtatgagctttgaagctaaaaaggaacatgccattgccatcatggaaagcaagaaaatgtggcgtagtaactatgcgcctcctttgctacgcctcgcatggaaagctggcctcaagatcccaccgttgccttttgccacgttctggcaaataaccttgctgatgggaggttggtttggtccggcatgggggatttgtatgtggttttcttcatggaaggacagtggtatgcagccgggcgttgcatttgtctcaagcatagtcgcaggtatttgctttggtgttcttatggctgcgtatcattggtggcgaaaggtagttaacaatctgcctgactgggatagtctggagtaaagatctctgtagtggctatataacctctaaatggactgagtgtgagatgggaaaaataaaatattggttaatagcgggatttattatccttcttgcaattgtttacactgctatcagtgacaggtattctacgctttctaggttgaaatcagcaggtgaaaacggagatgtagaagctcagtatgcgttgggtctcatgtatttatatggagaaatactggatgtcgattatcagcaggcaaagatttggtatgaaaaagccgctacccaaaatgatccgcgtgcacaggttaaactcggtttgatgtatgcaaatggtctcggggtaaatcaggattatcaacaggccaaatcttggtatgaaaaagcatcggttctaaatgatgttgatgcgcaatttttgcttggagagatgtataacgatggtctcggggtaggccaagactaccaacaggcaaagatgtggtacgaaaaagctgctgctcaaaatgatgagcgtgctcaggtcaatctcgctgttctatacgcaaagggtaatggggtagaacaggattatcgtcaggccaaaagctggtatgaaaaggctgcagctcaaaatagccctgatgcgcagttcgccattggaattctgtatgccaatgctaatggtgtagagcaggactatcagcaggcaaaagactggtatgagaaagcagcagaacaaaatttcgccaatgctcagtttaatcttggtatgttctattacaaaggtgagggagttaatcaaaactttcagcaagccagagaatggtttgaaaaagccgcgtctcaaaatcagctgaatgctcaatataatttaggtcagatctattactacggtcagggcgtaactcagagctatcgaaaggctaaggaatggttcgaaaaagcagctggggaaggtcatgtcgatgcccaatataaccttggcgtaatatacgaaaatggtgaaggggttgggcaggactttcatcaggcgagagcttggtatgaaaaggcagcttcgcaaaacgatgcgcaggcacagtttgatcttggtgttatgaatgagcttggtcaggggggaagtataaatctgaaacaagcaagaacttggtttgggctggcatgcaataatgggcataaggaaggttgcgaacgttatgaaaataattgaaatggttttttaggggattttttgtcataactaaatttaattttagctttataatttattttgattcttttttgatatgcaaaaatatagtgtgaggagaggggcgataaataatatacaaaacattaatacgaataagaatagttagtagtaaatgggttaaagcctctggaacttcaggattttttacaatgaacaaaggcgtttgcttggttaataacccggaaacaaacacctgctcatgtcagtcaggcactgtagcgaaagaattgttttatacaacagcaactgaacagttaggtggtggtagccatggtggcggcataacagtggtaaaagagagagtattatatcaatgtagataaggatgattgtcttattatactttattttatgcaagataaatttgatttccatcgggatgtaattatatatttaatgtatcccgattttataacatctttttatgttttacaattcaggagaacttaaacctaaaaatatcaggagtgatttatgaataagaaaatattagtattgtccgttttatttggtttttcaactatgtcccatgctagtgaaccaaagtatgcttttccgcaatcagataaacaggtagtctcaaaaattaaaattcaaaatgcaccgataaatcatgataaatatggtcatggtgaggttcttgccaatggggcgtgggttaaaggaaattctggtagtcaaaacaaaaaatgataggctcacttattttaaataaataatccgatggatatataggtgagtagaaatcgttagataaagttgaaatagtggcttgacttaagaataaagagtgctatatctatttgtagctaacatttttttaatttggctgccagatgttttaattttttgctcacattgatgttaggttgttatataccttgtcctgatattctaaaatataactatccttttgtatggtattacaaggcgtcaggaacttggtttgatcctcctgacagtctgttgtggaggattaaatttatccagagtaagcgattatgatggtttttatttaaatagataaatatatttgattatcgatattaaatgttatgtttaataagtgttttctgtgaatattcacttcatgaaatgtctgattactctacgtattgggatatgtattttctccaacggatagttcccttaatgggaaatgaaagggccgaaaggccctataactaattacatattgttaactttttacttccactaatgttctttttttctcaatttcttagcaagcttggggtaatatattttgtgaccatcctctttgggccagcagactgatactgcatagaatagtaatgctgaagaaattaatagaccaatgagataatgtggtgttgtaggatcactgtgttttgattgttcccataaccagtcaataaacatccgactggaaccatttgatgcagataaataccactctattgagaaaacaaaaattgttccaaaagagattatttcagctgctctcccttctttataatttttctctcttttgctttgctcttcagtatacaattttaatgacatgtcgtcgccattttctaaagcatcatctcgtagttctgacataaaaacttcagtagatgatttttggtagatcctctcatctttactttgtagtagattactatacttaattcgtatcagaagtagattaaagcatagagatgttatttctaatattattgatgagaaaattcctaaagcaataatcattccggccaaatctgcaagtgaaagatcgaattccttccctaattttatgccaaataaaccatttccttttagatagaaaaatagaacatcaaaacatagtgtgaaataaattaattttgctactttcgctaaatcccacaatccatctacaaagcttaataccgaaaatgttgaactactattactggatgacatatattgcctctttcagcttttgataaacttcttatattaatgagttaaagaagggaggcaagccatccttggctttcaattctttacttgtgatgagcaaattcaaacggcctgaccataccgttgctgttagcatcaaggaaatcagcaaccactggagcatcaggtgtcgctgcttaaggtgcttggttttatggttataagcaacccggattctgttgctttccttatggtccacttgatgctttacagcgtcttctgaccacaaacctgactcaattaaggcactacaggccagcgtgtgaaaaccttgtccacagatgtcctgtgtggtgttttcaatcagaacagctaaaacatggcaagacaataccccgaccactcatccatcaacgccacccgcttaggccataaggtcccacgttgatatgctgcttcggctttatctgctaactggtgagccagtgcatgttcaatgacttcacgttgatgatcggttgtgacatcatcccagtcacgaaaagtggaacggaaaccatgttgagttaatcctgaatggttcattctctttaagactgccaacagcgacatatctgatagttgtccaccacgaggggctgggaacacaaggttattgtctctgacatgtggtaaatcctttaacagggcaaacagcagtatccgacaacaggacttgctgttctctacccaccacccgccagagataacttattcaatcttttctggggggcagatggaggggagttgttttcatgtgttctatgaccagttcgctacattaatcaaagctttatttttaaagctttgatcaggaaaatcacagcaaaaacaggaagttcagatacaaaaaaagtccgtttgaacggacttttttatgcagcattttatgcagtacaaaaccaaaaatgcgttgtaactaattgattttgtgttaaatatggcggtgagggggggattgactcgcttcgctcgcccctgcggggcagcccgcttactgcgtgcgcggtctgtccaactggctgcgccagttgtcgaaccccggtcgggggttctcatccccccctgcggagaatataaaagaaaagagcccgtacttgcgtacgagctcttcttaaaatatggcggtgagggggggattcgaacccccgatacgttgccgtatacacactttccaggcgtgctccttcagccactcggacacctcaccatattgtctt

SEQ ID NO: 66 - DNA, 134633 bp, Unknown
  source: /note="Description of Unknown: KP2-Mcoc1 Bacteria Sequence"
cttatgcggcatcgtcgacgaaccgccgcgaccttccgccaccggctcgcccacctcagccacttcggtctgcatcagcagggaaaagtcgttagcgaatttccccagcgtgccgcagacgccggcaaaccaggcgcccgcctccagcagccgatcgcgctggctgtgccacggagtatccggcagcgacagaccgaggatctgcgccagcgccaggccaaccgccggccctttctcttttagcgcgtccagagtgcccgcggcgccgccgaactgcagcaccagcagccgcggacgcatctcgcgcagccgctgctgccagcgcaggagcgcgtcgagggtgcccgccagcttcaggccaaaggtcaccggcagcgcgtgctgcatccaggtccgtcccggcatcacggtatcgcgataacgatccgcctggagtgccagggccgccaacagctgctcaagcagagtctcagcggcatccagcgccccgcgcagctggagcaccagtccggtgtcgatggcgtcctggctggtagcgccccagtgaacgtagcgcgcagcctcgggatctcgcgcttttacctgggccgtcagctgtttcaccagcgggatggccagattaccggctcccactgccgcctcgcccagcgcggcaaaatcgatggcttcgtggcggcaggccgccacaattggcccgaccgcttccggcggcaccatcccgcaggcggcctgcgcttgcgccagcgccgcttcaaaatccagcatgccctgcacccgctgcgcgtcgctgaaccagtcggttagcggactgctgcgcagcatcggggtcaacaaactcattctggctccttaaacacgttcaataatcagggcgatcccctgtccgacgccgatgcacatggtgcacagggcgtaacgaccgccggtccgtttcagctgataagccgcggtcatcgccagccggccgccggaggcgccgagcgggtggcccagcgcaatcgccccgccgttagggttcacgtgggcggcatcgtccggtaagcccaaatcacgggtcaccgccagcgcctgcgcggcgaaggcttcattcagctcaatgacatccatctggcctaatgtcaggccggtctgcgccagcaccttgcgcaccgccggcgccgggccaaaacccatgatccgcggcgcaacgcccgccgtcgccacgccgaccacccgggccagcggctgaagatcgttggccgacagcgccgtctcgctggccagcagcagcgcgcaggcgccgtcgttaaccccggaggcgttaccggcggtaacgctgccctcggcgcgcaccacgccgcgcagtttagccagcgcctccagcgaggtgctgcgcgggtgctcatcgcggctaaacagcagcggctcgcctttgcgctgcggcacctggacggcgatcagctcatcggcgaaacgccccgcctcttgcgccgcggcggtacgcaactgactgcgtaaggcgaacgcgtcctgatcggcacgggagatggcaaactcatcggcgacgttttccgccgtctccggcatggaatgcacgccgtacagggctttcatctgcgggttaataaagcgccagccgatggtggtatcctccatctgcatgctgcggctaaaggcgctctccgctttccccatcacaaacggcgcgcgggacatgctctccaccccgccggcgatcatcagctgcgtctccccgcttttaatcgcccgcgccgcgacgccgatcgcgtcaaggctggaaccgcacaggcggttgatggtgctcccgggcacgctctccggcaggccggccagcagcagcgccattcgcgccacgttgcggttgtcttccccggcctggttggcgcagccaaagatcacatcgtcaatgcgcgagggatccagtcccgggttgcgcgccagcagcgctttcagcggcagcgccgccaggtcgtcagcgcgcatcgtcgccagggcaccgccgaaacggccaaagggtgtacgcaccgcatcacagataaatgcctgattcatcataggttccttacgcgctttccgccagttgttgaaaggtcagcgccaccggagtgatgcgctgcagctcttcaaaagagaggccgttaaagatttcccgcaccaccgggccgcggtcggtgatgtcgatcaccgccaggtcggtatagatccggctgacgcagccgacgccggtcagcgggtagctgcactgcgccaccagcttgcactcgccgtcacgggtcaggtggtccatcatcacaaatacctggcgggcgccgatggccagatccatcgccccgccaacggccgggatcgcatccggcgcaccggtgctccagttggcgaggtcgccgctggcggaaacctgataggcccccagcacgcagatatcgagatggccgccgcgcatcatggcgaaggagtcgccgtggtggaaatagcagcccccctgcaggagggtgacatactctttaccggcattgatcagctcgggatcttcttccccgggctgcggtttcggccccatccccagcaggccgttttcgctgtgcaggaacacctctttgtcagcgggcaggtaattggcgatgcgggtcggcaggccgatgccgaggttgacgtaagcgccttcgggaatatcgcgggccacgcgctgggccatttcgtcacgggtcagtttttgcatgtcgggctcctcaggcgcgttgtgcggcagtcaggttttccagcgagaagacgcgctggacgaaaatgccgggggtgatgatgttttccggatcgaggtcgcccagcgccaccagctgcgagacctctacgatggtggttttcgccgctgtcgccatgatcgggccaaagttgcgcgccgccttgcgatagaccaggttgccccagcggtcgccctggtgggctttaatcagcgcgaaatcggctttgatcgggtactccagcacgtagtggcgaccgtcgatttcccgtgtctccttgccttccgccagcggcgtgccgtagccggtgggggtaaacaccgcccccagcccggcgccggccgcctggatccgcgccgcgaggttgccctgcggcaccagctccagctccactttgccgcgacggtagagatcatcgaaaatctgggaatccacctggcgcggaaaggagcagatcattttgcgcacccggcccgccttgagcagcgcggcgagacccacttccccgttgccggcgttgttatttatgatggtcaggtcgcgagcgccctggtcaatcagggcgtcaatcagaaaggtcggctggccggcggggccaaagccgccgatcataatagtcgccccatcgtggatcccggcgatggcctcgctcagcgtcgatacgcttttatcaatcatcaggtcgctccagtgatgtgcggtaatcgcacttttattcgttgttcgcacaaaatgtgacccgcttaacgatgtcggtcaagggcgataatcgaaatatggtgcgataatcgaacatcggttatcttttgcgaaagaatgtgatcgatggcaaatatggggaacagaaatggacaagcatccagacgatttactgaccggcgacggcgatccgtttaaaggcgatcctaactttatggcctccctggcgcggggtctggaggtgattcaggcgttcacgccgcagcggcccctgctgtctatctcgcagatcagtcagaagaccggcatcccgcgcgccgcggtgcgccgctgcctgtataccttgagcaagctggggttcgtgtatgccgaagacggtaagaatttccagctgcggccgcggatcctggcgctgggccacgcctggctggcctcgacgccgctggcgcgttcggcgcagccggtgctgcggcatctgagcgaaatgctcaatgagtcctgctccatcgccaccctcgacggcgacgatatcctgtatatcgcccgcgcctccagctcgcggattatgaccatcgacctggatatcggcagtcgccttccggcgtgggcgacctcgatgggccgggtgctgctgagccatcagccggaggagaagctcaacgatatgctggcccgggtgaccatgatccgctataccccacagacggtggattcggtggcgaagctgcgcgccgaactgaaacgggtgcatcagcaggggtatgccctcaacgatcaggagctggagatggggctgcgctccctcgcggtcccgctgtttaacgctcaggggcaggtccaggcggcgctcaacgtcggggtgcatgcgggccagatgacggcccgcgagatgatcgagcgcgtgctgccggagctgcaaaaagccgcccgcgagctgacgctgcttctgcgctaacgactgcgcttggcgtgctgctcccaggtctcctgcttcgcctgcgccgatttacgcagcgcaacatagcaggcgccgctgccgccatgatgcggaagcgcggcgcagaaggcctgcacctccggcagctcttccagccagcgcgccagatagctgcggataatattggcgtgggactggtcgtcgcggcctttgccgtgaacgatcagcacattgcgtaacccctctttctgcgcctgcaccataaaggcgaagagcatctgccggcactgttccaccggctggcgcagcagggagaggctcgcctgctggctgtatttcccccgccgcagcttatccagcacgccgctctgcagcccttctcgcttaaactccagcggcgtggcgagcggcacgatatcgagatagccggtggtgagaaaattatccagctgcagggtatcgacgcgttgcggggcccggctgttacgcccgggatgccagtgcacgtcattattacgtttcagaggctggacatcttccatggcgtcaagaaacagggatttgtcatcaaggttcatgggctctcctccagcggctgtcgccagctactatagccgcctcgcgctcccctctcaacgcgtttagccgcgttcgctggcaaagtgagcgcgacggacgattaaggaaacaattgtcggctctggcggcggaacagggtgattaacgacgccgtgagcggcgtttgccgggtatcgcgccgctggatcagataataggtggcggtgggtaacacttcacggatatggatcatcaccagtttgtcggccatcagcgggtcgttgcccagctccaccggcaggatgctgagaaaatcacttttcaccaccaggctgatgcaggatgagaacgtttcgcagacgatccccacctttggctcccgtcccagctgttcgaagcattcctgcagctgcttgaagtagctgccgcgcggcgtcggcatggtccagtggtgatccatcaattcccccagcgaggtggcctgcgccgccggatggcccgcgcgggcgaacaccgcgaacggtttctcaaacagtttctcaaagctgaactcatggtcgtacggcccggggtaataggtattaatggtgaaatccagctccccctggcgcagctcattaatcatcgccagcagttgaccctccatgatccgtaccttcacctgcggatgctgctgatgaaagcggcagatcaccgacggcatcagcgaccgggcgacgctggcgccaaggccaatattaatttgcccggcctgttccccctggcgctgcagcagttcatcctgcgccgcccgcagctcctcaaggatcaggctcgcatgttgataaaaactttcgccattgtcggttaacgccaccccctggctgcggcggacgaacagctgggcggaaagcccctcctccagctctttaatcgctttggtcagcgccggctgcgagaccgccagcgcccggctggcgccacggatactgccttcccgggctacttcgacgaaggcgcgaatttgatgaaatttaatctgaaatgccatgcttttagtgataaccgttgattatcagacagaagaaaatgacatctactgtaatccatcaggctgtggcaggttaagggtgttaaggcctgtagcgcgtcagtgataaacaaaagctatcacatcgtgaacgccgtcacattttttacttatgacaggataagctatgccgcaacttgatgaatacctccgccagctggcgccctccatgacccaatggcgccgtgattttcacctgcacgctgaatccggctggctggagtttcgcaccgccagtaaggtcgcggatattcttgacgggctaggctatcagctggcgctaggccgcgacgtcatcgatgccgacagccggatggggctgccggacgaggagaccctggcccgggctttcgaacgcgcccgcgaacagggcgcgccggagcgctggctgccggcgtttgaaggtggtttcgccggcgtggtggccacgctcgacaccgggcggcccgggccaaccctggcctttcgcgtcgatatggatgccctcgatctcaacgaacagcatgacgatagccaccgcccccatcgcgatcatttcgcctcctgcaacgccggcatgatgcacgcctgcggccatgacggccataccgccatcgggctggggctggcgcatgtgctcaagcagtatgccgcccagctcaatggcgtcattaaactgattttccagcctgctgaagagggtacccgcggcgcccgcgcgatggtggccgccggcgtggttgatgacgtggattatttcacggcgatccatatcgggaccggcgtgccggcaggtaccgtcgtctgcggtggagacaactttatggccaccaccaaattcgacgtgcagttcagcggcgtggccgcccacgccggcggcaagcccgaggacgggcgcaacgcgctgctggccgccgcccaggccgcccttggcctgcacgccatcccgccgcacagcgccggcgcctcgcgggtcaacgtcggggtgatgcaggccggtaccgggcgcaacgtggtgccctcttccgcgctgttaaaagtggaaacccgcggcgaaagcgaagccattaatcagtacgtgttcgagcgggcgcagcacgtcgtcgccggggctgcggcgatgtacgaagcccgctacgaactgcgcatgatgggcgcggcgaccgccagcgcaccgtcgccggcgtgggtggactatctgcgcgaacaggccgcccgggtgcccggcgtgcaacaggcggtggatcgcatcgccgccccggcgggctcggaagacgccaccctgatgatggcccgggtccaggcgcgcggcggcctcgcctcgtacatgattttcggcactgaactcagcgccggtcaccacaacgaaaagtttgacttcgacgagagcgtgatggcggtagcggtcgaaaccctggcgcgcgtcgcgcttaactttccctggcagcggggggtgtaatggaagccatttttcagtttgtggacgaggtggttgaggcacaacgcgacacttactgcgccatcgccgacgacatctgggaccacccggagacccgctttgaggagttctggtcagcccaacgactggccgacgccctggaggcggaaggttttcagctcacccgcgatgccggcgggatcccgaatgcctttatcgccagcgtcggtgagggccaaccggtcattgccctgctcggcgaatttgacgccctggcgggactcagccagcaggcccacagcgcggaaccgacgcccttgacaccgggagccaacggccacggctgtgggcacaatctgctcggcaccgcggcattcgccgcggcggtcgccgccaaaggctggctgcagcagcacggcgacagcggcactctgcgcttctacggttgtcccggcgaggaaggcggttcgggaaaaacctttatggtgcgcgaagggttgtttgatgatgtcgatgcggcgctgacctggcatccggaagcctgggccgggatgttcagcacccgcaccctcgccaacattcaggcggcatggcgatttaccggcaccgcggcccacgccgctaattcgccgcacctgggccggagcgcgctggatgccgtcaccctgatgaccaccggcagcaatttcctcaatgaacatatcatcgagaaggcgcgcgtccattacgccattaccgataccggcggcgtctcgcccaacgtggtgcaggcgcaggcggaagtgctgtatttgatccgcgcgccggagatggccgacgctgagcaaatcttcgcccgcatagagaagattgcccagggggccgcgctgatgaccgagacccaggtcagctgccgctttgaaaaagcctgctccagctatctgcccaaccgcacgcttgaggcggcgatgtatcaggcggtctgtcattacggtacccccgcctggagcgacgaggaacgcgcttttgccgcggcgatccgcgccgctctcagcgccaatgatattaacaacagcctgaacaatattgccggcaccagtggcgaggaaggcaaaacgttcgctcgtcgccaccgcgacaccttgctgattgatgaggtggcgccctgggcggccacggataacgtcctcgccggatccaccgacgtcggcgatgttagctggaaagcgccggtggcccagtgcttcagcccgtgcttcgcggtgggtaccccgctgcacagctggcagctggtgagccagggcagaacctccattgcccataaagggatgttgctggcggggaaagtcctcgcggcgaccgccatccgtttattcagcgacagcgccctgctggaggccagccagcaagagctcaggcaggtactggccgaacgcccctatcgttgcccgatcccggcggaggtgagtccgtccgttttacgataaccacttagaggctactcctggccaacgctgaccggatcgcggcacgcaccgcccataataaccgccggcagtaggggagcaggcctgcccaacacaacaacgacaacagaggaatgcccatgagtatgtcatccataccgtcatcttcccccggcggaaagcgctatggctgggtagagaagatcggtaacaaggtcccgcacccgtttttgctgtttatctatctcatcgccgtgctgatcgctgccacggcaatcctctccgccctcaacgttggggtacaaaacccaactgacggttcgcgggtggtggtcaaaaacctgctcagcgtggaaggattgcactggtttttgccgaacgtgattaaaaacttcagcggtttcgcgccgctgggggcgatcctcgccctggtgctgggcgccggctttgccgagcgggtgggcctgttaccggcgttgatggtcaagatggcctcgcacgtcagcgcccgctatgccagctatatggtgctgtttatcgcctttttcagccatatctcttccgatgcggcgctggtgattatgccgccgctgggagcgctgatgtttcttgccgtcggtcggcatcctgtcgctggtctgctggcggcgatagccggcgtgggctgcggctttaccgccaatctactgattgtcaccaccgacgtgctgctctccgggatcagcaccgaggcggcaaagtccatcgatgcctctttgcacgtcagcgtgatcgacaactggtactttatggcgacctcggtgatcgttctgacgctcgtcggcggactgatcaccgataagctggtcgagccgcggctgggccagtggcaaggcagtcgtgatgaaaagctgcagacgctgacgcccggggagcggttcggcctgcgcatcgccggcgtggcgacgctggtattcgtggcggtcatcgccctgatggtggtccccgaaaacggtattcttcgcgatccggttcagcatacggtcatgccctcgccgtttatcaaaggcatcgtgccgctaattatctttttcttctttgtcgtgtcgctggcatacggcatcgccaccggcaaaattcgccgccaggccgacctgccgcagttgatgattgagccgatgaaagagatggccgggtttatcgtgatggtcttcccgctggcgcagttcgtggcgatgttcaactggagcaacatgggcaagtttatggccgtcgggctgacggacctgctggagagttcaggcatgaacggtgttccggcgtttgtcggccttgcgctgctgtcggcttttctgtgtatgtttatcgccagcggctcggccatctggtcgattctggcgccgatcttcgtgccaatgtttatgctgttgggctttcacccggcgtttgcgcagatcctgtttcgtatcgctgattcatcggtgctgccgctggcgccggtgtcaccgtttgtgccgttgtttctcggctttctacagcgctaccggccggatgcccgcctcggcacctactactcgctggtgctcccttacccgctgatttttctcgccgtctggctgctgttgctggtgggctggtatctggtgggactgccgatcggccctggcatctatccgcggctgtcttaacccaccgatgcgccagggacggccgccttagcttaacgcgatatcttcactttgaacttacgggtcgcttccccggctccggcgaatatgccgaaaagcgcgcgatatcctcgctcaagcaacagcgacataccatgaataaccagaccgctgaagatcagtacgattacgccagtcagtatatattgcatagctccacctctgagttattaaccgcgccgcgccgacgcggtagcactttcccgagcgcgcacagcggcgcggaggaccgacgtcgtcagcttaaaagtagcaaaaaccctgtccggtaacccgccaggatcgatccaaaaataaatcatcgtggcgatcgcagaatgcctccacggcggatagcccgccgtgctatctggcgatgcggttttaccttttgggagtatagttgactgccgtcagcgcgtggtatcgtgtgcctctcatgtacgatggtggatgacagaaacgatgttgaccttgctgcaggataaaatggataccccgctggggccgttgtgggtgctttgcgacgaacagtttaatttgcgcgctgtcgagtgggacgagcaccgcgatcggatggaaacgctgctcgacgtacactatcgccgggaaggctatcagcgcgtcgactgccgcaatcccggcggtctcagcagtaagctgagcgactattttgccggcgatttagccattatcgagactctgcctaccgccaccgccggcaccccttttcagcgccaggtctggcaggcgttacgcgatatcccctgtggccaggtgatgcactacggccaactggccgaggcgctcggtcgtcccggcgccgcgcgcgcggtgggcgccgccaatggcgccaatccggtgagtatcgtggtgccctgccatcgggtcatcgggcgcaacggcaccatgaccggctatgccggcggcgtacagcgtaaagagtggcttttgcgtcatgagggctatctgttgctttgactgaaaatgccttttctggaattttcaggtaattttacaatcaaaagtggcgtaataatctgtttttaatcaaatagatacacagtcgatttgatttaccctgctgatattacgtgtttccgggcctgaagacttacctgctgatcaaaaagatgttaaaattgaccaatatcaattaaggcctgagcagacatatgatccctgagaagcgaattattcgacgcattcagtctggcggttgtgcaatccattgtcaggattgcagcattagccagctctgcatcccctttactctgaacgagcatgagcttgatcagctggataatattatcgagcggaaaaagcctatccagaaaggtcaaaccttgttcaaagccggtgatgagctgaagtcgttgtacgctattcgctccgggaccatcaaaagctataccatcaccgagcaaggtgatgagcagatcactggcttccatctggcgggcgacctggtgggctttgacgccatcggcaccggtctgcacccgagctttgcgcaggcgctggaaacctcaatggtctgcgagatccccttcgaaactcttgacgatctttccggaaaaatgcccaatctgcgtcagcagatgatgcgcctgatgagcggtgagattaaaggcgaccaggatatgatcctgttgctttccaaaaagaatgccgaagagcgcctggccgcgtttatctataacctttctcgtcgtttcgcccagcgcggcttctcaccacgtgagttccggctgaccatgacccgcggcgatattggcaactatctcggcctcaccgtcgaaaccatcagccgtctgctgggccgttttcagaaaagcggcatgctggcggtgaaaggcaaatatatcactattgaaaacagcgatctgctggcccagctggccgggcaggcgcgcaacgtcgcttaatctctgcgcaatccctggtcacgatcggcaattttttcagatttgttgatctgaccaggctcctcccctgtttcaattcatccatataggttatctttttaataactgacggtagctgcagttgtaaggagaccctgtatggcgaagtatcagagcatgctggtagtaatcgatcctaaccaggacgaccagccggcgctaaggcgagcggtgtacctgcaccaacggattggtggacgcatcaaagcctttttgccgatctatgatttttcctatgaaatgaccaccctgctgtcgccggacgagcggacggcaatgcgccagggcgtcattgcccaacgaacggcctggatccgcgagcaggcgaaattctacctggaatcgggcgtgccgattgacgtgaaagtggtgtggcacaaccgccccttcgaagcgattattcaggaggtggtcagtgagaaacacgatctgctgctgaagatggcccaccagcacgacaaactggaggcggtgatctttaccccgacggactggcatctgctgcgtaaatgcccttgcccggtgtggatggtcaaagaccagccgtggccggaaggcggcaaagcgctggtcgccgtcaatctcgccagcgaagagaattatcacaacacccttaacgagaagctggttcgcgagacgctgtcgctggcggaagaagtcaaccacactgaagtgcacctgatcggtgcctacccggtgacgccgatcaatatcgcgatagaactgccggattttgatcccagcgtctacaacgacgcgatccgcggccagcatctgctggcgatgaaagcgctgcggcagaagtttggcatcgatgaaaaattcacccacgtcgaaaaaggactgcctgaagaggtgatcccggacctcgccgagcatctgcaggcggggatcgtggtgctgggaacggtcggacgtaccggcctgtcggcggcgttcctcggcaataccgcggaacaggttgtcgaccacctgcgctgtgacctgctggtgctgaaaccggaggcctaccagacgccggtggaactggacgacgacgacgacgattaaccgccaccgctcatcttcccccgccgcgcgggggatttttttgcttgctgccagccaggcacaaaaaaagggccgttggcggcccctgtcgctgtccagcgagaatggcttagtggatacccagacgccaggccagatcgatctcttctttcagctccagcgaggagagcgccatcaggtcagcaaactccagctccagcagtttaagttttttcagatactgcgctggggtcatgacggtggggtcgcggcgtaagaattcgatggccatctgcgttggggttaactcggtatccataatatcctctgtctgatgtaagaaccggaacattatatcacctcttaccgcttattttatgaacaattccaggcatccccctgcatataaaaaagccgtctcacaggagacggcttataaacaaacgttgtaaaacaattatgttacattacagcgctttcaggatcgcatcgacgctggctttagcatcgccaaacagcatatgagtgttctctttaaagaacagcgggttctgtacgccggcgtaaccggtgttcattgaacgcttaaagaccaccacattctgcgctttccacacctcgagcaccggcatgccggcgatcgggctcttcggatcgtcctgcgccgccgggttgacggtatcgttggcgccgatcaccagcacggtgtcggtgtcgctgaaatcgtcgttgatctcatccatctccagcacgatgtcgtaaggcactttggcttccgccagcaggacgttcatatgccccggcaggcgcccggccaccggatgaataccaaagcgtactttgataccccgcgcccgcagcttctcggtaatttctgctaccggatactgcgcctgagccaccgccataccgtagcccggggtgatgatcaccgagtgcgagtttttcagcatctccgccgtctcttcggcgctaatctcgcgatgctcgcccacttcttcatcgccgccgctggaggaaccatcggtgccgaagcccccggcgatcacgctgataaaggagcggttcatcgccttacacataatgtaagagaggatggcgccggaagagcccaccagcgcgccggtgacgatcagcaggtcattactcagcataaagcccgccgccgctgccgcccagcccgagtaggagttgagcatcgagaccaccaccggcatgtccgcaccgccgatagaggccaccaggtgccagccaaaggccagcgcgatcgcggtcatcaccagcaggcacaggacctgggtgccggtgctgtcagagcgaacaaaaatcaccatcaggatgaaggaaaccaccagcgccgccaggttcagcttatggcgattgggcagcatcagcggcctggaggaaattttgccgcgcagtttaccaaacgccaccaccgaaccggtgaaggtcaccgcgccgatgaagatcccgaggaacacttcggtcaaatgaatattgaccagaatttgctccataccggtttcatgctgcaggtagctgttgaaacccaccagcaccgctgccagccccacgaagctgtgcaggatagccaccagctccggcatctcggtcatctcgaccttcttcgccagacgaataccgatcgccccgccgatcaccatcgcaagaataatccagccgacgttgccggcgtccggccccaggatggtagcgatcagggcaatggccatcccggcgatgccgaaatagttgccctgctgcgacgtttcgtgtttcgacaggcccgccaggctgaaaataaacaggattgcagcaacaatgtatgcagccgttactaatccaccagacatgtgctaccccttatcctttgcgaaacattttcagcatgcgctgagtcacggtaaaaccaccgaaaatattaatgctggcgatcagcaccgcgataaagctcaggaagctgacccagccgccgtggcctatctgcaacaacgcgccaaccacgataatgcccgaaatggcattggtcaccgacatcagcggcgtatgcagcgcatgggagacgttccacaccacgtagtaacccaccacgcaggccagcgcgaagacggtgaaatggccgaggaactcttttggcgccacgttggccagccagccgaagagaataatcgccagcgccatcagcgcatatttgcgccacggcgacgccggtttcaccgcttctttcggcgcttccacttttttcgccgcggcctgcggctgagcggagacctgaatcggcggcgccggccaggtgatttcaccttcgcgaacaacggtcacgccgcgcactaccacgtcatcgaaatcgataacgatattgccgtctttctctttgcacagcagcttcagcaggttcaccaggttggtgccgtagagctgggaggactgggtcggcagacggccaggaagatcggtgtaaccgatgattttcacgccgttggcggtggtcaccacttcgcccggtacggtgtactcacagttgccgccgttttgcgaggccagatcgaccaccacgctgcccgatttcatggagtcgaccatttcgcgggtgatcagcttcggcgccggtttgcccgggattaacgccgtggtgacaatgatatcgacctctttcgcctgcgcggcgaacagcgccatttcagccttaataaaggcctcagacatcaccttggcgtagccatcgccgctgcccgcttcctctttaaagtccagctcgaggaactcggcgcccatactctgcacctgctccttcacttccggacgggtatcgaaggcgcgaacaatagcgcccaggctgttggcggcgccaatcgccgccagaccggctaccccggcgccaatgaccatcaccttggcgggcggaaccttgcctgccgccgtaatctgcccggtaaagaatcgaccaaattcatgcgccgcttcaacgatagcgcggtacccggcgatgttggccattgagctgagcgcatccagcgactgggcgcgggaaatacgcggcacggaatccatcgccattacgttgatattacgggccgccagtttttccatcagctgcgggttttgcgccggccagataaaactaatcagcgtggtccccggattcagcagggcaatttcatcgtcattcggagcattgaccttaaggatgacatcagactgccatacctcgtcgccggtcacgatttcagctcctgcctcggcaaaggcctcatcgtcaaagctggccagcttcccggcgccgctttctaccgcgacgctaaagccgagtttgagcaattgctcaacggtcttcggcgtggcggcggcccgggtctcctgggctagcctttcttgtggtacaccaatacgcatagttttcccttccatcggtttttgatgatggtttacttttctgcccaacaacgccaggacggcaaaatcttcgtcgccatctttcgctgtctacaaaatgaaacagtaacaaactttttataacctactgaaaataccgattgtgatctactgcgataaaacacaaattttgattttattgcttattgtcagctcagatgggtccgggcagcaatatttacctgaatttgccgctcaggcctgataatccgcttatcctgcggtataaaacgccatttatcgccattgagatcattgtgttaacattacattaactaataaaagtggtattgattatcgtttttgctggtcaagcgcctgttttttcaacatatcgaaaaatgttatctttccgtagtatacgattcgggcggcaagcaaaaattgacgcagacagtcacggcgattaaatgcaataatcaaacgttttcagtcaacaacaacaccagtatatggtttgcgcaaggcaaaggattatttttatgaagcttaaaaacaccctcctggcgtctgctctcctgacaaccgccacgttgtctgcccatgcagcgaccgagttgaccccggagcaggcggctgcgctgaagccctacgatcgcgttgtcgtcaccggccggtttaatgccattggcgatgcggtacaggcagtatcgcgcaaagccgacaaagacggcgcggcctcattctatgttgtcgacacgtcggactacggcaatggcggcaactggcgcgtcacggctgacctttataaagaagacgcgccgaaagcggatgcgccgaagaatcgcattatcaatggcgtgatggagttgccgaaagatcaggccgttgagctgatgccttacgacaccgtcaccgttcagggcttctatcgcagccagccggaagtcaacgacgccatcaccaaagcggcgaaagcaaaaggcgcctatgcgttctttatcgtccgccaggttgacgccaaccagggcggcaaccagcgcattaccgcttatatctacaaaaaagatgctgaaaaacgcgtgctgcagagcccggacgctatcccggctgactctgaagctggccgcgcagcgctggccaaaggcggcgaagcggcgaagaacgtggaaattccgggcgttgccaccaccgccgcggtgggttcgggtaccggcgttgggcgtttctttgagactcagtcttcgaaaggtggacgttacactgtcactctgccgaacggcactaaggtcgaagaagtgaacaaagtgactgcggcgcaaatggtgccgttcgataacatccagttcaccggcaactacggcaacatgacggaaatctcctatcagacggcgaaacgcgcggcgaagaaaggggcgaagtactaccacatcacccgccagtggcaggaacgcggcggcaacatcaccatcagcgccgatttgtacaaataatcgctgctggctggctaaaaaggcggcgcattgccgccttttcattttttttcatcccccgccattgcatggcccccggacactccgtaaaatcccgcgccttagcgcaatcctccatttttatgcgatttcgcaaaataaatattctggaacagccattttcacctcgggaatgcaatggaaaagaaactgggcctgagcgccctgaccgccctggtccttagctcaatgctcggcgctggcgtattcagtttgccgcaaaatatggctgccgtggccagcccctccgctctgctcattggctgggccatcaccggcgtcgggatcctgtttctcgctttcgccatgctgctgttgacccgtattcgtcccgacctcgacggcgggatcttcacctacgctcgcgaaggattcggcgaactgatcggcttctgctccgcctggggatactggctgtgcgcggtgatcgccaatgtctcctatcaggttatcgtcttttcggcgctcagttttttcaccgatacccctgagctgcgcctgtttggcgatggtaatacctggcagtctatcgttggcgcgtcggttctgctgtgggtcgtccactttctggtcctgcgcggtgtccagacggcagcggggattaacctggtggccaccctcgccaagcttctgccgctgggcgcctttgtcgcgctcgccgccctggcctttcagctggatacgttccgcctcgattttagcggcctggcgctgggcgtgccggtatgggaacaggtcaaaaacaccatgctgatcaccctgtgggtgtttatcggcgtggagggggcggtagtcgtgtccgcgcgggcgcgacacaagcgcgacgttggccgcgcgacgctgctggcggtgctgtcagccctcgcggtgtatctgctggtcaccctgctgtcgctgggcgttgtgccgcgcagcgaactggccgaaatgcgcaacccgtcgatggcgggactgatggtcaggctgatggggtcgtggggggagatcgtcattgccgccgggctgatcgtgtcggtgtgcggcgcttatctcagctggaccatcatggccgcggaggtgcctttcctcgccgccactcataaagccttcccgcgcctgtttgcccgtcagaatagcaacaacgccccctccgcctcattgtggttgaccaatatcagcgttcaggtatcgctggtgctgatctggctgaccggatcggactacggcacgctgctgaccattgcctccgagatgattctcgtgccctatctgctggtcggcgcctttctgctgaaaatcgccactcgcccgctgcataaagcggtggctatcggcgcctgtatttatggcatatggttattatacgcgtcggggcctgtgcatttgctgttgtcggtggtactttacgctccgggtcttctggtctttttgtacgcccgacgtacgcaccagcacgatcgttcgctcaaacgccgcgaagtggcgctaattggtttattgctggttgccgctttgccggcaacgtggatgctggtggggtaagcggtcgccctgccgcagaacgcataggagatacccatggctgaacaacagccccgcccgattctgatcacaggagcaggccgccgcatcggcctcgctctggcacaccattttctgcagcagcgccagccggttatcgtcagctatcgtacgccctatccggcgattgacggcctgcgcgaagcgggcgcgctctgcctgcaggccgattttagcagcgatgacggcattctgaccttcgctgaagcggtcaaatcacacaccgacggtctgcgcgccatcatccataacgccagcgactggatggcggaaaagccgggcgtcccgctgagcgccgtcatcaaccgcatgatgcagatccacgtccacgccccctatctgctcaaccatgcgctggaggcgttgctgcgcggccacggccatgccgccagcgacattatccatatcaccgattacgtggtggagcgcgggagcgacaaacatatcgcctatgccgccagcaaagccgccctggataacatgacccgctccttcgctcgcaagctggcgccagaggttaaggtcaacgccatcgcgccgtcgctaatcatgtttaatgagggtgacgacgaggcctatcgtcagcaggcgctggataaatcgctgatgaaaatcgcccctggcgaaaaagagattagcgatctcatcgattacctgtttaccagccgctacgttaccggccgctcattcgctgtcgacggcggccgcccgctgcgctagtggaaacggctccagccgaggattaacagccaggcgcacagcccccagcatcccactgcgcctgccagcgccaacggcaggcgcataatcccggtgaaataccacagtgacagcagatagataaaatagggaagaatcgaccacatgccgaatacgatggtcgcgcgcagggcttcgatcccccgctcgctggcgacaatataatgggcgatgagcgcaaaggtgggaaacagcgggaccaggccagcgatagcgtagtttttggttttcgccagcacgccaatcagcaccaccaccagcgctcccaacagccctttgattaacagccccatgcccgtatgccttaacagtgaatcaataagttagggcagcatagcggatttaacgctgtttataaaagagtaatggcgggtaaaataagtgcggtgtatgttacttcttttactgatgtgcaatagacatgaataaaatcgtttttgttgaggatgaccctgaggtaggcacgctgatcgccgcctatctcggcaagcatgatatggatgtggtggtcgagcctcgcggcgaccgcgctgaggaggtgatcgcgcgggagaaaccggatctggtgctgctggacattatgctgcccggcaaggacggaatgacgctctgtcgcgatctgcgcgggcaatggcaagggccgattgtcctgctgacttcgctcgacagcgatatgaaccatatcctctccctggagatgggcgccagcgattatattctgaaaaccaccccgccagcggtactcctcgcgcgactgcgtctgcatttgcgccagcatattgctccggcaggcgccggatccgcctcctcaacgctcacgccacataaaaccatctccttcggctcgctgaccattgacccggtcaaccgccaggtgctgcttggcggagaaaacgtcgccctgtcgaccgccgatttcgatctactgtgggagttggccacccacgccgggcagattatggaccgcgacgcactgctgaaaaatttacgcggcgttacctatgatgggatggatcgcagcgtcgacgtggctatctcccgcctgcgcaaaaaactgctcgacaacgccacggagccctatcgtattaagaccgttcgcaacaaaggctacctgttcgcccctcacgcctgggataactaagcggcccttctgcggccctgcgaggggcccgctcattgcgcgctcgccggcggcaaagttatcacgtttgctgcctgctgcgttcgtccctggcgcgcacattcatcaccggaacttgtcatattgactaaatcaatagaattagccgtacagaaccccatcacataactcctcaatatgattgtgctcaaggacttaccgctgccagagtggcataaagcctgaaaacacaggacttttgcatgatgaaatacgttgtacttttggcactctcactgttcacttctctctctggctgggctttttccctcgacaacgccgatattcgactcctctgtccgcagcgcgggcaaatcgaggtgatccttcatcgctatgaacatacccagcaatcctgggggcagcatcactttgaaaccggcggcggccacgttcgccaggggccgctgctggtgatcccgtttgccaacctcgatcagatgatttaccaccagaccaccggcgagtttgcttactggtatgccgaaacggaaaagctggtgcgctgtcggctgctgagtctgacgaccacctatccggtagacattccttattatcgtgagtagcgtatccatcgacgcacaaaatacgattgcccagctccccccgaggtgaagaaatcaccgcatcgagtgacaccgtcaccttttcaccgttctgtctccaggctggctattgtcagggggcataaaccctgctttgatagcgtatctatgatttccccgcgcctcgcccggggatatcgataacattgactccccgacgcgcagaagatgcccctggggcgccagacaggtttctcttgaatacgcggtaatgtaatgaaaaagctgttcgtgcagttctatcttctgctcttcgtctgctttctggtgatgaccatgctggtcggtctggtctataaatttaccgcggagcgcgccggacggcagtcgcttgacgatttgatgaaaagctcgctgtatctgatgcgcagcgagctgcgggagataccgccgcgcgactggagcaagacccttaaagagctggacctgaatttatcgtttgatctgcacatcgagccgatcagcaaatttaagctgtcggaaagctcgatgcagcacctgcgcgccggcgatatcgtcgccctcgacgatcagtacacctttattcagcgcattccccgcagccattatgtgctgtcggtgggtccggtgccctatctctattttctgcatgagatgcgcctgctggacgtggcgctgatggcgtttattgctatctcgctggcctttccggtgtttatctggatgcgcccgcactggcaggacatgctgcgcattgagacggccgcccagcgctttggcgaaggtcacctcagcgagcgcattcacttcgacagtatgtccagcttcgagcggctcggggtggcctttaaccaaatggccgataacattaatgcgcttattgccagcaaaaagcagctgattgacggcatcgcccatgaactcaggacaccgctggtacgcctgcgctaccgtctggagatgagcgagaatctcagcgaggcggaatcgcaggcgctgaaccgcgatatcggtcagctggaggcgctgattgaagagctcctgacctacgcccgcctcgaccgcccgcagacggagctcagcctgacgactcccgattttcccgcctggatcagcgatcacgtcgaggatatccagatggttaacccacagcgcgaggtcgccctggcgacgctgacccacggtaactacggcgcgctggatatgcgactgatggagcgggtgctggataatttggtcaacaacgccctgcgctacagcagccagcgggtggcggtcagcctgacgctgcagggttcgcgcgcatcgttgctggttgaggatgacggcccgggaatcgcccccgaggagcgcgagcgggtgtttgagccctttgtccgccttgaccccagccgggaccgggcgacaggaggctgcggcctcggcctggcgattgtccacagtatcgcccaggcgatgggcggcgaggtgcgctgcgaggccagccctctcggcggcgcccgcttctgctttagctggccggtctatcatcagctgcctgatttcacctctgcctgaataaaacttgcgcagaagccgcgggctgggtatgctgcaaaaatctaatagtatgttgtaactaaggtggtaataatggccagctacgacctcgttgaacgtctgaataatacctttcgccagatcgagctggagctgcaggcgctccagcaggcattaagtgactgccgtctgctggcgggccgggtatttgaactgccggcgatcggtaaggatgccgagcacgatccgctggccactattccggtggtgcagcacatcggcaagacggccctggcgcacgccctgcgccactacagccatctgtttatccagcagcaatcggaaaaccgcagcagcaaggccgccgtacgcctgccgggggctatctgcctgcaggttaccgccgcggagcagcaggatctgctggcgcgtattcagcatatcaatgccctgaaggccaccttcgagaagatcgtcaccgtcgactccggcctgccccccaccgcccgttttgagtgggtacaccgtcatttgccggggttgatcaccctaagcgcctaccgcacgctgacgcccctcgtcgacccgagcaccatccgcttcggctgggccaataagcacgtcatcaagaatctgacccgcgaccaggtgttgatgatgctggagaaaagcctgcaagcgccgcgggcggtgccgccgtggaccagggagcagtggcagagcaaactggaaagggagtatcaggatatcgccgccctgccgcagcgggcgcggctgaaaataaaacgaccggtgaaagtccagccgatcgcccgcgtctggtacgccggcgagcagaaacaggtacagtacgcctgccccagcccgctgatcgccctgatgtccggcagccggggggtcagcgtaccggatattggcgagctgctgaactatgatgccgacaatgtgcagtatcgctacaaaccggaggcgcagtcgctgagattgcttatcccgcgcctgcacctctggctggctagcgaatagccaggctgccgaccatctcttccgggcgcacccagctgtcgaattcggcttccgtcaggtagcccagcgccagcgccgaggctttgagagtcagcccctcatggtgcgcttttttagcgatttccgccgccttgtcgtagccgatatgggtattcagcgcagtaaccagcatcagcgactcattgagcaactgactgatccgctcgcgattcggttcaatacccaccgcacagtgctcgttaaagctcgccataccgtccgccagcagacgcaccgactgcaggaagttgtggatgaccatcgggcgatagacgttaagctcaaagttgccggaagcaccgccgatattcactgccacgtcgttgcccatcacctggcagcagaccatggtcagagcttcgcactgggttgggttaaccttgcccggcataatcgatgaccctggctcgttttccgggatggcgatttcaccaatgccgcagcgggggccggaggccagccagcggacatcgttagcgattttcatcagcgaggccgccaggcctttcagcgcgccgtgggcatggaccagggcatccacagtggccagcgcttcgaatttgttcggcgcggtgacaaatggctgtccgctgagcgacgccagctcggccgccacccgtacggcatattccggatgggtattcagcccggttcctaccgccgtcccgcccagcgccagctcggcaagatgcggctgactggcttcaatgtgcttcaggctatggtccagcatcgccacccagccggagatctcctggcctaaggtgagcggcgtggcgtcctgcagatgggtgcggccgatcttgacgatatccctgaaggccaccgctttttcattgagcgtcgcccgcagcgcctgcagcgacgggatcactttttcccgcagggcaatcagcgccgcgacgtgcatggcggtggggaatacatcatttgagctttggctcttattcacatcgtcattgggatgaatttttcgcgccatcccccgttctccgccgagcagttcactggcgcggttggccagcacctcgttcatattcatattgctttgggtgccggagccggtctgccagatagccagggggaactcctgcgcgtgctttccggccagcacttcgtcagcggcggcgacgatcgccccggctttctccgccgtcaacagtccgagatcctggttaaccttcgccgccgcccgcttggtcagcgccagggcgtatatcagctccccgggcattttttcggtcgagatgcggaaatgctccagcgagcgctgggtctgggcgccccagagtttatcggccgggacctcgatggcgcccatcgagtctttttcactgcgatgcgttgtcattactttctccttggatgaaaagtgcgtcatagcgacaaagctcacctgcttaaaagactaagtattggccagattgataagttgttttggtggttcgtgccgcgaagcgacataaaaaaagccgccccgaggggcggcccagaccgctgacaaaatgcaatcgtcgggattgcccggcggcgctacgcttgcgcgagcctacagagaactgcataacttattgatattgctgtttttcgtaggccgggtaaggcgaaagccgctacccggcagaaaggcgctcaccctaacgaaatcaggtttgtcatcgaccagcgccgccccgaagggcggcctgggttacttcacgcagcgggcgcactgcgaggtctggatctgctggaagaagtcattgcctttatcatcaacgaggataaaggccgggaaatcctccacttcaattttccagatagcctccatacccagctccggataggccacgcactcgaggctcttgatgctctgctgggccagcactgccgccgggccgccgatgctgccgaggtagaagccgccgtgtttgtggcaggcgtcggtgacctgctggctgcggttgcctttcgccagcatgatcttgctcgccccatgggactgcagcagatcaacgtaagagtccatgcggcctgcggtagtcggccccaaagagccggaggcgtaaccgtccggcgtcttggccggacctgcgtagtagatcgggtgatctttgacgtactgcggcagcgcctcgccgttgtcgataagctccttcagcttagcgtgggcgatatcgcgggcgacgatgatagtcccgctcagcgacaggcgggtggacaccggatactgcgacagctgcgccaggatctcgctcatcggctggttaagatttaccttcaccgcttcgccttccccggcctggcgcagatgctcagggatatatttccccgggttgctctccagcttctcgatccagatgccgtcgcggttaattttggctttgatgttgcggtcggcggaacaggaaacccccatccctaccgggcaggaagcgccgtgacgcggcagacggatcacgcggatatcgtgggcaaagtatttgccgccgaactgcgcgccgagaccaaggttctgcgcctccagcagcagctcctgctccagctgcacgtcgcggaacgcctggccgtgctcgttaccttcggtcggcaggccatcgtagtatttggtggacgccagcttcacggtcttcagcgtcgcttccgccgaggtaccgccgatcacgaaggcgatatggtacggtggacaggcggcagtaccgagggtgcgcatcttctcgacgaggtaatttttcagcttcgccggggtgatcagcgctttggtttcctggtacagataggttttgttcgccgagccgccgcccttggcgatgcagaggaatttgtactcatcgccatcggtagcatagagatcgatctgcgccggcaggttggtgccagtgttaacctctttatacatatccagcggcgcgttctgcgagtagcgcaggttgtcctggatataggtgttgtacaccccctgcgccagggcggcttcatcgccgccgccggtccacacgcgctggccttttttacccatgatgatcgcggtgccggtgtcctggcaggtgggcagaatacctttggcggcgatatccgagttgcgcaggaactgcagcgcgacgtatttatcgttttcgctggcttccggatcgttaaggatatccgccacctgctgctgatgcgcagggcgaagcataaaggaggcgtcgtggaaagcatgctgcgccagaagggtcagcgcctgagggtcaacttttagcacttcctggccggcgaattcggcgacggagacgtaatcactgctgaggagataatactcggtgtcatcctttttgagcggaaaaggatcctggtaaacaaacggtttattcgacattgtactctcacttactgctttggctgattatgtttcaggcagggactccatgtgcctgtagaaaagcgagtcgaacaatcttacacaattttttaacaaaaactgagacaaggacgactttttctttcagcagttgcttctccaccgtttgctggtttaatagggcgataaaatttactttgtttgaaacagggattgagaatgcaaaagctgattaacgccgtgcagaactatgcatggggaagccacaccgccttaaccgaactctatggcatcgccaacccggacaatctgccgatggcagagctgtggatgggggcgcatccgaagagcagttcgcagatcctggcggccgacggccagccgcgttcgctgcgcgaggtgattgacgcggataaagccgctctgctcggcgacaaggttgccgcccgctttggtgaactgccgttcctgtttaaggtactgtgcgccgctcagccgctctcaattcaggtgcatcccaacaagcaggcctcggaagaaggtttcgcccgcgagaacgccgccggtatcccgctctccgccgccgagcgtaactacaaagatccgaaccacaaaccggagctggtttttgccctgacgccgttcctggcgatgaatgcatttcgcgagttcagcgagattgtcaccctgctgcagccggtggctagcgcgcatccggcaatcggcgccttcctgcagcagccggacgcgactcacctgagccagctgtttgccagcctgctaaatatgcagggtgaggaaaaggccaaggcgctgcaggtgctgcgcgacgtactggcccgtgaacaaggcgaaccgtggcagacaatccgcctgatcgcggaattctatccggacgacagcggcctcttctccccgctgctgctgaacgtagtgaagctgaacccaggcgaagcgatgttcctgtttgctgaaacgccgcacgcctatctgcagggggtggcgctggaggtgatggccaactcggataacgtactgcgcgccggcctgacgccgaaatacattgatattcctgagctggttgctaacgtcaagttcgaggctaaaccggcgggtgagctgttgacccagccgcagcgtcacggcgcggaactcgacttcccgatcccggtggaagattttgccttctccctgcatgacctctccgccgaggccagcgatctggcccaggcaagcgcggcgatcgtgttctgcgtcgacggcgaagccgtactgcgcaaaggcgaccagagcctgaccctcaagccgggcgagtcggccttcgtggccgccagtgaatcgccggtgcaggtcagcggccgcggccgcgtggcgcgcgttttcaataagctccagtaagcgactgccccttcaggtcgcgcttactgttggtgataactcagccaggcggtctctccgcctggcttcatttatggataaatgctatgaaaaaatcgctggtcgcagcaggagtcatcgtggcgctgggcgtggtatggacaggcggcgcctggttcactggtaaacagctggaaggccggatcgccgatatggtgcagcaggcaaacgcccagctgcgcagcagcgcgccggagtcaggtctggagctgagctatcaggactaccagcgcgggctgttcagcagccatctgcagctggtggtgaagccgatcgccggtcaggctaacggctggctggccgccgggcagagcgtggtgcttgacgaagtggtcgatcatggccccttcccgctggcctcgttaaaagcctttaatctggcgccggcaatggcttccgtccacaccacgctggtgaaaaacgacgccagccaggcgctgttcgagatagccaaaggcgacaccccctttaccgtcgatacgcgcattgcctacagcggcgacagccagtcggctatcgtccttaacgccctcgactacgctaaaggcgatgagaaagtcaccttcagcggcggtcagttccagctcgacgccgaccgcgacggcaaaaacatcagcctgaagggccaggccggcagcgggcagatcgatgcgctcaacgaatataatcagaaggtacagctgcgcttcgtcaacctgaccaccgacggcgccaccgagctggccagcttcaacgaacgtatcggccagcaaaaaatgaccctcgataaactggccatcagcgtcgaaggcaaagagctggcgctgatcgacggcatggcgctggacggcggctcgacgctgacccaggacggcaaaggcgtgaacagccaggtgaactacaccgtcaacagcctcaagctgcaggggcaggatatgggcagcggcaaactcacgctgaaagtggataacgtcgacggtcaggcgtggcaccagttcagtcagcagtacagcgcgcagtctcaggcgctgctggcgaaaccggagctggcgcagaatccggagctgtatcagcaggccctcaccgaaacgctgttcaatgcgctgccgatcctgctcaaaggcaacccgtcggtgaccatctctccgctgagctggcgcaatgccaaaggcgaaagcaccctcaacctctcggttctgctgaaagatccggcccaggtgaccgctccgccgcagaccctggcggacagcctggatcgcgtggtgcagtccctggacggcaaagtggtgatcccagtggatatggcgacggagtttatgactaagatcgccggtctggaaggctatcagccggccgatgccgccaaactcgccgatcagcaggtcaaaggcctggcggcgatgggccagatgttccgcattaccaccatggaagataacgccatcagcagcagtctgcagtacgcgaacggccaggtgacgctgaacggacagaaaatgccgctgcaagactttgccgcgatgtttggtctggaagcgccttcgctgccggacagcgcgccgcaggaaggccagccgcagcaggatgacgccgctcctcagcaggacgacgccgccccgcagccgtaacttatcggtacaggagacggccagcgcgcgccgtctccctcattttcgcgtcaccagccgcgggggcataatctggtttcgcgtctcgccagtcccctcttccagccgccgcagcatcgaatccgccaggcttttccccatctcccgcgccggggtggtcacccaggtgagaggcaggtcgtcgagggcggcctccggcacgtcggcaaacgccgccagcgccacccgctgctcaaagtagctctcgacgccatcttccccgctctgtcttccagcccgtaacagaccgaaccacgcgccggtggctaccacgttgttgtagcacagcaccgcggtgatggtcggattctggcgcagcaggccggtcatcgcctccgccgcctgcttctggctggactcgcactccagcacccattcgctgtgaaacggcaggccgtatttcagcaaggtggcgcaatagccgccgacccgctcggcgcgcgtcagcgaagcactctgcccgccgagccaggcgatccgctgatggccgcggcggataagatgctccgtcaccagctgcgccgcctgcatgttgtccgggcggatcaggtcgacatcgtcaagatagctggcgcgggaagcaaacaccagcggcacccccgcctccgccgcacgctcgcgcagctcgctcccgcggtcgatcgccccggcgataatcaccccgtccaccccctgcgccgccagcgtatcaaaccgctgggccatcttctcgccgctgcggcctccctgggtgagaaataccattttcccctgcctctccagggcatcggtgaggccggcggttaattcagcataaaacggttttgacaggtcgctgacgataaggccaatcaccccgctctgcccaccgcgcagcgaggccgcctgacgattgcgcacaaatcccagctgttcgatagcctgattaacccgctcgccggtggcgctggagatgcgccctttgccgctcagtaccagtgaaacggtactcacggagacgccggcagccagcgccacatcattgatggtgatcttttttgcgatagccataacctgctggctgactcccttgcctgtcgataaatcgttttatcattgtgcgatctttataaaccttattatcgcttgaatatgtgatttttatcgcactaaaaagtgataaaacgttttatcttgccgtggcattagttctcccgaccacttatgaatcaggaaccgtgctatgacggcgaaaacagcaccaaaaatcaccttatgggaatttttccagcagctgggaaaaaccttcatgctgcccgtagcgttgctctcgttttgcgggatcatgctggggatcggcagctcgctaagcagtcacgatgttttgactctgctgccgtggctggatatgccgctgctgcaggccatctttatctggatgagcaaggtcggctcctttgccttcagcttcctgccggtcatgttttgtatcgccatcccgctgggtctggcgcgagagaacaaaggcgtcgccgccttcgccggcttcgttggctacgcggtcatgaacctggcggtcaacttctggctgaccgcgaagggtattctgcccaccaccgacgccgcgatcctgaaggccaacaatatccagaacattatcggcattccgtcaatcgataccgggatcctcggggcggtgatcgccgggattatcgtctggctgctgcatgaacgcttccataacattcgcctgccggacgccctggccttcttcggcggcacccgcttcgtgccgatcgtcaccaccgtggtgctggggctggtcgggctggcgatcccgctggtgtggccagtcttcgctatggggatcaacgccctcgggaagatgatcaacagcgccggggatttggggccgatgatcttcggcaccggcgagcgactgctgctgccgtttggcctgcaccatattctggtggcgctgatccgctttaccgaagccggcggcactctcgacgtctgcggccacagcgtcagcggcgcgctgaccatcttccaggcgcagctgagctgtccgacgacccacggcttcgccgaaagcgccacccgtttcctgtcgcagggtaaaatgccggcattcctcggcggcctgccgggagccgcgctggcgatgtaccactgcgcccgtccggaaaaccgacataaaattaaaggcctgctgatctccggggtcatcgcctgcgtggtcggcggcaccaccgagccgctggagttcttgttcttgtttgtcgcgccggtcctgtatgtcatccacgcgctgctgaccggtctcggctttaccatcatggcggtgctcggggtaaccatcggcaacaccgacggcaatatcatcgacttcgtggtgtttggcattctgcatggcctggcgaccaagtggtatctggtgccggtagtggcggctatctggttcgcggtctactatgccatcttccgcttcgccatcacccgcttcaatctgaaaacgccgggccgcgacatcgacactgccgccagcgtggagaaagccgtcgccggtaccatcggcaaatccgggtataacgtaccggcgattctggcggcgctcggcggcgcagagaacattgtttcgctggataactgcattacccgtctgcgcctgtcggtgcacgatatgagcaaagtggacgccgccgcgctgaaagcccatcgcgccatcggggtggtacagctcaaccagcataatctgcaggtggttattggcccgcaggtacagtcggtaaaagatgagatggccacgctgatgaataccgtgcaggcctgatcccactagtccccctccgctacggagggggcgctcgctaaggaagctccaatgtttgattttgccacccctatcgatcgccacggcacctggtgcacgcaatgggactatgtcgccgaccggtttggcgccgccgatctgctgccgttcactatttccgatatggatttcgccaccgcgccctgtattctcgacgccgtcagccagcggctggcccacggggtgttcggctacagccgctggcgcaacgaggcgtttctcggggcgattgcccactggtacgccagccgctttaacagcgacatcgatccgcaatctgtggtctacggaccgtcggttatctatatggtggcggaaaccatccgccagtggtcgaaagaaggcgacggcgtcgtggtccacacccctgcctacgatgcgttctataacaccatcaccgctaaccggcggcggattgccccggtgccattgatcctgaaggataatcggtggcgctgcgatatggaccgcctggaggcggcgctggcggagccaaagaataccctgctgctgctgtgcagcccgcacaacccaacggggaaagtctggcgtcgcgaggagctggagaccatggcggccctgtgtcaaaaacatggcgtcagggtgattagcgacgaaattcatatggacatgacctggagcgaacaccgccatatcccgtggagcgaggtcgctcagggaccatgggcgttgttcacctccggttcgaagagcttcaatattccggcctttaccggggcctacggctttatccccgaagagaacgagcgcgacagctacctgcaggcgctaaagggtcgcgacgggctctcttccccttccgtgccggcgctggtcgcccatatcgccgcctaccgcgacggggctccctggctcgatgccctgcgcgactacctgcaggcgaatatgcgctatgtcgccgacacgctcaacaacgccttccccgcgctcggccggcagccgccggaggccacctacctggcatggatcgacctgcgcccgctcaacgttgacgatcgcgcgctacagcaggcgctgatcgccgaacagaaggtggcgattatgccgggttatacctatggtcctgagggcaacggctttctgcgactcaacgtcggctgcccgcgcgagaagctggaacgcggtgtcgaaggactgattgccgccctgcgcagcctcagctgattcgacgcgcaatctacaggtcatcgcgccggcgaaacgccaggtaaccggcgccgagggtaaagacagcgacaatcaccaccagcaggataaacccgtggtggttgcttgccagcgggatcccaccgacgttcatgccgaagaaaccggcgacgatgttaatcggcagcgcgaggacggtgatcaccgtcagggtatagagggtgcgattgctctgctccagctggcgggcgccaatctcctcctgcagcagactgatgcgctcgatcaggcccgacagatcgttaagcaccacgctaaactcttcggtgaactgacgaaacgcctgcaccaccgcgcgatccatccacgccggcggccggttaagcagccggaacatcgccgccggctccggcgccagcagccgctggaagcgtaaaagcatccgccgtagccgcgccagatcggcccggttgcgctgcacgtgattgctcagaagacgctcttcaataaggtcaacatggcggctggcctggcggacgacctgctccagcacctcctcctgctcctccagcagaaaggccagcagctcagtagacgtgttcaccctgagcgtctgcaagcgcggcagcatccattcgataaaccgcaacggtttgaagcgcgccgtcaccaccagcctggggctacagtagagccacagcgtggcggtttccgcgctggtatcctgcggacgaaacagcacatcgttaagcacagcgaacagattttccccctgtcgctcaatgcgggtggtgtgcgagccgctgcggatctcctcgaagaaaaaatcggccaccggaaagtggctggttaaccatttctcggcggtggcgtgattaagattcaggtgtaaccagataaacgccttgtcatcggcgagcgcctgatagcgggcgcatacctcgccagaggcgatcggctgcggggggcgctgttcatgaaacaaatagccatgcaccaggccggaaacttcactatcaaaatcgggctttaacatcttcgcggtgacgtcttgactcatggctccctcaggacaggcactggcaccgttgatgcccgaatattgccatctttcgctattttccgcgggctggcaaggttaataatctggtcataaaacagtaacctggctgacatatgacggccagtatcacgcttcatcccctcgccgcgcaggcgatgcgatggaggcgaacagaaggtcttcttgcctttatgctcaggtggttattaaaataaatttgattatcctcaaaacttttttaggcagaaagcggtattaatttgcgcgcttaatcattgctttcacccaggtttattgaggaggagaccatgaaaacctatgaccgtaatcgtaacgctattgctaccggcagcatggtaatgatcgccggtaacgggacgacgggcgtgattaaagctatccatggcgaggggaaaaccgctgagcagttgcgccgggcggactgcgttgaaatcgacggctgcgagggccgcttctgcccgttggatctgatccgtctcggctttcattaattcctgccgccaggtcgttagtatcaggccacctgtggtggcctgctcttttcccgggaaataaagcgtctagcgaaagctccactgaacactcatcacaaagatcgccggcacaataatgccgccttccacaccgaaataatcggtgaaattatattgcaggccatgatagaggtagggcgaaaaaccgatgccggtgatttttttggcggtgcggtaggtgccggaatccccacagtggctgaaggcatcaaagaaaaattccccggtataggcatacacccctttcagtacccagccggtatcgtttttcagccagtcgcggcgcacgccgagagtcaggcagcgatcgtcaaagctgtttttcatcgttccgaccagcacgctgtattttgaatcctgagaaaacttgcgctccaccgagaaaaagttgttattgaaatgttcgttatattgtccgtggttacccgtcatatgatagacataggaaccggtattcatcgaatagaggtttaattccccggcctgcgccgacggcatggcaaccattagtagcgctgataacaaaatccataatttatttaccattcagtaacctatgccatacccgtaaaaagaacccggcatgctagcaccgcttagctaaaccaaagggcaatcagataaaccgacgctcttcgcggcgggaaaatatgacgctatctgcactatagcagtcgccctctcgcctggtgagcgcctgcggttatactggagaaacatttctctaatcgttaaggaccgctgtgttagccactctcctcgttgcgctggtcgctattattcatctcgccatcctggtgctggagatgtttctctgggaagcccccgccgggcgccgggcctttaacctcagcgccgatttcgcccggcagacccgggtgctggcggccaaccagggcttgtataacggctttctggccgccggcctggcatgggggctgtggctgggggcgccgggggtacaggtggttatctttttcctggcctgcgtgctggccgccgggattttcggcgcgctgaccgccagccgcaaaattctctatattcaggcgctgcccgcgctgctggcgctggttgccgtgctgacgcaagcgtagggccttgatccaaaacagagaaagcaggcgctaaggcgggtactatttgccccctttggtcggtcatcgaccgttaataccttctgagttcagaggcatttttatgacatggcaatccttcaaacaggcctggcttatccggttctggtctcctgtcccggcggtcattgccgcgggcattctctctacctactattttggcatcaccggcaccttctgggcggtgaccggcgaattcacccgctggggtggtcagctgctgcagctgctgggcgtccacagcgaacagtggggctattaccagctgatacatctcgaagggtcgccgctgacccgcatcgatggcaggatgatcatcggcatgttcggcggctgcctggccgccgcgctgtgggcgaataacgtcaaactgcgcctgccacgcagccggatccgcattgcgcaggccgtggcgggcggcatcatcgccgggttcggcgcacggctggcgatgggctgcaacctggcggccttcttcaccggcattccgcagttctccctgcacgcctggctgtttgccatcgccaccgccatcggctcctggtttggcgcccgcttcacgctgctgcccctttttcgcatcccggtaaaaatgcaaaaagtgtccgccgcctcgcccttaacccaaaaaccgcagcaggcgcgccgccgtttccgccaggggatggtggtctttttcgccatgatcggctggggcctgctcaccgccgcagaccacccggcgctcggcctggcgatgctgtttggcattgcctttggcctgcttattgagcgcgcgcagatctgctttacctccgcctttcgcgatatgtggatcaccggccggacggtgatggcgaaggcgattatcttcggcatggcggcgagcgccatcggtatcttcagctatgtgcaattggggatggcgccgaaaattatgtgggccggtcctaatgcggcgattggcgggctactatttggctttggcatcgtgctggccggcggctgtgagaccggctggatgtaccgggcggtggagggccaggttcactactggtgggttgggctgggcaacgtcatcggctcaacgctgctcgcctggtgctgggacgatatcgccgccccgctcgccacccactggcagaaagtcaacctgctgaacgccttcggtccctttggcggactactggccacctatctactgctgctgatcgccctgctgctggtgatcgcctgggagagacattttttccgccgccaggcggcggtccggaccgtgaaggagagcgcatgaaaaacatcatccctgattatcgcctggatatggtcggcgaaccctgcccgtatccggcggtcgctaccctggaggcaatgccttccctgcaaaaaggcgagatcctcgaagtggtcagcgactgtccgcagtcgatcaataacattccgcttgatgcaaggaaccacggctacacggtgctggatattcaacaggatggcccaaccattcgctatttgattcagaagtagcgccgttttcccgccggcggccttccccgccggcgcttgtctcctcgttcccgcctcgccgttcgcttacgcatcgctgaccaggtagccaaacgattgcaatagattgtaacacttgaaaccgtgttccagttacgcaataaccattaatataacgcgcctatattattaaaatgcgaataagttatttagtgaatggtttctgccgctatcggccaaagccgcacacagcgacacgataaggatcgaaatggaactgctggtcaggctgggtcatttttttgagcaagcgcgttctgacgccgactatgccaccttcgccaatgaactgcgtcggcatcaggtctcctactacatctattttgtctccaccggcaatatgaatttcgtaatggcaaacgacgaggtggtctcggtaaaaagcgcccgcgggctgctgcgcgttcgcgctgaggccagccattgtctgaccagggccgccgttatccgccactttgcccgggccattaactttgaacagtactgccgggatctcgccagcgccggggtgtttaagtggatcgtcgatctggaagaggagacccggcactactggtcgaaggataatacgctgttatataaagagtgcctgatgcccccctgagccggtctcagggggaggcggcgagggtcagcctttaatcgcgggtctgcacccaaaaggcgtggatcaggccaggaatatagcccagcagggtcaaaatgatattgagaataaacgcccagccgaagccttttcccagcagcacacccagcggcggcagaatgatagtgaaaacgattctccagaatcccataacctctcccttcgtctaacgtcaattttttactaagctattcaatagttaagcatagacgcttttcgtcgtttcgccagcaggcagccccctcatctctggtaacaaaaatcattccctgccgtcacgggcaaaaaagaccgggaaaacattcacttttcccctctccggcccgcaggccctggcaaagcgcacagattgtcagttgaccaatcagggggacagggctaagcctggaggagtttcatcacatcgagtcgttttaccaaccggagaatatccatgagtaaacttgggattaatggatttggtcgtatcggacgtctggtgttacgtcgtttattagaagtcgacagcagcctggaagtggtggctatcaacgacctcacttcgccaaaggtgctggcctacctgttgaagcatgattcaaactacggccccttcccgtggagcgtcgactttaccgaagatgcgctgatcgtcaacggcaaaaccattacggtgtatgccgaaaaagaggcgcagcatattccatggcaggcggcaggcgccgaggtgattgtggagtgtaccgggttctacacctcggctgagaaatcgcaagcccatctccaggccggcgcgcgcaaagtgctgatttccgcccccgccggcgagatgaaaaccatcgtctacaacgtcaacgatgacaccctgaccccggatgacaccatcatctccgtggcctcctgcaccaccaactgcctggcgccgatggccaaagttctgcaggatgccttcggcatcaccgtaggcaccatgaccaccatccacgcctataccggcacccagtcgctggtggacgggccgcgcggaaaagatctgcgcgcctccagggcggcggcggaaaacgttatcccgcacactaccggcgcggcaaaagccattggcctggtgatccctgccctgagcggtaagctgaaaggccatgcccagcgcgtaccgaccaaaaccggctcagtgacggagctggtatcggtgctggagaaaaaggtgactgcggatgaggtcaatcaggcgatgaggcaggcggctgagggcaatgaatcctttggttacaccgaagaggagatcgtctcttccgatatcatcggcagccatttcggttcgatctacgatgctacccagctggagattgtggaggccggcggcgtacagctggtgaaaaccgtcgcctggtacgataacgaatacggctttgtcacccaactgatccgcgtgctggagaaatttgcccgctaagtgaacggcggacagcctgcgctgtccgccggttctgtgtggagtgcctcaggcctgcagatagaccacctgggtctgcaggtactcattcaggccgtggcggccatctgcgccgccgatccccgacttacgccagccggcgtggaacccctgcatcgcctcaaagttctcacggttgatataggtttcgccaaacttcagtcccttaatcgctttcatcgccacgttcagatcgcgggtatagattgaggaggtcaggccataatcgctgtcattggccatcgccagcgcctcatcgagggtcgaaaaggccaccaccggcagcaccggaccgaaggtttcctcatggataatgtccatctcctgacgtacatccagcagcagggtcggcggataaaaatagcctttgccctccagcggctgaccgcccagcgccacccgcgccccctgcgccaccgccttcgccactttgcccgccacctggtcccgcgccgccgcgttgatcagcggccccatcgcgatgtcatctcgcgtcgccgggtcgccaaactggacggccttcatcgcctcaccgagtcggttgacgaagcggtcgtatattccctgctgaacatagacccgctcgacgcagttacacacctgcccggtgttaatcacccgcgagtccactaccgctttcaccgccagctccagatccgcatcgtccattacaatggcaggcgctttgccgccgagctcgaggcacactttggtgatatttttcgccgcagcggccataattttttctcccgccgccacgctgccggtcatgctgaccatcgccaccttcggattgccggccagctcctggccaacggtttctccgcggccaagcacaaggttaaagacccctttcggcaacccaacctgatggacaatctcggcaaaggcgatggcattattgggcgtaaattcgctgggcttaatgacaatggtatttccagtgatcagggccggcgccagcttgcgggcgataagaaagaacgggaagttccacggcaggatcccggtggtcacccccagcgcgcgtttaaagacaaggatattctcccccgggcgatcgctctgcacgatctcaccttcgtaacggcgcgcccattctgccatatagtcgagatagtccgcggtgaacgcaacctccaccgccgccagctgctggatcttgccgccttcagcgacaatcagcccggcgatctcgtcggcacgctggcggataccggcggcaattttgcacagccagcccgcacgctcaatggccggcagcgcttcccagccgggctgggcgcgctcggcggcgtcaatcgccagccgcgcctcttcggcagtcccgtccgggatccgcgacagcagcgcttcggtcgccgggttaagcacgtcgatccagccgtcgccgcgaccggaaacgaactggccatcaatatacatcgggtgttgaacgggtgctgtcatggctgctcctgtggtgcatttgtatttaacaggtgatttttttgttaaatatcgggcggataagccgctgttcggcagcacattgacgcagttctgtgagctgattcataaaaacgggccaaaaattcccgcttgaggttacattttaataacacaaattgcccgtttgcgacgaatctgccgtaaacgggcatttttcagccgagggtgcgggcctgcagcgccccggcaagctgggcgtcctcccgcagctgtcgccaggcgtcgaggatctccggcgggaaggtgacatggctgatgaagtcttttccccgcggaccgtatccttcaggggtatcctgcaggcgcggcagctcgcccagcagcagccccaggtagcgggtgaccggccagagccccgctccgccgcccgcgaaccccagttggccatcggtctgctccagcaccggcgagcagccgggaaagctcaaccactgcggcggcggcgtcgccccctgccagacgcgggcgaaggtagccatggttcgccgctgcatagtcgggtcctgaatgacgatcccgcgacgatgggcgagcccccggctctccagcgtggtccgggtaaaacgggcgttctcaccgcagttggttgactggtcctccaccaccagccgcgaatgggggatgtgccagtagtcatgagcaatgtcggccagaacatgcgcttccgggcggccatccaccggcaacgtacggtaacggggatcctggcgcaccgcctcgtaaagatagcccgtagaatgtcccacgccgccgctgatcagcagcgggaccgcctgcgccgccgccagacggcaggcggcgtcgatggttgggatcacggcgttgccggccagcactaccacgtccacctgcggcaacgcgggcagcgtcgccagatcgtcctgcgccagccaggcgccgacctggttagccgccgccagcgtcgctgccgacagcggaggaaattgttctgccattctgtctccttaatcctctctcagacgagcggagaggatgctttcgctatcataaacgccgcctgccgggaggcatagcggcgtcgatttgtaaccattttgaaataacaagaaacatctaaaaacaggcgggttgcacctgaacaactcactatgaaaataacaaaaaacagcaaaatcaggtggaaaataaaaaatagcgtcgcggttataccagttctaagcgcgccataatgcccagtttgccagccataaacttgccaattgtaaccttcaaccctaagttgcttaacaattacacaaccttttcacatcaggttgcaccctgctcgtacagagtgacacctgacctatctaccgtggcgggagaacgtttcgtaatgagcaatccacaagacaacactgcatccattctgcagaaaaacaagaaggtactgatcgcgagcctgacaggcagcgccatcgaatggttcgattattttctctatggcaccgccgccgcgctggtgttcaacaaaatcttctttccgatggtcgacccggttatcggcctgatcctctcctggctctccttctcgctgacgttttttatccgccccatcggcggcgtgattttcgcccatatcggcgatcgcatcggccgcaagaagacgctggtgctgaccctgtcgctgatggggagcgccacggtggcgatcggcctgctgcccacctacgagatggtgggcctctgggcgccggccctgctgattactctgcgcattattcagggcatgggtatcggcggcgaatggggcggcgcgctgctgctggcctatgaatacgcgccggaaaagcggaaaggctttttcggcagcattccccaggccggggtgaccatcggcatgttgatggcaacatttatcgtctcgctgatgacgctgttcgatgaggcgcagtttctcgcctggggctggcgcataccgttcctgctcagctccgtcctcgtttttctcggcctgtggatccgcaaagatatcgacgaaacgcccgcctttaagcaggtgaaaaaatccggccaggtggcgaaggccccgctgcgcgatacgctcaagcaccactggcgggaagtgctgatcgccgccggcctgaaagtggtggagaccgcccccttctatatcttctccacctttgtagtcagctacgccaccaccaccctgagctatcagaagtcgcaggcgctggaatccgtgaccctgggcgcgctggtggccaccgtgatgatcccgctgatggggctgctgtcagacaaggtgggtcggcaaaagatgtacaccctgagcgtggtgctgctggggctgtttatcgtcccgtggttcctgctgctcgacaccggcaccggctggggcatcatgctggcgacgatcgttgccttcggcatcctgtgggcgccggtaaccgcggtgctcggcaccctgtgctctgagattttcagcgccaatgtgcgctataccgggatcaccctcggctaccagctgggcgccgcgctggccgggggcaccgcgccgcttatcgccaccggtctgctggcaaaatatgacggtgactggcggccggtggccatttatctgggcgttacggtggcgatttcgctcctggcgatattctgcgccagccggatgaagtccgcgctgggcacggccccctcccgggcggaaagcgcctgaccgccgcccgccagggctactacggcgccgactatcccgcccggtggcgctgcgcttgcgcgggcctggggggagatcgcgccgcgggggataccgcttatccctggcccggtaagacagtaggcccggtaaggcgccagccgccaccgggcacaaacaggcgtcaagtcttcccccctgcttagccagccgccagggccggcgggtgtcaggcgctctggttgtccagctgaagctgcccctcgcgccgctgcttcagcttccagaagccccacagcgcgataaaccacagcggagaagccaacagcgccagcagcgtgtccgggtcaaagatcatgatgaagatagcgaacgcgaagaacagcaggctcacccagctcatcaccaccccggcgggcatcttaaagatcgacccggcgtgcaggtccggacgctgacggcggtaaaccagataggccacgaggatcatcccccagctgaacaccaccataatcgccgccagggtcgagacgatggtgaacagggtcatcacgttcggcaccagaaacagcaacagcgtgccgatcagcatgcagaagcaggagaacagcaggctgcgcaccggaatgcgggtactgcgcgacaggatacgaaactgccagtgcgcatgcttctccaccgacaggccgtacagcatgcgggtgctggagaagaccccgctgttggccgaggacatcgccgaggtcagcgccacaaagttaatcaccgccgcggcggcaggcagcccggccttggcgaacagcgtcacgaaggggctggtctccgccgacacccccggccacgaggcgacagcgatgatcaccaccatcgacagcagatagaagatgataatccgcagcggcagagcattgatcgccttgggcaaaatgcgctgcggatcgcgggtctccgccgtcatggtgcccagcagctcaatgccggtaaaggagaagatcgctatctggaaaccggcgaaaaagccggtgatgccgtggggcataaaggccgtcgggtcggtgagatggctgagggaggccgtcacgccgtccggggaggtccagccggtggcaatcatccagccgccggtgccgatcagggcgataatggtgatcaccttgatcagggcgaaccagaactccgcctcgccgaacattttcaccgacagcaggttaagcaggaacagaatcgccagcatgctgagggccggcatccacgccgacagttccgggaaccagtactgcatatagctcccgcagaccaccacgtcggcgatacaggtcaccacccagcttagccagtaggtccagccgaggtaaaagctggcctgcggcccgagatactcgccgacaaagtcggcaaacgagcggtagtcatggcgggtgagcagcagctcgcccatcgcccgcatcaccatataggtaaagaacccgaccagcacatagataaccaggatcgaggtgccggcgacggcgatgttgcgccccgcccccataaacagcccggtgccgatggcgccgccgagggcaatcatctggatatggcgggcgctgagcccgcgcttaagctgtgacgcgccttcacctccggcggcaggtgacgcctgaggttgatgttcagtcatggtgtttcctcaggctggttgcgggagacgaagggcagcggcgcggagcaacagcccggcgcgctggccggtggcgaccccggcgttgggaaagaggatatagggggcccgggcctgcaccacccaacgtttctctgcctggcgggcgatctcataccctgccgggagcgcggtgaagttttcaacgtctgccgcgagattaagcgtaaattccccctcgcgcttgatgatgctctcctcgaccaggaagtagtccaccggcgctttgtcgcgcggcggcagcggcgcatcagcgatccaggcccggatcgccgcgtcggcggcggcgaacaggctgagatcgttggcgccgaacggcatcactttccccagctccagggtggcgctttgcgcggcgaacttttcgcaggtgaaatgggtgaaggtgccgcccgcttcggtatggcgcacgacggcgtccatcccgctggcctgcagcagctgatagaaatcgggcgaaaaatccccggcgtgggccgggagcagcgcaaactggcgatacagcgatccgcgaatggcggtgtgcatatcgagatgaccacggttgaccggccccgccgcatcggcggcgcgataaaaagcctgcaccgcctgctccagcgcaaaagcccgccgcgactcatttcccggggtgaccgccagatggcggccgccgaacaggcgattcaggtcgttatgcagatagcggcgcgcggcgcggatcgccggcagattaccaaagacgatcagcagcgcctgcgtgagcggctgccgcccctggctcagatcgtgggttagctgcagcagcagttctatcggcgcggtctcattgccatgcacgccggcggagaggatcgtcgcctggcgccacggcgccgtcggcagcagctgtaaaatgccctcgcccagccagcgggcctcgatgcccgccggaaaggtccacgcctgcaggcggcagtgcagtaaatcgttaaccaggtgctccatctgccgctccttaacgctgaaaatcatagaccgcgcccaggcgcaggatctgcgtcagctcatccagcgcctgataaacctcgcgcagcagctgcgggtccgccagatcgcgggcatgcagccggtcgcgatagtgtttttccacccatgccgtcagctgctgataacgttcgtcgttcatcaggctatgggcgttgaccgcctggcgctccgcctcgttgagcaccacccgcagccgcagacaggccgggccgccgccgttgcgcatgctttcccgcaggtcaaagaccgccacttcatcgatcggcgatgcgctatcggcggcgagatcgctgagatagcgccagacgttttcccgctggcggcactcctccggcaccacgatcagcatcttgccgtctggtttgctcagcagctggctgttgaacaggtaagaggccacggcgtcgtcgagcgaaacccgctcgtccggcacttccacgctggtgaacgggatatccagactgtcgcttttagcccgcagcgtggtcagcaccgccgcctgatcgacaaacgcctgctgatggtggaacagcacatggcgattgctgaccgcgatgacgtcgttatgaaacacgccgcgatcgatagcctgcggcgcctgctgggcaaacaccgtgtagcgcggatccagctgatgcaggcgggccaccgcttcgctggcctcgagggtctgccgcgccggatacttcaccggggcgataccgccgctggcgcgtcgaccatagacgaaaaactgcaccccctgccggtcatattcccggcagaagcggttatggttggccgccccttcatcgccgaggtcgccatgctgcggcagcgccgcatggtgggcaaagtagcgcggatcggcgaacgtggcgccaaggatcgccgaggtggtgggtgcctcctgcatacggtgcagcttattgttcaggttggcgacggtgaaatggactttgccatcggcgctgtccgccgacggtgagacggtcgccgcgttggcggtccacatcgacgaggcggagctgaaggcggagagcagctgcggcgccgcgtgggccgcctgccggataacctgctcatcgctgccctggaaacccacttcgcgcagcagacgcagattcggccgcggctgcggcggcagaatgccctgcacgaagccgcggtcggccagggctttcattttatacagcccctgcagcgccgcctttttagggttagagagaccatcgcggttattttgcgaggcttcattgccgacggagagtccggcgtagtggtgcgtcgggccgaccaggccatcaaagtttgcttcaaaaccagacatatgtcctcacaggatccgttatcagaatggcaggcccggcgataccgtcgccggaagcgtcagcgtatcgctgaccagagaggccatcggccaggcacagtaatcggcggcgtaccacgctgccgcgcgatggttgccggaggcgcccaccccgccaaacggcgctttactcgatgcgccggtcagcggcttgttccagttgacgatcccggctcgcgcctcgtccgccagctgatcaaactgcgccgcatcgctggagatcagcccgacggccaggccatagcgggtctgattggcgaggcgaatcgcctccgggaagccgtcgtaacggataatcgtcagcagcgggccaaagtactcttcatccggcacctcaataccggtgacgtcgacgatccccggggtcagcaccgtggagcgcgggtcaggctggcgcatgcgcagcagcaccttgccgccgagcccctccagtttttgctgcgccgccagcatgttctgcgcagcgtcgagagagatcaccccgcccataaacggcgccggctgatcatcccacttgccggcgcggatctgcgcgctggcctctaccagccgctgcagcagcgcatccccctgctcgccgcgcggcacgatcagccggcgcgcgcaggtgcagcgctgcccggcagagataaacgccgactggataatcacatgcagcgccgcatcgatatcggccacgtcggcgacgatcagtgcgttgttgccgcccatctcgagggccagcatcttctccggctggccgccgaagtagcgatggaagtggaaaccggccgccgcgctgccggtgaacagcacgccgtcgatatcacgattttccagcagcgcctggccggtggcttttccgccctgcagcaggttgatcgccccgtcggggatgcccgcctgctgccacagctggacggtcatttcagcggtagccggcgtcagctcgctgggtttaaacacaatggtgttcccggcgatcagcgccggaatgatatgtccgttgggcaggtggcccgggaagttgtaggggccaaagaccgccatcacgccgtgcggtttgtggcgcagcagcgctttaccgtccggcagcgtcgactcatgaaagcccgtccgctggtgataggcttcgatggagatcgcggccttgccgatcatcgcctgcacttcggtgcgggtctcccacagcggcttgctggtctcgcgggaaatcagggtcgccagcgcctctttatgcgtctccagcagcgcggcaaaacgctgtacgacgtcaatacgctcggccagcggccggtgcgaccagggataaaacgccgcgcgcgccgcggcgcaggccgcctggacgtcgtcagcccccgcgctggccgcctgccacagcagcgactgatcctccggggccagtttgctcatcgttgcgccgctgcctggcagccactgcccggctataaactgtgcttttaccgccatgatctgttgtcctctggattcagggttaccgtataaacgcggtcggtttcactgacctgcagcgcgtccagcgcggcgctgtcaagcgagacctgctcttcgtgggccaccagcagcgcccgaaagttgtcgaattgaccgttggcgacgagggtcggcgccggcaggtcgcccatcagctgccggacaggcaggcgctggctgtcgcgcacggcgcggatctgatcggtgtccgcctccagcaccggaccggcatcgaaaatatccaccgagccgcgccagctgaaaccctctttctcgaggatcgcccgcgccggggcggtattgggatgcacctgaccgatgaccccgcgggccgcttccggcagcagtgagatatagatcgggtacgccggcatcagttcggcaataaaggttttcatgccggtgccggtcagccggtcggcatcggcgaacgggatgtcgaagaaatgatggcccagcgcatcccagaacggcgactgtccctgctcatcgctgcagccgcgcagttcggcaaacaggtgcggggagaaccactcgcgaaaggcggcgataaataaaaagcgcgccttggagagcagcagaccattgcggttgcgctgatacgccgggtcgagaaacagcgtacacagctcactatgcccggtgtggtcatagctgagattaagcagctcctggggcttatagactcccagcgctttcgaggcgcgcaccgttttctgaatgcgaaaattgtaaaacggctcatccaggcccactgcgacctcaatggcgctcacccccaccacccgcgccagcgcggtgtcctccagcacaaacaggaaaccctgctgactgcgcggcagttcgccggcgaaggtctcgatactgcgccgaatcctggccgccaggcgcccgacgtcatgcggtaaagaggtcatgccaacccccgcccgcgcggcgaggcggacgatgtcgtcgagatcgttttcccgtacgggacgaaatagcatcacaggccgtcctcccggttagcgggttaagcgggcaacggcgcgatcaaggcgcacgaaggcttccgcaatatccgccagcgggatattgagcgccggcgcgaagcgcagcacgtcggggccggcaatcagggcgatcagcccctcttccgccgccaggttggtcaacgttttggccttgccgcgcagcggccccgccagctcagcgccgatcagcagaccggtgccgcgcacggcgctgaacgcatcgtaacgggcagagatcgcattcaactggtcaacgatcagcgcatggcgctcgccaacgcccgccagcagcggcgcatcgagatgggccagcacggcgttagcgacggttgccgccagcgggttgccgccgaaggtggtgccatgagtgcctggctggaagacctgcgcccaggcctctttcgccagcatcgcgccgatcgggaagccgccccccagccctttggcgctggtgagaatgtccgggacgacgttgtaatgctggtaggcgtagagatggccggtacgcccggcgccggtctgcacctcatcgaatatcagagtggcatgatggcgatcgcagagggtacgcagcgcctgcaggaacgccgggtccgccgggatcaccccgccttcgccgataatcggctcgacgatcaccgcgcaggtgcgcgaggagatcgccgcggtgaccgcctcgatatcgttatagggcagatgggtaatgccctgcggcagcggagcataatcgctggaatatttcggctggccgccaacggagacggtgaacagcgtgcggccatggaaggcgtggttgaaggcgatgatttcgcttttttcaccgccaaatttatcgtgggcatatttccgcgccagcttaagggccgcctcgttggcttcggcgccggagttgcagaaaaacaccttgtcggcaaaggtcgactgcacgagggtttttgccagctgcagcaccggctcgttggtatagccattgccgatatgccacagtttcgccagttgatcctgcagggcctgagccagcgccgggtgagcatggcccagggcgttcactgcgatgccgcccgccatatcgatatactctttcccctgctggtcccagacgcgggagcccgccgctctgaccggaataaacggcgcgggggcaaaacagggaaccaggtaagcgtcaaaatcttcgcgagtcatactgcctgacataatttatctccggaacgtaagacgacggaaaacgctcccgtcgcgttggacaatcgacattaaccctgcccctcggcttattttgggcacgagcacacccgctgcgatggtaaaaatattcaccacagaaaaataaagccctattctttttacgggtaattgttaattcatggttaatgccatgttgttgtgtgggctaatgctggcctgtgaacaacaagattgtcaatacggacaaaagcaatttattcactttttgaagatcatcaagataatgaaaaacatagaaaaaatattttcttatgcacttaagtgaataaaaagtgaattaaaatgcacagcttgcgggtggttgacgtgcgtagttattcacttaaaaaataaaaaatctaacaaaaatttaaaaatcggaattgccgtcaaataccgctttataaaattggtgataccattcattgcacagagtttactgctgtagctattccacggttttacacgacataaataacactgagaaacaggactcttatggaaaagttatcttacgcatctgaaagtagtacatctccatggaccacctacctgcgccagatcgaccgcgtcgcgccttatctcggcgatcttgcctactgggtggaaaccctgcgccatccgaagcgcgcgctgatcgtcgacattcctgtgcaaatggacgacggcaccatccgccacttcgagggctatcgcgttcagcacaatctgtcgcgcggaccgggtaaaggtggtgttcgctaccatccggatgtcgatcttaacgaagtcatggcactttctgcctggatgaccattaagtgcgccgcggtcaatattccttacggcggggccaaaggcggcatccgcgtcgaccccttctccttgtcggaaggtgaactggagcgtctgacccgccgctacaccagcgaaatcggcattattatcgggccgcagaaagatatcccggcgccggacgtcggcaccaatggcaaagtgatggcatggatgatggacacctactccatgaaccatggcaccaccatcaccggcgtggtcaccggcaaaccgatccacctcggcggctccctcggtcgtgaaaaagccaccggacgcggcgtgtttgtcaccggccgggaagttgcccgtcgcgccggtatcgaaattgaaggcgccaaagtggcgctgcagggctttggtaacgtcggtagcgaagcggcccgcctgttcgccggcgtcggcgctcgtatcgtggttattcaggatcataccgcgaccctgtataacgaaggcggaatcgatatggccgccctcaccgcctggcaggcggagaaaaagcagattgccggtttccccggcgcccaggagatcgataaagacgccttctggaccactccgatggacatcctgatcccggcggcgctggaagggcaaatcacccgcgagcgcgctgagaagctgacctgcaaactggtgctggaaggggccaacggcccaacctatccggaagcggacgacgtgctggccgagcgcggcgtgatcgtggtgccggacgttatctgcaacgccggcggggtgaccgtcagctactttgagtgggtacaggacatggccagcttcttctggagcgaagaggagatcaacgccaagatggaccgcattatgaccgacgctatcgtgcacgtctgggataaagccgccgagaaagagtgtacgctgcgcaccgccgcctatatcgtggcctgcgagcgcatcctgatggcgcgtaaagaccgcggcatctacccgggctgatccccatcagcaaccgcatcaggggtggccttgcgccgccccttttttctttgccgcgccgttaaccgccgaggatgtgcgctatctgacaaggagttgttcggcaaaggtgacaacgtcacgcaagtaataaccatccgctgcccgtaggggattatttttcgattaaatcaaaatcgccctgggtatagcgtaagccagtgacgttgtcggcagtgaaaatatgttcgatggtgaggatgtcctccggcgcgagagtaatattcgcggcgccggcattgtcgcgcaggtgagcaattttcctcgcccccgggataggcacgatatcctcgcctttgctcatcacccaggcaagggcaatctgcgcaagggtcgcgtcatagcgggtggccacctgctgcaggcgctcaagcagcagctggtttttgcgcatggtttcggcctggaagcgcggcagatggcggcggaaatcatccgctgacaaaacgccgggatcggtaattgtccccgtcaggaagccgcggccaagcgggctgtatggcacaaagccgacccccagctcgcggcaggtgtggagaataccggcctccggctcgcggctccatagcgaatattccgtctgcacggcagcgatcggatgtaccttgcaggcccggcgcagcgtctgagcagatacttccgacagaccgatatggcgaattttaccctctttaaccagatcggccatagtgcccaccacctcttccaccggtaccgcgggatcgacgcggtgctgatagagcagatcgatggtctcgacattcagtcgcttcagcgacccttccactgattcgcgaatatgtgccggacggctgtcaacgccggccatccgctccagaccctggccggtcggcaaaatacgaaatccaaatttggtggcaatctgcaccttatcgcgaaaacctttaatcgcttttccgaccagaacttcattatcgaaaggaccatatacttcggcggtatccaggaaggtcacgcccatgtccatggcggtatggatcgtatttatcgcctgcgacgtttcagcgccgccataggcaaaactcatccccatacatccgagacctaatgcggaaacctgaaacttctcttttccaagataacgtgttttcatcttattttccttaattgctgaatggcattaaatatatacttccctttcatattgataacaattaatctattccgaacgcggtgttagctggaaattaacaatgaaaaccttgcccgatctgcaacaaatagaaatattaatactcatagtgaaacatggcagttttcgtcaggccgctaaagcgttaaacctttccccaccggcccttactgtcgctattaatcatctggaagaaaagttaggcgtgcgcctgctaaatcgctcaacgcgcagtttgtcattaaccgcagtgggtgaggaatttcttaataatataacgccggtggtcaatgattatcgccgggtggtggacagtctgaattatcaccgtctgactccggaaggcgtggtgaaagttaatttaccgcgcattgttattgacctgttttttcaagactattttatcgcctttaaaaacgcctgtcccaatgtgacgctcgaactgtatgccaccgatcggaaagtcaatattatcgagtccggttttgacgccggcattcgctattcgcaggatgtgcccaaagagatgattgccatcccctttggcgagaaactatcgctgatcccggtggccagcccggactatatacgcgaagccggagagcccgacaccccgcagtctttagttaatttccgctgcattaaccgctgttttcctggtggggagaagtaccgctgggagtttattggccccagcggcgagcttagcgaggtcgcggttaaaggcgatctggtcgtcgatgccgatagcgcaatgatccaggccgcggagagcggattaggcatcgcctttgtctatcagtcgctggtgacgcagcagctgagcgcgggcagcctggtccatttgttacccgactaccgctatcctgccgaccatttctgcgtctactacccaagccggaaacatattcccgcccccctgcgggcctttatcgcctgggtgatggcgcagaataaaaatatccttggtcagcagaccgcacgacacggatcgcggccggaagattaactacaattaacgtacataccgttaaccaatttctatctttcatcttgaactccggcggttatccggcataaaatcgttagagctctaacgatattgacagacgacctatggacaatcgacagcttaccttctctcatcttttatacctcaccgcgcaccactggcggctggcggtcaatcgtcggctgaaaaatctcggtctcagccaggccagctgggtggcggtagcgtccatcgcccgccaccagcagccgctgtcgcaaagcgaactggcgcaggagctgggggtggagagcccgaccattgtgccgttgatccatcgtctggtcgccctcggactggttgagcgcgtcaccaccgccagcgacaaacgtaagcgactgctggtggtcaccgacaaagggaaggccctctatgaacaggtcaaaacggtggctgacgatctgcgcgaagagatcctgacggcgattaccccacaggagcaggagcaaacccagcgggtgctggaaaagctattgcgcgaagtggagaagaaataatgccccgtcgccaggataacccctacgccccgcatgactgggcgccgcatgaaaaaccggctctgctcggttcgccgtcgacgccgctgcacagtccggcgaaacgcctcgcctacggcgtggtcggtctgctggtatgtctcaccggcgcgctgggcaacgcagtggtcaccgccaacctgcagctgctgcagggtaccttcgccgcctggtcgacagaaatcgcctggctgccggcggtatacgtgatgaccaacgtctccatcaacctgctgctggtgaaattccgccagcagtttggcctgcgcgctttcaccgaaggctttctggtgctctatgtgctggtcacctttttccacctcttcgtcaacgatctcagctcagcgatgatggttcgcgccgcccatggcatggtggccgcggcgctcagctcgctggggatctactaccaggtacaggcctggcctgcgcgccatcgcctgaaagggctgactatcggcatcaccggctcgtcgctggccattcccctggcgcgcctcttttccaccgaactgctgcagaccgatgaatggcgcggtctctacttctttgagctgggcctggcgctggtgtcgctggcctgcgtcatcgcgctaaaactgccgccaagcgatcgtaaaaaagtgttcgaaaaaaaagatttcattaccttctttctgctggcgcccggcatggcgctggtgtgcgccgtgctgtcgctggggcggctcgagtggtggtttgaagcgccgtggatcggctgggcgctggcggcggcggtaatactgatcgtcgctgcgattaccttcgagcataaccgcagcaaccccctgctcaataccaaatggctctccagcggcagcatcgtgcgtctgggcctgattatgctgttgatccgcatcgtgttggcggagcagaacaccggggtcatcggctggctgcagtacgttggcctgcaaaacgaacagatgactaacctcgcgtggtcgattttcgccggtattctgtgcgggatcattgccagctgtctgacgctcaacccgcagaagctctactggccgaccgccaccgcgctggcgctgatcatgatagcctcgctgctcgacagccagtccaacgccctcacccgtccggaacaattaatgttcagccagtttttactcggcttcggcagcgccttctttctggccccggcgatgctcgccgggattggcggcgtgtttgccgacccgcgcaacctggtcagcttctcggtgctgttcggcatgagccagaacattggcgggctgctcggctcggcgatcctcggcaccttccagacctggcgtgagaaattccactccagccagctggcggaccagataaccaccctgaacccgctgatcgtcgagcggctgcagcagtacagccagatgtatcagagccagattggcgacagtacgctactcaacgttcaggccaccaccctgctgcaaaacgccgcgacgctgcaggccaatattctcgcctggaatgatacctatctgctgacggcggcgatctccgccgggacactagtgtgggttttctggcgcttaattcgcttacgactgactgcccgtatcgcgttgcaacgcgctaccggcagcaaataattatcatcatttcatctctggagtcgttatgagtcagcaggatgcggccaaacaacaggccaacacccggaataatattcgcgtggtttccatttttaccgccgcggcgataggcctcgtcggcgtgctggtgatcctctacgcctggcaactgccgccgttcactcgccatagccagtttaccgacaacgcctatgtgcgcgggcagaccacctttattagcccgcaggtcaacggctatatcaccgccgtcaacgtcaaagatttcgcgattgtccagccgggcgaggtgctgttccagatagacgatcgcatctataaacagcgggtgcatcaggcccaggctaccctggcgatgaaagaggccgcgctgcgcaataacctgcaacagcgcaaaagcgccgaggcgacgatcgccaagaatgaagccgcgctgcaaaacgcccgcgcgcagaatctgaaaatccaggccgatttaaaacgcatccagcagttaaccgccgacggttcgctgtcgatccgcgaacgtgattcggcgcgggccagcgcggcgcaaggggcggcggatattgagcaggcgaaagcggcgctggagatgtcgcgccaggaccgtgaatcgaccatcgtcaatcgcgattcgctggaggccgacgtggccagcgccaaagcggcgcttgagctggcgcagatcgacctgcagaatacccagattatcgcccccaccggcggccagctggggcagatctcggtgcgtcttggcgcctatgtcagcgccggaacccatctgacctcgctggttccgccgcagcactgggtgattgccaacctcaaagagacccagttggccgaagtacgcgttggccagccggtcaccttcaccgtagacgcgctcaacggcgagaccttccacggcaaggtgcagagtatctccccggcgaccggggtggagttcagcgccatctctccggacaacgccaccggcaatttcgtcaagatcgcccagcgcatcccggtgcgtattacggtcaacgacgggcaaaacaacagcgaacgcctgcggccggggatgtcggtgcaggtgactattgatacccgtgcggagaaacaaccatgatccgcccggtcgcccttgctatcgttctggcgctggtcggctgtcaatccgccgatgtgcaacgcgcgcagccgaccctgaccattcctgccgcctggcgggccgacgttggcccggccagcccggtggagggtgtatggtggcgcaattttcatgacagtaccctcaatcagtatgtcgaccaggcgctgcgctataacagcgatgtgctgatcgcccgcgagcgggtgaatgagtatcaggcgcgcgcttacgccgccgacagcagcctgtttccgtcactggacgccagcctcaccggcacccgcgcccggacgcagtccgccgccaccggcctgccgatccacagcacactgtataagggtggcctgaccgccagctatgatgtcgatatctggggagcgaaccgcagcgcggccaacgccgccggcgccagccttgaggcgcagaaagccgccgccgccgccgccaatttgagcgtcgccagctcggtggccgttggctacgtcacgctgctgtcgctggatgagcagctgcgggtgacccagcagacgctaacatcaagggaagacgcgtggcgcctggccaaacgtcagtttgaaaccgggtatacttcacgccttgagctaatgcaggcggattcggagctgcggtcaacgcgggcgcagatcccgccgctacagcaccagattgcgcagcaggaaaatgcgctcagcgtgctgctcggcgataaccctggcgcggtaaaacgcggcgagttcgcccagcttaccccgctgcgtctgccgtcgcagctgccgtccaccttgctcaaccgccgtccggacatcgctcaggccgagcgccagctggtggccgccgacgccacgctggcctcgtcgcaggcgcagctgctgccctctattaacctgaccgctaccggcagcctgcaggaccggacgctgccggatctgctggacaacccgctgcggctgtggagtcttggcggcagtattctggcgccgctgctaaaccgccaggcgttaaatgcccaggtggacctctccatggcccagcgcaaccaggcgctctatagctatgagaaaacggtgcgcagcgcgttcaaagaggtcaatgacagcctggacgccatcagtcgctatggcgaacagttatccgagcttcaggaacaagagaccgttgcccaggaaaccttacgtattgcacaaaaccgctaccgtaacggctactcttcttatctggatgtgcttgatgcccagcgaacgctgttctccacccagcttagcgtggtgcaggtgaagaacaacctgctgctggcgcagatcgatctgtaccgggcgctgggaggcggctggtctgactcatcagggagctaaatggggaagcgtcatatgcaacaacagtggtcggcagtagacaattatttaattaaggccttaattcccggcgatcctgtactcgatcgggtactggaaaacaaccatcgtgccgggctcccggcacacgatgtcgccgccaatcagggtcagtttctcgccctgctggtacggctaacccaggctaagcggatactggagatcggcaccctcggcggctatagcaccatctggatggcgcgcgagcttcctgcagacggccaactcctcaccctggaggccgacgcgcatcatgcccaggtggcgcgggagaatctgcagctggcgggcgttgaccagcgggtcacgctacgggagggacccgcgctacagtccctggaggcgcttggcgcatgtcccgctttcgacctgatcttcatcgatgccgataagccgaataatccccattatctgcgctgggcgctacgttattcccgcccaggaaccctaattattggcgataacgtggtacgcgacggcgaagtggtcaacccacagagcgccgacgagcgcgttcagggcgtgcgtcagttcattgagatgatgggcgccgagccgcggttgacggcaacggcgctgcaaaccgtgggcactaaaggctgggacggctttactctggcgtgggtaaacgcttaagcgtggacgcctgaccagtagccccggtaagcgcagcgccaccggggacaaccagccaggctatggggtaatttgctccatcgcctgcaacactcgcttgtccgagataggatacggggtgcccagctgctgggcgaagaagctgacccgcagctcctcgatcatccagcggatctcccggacatcgtcgtcctcacggcggttcggcggtagcttattcagccactgctgccacgcctgctgcacgctctccaccttaagcatctgcgcccgatcgcggtgcggatcgatagccatcttctccagacgcttttcaatcgcctgcagatagcgcagcgtatcgccaagacggcggaaaccgttgccggtgacaaagccgcgatacaccaggcccgccatctgcgctttgatatccgacagccccagcgccatggtcatatccacccggcctttcagccgtttgttgatattgaacaccgcggtgaggatctgctcgacctgtttagcgatctccaccaccgtgtcgttgagctcggctcgcactttatcgtgcagctgactaaagccctcttccgtccacaccggaccgcccgcctcgtcgataagcttatcaacgccgcaggagatgcaatcgtcaatcagatccagcactttgccgtacgggttaaagtagagcccaagcttggctttattcggtagtttctcgtgcagatacttaatcggcgacgggatgttgagcagcagcaggcgacgcagaccgcgccacatggcctgctgctgttcctgtggattatcaaacagcttgatggccacgctgtcgcgctcgtccaccagcgccggccaggctttcaccttatagttaccgcgcttctgttcgtaactttccgccagggtgccaaagctccagatatgcagcccgctctgctcaataccgtcatcagcgaccgccgacagcgtctcctgcactttgcccttcagggcgtctttcaacgcctgcagcgagcgcccttcctgcagcttcttgtttttatcatccaccacccggaaggtgattttcaggtgatcgggcacctgatcccactgccaggcttcgcggtcgatggtcacgccggtcatcttacgcagctcgcgctccagcgaatcgagcagcggcagctcaagcggcgtcgcccggccaagaaacgcttccgcatagttgggagccgggacgaaattgcgccgtaccggcttcggcagcgattttatcagcgcgataatgagctcgcgacgcagaccagggatctgccattcaaacccggcttcctctacctggttgagcagcggcagcggaatatgaaccgttacgccatcggcatcggcgccaggttcaaactgatagctaagccgcagcttgaggttgccctgatgccagaaattcgggtagtccagtttactgacctgctccgccccctctttaatcagcatgctcttttcaaaattgagcaagtctggcgtttcacggctggcccgcttccaccagctatcgaagtggcgggcggagatgacgtcgtggctgatgcgctggtcgtagaactcgaacagcgtctcgtcatccaccaggatgtcgcggcggcgcgacttatgctccagctcttcgatttccgcgcgcagcttcaggttatcgcggaagaaggcgtgccgcgtctgccagtcgccctctaccagcgcgtggcggataaatagctcacgacacagcgccggatcaatctggctgtagttgaccttacgcgcggcgacgatcggcaggccgtaaacggtaaccttttccgtcgccattaccgcgccctgcgaccgctcccagtgcggctcactgtatgagcgcttgatcaggtgctgcgctaccggctccacccactccggctcaatgcgggcggcaatacgcccccacaggcggctggtctcgaccagctcggccaccatcgtccacttcggcggcttcttgaatagaccggagccggggaagatagagaaccgcgcattacgggcgccggtatactcctgtttatcggcatccttcatgccgatgtgcgacagcagaccggtcagcaacgcagtatggatctcgcgatattccgccggctcactgttgatcggcaggccgagctctttcaccacctggcgcagctgggtgtagatgtcctgccactcgcgcacacgcagatagttaagaaaatcgacccggcactggcggcggaactgattcgacgacagcgccttctgctgctcgccgaggtagttccacagattgacgaaggcgagaaaatcggactctttatcgtggaagcggcgatgtttttcgtcagaggcctgctgtttgtccatcggccgctcgcgcgggtcctggatcgacagcgcggaggtgatgatcatcgcttcccgcacgcagccgtgcttctgcgcctccagcaccatgcgcgccagacgcggatccaccggtagctggctgagctggcggcccagcggggttagcttataagccgttgcctgcgcatcggtggtgatggcgcccagctcttccagcaggcgtacgccgtcctggatattgcgcttatccggcgcttcgacaaacgggaaggcggcgatatcgcctaagcccagggcggtcatctgcaggatgaccgacgccaggttggtgcgcagaatctccgggtcggtaaattccgggcgcgacaggaaatcgtcttctgaataaagacgaatacagatcccttccgaaacgcggccgcagcggcccttacgctggttggcggacgcctgggaaaccggctcgatcggcaggcgctgcaccttggtgcggtagctgtaacggctgatacgcgcagtaccgggatcgataacgtacttaatgcccggcacggtcagcgaggtttccgccacgttggtcgccagcacgatgcgccgtccgctgtgcggctggaagacgcggttctgctcgctgttggacaggcgggcgtacagcggcagcacttcggtatggcgcagatccagcttattcagcgcatcggcggtatcgcgaatttcccgctcaccgctcataaagatcagaatatcgccgggcccttcgcgccccagttcgtcaaccgcatcaaagatcgcctgtaactgatcgcgctcggtatcgtccgcctcttccactatcggccgatagcgcacttccaccgggtaagtccgcccggagacttcgataatcggcgcattattgaaatgctttgagaaacgttccgggtcgatggtcgccgaggtaatgatgattttcaggtccgggcggcgcggcaggagctctttcagatagccgagcagaaagtcaatattcagactgcgctcgtgcgcctcatcgataatgatggtgtcgtactgcatcaacagacgatcctgctggatctccgccagcaggataccgtcggtcattagcttaaccatggtgttttcgctgacatggtcgctgaagcggactttatagccgatgcagccgcccggctcgctctgcagctcttcggcaatacgattggcgacggtccgcgccgccaggcgacgcggctgggtatggccgatgagtcctttcagcccgcgccccagctccatgcagattttgggcaactgggtggttttacccgaaccggtctccccggcgacgatcaccacctggtggtcgcgcaccgcctcgagaatctcttgttttttctggctaaccggcaggttttccggataggtgatggccggacgcgccgcttcgcgcagcaggactttaccggctgcctggcttatctccagcgccatctcctgcagaatggcctgttgcgattcaggatttttaaccttcttcacgccgtgcagacggcgggcaaagcgcgttttgtcgcgcagcatcaggccgtcgagctgttgataaagctgggggaaggtgattttttgttgttctgtcatagcgttatcgggcagagctctgccgggaaaatctcttttgaagtattgccttagagtaccacatctgtgtcattcgtgccttgttcaaaaaatctgaacataggattcgatatattgcgctatctctgtggcgcgattgtgaatacagtgtcaacaagcaccagggcattgacccgtcaatcacattaaaaaaaggaaacacccatgagcaaagtattagttctgaaatccagtattctggcagggtactcacaatctggtcagctttccgactattttgttgaacaatggcaggaaaaacaccctggcgatgagatcaccgtgcgtgacctggccgccaatccgatcccggttctggatggcgaactggttggcgccctgcgtccgagcgacgcgccgctgactccgcgtcagcaggaagcgctggccctttccgacgagctgatcgccgaactgaaaggcaacgatgtgattgttatcgctgcgccgatgtacaacttcaacatcccgacgcagttgaaaaactatttcgacctggtggctcgcgccggcgtcaccttccgctacaccgagaaagggccggaaggtctggtaaccggtaaacgcgcggtcgtcgttaccagccgcggcggtatccataaagatactccgaccgacctggtcaccccgtacctgtccaccttcctcggcttcatcggcatcaccgacgtgaactttgtgttcgccgaaggtatcgcttacggcccggaagtcgcggccaaagcgcagtctgacgcgaaagcggccatcgacagcgtggttgcagcctaatatttcactcctctcgcttcctgcgggaggagagttttactttttctcgtagcgtaaataccccaccacgcctccgccgccatcctttggatgattcacgccgtcgttgacctccacgcaagggaaatcgaaaggcgaaatgccgtcaatgcaggccacattcaccccatactgctgtgggtttgatcgccgttgatgaaaggtgtagatcccgcataccgagcagaaaaagtgcacggcttcccctgtattaaagcgatactctgtgagcttatcccctccgcgtaccacctctattcctgaacgcggcgaagagaccgcgaccgccccacgcatgcgacaatatgagcagttacagcgccgaacggtgttgaagccgtcgctgagttccacggtaaacgccaccgcaccgcagtgacagtgagcggataatttctctgccataattttacccctcaggtggcggcttttggccgcaggttttcatcaaacgccagccgcttacgccctgcttcgacttcccgtaatggctccacctggtgcagcgtctgcttacagcgttccaccagcgcctggtattcacgggtaccttgttttttccacaccagctcctgttcgctcagggtgcgaatcgcttttgccgggctgccgataatcagatggttggcgggcatctcggcgttggctttgacaaaggccgaagcgccgacaatgctgttttcgccaatgaccgccccgtcgataatcaccgcgctcatgcccaccagcgcgttgcggccaatcacgcagccgtgcagaatagcgccgtggccgatatggccctcctcttccaccaccgtatcctggccggggaagccatgcatcacgcagttatcctgaatattggcgccgtctttgaccacgatgcgcccgaagtcgccgcgcaggctggcgttgggcccaacatagacccctttgccgaggatcacgtcgccaatcaacaccgcggtcgggtgaacgtaactctcctccggcaccaccggcgtcagtccatcaatctgatatatcggcatgcaacctccttatgcgcccggcaaaccgccaaagcgctgataatagagcggacccggcgccgggagctcgcccaccgagctctcacctttctcgctgacgaacgccagcgcgccgggactcacgcgttgataaatattgatacacagctggcgggcggtttgccctgcccaatgcgccggcaggagctcttccggcagcagcgggtctttgagcaccacccggcgatagaaatggataaggagcagttggatctggaaacagcgatccggcgtcaactctgacgggtcgcaatcgcgcagcagcggcagtagaggtcggaacaaggcgataaacgcctcgtacatctcattttgttcggtgagatgccagcactcctccacccggctgcgcagggccgctctggagagcgccagcggcgaatgggcttcaaaacagatgacgttttcggcgacgcccgcttcgtggagcagagactggacatcggccagcttttgcgacggcgaggccagcaggctcggcgccagcgcgccaaacccctgccacagcagctgctttttaacgtcggcgagcacatttttctccaggccttccgaaagcagcagcagccaggtaccgtcccattccggggcactggcgcgataaattttatgctccgcgcgccgggtcaggcgcaaccctttatcactcaggcgatagaagctgcgccggccgatgcggacaacatcaagccactcttctttattgaggcgaaacagcgcggtgcgtacgaagcgctcgccgaagcctaatccttccagcagcgccgcgacgctgcccagccacacttccccaccgcgttgtaataaagcgtcgccatacagcgaggcaattaatgacgtgccgctgatgggcatcgccgtcaccgcttgttgaataaaggcgtcgagtttactcatctgattcattctgttgttatatttttcctttatgaatcatagcacaggaaactccccggctgacggcgcaaacgcttcagccgggtgcctgccgcgcagccggagagaggattaaccgctgaccaccgcttttcgcaggtcgaatacccgacaggctttcccttccgagcgcggaatgctgccgcagttgacgatagtaatatcggtggagatcccgaccatcgacttaatgcggtgacgcaactgatggcaaatctggcagcgttgttcatgactcagcgccagcccgctctctttcagctcaacgcgcaccgccagcgaatccagatgaccgcggcgattgacctctaactgatagtgcggcgccaggtgttcaaacttgaggatctcctcttccagctgcgaggggaagacgttaaccccgcggataatcagcatatcgtcgctgcgtccgctgatgcgatccatgcggcgcatggtccgcgcggttcccggcagcaggcgcgtcagatcgcgggtacgatagcggatcaccggcagcgcttctttggtcagggtggtaaacagcagctcaccatgctcgccatcttccagcggcgtaccgtcgtccgggttgacgatttccgggaagaagtggtcttcccagatagtcgggccgtcaacggtttccagacactccatcgctacgcccggtcccatgacttccgacaaaccgtaaatatccagggcggtgatccccagccggcgctcgatttccgcgcgcatcgccagcgtccacggctcagcgccaaagacgccgactcgcaatgaacagctgcgggcatcgccgcccatctggcgctccagctcttcaatcagattcagacagtaggacggcgtcaccatgatcatatccggctggaaatcgcggatcagctgcgcctgtttttcggtctgtccgccggacatcgggatcaccgtcgcgcccaaacgttccgcgccgtagtgcgcgccaaggccgccggtaaacaggccgtagccgtaggcgacgtgaattttatcttttgctgaaccaccggccgcgcgcagcgaacgggcgacaatattggcccagttatcaatatcgttttgcgtatatcccaccaccgtcggtttgccggtggtgccggaagaggcgtgaatgcgcaccacctgctccatcggcaccgcgaaggtatcgaagggatagttgtcgcgcagatcctgtttggtggtacaggggaatttttgcagatcgtttaattcccgaaagtcgtcagggtgcacgccggcggcgtcgaacttgcggcgatacatcggcacattttcgtacgcatgcttcagcgtccatttcaggcgctgggtttgcagggcctgcagttcgtcacgcgatgcggtttcaatcggatctaattttgtagtagttatcattgtagggtactcgcaggtaaattagctcacactcgctcgaggatcatggcaatgccctgacccacgccaatacacatcgtacacagcgcatagcgcccgccccggcgttgcagctcaaggctggcgctcagcgctaaccgcgcgccgctcatgcccagcggatggcctaacgcgatggcgccgccgttgggattcacgtgcgccgcatcgtccggcacgccgagctgtctgagcacccccagcgcctgggcggcgaaggcctcattcagctcaatcagatccatatcgttaatattgagtcccgcccgctccagcactttacgcaccgccggtaccggccccagtcccatcaggcgcggttcgacacccgccgtcgccatcgccacgatacgcgcccgcggcgtgagcccctggatagcggcctgctgttcgctggcgatgatcagcgccgcggcgccatcgttgacgcctgaagcattgcccgcagtaatgacgccgccctggcggaacggcgctttcagtttcgccagctgctcaagcgtggtttccgggcgcggatgctcgtcctcgcgcacgtcgctaaccgcccctttccggccgacaatctgcaccggcacaatctcctgcgccagaatgccgtcgcgctgggcctgcgccgtgcgctgctggctgcgccaggcgaaagcgtcctgatcggcccggctgatatttaacaattcagctacattctcggccgtttccggcatgctgtcagttccgaagtgttgcgccatgagcgggttcacaaaacgccagccaatcgtggtatcaaagagttccgcctgacgctggtacggcgtgctggcttttcccatcacgaaaggcgcacgcgacatcgattccacgccgccggcaatcagcagctcgacatcgccggctttgatcgccctggcggcaaagccgatggcatccagacccgatccgcacaggcggttaatcgtggtgcccggcacggtatgcgggtaaccggccaacaacgtcgccatgtgcgccacgttgcggttatcttccccggcctgattcgcacagccgaaaatcacatcatcaattgctgccgggtcgagcccgggattacgactcaggagctcacgcagcgggattgccgccaggtcgtcggcgcgcacactggccagcgcgccgccgtagcggccaatcggcgtacggatcccgtcacaaataaaggcgtcgcgcattacacgtctcccgtgattgtgccgccgatgcggtgcgatttgccgcggaacagggccacaatcttttgctgttgattaacaatttcgatgtcgtagacgccggtcagcttgccctgctgtttgactctggcggtggcgaccagccggtcgccggcaaacgccggacgaagaaaatcaatgcttgccgccgaggccaccgccgccagcccctggctgttacaggcgtaggcgaaagcggtatcggcaagtgtaaatagctgaccaccgtgacaggtttgatggccgttaagcatgtccgccgagacggtcatactcatctgcgcaaaaccgtcgtccatttcgataagttcgatccccatctttctggcgcaggtatctttttcgtacatcacgcgcgcgttgcgccacggatcattgctcatggtgcttctccatcagcgccttctggcgcagcagggaactggggcgatagcgctcctcgccataatggtgttgcaggttctccagcagttgcagcacccgccgccagccaaggcgttctccccatgccagcgggccatgcggatagttcacgccaaggcgcatcgcggtatcgacatcctgcgggctggcgacgcctttttgtaccgcatccagcgcttcgttaatcagcatcgccaccgtgcgccacaccagcaggccgggataatcggcaatacgcagcactttcttgccctgctgctggaagtaatgcacggccttatcagtggccgcaggcgcgttggttgccgctgcggccagcaccaccgtatcgctggcgcacaggtcatacaccaccaccgggcggtgatgcttaatactcagcgccagggcggtctcgccttcagtctccagcagcaagatatcgtctaattcagtgacgttgtcacttctgacggtaacggattcagcacctatcattaccggcggcagcgccgcgtccggcagtgtctcagcgggccagcgatagacgccgtggccgctctttttacctagccgcccggccagcgccagctcttgctggaggagcgatggcaggtagcggcggtcctgccagaaggcgttaaacaccgaacaggtcacggcgaagttgacgtcctggccaatcaggtcagtcagcgccagcggtcccatcgggaagccgccgccgtcacgcaaagcggcatcgataacctccggggcggcgacctgctcttccagcgcgcgccaggcctcagcgtagaacggacgcgctacgcggttaacgataaaaccgggcgttgagcggcagcgcaccggctgtttcccccagccgcttacgcactggcacagctgctccaccacttctgtggaggtcgcaagaccactcaccacctcgaccagcttcatcaccggcgccggattaaaaaagtgcagtccggccacccgctccgggtttttgaccccggcggcgatagcggtaatcgaaatagacgaggtattactggtcaacagcgttgacggcgcgcagatcgccgccagctgcgcgaacagcgccgttttgacctccagccgttcagaggccgcttcgatcactaaatctgcatcggcaagtgcggctaaatcgtgggccggatgcaggcgcgccagcagcgcgtcggcctgctctgacgccagtttgccccgcgcaacgcgtgacgccagacgcccggcgataccctctatcgccaggtctacagccttagggttaatatcaaaaatacgcaccggatgcccggcggcggcagccacttcggcgatgccggcccccatggtgccgctgccgatcaccgccacggtggctaaggatgtcgtcatcatctatttcccgctgaactgtggtggccgtttggccagaaacgcgctgaccccttcgcggtaatcatcgctgcgcccggccagacgctgataatcgcgctccaggtccagctgcgcatcgagactgttggtttcagaggccagcagcgcctttttaatcagcccaagaccaaacgtcggttgcgccgccagatggcgcgccagttgcagactggtatccgccagttctgaatcgtccaccagttgccagatcattccccactgcgcggcctgttccgcgctaaggctgtcgcccagcagcgccagccccatcgcgcgcgcacggccggccacccgcggcaggaaccagctgccgccgcagtccggcaccaggccgagcttgctgaacgccatcacaaatttggccgaacgcgcggccagcacgatatcgcagcccagcgccagggtagcgcccgcgccggcggccacgccgttaaccgcgcagatgaccggtttcggcagcgccgccagacggcgcactaacgggttgtaaaagcgttctaccgacatgccgagatccggcggcgggccgctggggtcgacattgcggtcgttcaaatcctggccggcgcaaaaaccgcggccggcgccggtgatcagcaggcagcgcacgccatcatcgcgctcggcctgcttcagacattccgccagctggtgatgcatcagatcgttaaaactgttgaggcggtccgggcgattgagggtaatggtcatgacgccctgttccactgcgctgagaatgaaagcttccacgattagcgtcctttaaattccggggtacgtttttgtaagaaggcgtcgatgccttcgcggcggtcctcggtggcgctcagcaggctaaacagctggcgctcctgttgtagaccggcctgcaggctgacttcctgcgccaggcgtagcgactgttttgccgcccgtagcgccagcggcgaatggcgggcaatggtggttgccagtttcagggcatactcatcggttaacgccgccggatggatatcactgaccagcccggcctgctgcgcctggcgggcgtcaatactctcgccgctcagcaccatccggctggccagcgccttgccaacgctgcggatcagccgctgggtgccgcccgcgcccggcattatgccgagggtaatttccggcaggccaaagcgggcattgtccccggcgacaatcaggtcgcacagcagggccagctcgcagccggcgccgagcgcgtagccgttgaccgaggcgatgagcggcttagtaaaagcatcgattcgcgcccataaccgtgggcgaatatcatccagggtggcaggaagatctttttccgccatttcattgaggtcagccccggcggcgaaaaaacgcgcgttaccgcgaataacgcagacgccgacgctgtcatcaactgccgccgcctccagcgcctcggcaatctgggttaataaggcattgttcagcgcgttgcgggcctgcgggcggttcagcgtcaactgaagcacccggccatgacggtggatcagcaggtcactcatgccatcccccgcgcgtcaaagtcgaccaccacatcgccgctggtcggcagcgactggcagctcagcacgtagcctgccgccagctcatccgcttccaggctgtaattggcggccatcgccacttcgccgcgcagcactttacatttacaggtggcgcataccccgcccttacaggcgaacggcagatcggcgccctgacgcaatgcggcatccaggatgctgtcgtcttcggcgctgagggcgataagccgatcgcgcccgtcctggcggatggtcaccgtgcgcccttccgcctgcactccagcggcccgcttcacattgccgcctggggtattaaagcgttcgagatgaatcgatttctccgctatgccaagttcacgtaacgtcgcttccgcctcgtccatcatcgccgccggaccgcagataaaggcctcgtcgaaacggctgaaatccagcagatggtcagcgagctggcgcagtttgtcgccgtcaatgcgcccctgtagcagatcgctgtccatcgactcctggctaaacaggtggatcacctgcaggcgctgcggatagcggtcttttaaatcggccagcgcctggcggaacatcatgctatggctgctgcggttgccgtagatcagcgtaaagcggctttgcggctcggtcgccagcgtcgcgctaatgatcgccatcatcggcgtgatcccggagccggcggcaatcgccagatattctccctgccgttcggcctgcggttgataaccgaaatgcccctgcggcaccatcacctccagctccataccctgctggatatcgtgctgggcgtagcgcgagaagcgtccgccgtcgatggctttgaccgcgacgctaatttcgcctggcgtgcggctgtgacaaatggagtaacagcggcgcagttcttcgccgcccagacgggcttttagcgtcagatgctggcccgggcgaaaacagtattccgcctgcagggcttgcggaatcgcaaaagtgatggtcaccgcatcgcgggtttccggctcgactctcgccaccttaagcgaatggaacgtcgtcatggcaacctcaaatacatttaaagtaatcaaaaggttcccggcagctgtcgcagcgatagagcgctttgcaggccgtggaaccgaattcgctaatcagcgaggtatgggcgctgccgcagcgcggacagctcacctcaacgggcatgtccgcatggcaggcgtgcccctggggcgggctgatgccgtactggcgcaggcgctcgcgggcatcctgactcatccagtcggtggtccacggcggatccagctgcaggacgatatgtaccggctgaaagccatgctcgctcatgaccgtgcggatctcccccagcagatgctccgtcgccggacagcccgaataggtcggggtaaagccaatcacccagccgtcgccatggcgcgcgacgctgcgcaccataccaaggtcggtgatggtgagtactggcacttccggatccgggatcgcgcttaataatccccagatggtgcgaacctctgcaggagcgatatcggcaagacgttgcatagtcacctcacttaccactgcagtccgggatgcgaacgctgcagatactgcatctccgccagcagcgggccgagatgttcactgtgcagcccctgtttgccgccgctgcggaaggccgcttcctgcgggatctgtaagccggagtcgagaagcgccgtgtgtaccgcgctttgccattcggcctgcagttcacgcggatcaaccgcaatgccctgctcaaccaggctgagctccacttcatcagccaggaacagttcgccggtgaagcgccacagattgtcgaccgcctgctgcattttgcgatttgataattcggtgccgttacccagacgctccagccagccgcggctaaagcgctggtggtaacgcacctctttcagccctttagcggcaatggccgccagctgcgcgtcgcggctgttcaccagccggctgaacagggcgacatgccagacgtcgataaagaactggcgggcgatagtgtcggcaaaattgccgtttggctgctccaccagcagcaggttgctgtactggcgctcatcgcggccaaaagccagcgtatcttcgtcgccgcagccgttaagctcggcggcatagcttaaaaaattgcgcgcctggccgagcaggtcgaggccgatattggccagcgcaagatcgatctcgagctcgggagcatggccgcaccaggcgcctaaacgctgggccagaaccagaccattgtcgccaagccgcagggcgtaggtggctacggggttagggttattcatcgccgcctcacatatgttccatgccgtccggcacggtatagaaagtcggatgacggtagactttgctttccgccgggtcgaagaattcgccgcgatcttccggctgcgaagcaacgatttcgctggccttcaccacccaaattgagcagccttcgctgcggcgggtgtaggcatcgcgggcattctccagcgccatttgatcatcggcagcgtgcagactgccgacgtgacgatgggataacccctgtttgctgcgaacgaacacttcatataacggccagtaaactttactcatgttgtctctcctcctgccgcgctgcgggcctgctgtttttgcgcatgggccagcgcggcttcgcgcacccattcgccctcttcccaggccttacgcttggcggccaaccgctcgtgattgcaaatgccacggccgctaatcacctcgttaaattcctgccagtcgatttcgccgaagcggtagtggccgctggcttcatcaaactgcaaatccgggtccgggacggtcataccgaggatctctacctgcggcacggtattgttgacgaagcgctgacgtagctcgtcgttggagtgcagtttgattttccacgccatgctgcgggcgctgttcggcgagttgtcatcgttggggccaaacatcatcagcgccggccaccagaagcggttaatggcgtcctgcagcatctgccgctgcgcgtcattgccctgcgccagcgccatgcaggcttcaaatccctgacgctggtgaaagctctcttctttgcagattttgaccatcgcccgggcataggggccgtaggaggtccggcacagcgccacctggttgacgatggccgcgccatcgaccagccagccgatcacgccgatatccgcccagctgagggtcgggtagttaaaaatggaggagtatttcatctgcccgtcgagcatcttctgatacaggtcttcccgggcgcagccaagggtttccgcggcgctatagagatacagcccgtgtccagcctcatcctgtaccttagccaacaggatcgctttgcggcgcagcgtcggcgcgcgggtgatccagttgccttccggcagcatgccgacgatctccgagtgcgcgtgctggcctatctgccgaatcaaggtcttacggtaggcatccggcatccagtcctgcggttcgatggccgtttcctgcgcgatgcgctggtcaaagcgttgttcttctgtcacgtcatcacctttatgattccgatattcacaacaaaaaaatttatgtgaatcactttatttattgaaggttacatattggttaaataaaaccacaaattttgtttgctctttttgtgataatctccgcaaaaccttttgtaaaccacaataaatacagtaaattaagcataatgcgtaacgccatcgcgatcacaatgttaataatttattaaatacgggcttgcattttatgattcataaaagaactatttatagatatcacacgtaacacatttggagatttgcgatgcagcagttagccagctacttatccggcgcctggcagaccggccggggccgcgcccgtactatccatcacgccatcaccggcgcggcgctttgggaggtgaccagtgaaggcctggatatggcgcaggcgcgccgcttcgcgattgagcgcggtggcaaagccctgcaggcgatgacctttattgaacgcagcgcgatgctgaaagcggtggcgaaacacctgctggagcagaaagaccagttctacgccatctccgcgcaaaccggcgccactcgcgccgacagttgggtggatattgaaggcggtatcggtacccttttcacctatgccgggctcggtagtcgagaattaccggacgatatcctgtggccggaagacgagctcatcccgctctccaaacagggcggttttgccgcgcgtcatgtgctgacatcaaaatcaggcgtcgccgtccatatcaacgccttcaacttcccctgctggggaatgctggaaaaactggcgcccacgtggcttgccggtatgccggctatcattaaaccggcaaccgctaccgcccagctcacccaggcaatggtgaaagcgattgtcgacagcggcctggtgccggagggcgccatcagcctgatttgcggcggcgcgggcgatctgctcgaccacctcgatagccaggacgtggtgacctttaccgggtcagccgccaccggccagcagctacgggcgcaccctaacctggtagccaaatccattccctttaccatggaagcagattcactcaactgctgcgtgttaggcgaagacgtcactccggagcaaccggaattcgcgctgtttattcgggaagtggtccgcgagatgacggcgaaagccgggcaaaaatgtaccgctatccgcagaatcattgtgccactggctcagattaatgcggttagcgatgcactgatctcccgcctgcataaagtaaccgtcggtgaccctgcgcaggagggcgttaagatgggggccctggttaatagcgaacagcgtcaggacgtacaggagagcgtcaataagctgatagccgctggctgcgaagtactgctcggtggagaggcggatctcagcgcggccggcgcatttttcccgccgaccctgttgtactgctcacagccggatgaaacgccggcggttcacgccattgaagcttttggtccggtggcgacgctgatgccgtatcgcgaccgccagcatgcgctgacgctggcgcgcgccggcggcggcagtctggcggggacgttggtcaccgctagcggcgagctggcgcgcgagtttatcctcggcgccgcccgcgcccatggccgtattcagatactgaacgaggcgtcctcggttgagtcaaccggccacggctcgccgctgccgcagctggtgcacggcggccccggccgcgctggcggcggagaagagcttggcgggctgcgctcggtgaaacactatatgcagcgtaccgcggtccagggcagcccaacgatgctggcgaccatcggtcaacagtgggtgcgcggcgcccaggtgaacgaagaccgtattcacccgttccgcaaatatttcgaagagattcagcctggcgacagcttattaaccccgcgccgaaccctgaccgaagcggatatcgttaacttcgcctgcctgagcggcgatcatttctacgcgcatatggacaaaatcgccgccgccgagtcgatttttggcgagcgggtggtccacggctatttcctgatctccgccgcggccgggctgttcgtcgatgccggcgtcgggccggttatcgccaactacgggatggaaaacctgcgctttattgagccggtcaaaccgggcgacaccattcaggttcgcctcacctgtaagcggaaaacggtcaaacgtcagcgcagcgccgatgagaaagccaccggcgtggtggaatgggcggtggagattttcaaccagcaccagcaggcggtggcgctgtattccattctaaccctggtggcgcgtcaacagggagatttcccggcgtgatagcgaaaaatagatcgctggcgctctgttggccgaccctttagccattgatacagcaatcggtttgcaacggtttcgccccgggaagtcctttatgttatccgtggcttcagcgcacattgcgctcccggttaatcgtctgcgttatgcctggcatagcgcagggagcgcacagggggcggccagtcgccgccgccccctgtacccccgggctcgggccagcaagaatggtgaataaattaacggcaggccgcacagaccgtaggccgggtaaggcgtcagccgccacccggcaaaaaaatcagcgcacgttctcaatgcctctgcggaggcattttttacgcccgtctggcaaaactgacaaacaagctggcaaaagcaaacaaacgccccggcgccgctggctggtagcttaaggatgacaaagccgacattcgcagcggcaagagacaacacaacaataagatgaggtcacaatggcaaacggcttgaaattttctcctcgtaaaaccgcgctggcgctggccgtggcggtggtttgcgcctggcaatcaccggtcttcgctcacggtagcgaagcccacatggtaccgctggataaaacgctgcaggaattcggcgccgatgtgcagtgggatgactacgcgcaaatgttcaccctgataaaagacggcgcttacgtcaaagtaaagcccggcgccaaaacggcgatcgtcaacggtaaatcccttgacctaccggtgcctgtggtaatgaaggaaggtaaagcctgggtttccgatacctttatcaacgatgtgttccagtccggtctcgatcagaccttccaggtggaaaagcgcccgcacccgttaaactcgctctcggcggcggaaatcagtgaagcagtgaccattgtcaaagccgcgccggagtttcagccgaatacccgctttactgagatttccttacacgagccggacaaggcggcggtatgggcctttgccctgcagggaacgccggtcgatgctccccgcactgccgatgtggtgatgctcgatggcaaacacgtcattgaagccgtggtcgatctgcaaaacaaaaaaatcctctcctggacgccgatcaaaggcgcccacgggatggtgctgctcgatgacttcgttagcgtgcagaacatcatcaatgccagcagcgaattcgctgaggtgctgaaaaagcacggtattaccgatcctggcaaagtggtcaccaccccgctcaccgttggcttttttgatggcaaagatggcctgcagcaggatgcgcgtctgctgaaggtggtcagttatctggataccggcgacggcaactactgggcgcacccgattgaaaacctggtggcggtggtcgaccttgaagcgaagaaaatcatcaaaatcgaagaaggtccggtgatcccggtcccaatggagccccgtccgtatgatggtcgcgaccgcaacgccccggcggtgaaaccgctggatattactgaaccggaaggcaaaaactacaccattaccggcgataccattcactggcagaactgggatttccacctgcgtcttaactcgcgcgtcggaccaattctgtcaacggtgacctacaacgataacggcacaaaacgccaagtgatgtatgaaggttccctcggcgggatgatcgttccctacggcgacccggacgtcggctggtatttcaaagcctacctcgactcgggcgattacggcatgggcaccctgacgtcgccgattgttcgcggtaaagatgcgccgtcaaatgcggtactgctggacgaaactatcgccgattacaccggcaaaccgaccacgattccaggcgcggtggccatattcgaacgctatgccgggccggaatataagcacctggagatgggcaagcccaacgtcagtaccgagcgccgggagctggtggtgcgctggatcagcaccgtcggcaactacgactatatctttgactgggtgttccacgacaacggcaccatcggtatcgatgccggcgccaccggcattgaagcggtgaaaggcgtgctggcgaagactatgcatgaccccagcgccaaagaggatacccgctacggaacgctgatcgaccataatattgtcggcaccactcaccagcacatctataacttccgcctcgacctcgatgtggacggcgagaacaacaccctggtggcgatggacccggaagtgaagcccaacaccgccggcggcccgcgcaccagtactatgcaggtgaatcagtacacgattgacagcgagcaaaaagcggcgcagaaattcgacccgggcactatccgcctgctgagcaacaccagcaaagagaaccgcatgggcaacccggtctcataccagattatcccttacgccggcggcacgcacccggcggcgaccggtgccaaattcgccccggacgagtggatatatcatcgcctgagctttatggataaacagctgtgggtgacgcgctaccacccgacagagcgatatccggaagggaaatacccgaaccgttccgcccacgataccggcctgggccagtacgcgaaggatgatgagtcgctgactaaccacgatgacgtcgtgtggatcaccaccggcaccacccacgtggcgcgcgccgaagagtggccgatcatgccgaccgagtgggcgcacgcgctgctcaagccgtggaacttctttgacgaaacccctactctgggcgaaaagaaaaagtaatcttaaccggcggtgaaatccagcaggatcttaccgcctcttcccggctggccggcggcggcaatcgccgcccgcaggtcgttcaacgctatacgctgggccggcggctgggaggtcgtcggcaggcgctgccagatttcgtcgaacgctgcccgccacgccgccacgctgagtgtcggcagcgcctcccgcagatgaaacttgcgcaccgtcgcgctaccgcgcgtctgggtcagcggccgcccggataacagcccataggagatcagggtcgacgacccgggcagcaccgacagcagcgtattcgccagttcgccgcccaccgcgtcaaacaccagatcgctgtgctggctgaccttctccatcagcgcccggtcggtatcgaggatcggatagatcccggcctgttccaggcgcgcccggtgctgcggcgagcgaataatcccgctcaccgagcgggcgcccatcgccagcgcccactgccccagcagactggcgcaggaggacgatgccgcggtcagcacgaggtgttttccggcaaccggccagcgcttgagcatcagcatcgccgtcagcggattgatatacccgcgggcggccagcagatcgtcaactgccggcggcaccggcaccagccaggtctcatccagatcgataaaccgctgccaggtgccgcccccgcgcaggggcagcacccgctggcccgcggccagccggctgccgtatggcgcggcgaccacctcgccaaggccttcatagccggcgacggccggcagtcgggtgcggtggcgataggcgccggtcacggggatcagatccgaaggattcaccggggcaaagcgcatcctgacccgcacccgtccgcccgccagcggcgccagcggcaggcgtttcagggtcagcacggcggccggcggcccgtagcggtcataaacaatggcgtcgttgaacatcgactggctccagacaacgaaagtcgggatcatagcagatcccgcttccagtggctcgcacccgcgccagcccgggtcagcccgggccgtcgctggccgccgccagcaacggcacgatgatatcgctgagcggcgtcggaatgccgtgctggcgcccgcgacgctgcaccacgccgttacgaatatcccactccagcggtcggccattgaggcgatcgatcagaatagaggtgcttaagtcggcaggcgcccgatgaaagccggcgataatctcctccggcacgttgtcgctcagggcggccccttccgcccgcgccacctgcaggcattcgcgcagataagccagcccgagggcagtgatgtcctcccgggcgaacatcccggcgcgtcgtccggtcagcaccatcagcccggcaaccgcgttctgcaacagtttgcgccaggccacggtggtaaaatcagccgccaggtccaccgcgcagcgggttcccgccagcgcctgctgcacccgctctgcccccggcagatccggcagcgtcaggcgcgtcgtggcgcgcaaccagacagaggcatcggcatcgcgctgcgccgggaaccagaccaccgacggcagcaccgtcgcgccgacggtcaagggggcaaactgctggcgctgctcaacgccgttttgcagcacgcacaccacggtgtcaggggaacacagggccgtcagccagggggcgatggcctccgtctgggtggttttcaccgcgacaaagaccaggtcgaagggggcggctatcgccatcgggtcggtgtgcaccgggccgggcaccacgatctcaccctcgtcagtgcgcagcaccagcgccgaatgggcggtacgcccgcagaccatcggcgccctccccctctcaaacagggcggcggcaatcgtggtgccgatggcgccgggaccaattagcgcaaccttaggaaatgctgtcatgccgaagacctcctgatgattcaccgcccagattaggcaaagattgccctccacagtagcgagaaagaccggaggtcggcaaggggcgcgtcgggaaaagcctttcgccttccccgacggagggctagtagcgcacgcagacggatttggtttcgcaccagccgtcgagccagtcagggccgaaatcgcggccggtaccagactgcttcatgccgccgaaaggcaggttggcgtcaatcagggtatggctgttgacccataccgttcccgcctgcagacggtcggtgtagttcagggcctgggtcagatcgcgggtccagacgctggcggtcagaccaaaatcgctgtcgttggccaggcgcagcgcctcctcgccatcggccactcgcaccaggttcaccaccgggccaaaaacctcctcacggctgagacgcagtccggcgtcggggtttaccaccagcgttggcggaatatagtaccctcccgcatctggtccggcgctgccgctgatgagctctgccttctgctggcgagcctcttcgaggtaggccgccaccttgtcgcagtgggcccgggagaccaccgggttgatctgcgccgtctcctgcatacccggccccacctgcagcgatttcaccgcctgctcgaagccgctgaccagggtgtcaaacagcggcgcttcgatgtagatccgcgagctggcggcgcagacctgcccctgattgaggaagcttccggtcatcagcccctcaataacccactgggggtcggcgtctttgagcacaatcgccggattcttgccacccagctccagcgtcacgcgggtcaggcggtcggcagccacgcgggcaatctgtttcccggtcgccgtcgagccggtaaagctaaccttcgccacctgcggatgggcggtcagcgccgcgccgcagccggcgccgctgccggtgaccacgttgaacaccccgtcaggaatgcccgcctgggtcgccagctccgccacccgcagcagggtcagcggggtggtttccgagggtttgatgacgatcgaacagcccgccgccagggccggcatgaccttccacatgccgatcatcagcgggaaattccacgggacgatgcccgccaccaccccgaccggctcttttttggtccacgcctggtaacgcgccccttgcgggaacgggatcgaaacgtccagcgtccggccgctgatcttggtggtcagccccgcggtgtagcgcatccagttcagggtgcagccgacctcaaaggcgcgggagatggcaatggatttcccctgctcgagggtttccagttgcgccagctcttcgccgtgctgctccaccagatcggcaaaacgcagcaggatgcgttcacggtcagccggggtgcgcccggcccagcggcgatcgacaaaagcgcgccaggcggacatcaccgcccggtcgacatccgccgggctggcgtcggcggtggtggcaatcgcctgcccggtggccggatcccagacggttaaccggttttcgctctgcgcggcgcagggggcgccgtcgatatacaggccatgctgacggtctaaaaactgctggacgctggcaagcagcgctatctgtgaggtggacataccctttccttattcatcgcggatagtgctttcagtctatgtctggttggcggttggcgcttttttctctgtgacattcgtttgcgccgctgtgacagtcgccgcaattccgtcgtctgccctcgcagaaatgtgccgcgggtaatagttctttcatatacccgccatcgcgcccttgcctgaggcgacacaaatgcaacaatgcggaaacattgttattacaggagaagggcgaatgatgaccacggcagagggggggctggcatatcagcgctggctggcgacgatcaatcaggtctgcggccatttcgccgcccggccgctgaaggagagtttccacggcgagattgacgcccgctacgccggcagcctcaaggtcagtaccgtcaccgccgccggcgtcaatctctaccgcacgcgcaatgagataaaacgcgataacgacgcctggttctataccgtgtttcagctcgccggcgaagccatcatcgaacaggacgatcgccaggtgacgctggcggcaggcgatatcacgttaatcgacgccgcccgcccctgctcgattgtctggcagcagacctcgcgtcaggcctcgctgctgctgccgcgccagcgggtggcgcccacaggggacatcactaccgcctgccggctggacaaatctctgccaatggtccagctcagccagcgactgctgctggaaagcatgggcggcacgacgctctccgccagcgagagcgaagccgcgctggaggcgatcgcctgcctgttgcgcccggtgctgcatcagcgcgatcctgccccttcccggcgggaaaagcagtttcagaagattattgcgttaatcgatgcgtccattcagtcggagcatctgcgtccggagtggctggccagcgagacgggcatgtcggtacgcagcctgtaccggctgtttgccgaccaggggctggtggtggcgcagtatattaagaaccggcggttggatctgtgtgcccaggcgttacagaatgtccatgacgatgaaaagctggcggggatcggctaccgctggggcttcagcgaccacagccatttctccaccgcctttaagcagcgctttggcgtcaccccgggggaataccgcaagcgctgtcgctaattatttgcgcagccactggccgttcaatccctggacgtactccccgggctgcgcgcgggccaccagcttctgcccagccattttcgccacttcatccaccggcagattgttgtcatccgccagctgctggtagctttcgctgcgcgcggcgttaatctgctttaccagcgccagcgtctctttatcctgacgcagcggcgcgagatagccgttcagcgtctcccccactcgtccctgctggcgcgcttcgctcagggtcaacgccagcgcgggcgcgcagagtaaagccagcgtcagcgccgcggttaacagtcgttttctcatcgtcgcctcagaacaaatcgctgcgggatttgagcaggttttccacatccttatcgaccttgatatggatctcatgctcaattttgacattcatattgatggtgatgggctctttcgacgccgcgatttcgatgcgcggcgtacagccggcgagcagcatcgacgccaccatggccagtaacagcttcttcatttaggttccttacatgtcttaccgtccgtacagcgccgtacgggcagcgtagcattctgctcgagccacgcctgtaaattgtcgccgaagcgcaaactgcgccacaggtcgaaaatattctcttcatgagcgtagtttaaatgcacggtactacttttcccttccacccggctggtgccgttgatgctggccttaagcgtcaacacgcccagattatcgaggttaatctgcgtccacgagcgggagatttccatatagcgcagccagttaatcgccgccccggcggagacgttatccgccaccagcgcatcggcggtgtctttatccagccgcagggtcatcggtccgtcattgcgcagccagccgtcgtggatgatccattgattattctccagccacagcggcagcgcgccgctcaccgcgccggacatggcgaactgtttcaccttgacggcgctggtcagttcgctgctggagatatgctgcaggcggatcaacgccgggtcgcgctgcggcatacgcagctgcagcaacgtcagtttcccgcctaacagatcgacgctgacgtcgctgagctgcagcggattggcctcgctccacggccaggtgccctgcaggtccgccgtcagattacgcgcggtgacctggttgacgatttcgccaatgcgcagggagaccgggcggcggatgcccagctgccagtgaccgtcgctgaagcggaacggcaggacgaaatcgacgccgttgatctggttatccggcatccaggcgctgccgcccttcaggacgccatggccgcccgcctcaaatccctgcccggctgccgccgagaaggccacctgcgcgtagagactgccttcgcgcaggttcatcttccagtccggcggcaccagcggctggaacaccgttagcgactgttttggccaccacgcctggccgcgcagccgttcgccatcccagcgcccggacagacgcaccggaccgatagcctcggcatgcagggcgccggtgaactggaaccacgttgggtcccgaccgtcgagagcgaatttcagcgttgaggccgggagatagctgccgccggagaaggtggttttggcggcgtccagcgacagcgcgccggtcaaccgcggatgctcagcatcgcgcagccagcggatcggctgctcgagggtcagacgcggggtgctgacccgcattgtgccgtactcaagcttatcgaagccggtggagaggctgctcagggtaatagcattgtcgcgccactccccgctgcccttcacatcccagcgcgcctgcatcggggtaaaatgtccctcgccccagtagcgccactgccagcggccgctgtcgggcagaaaatcgctcgcctgaccgtccagatgcagcgtaaagtcgcccatctgctgctcatgggcgcgaaggatcgcctgcaggcggccatcgacgccctgctgagtgaccttaaccccggccagcggccagcggatttcgtcaatattcagcgcgtcgatcacccgcccgcgcgagcgcagcaacgcaccggggtgaaaagccagctgcgggctgatcagcggcccgctgagctgagccggcagcgccgcgtatagtatcatctcccccagcttggcctcgccggtgagccgcagcggcagatcgctgttatccatgctcagcttgcccggaccaatattcagtaccgcattgcccttcccggcatgcccctcggtgagaacattcaggcgaccgctgacgatcatctgttcggtgccctgctgccagttacccaccgacagcgccacccgcccgcgcagcggatacgcctcgtaacgggtgcgccagcggccgtcgctgatggtgatccgctccggagtgatctcccacggcaggtccagaataggctctacctcaccccgcggggtgaccagcagctggccgcgattgtgctgccactcgagctcagcatcgatccattccgcagtctgcgggaattcgaaggtgccctgcatctggccgtcgaccggcagaccatccggcaccagcggcagatggaaggtccccaccagcttcaccggcggctgatcgtcagtcagccgggcgctgaactggctgacggtgagcgcctggccgcgcaggcgcgcctgcagactcagttccttcccggcaaagccgatatcctgctgcgcaggcgttaatgacattaccagccgcccctgccatttctcccacggcgagagccgcagattgtcaacggttaaccagctatagggcaacatcgattgccattcggcaagcgtgcgcggtgaaccgggagagggatcgctggcaggcagtttgctcaggcaggcgctgttgatctccagctggccaatatgcagccgccagcggctgggacgcgagagacgggcatcggtcacccgggcgatttcacagtcgcccaccagataacgcagatcggggatcagcagggccgaccgcgtcaggcgcgggctctcctgcaaagagatacgcgtgcccacgggcagccagatgcccgccagcgtcggcacccagtgggttagcgtcaacagcagggttagcggcaataacaccagaactaacaccagcgcgatggcggctttatatttacccttcatgggcagttaatatcctgattcaacataagtaaaagctgaaaggcgtccattgtgacacgttcgaccagtgagtgaaagtttacggcctgttaaagcatagttgccagccggactcgcggcgcgacgttcggccattatcatttaactgttgtttaagtcgcccctgccacactccagccagacgggaatagcttgcgggagaggcggtgtcgttaattatctcgctcatagagagcgcacaggaccactatccatgggtattgctgattgtttttctgcttaccttcactaaatcctgcgcattggtctcgctggcaatccccggcacctccggcctgctgctgctggggacattcgcttccgccagcctcggacatttcctgttaatgtggtccagcgccagcctcggcgccatcggcggattctggctatcgtggcggctgggcattcgctaccgtcatcgcctcacccatctacgctggctgaccgccgagcgtctggcccgcagccgcctcttctttcagcgctatggctcgtgggctatctttttcagccgctttctctctcccctgagggctacgctgcccttcgttagcggcgccagcagtctgccgctgtggtcgtttcagctggctaacgtcagctccggtctgctgtggccgcttctgctgctcgcccccggcgctttcagcctcagtttgtggtgaaaaacactgtctttcaaagagattccgcaagtccgcgatatgctctagaattaggattagcaccctctcattaaactattttttaataattgtacgattattttaaatatgctaccgtgacggtataatcactggagaaaagtcttatgaaaatcgcggtttatagtacgaagcagtacgataaaaagtacctgcagcacgttaatgatgcatacggctttgaactggaattcttcgatttcctgctgacagcgaagactgccaaaaccgccaacggttgcgaagcggtatgtatcttcgtcaatgacgacggcagccgcccggtgctggaagagctgaaggcccacggggtgaaatatatcgccctgcgctgcgccgggtttaacaacgtcgaccttgaggcggcaaaggagcttggcctgcgcgtcgtgcgcgttccagcttactctccggaagcggtcgctgagcatgcgatcggtatgatgatgtcgctcaaccgccgcatccaccgcgcttaccagcgtacccgcgatgccaatttctccctcgaaggcctcaccggcttcaccatgtacggcaaaaccgccggggtgatcggcaccgggaaaattggcgtagcgatgttgcggatccttaaaggcttcggcatgcgcctgctggcgttcgacccgtacccaagcgccgccgcgctggagctgggggtagaatatgttgacctcgccacgctgtacaaggaatcgaacgtgatctccctgcactgtccgctgaccgacgaaaactaccacctgctcaatcgcgaagccttcgatcagatgaaagacggggtgatggtgatcaacaccagccgcggcgccctgatcgactcccaggcggccatcgacgccctgaagcaccagaaaattggcgcgctggggctggacgtttatgagaacgaacgcgatctgttctttgaagacaaatccaacgacgtgatccaggacgatgtcttccgccgcctctccgcctgccataacgtgctgtttaccggccaccaggcgttcctcaccgccgaggcgctgatcagcatttcggagaccactctgggtaacctgcagcaggtcgccaacggcgaaacctgtccgaacgccatcgtctgacgcctttcccttttgtgctcctctcccggggggagcacattcagataacccccacagatccctgctgcgataccgttacactggcttggttttattagttatgtgaatgttttggagtgaaaatgaacaaatttgcggcgcttctggcggcaggtatgctgctgtccggctgtgtctataacagtaaagtgtccaccggtgcggaacagctgcagcatcatcgtttcgtgctgaccagcgtcaacggccaggcggtcaacgccagcgaccggccgctggagctgagcttcggtgagaagatggctattaccggcaagatgtatgtatccggcaatatgtgcaacggctttagcggggaaggtaaagtgtcggacggcgagctgaaggtcaaatcgctggcgatgacccggatgctgtgccacgacgcccagctcaataccctggatgcgacgatcgacaagatgctgcgcgagggtgcgcaggtcgatctgacggaaaaccagttgacgctggcgaccgccgaccagacgctggtctataagctcgccgacctgatgcactagccggcgttgatgtgccgctgacgctgccccgcgacggggccgctgttagtagccgcagctgccgcccgccagcgcctgctcgctgcagcgtttgccgttcggcagcgcgcacatgccaatcgccgaaccatcgagctgacgagccaccgataacgagccgcctatcatggcgcagttggcctgaccggcgtcgctcatcgccgcccgcattcccggcgtgacgtgcgccgccgtggcctgctgaacgggttcactactgcacgcggacagcaacagcgccgcacatcctactaacatcgcagctcgcattctctctcccctcagaaacgtcttaaaaaagcaaaccccagaataataggcagcgtggcgggcggcgtcgagaggggaagtacgtatttatgcgcctcattaacattttctagcaaattttcgccgaaagcttgatctgcctcggccatgtcgcccggcgcaggtggttcctctcccggcaggcagccattttctccgcgaaccacgcaaaatattgatctggtcacgggtacccggcgcattgaggacacaaatgcaaaaatggcggggtcagcggtttgctaaactaccccttatataattacagggcgcgtcgcggtttcacgcgtccattcttttgcgcaatgtaagggtgtcttcatatgattacgattgatggtaatggcgcggtcgcttccgtcgcgtttcgcaccagtgaagttatcgccatctacccgatcacgcccagttcaacgatggcggaacaggctgacgcctgggccggcaatgggctgaaaaacgtctggggcgatgttccccgcgtggtcgaaatgcagtcggaggcgggcgccattggcgccgtacatggcgcgctgcagaccggcgccctctccacctcctttacctcatcgcagggcctgctgctgatgatccccacgctgtacaaactggccggccagctgatgccgtttgtgctgcacgtcgccgcccgcactgtcgctacccatgcgttgtcgatcttcggcgaccattccgatgtcatggccgtccgccagaccgggtgcgccatgctgtgcgccagcagcgtccaggaagcgcaggatttcgcgctgatctcgcatatcgccaccctgcaaagccgggtgccgtttattcatttctttgatggtttccgtacttcgcacgaaatcaacaaaatcgccccgctggcggatgacaccattcgcgccctgctgccgcaggataagatcgctgagcatcgccagcgcgcgctcaatccggaacacccggtgatccgcggaacctcggccaaccccgacacttacttccagtcccgggaggccaccaatccgtggtacgacgcggtgtatgaccatgtcgagaaagcgatggacgatttcgctgccgccaccggccgtcagtacaaaccgtttgagttttacggccacccgcaggcagagcgcgtgatcgtcattatgggctcggccatcggcacctgcgaagaggtggtcgatgagttgctgagtcgcggcgagaaagtcggcgtgctaaaagtccgcctctatcgcccgttctccgccgcccacctgctggcggcgctgccggaaagcgcccgcgcggttgccgtactggatcgcaccaaagaacccggcgcgcttgccgaaccgctttacctcgacgtgatgaccgccctggcggaagcctttaaccgcggcgagcgcgagacgctaccgcgcactatcggcggccgctacggtctctcctccaaggagtttggtccggaatgcgtgctggcgatattcagtgaactgcaggccgcccagccgaagccgcgctttaccgtcgggatctatgatgacgtgaccaacctgtcgctgccgttgggcgaaaataccctgccggcagaggccaagctcgaggccctgttctacggcctcggcagcgacggcagcgtgtcagccaccaaaaacaacatcaaaatcatcggcaactcgaccccatggttctcccagggctattttgtctatgactcgaagaaagcgggcggcctcaccgtctcgcatctgcgggtcagcgaaaaaccgattcgttcatcgtatctgatttcgcaggctgatttcgtcggctgccaccagctgcagtttatcgataaataccagatggccgagcggctgaagcccggcggcattttcctgctcaacacgccgtacagcgccgatgaggtctggtcccgcctgccccaggaagtccaggccaccctgaatcagaaaaaagcgcgtttttacgtggtcaacgcggcaaagatcgcccgcgaatgcagcctcggggcgcgcattaataccgtgatgcagatggcctttttccatttaacccagatcctgccgggtgatagcgcgctggcggaactgcaggcagccatcgccaaaagctacagcagtaaaggtcaggagctggtggagcgcaactggcaggcgctggccctggcccgtgaatcactggcggaagtaccgctccagccggtgaacgccagcagtccgaaccgcccgccggtggtctccgacgccgcgccggatttcgtcaaaacggtcaccgccgcgatgctggccgggctcggcgatgcgctgccggtctctgccctgccgccggacggcacctggcccatgggcaccacccgctgggagaaacgcaacatcgccgaagagatccccatctggaaggaagcgctgtgtactcagtgcaaccactgcgtcgccgcctgcccgcactcggcgatccgcgccaaagtggtcgccccggaagagatggagaacgcccctgccagcctgcattcgctggatgtgaaatcccgcgatatgcgcgggcagaaatacgttctgcaggtcgccccggaagactgcaccggctgcaacctgtgcgtcgaagtgtgcccggcaaaagaccgccagaacccggagatcaaggccatcaatatgatgtcccgcctggagcatgtggaagaggagaaggtcaattacgagtacttcctcaacctgccggaaatcgaccgcagcaaacttgagcgcattgatattcgcacctcgcagctgattagcccgctgtttgaatactccggcgcctgctcgggctgtggcgaaacgccgtatatcaaactgctgacccagctctacggcgaccgaatgctgattgccaatgccaccggctgctcctccatttacggcggcaacctgccctcgacaccgtacactaccgacgccaacggccgcggcccggcgtgggccaactcgctgtttgaggataacgccgaattcgggctcggcttccgcttgaccgtcgaccagcatcgccagcgcgtgatgcgcctgctgagcgaattcgccgacaaactgccggcagagctgaacgcggcgctgcacgccgaggcgacgccggaagttcgccgcgaacaggtggcggccctgcgtcaggcgctggccggcgtggcgggagctgaagagctgctgaccgatgccgacgcgctggtggagaaatccgtctggctgatcggcggcgacggctgggcttacgatatcggcttcggcggcctggaccatgtactgagcctgacggaaaacgtcaatattctggtgctggacacccagtgttactccaacaccggcgggcaggcgtcaaaagccaccccgctgggagcagtgactaagtttggcgagcatggcaaacgcaaggcgcgtaaagatctgggcgtcagcatgatgatgtacggtcatgtttatgtggcgcaaatttcgctgggcgcgcagctgaaccagacggtcaaagcgattcaggaagcggaagcctatccggggccatcgctgatcatcgcctatagcccttgcgaagagcatggctacgatctggcgctcagccacgaccagatgcgtcagctgaccgccaccggcttctggccgctctaccgcttcgacccgcgtcgggcagacgaaggcaagatcccgctggcgctagattcccgtccgccatcagacgcgctggccgagacgctgcttaatgagcaacgtttccgccgcctgaacgcccagcagcctgaagtggcggagcagctatggaaagacgccgccgccgatctgcagaagcgctatgacttcctcgcccagctggctggcaaagcggagaaatcgccaagcgaaggttaaccgccccgtcacctctgtccataaaaaaagcccgaacacaacgttcgggcttgtcgttttaccgataaacaacatcattccgcagaatgagacggcaacaataaattattggcatgacaataaaggcatataacgcgcaaataatacgtgattagcccgggcatgtataatttttattttgtatattatctataaatgcattcagcataattatcaccatttcattggtattatttattttagattttacttatatcgtaacaattgagtcttaccggatctcagaccgctcctttagcatgagttcacttcccacccggaagttaaaacataaaaacagttaaaggaatttcttcatgaaaagaaaagtactggccctcgttattccggctttattagccgccggtgccgcgcatgcggcggaaatttataataaagacgggaataaattagatctctatggcaaggtagatggtctgcattatttctccagcgactcgaaaaaagacggcgatcaaacttatttacgttttggctttaaaggcgaaacccagatcaacgatatgcttaccggctatggccagtgggaatataacgttcaggccaacaacaccgagacctccagcgatcaggcgtggacccgtctggcattcgccggtatcaaagtgggcgattacggctccttcgactacggtcgtaactacggcgtgctgtacgacgttgaaggctggaccgatatgctgccggagttcggcggcgactcctacacctatgcggataactttatggcaggccgcgccaacggcgtcgcaacctaccgcaacagcgatttcttcggtctggtggagggtctgaacttcgccctgcagtatcagggcaaaaacgaaggccagaacgcgcaggatatgaacgtcggcaccaataaccgcagcagcgacagcgatgttcgcttcgacaatggcgatggtttcggcctctctacttcctacgacttcggcatgggcatcagcgcggcggcagcttacacctcgtctgaccgtactaacgatcagatgacccagaccaacgcgcgcggcgataaagcggaagcctggaccgccggcctgaagtacgacgccaacgatatctacctggcgaccatgtactctgaaacccgcaatatgaccccgtacggcaatgacggcgtggccaataaaacgcaaaacttcgaagtcaccgcgcagtatcagttcgacttcggcctgcgtccggccatctcctacctgcagtccaaaggcaaagatctgtacaataacggccgctatgccgataaagatctggtcaaatatatggacgttggcgcgacctattacttcaaccgtaatatgtccacctatgttgattacaaaatcaacctgctggatggtaacgacaaattctacgaagacaacggtatctctaccgataacatcgtcgccctgggcctggtttaccagttctgatgcgcctgcccgccggttccggcgggctttcccccacccgcctcgctgcagataaaacaaaacgctatatctcgcggactaaaatagccgtccgtttaatgatatagtcatggccagtcagtgcttgcccgaggacgtccatcatgcaccaccatccggttaaatcttcccgaattatctccgtcgcctacgatgacgcctccgccacactggaaatctatttctatcaccagccgccattacaatataccggggtcccaccgcgtatttttcatgattttttacaggtggtgtcaaaaggccggtattatgacggggtgatcaaaggaaaatttcccgaacgcaagctacgttaatgtcaaagtgtgactgcggtcatgatacaaaacgtgccctaataccgtacaatatgaagggatacttaaacaggaggttttatgagcagaatgattcttgtccctatcgatatctctgataaagaatttactgaacgcattatcagtcacgttgaatcggaagcgcggattgacgacgccgaggtgcatttcctcaccgtgatcccttctctgccctattatgcctcactgggaatggcctataccgctgagcttcccggcatggacgagctgcgtgagggttctgaaacgcaattgaaagagatcgcgaagcagttctccatcccggaagaccggatgcattttcacgtcgcggaaggatcgccaaaagataaaatccttgcgctggccaagtcgctgccagccgacctggtgatcatcgcttcgcaccgaccggatattacaacttatctgctgggctccaacgccgccgcggtggttcgtcacgccgagtgctcggtactggtggtccgctaacgccgcagcccgccgcccggcgggctttttatttccgcatcagccgcccccgcctggctgctcgctgccgaaagtgccggaaagatgctgacattccgcccctgaatccgtaccatacacgccacggttgcctgtcaaacctcaataattgctacgcgccagcgccacgttgttcagcggctggcagaatgcgtgctcttctgatgccacactatgaattgagccactattacatgctgcaaaaccaagaaatcagtaaaaaagaaaagtacaacatcgataagctgcagaaacgtctgcgccgcaacgtcggtgaggcgattgccgacttcaatatgattgaagagggcgaccgcattatggtttgtctttcaggcggcaaggacagctataccatgctggagatcctgcgcaatctgcagaaaagcgcgcccatctccttctcgctggtggcggtgaacctcgatcagaagcagccagggttcccggagcatattctgccggcgtatctggagcagctgggggttgaatacaagattgtcgaagagaacacctacggcatcgtcaaagagaagatcccggaaggaaaaaccacctgctcgctgtgctctcgcctgcgtcgcggcatcctctatcgtaccgccaccgagctcggggcgaccaagatcgccctcggccatcatcgcgacgatatcctgcagacgctgtttttgaatatgttctacggcggcaaaatgaaagggatgccgccgaagctgatgagcgacgacggcaaacacatcgtcatccgcccgctggcctactgccgcgaaaaggacatcgagcgcttctcccaggccaaaggcttcccgattattccgtgcaacctgtgcggttcgcagccaaacctgcagcgccaggtgatcgccgatatgctccgcgactgggacaagcgttatcctgggcgcattgaaaccatgttcagcgcgatgcagaacgtggtgccttcgcacctgagcgacgtcaatctgtttgattttaaaggcatcacccacggctcagaggtggtggatggtggcgatctggcgtttgaccgggaagatattcccctgcagcccgccggctggcagccggaagaagaagacgcccgtctcgatgagctgcgtctgaacgtagtggaagtgaaataaccctcacgcgtctcaggcagccgcctgagacgcactctcctgcccttacttcagcagtcgtacgcggcaggatttacctttgatcttgccattttgtaactgcttatacgccttctgcgccatattctggcggatcgccacatagacgtgggcagggtggacggtaattttgccgatatcggcaccatcaaagcccatatccccggtcagggctcccagcacatctcccgggcgcattttcgcctttttcccgccgtcgatacacagcgtcgccatctccgccgtcagcggcgcgatggtgttgcccgtcggcgccggcagccagttcagggaaagctgcagcatgtcggccagaatagtggcgcgctgcgcctcttccggcgcacagaagctgatggccagcccttgttcaccggcgcgggcggtacggccgatgcggtgaacatgcacctccggatcccaggccagctcgaaattcaccaccagcgccagggatttgatgtccagaccgcgggcagcgacgtcggtcgccaccagaacccggacgctgccgttagcgaagcgcaccagcgtctgatcgcgatcgcgctgctcaaggtcaccatgcagcgacaaggcgctctgcccggcggcgttgagcgcatcgcagaccgcctggcaatcgcgtttggtattgcagaacaccacgcaggatgcgggctgatgctggctgagcaggcgctgcagcagggcaatcttaccgtggcgggaaacttcaaagaactgctgctcaatcgccgggagcgcgtcgacagtgtcgatctcaattgtctgcggattgcgctgcacccggccgctgatcgccgcgattgccgccggccaggtagcagaaaacagcagcgtctgccggtcagccggtgcgaagcggatcacctcatcaatggcatcgctaaagcccatatcgagcatgcggtccgcttcgtccatcaccagggtctgcagcgcgtcaagggagaccgttcccttctgcagatgatcgagcagacggcccggggtggcgacgataatatgcggggcatgctgcagggaatctcgctgggcgccaaagggctgcccgccgcagagcatcagaatcttgatgttcggcaggcagcgcgccaggcggcgcagctcgccggcgacctgatcggccagctcgcgggtcgggcataacaccagcgactgggtctcgaagcgcgccggatcgatatgctgcagcagacccagcccaaatgcggccgtttttccgctgccggtttttgcctgcacgcgcacatctttccccgcgaggatcgccggcagggcggcggcctgaaccggggtcatcgacagataacccagctcgttaaggttggctaattgggcggcaggtaaaacagtcagggtagaaaaagcggtcacaatgtattctcgtattaaaaggcagacaatctgcaggcgcgtatcctcgcagatctccgcgcctgatgcgacaatttaatcggctcttcgtcaggcggcggatcgggctggggctgcggacgcggtcgtgggtcgggtaaaggagccggatcgttcggctcgggcgagatagggatagactgggctgtcagccctgaagcgtaatacatagaggcctcccggagagtgatacgggcgtacccgcaagcgtcaacggccagaaaccgtcgggtgtcctagtaagggtagaagctggtccggagagcgcaaaaaaaaagccgactcaacaaagccggcgtcgtacgaatcaattgtgctatgcagtaattcaaaaaaggaagtaagacaatatggagcgcaacgcccatcgcttgacgttgcattcacctgcgagagagatattgccctgaatgggtagatggtttattgatttcgctcaaacattgccgggttttcccggcactacagccgctaaaaggcgattctttacagccatttactgcgatgtaaccaccacgcaacaccaccgatgacaacgactaacatcaagcagaaaaggctaaaccccagatgccagctgttgccagggatcccgccgaggttgacaccgaacaggccggttaaaaaggtgctgggtagaaacaccatcgccatcaatgacatggtataggtccgccgcgccagcgactcctgcataatctgggcgatctcgtcgctcatgatcgccgtccgcgcgatacagctgtcgatctcatccagaccgcgccccagccgctcggcgatatcctgcattcgccgccgctgatcgtcactcatccacggcagccgctcgctggccagccgggcataaacgtcgcgctgcggcgccatatagcggcgcatcacaatcagctgcttacgcagcagcgcgagaaatccgcgcggcggcacctgctgatcgagcaggtcgtcttccaggtcgataatgcgatcgtgcagttgttcgataaactcgctggcatgatcggtcaacgcatcgcagacctccaccagccagctgccgccgtccgtcgggccattaccttccttcaggtcgcccagcacatcgtccagcgccaggactttgcgctgacgagtggagacgatcagccgctcatccatatacaggcgcatcgccaccagctggtcgggccgctcatcggtactgccgttgatacagcgcagggtgatcagcgccccgtcaccgatccgcgtcacccgcggccgggtgctctctcccgccagggcatcgcgtacgttattgggcagcaacggggtggccgccagccagtcggcgctgtcgctatgggtatagttgagatgcagccagcaaggcttgtctttgtcgataatatcgtcatcggcgagcggcttaacgcccccctgcccgtcgagcacccacgcgaagatcgcgtccggtatctgcaactccgagcctttaatcgcgtccactcaacctccgttaatccatatctgctaaattacgcgccttctctataaggtacgcgaaagcgcgcattcttgcttttaatgacccggaaatacaggcctagtcgcttcattgaaaagcgctttcgccccggtcgcggcgctcccctcatttaacgttaaaacttagtgaaatcaagttcttcacgattcaacacatacagagcgacgttttgccgtttattttgcaacttcttgctgtattatgctgtttattgcgttaatttgcggagtcaatggccatgcataagctcgccaggcaaaaacatattctcgacaggcttagcgaaaccggtcagctgagcatcagcgaactggttgcagatctgcaggtgtcggccgataccattcgccgcgatctgagcgacctggaacaacagggcgtgctgcagaaaagccacggcggggccatcgcccttaacgtcccggccatgacgcgccagggcagaaacgctcttctcacccagaccaagcagcgcctgggtcagcaggtggccgcgcgcattccctctggctcgacgctgtttctcgacgccggaagcacgctgctggcggtggcagcccagctgaaagggccgttgaccgtgatcacggcttctctggatatcgctcagctgttcagcgaccgtgccgatatccagctgatcctgcttggcggccagtgggatagtaaacaacggctgttcgccggcagcgccaccctgtcgctggtcacccgctaccgggccgatatcgccattctcggcacctgcgcgctccatgccgggctggggctgagcgccagccaggaagctgatgccgacgttaaacgcgccatgctggccgccagcgccgagcactggctggtggcggaccataccaaactcaaccgctgcgaaccgtggcgggtggccggactcagcgacattcaccatctttttcttgatcgtccctgggctgagctgggggatgaccccgccctctctgtacatattgctgacgcttaacaacgtggagaacctgatgagtaacaacacgataaatatcgccctgattggctacggattcgtcggtaagaccttccacgcgccgcttatccgttcggtgccggggctgaacctggcgttcgtcgcttcccgcgatgaagagaaggtcaaacgcgacctgccggacgtcacggtgatcgcctccccggaagctgcggtccagcatccggacgttgacctggtggtcatcgcctcccctaacgccacgcacgccccgctggcccgcctggcgctgaacgccggcaaacatgtggtggtggataagccctttaccctcgatatgcaggaggcccgggagctgatcgccctggcggaggagaaacagcgtctgctttccgtcttccataaccgccgctgggacagcgactatctcgggatccgtcaggtgattgagcaaggcaccctcggcgcggtgaaacacttcgagtcgcatttcgaccgcttccgcccggaagtccgcgtccgctggcgcgagcagaacgtcccgggcagcggcttgtggttcgacctggggccgcacctgatcgaccaggcgctgcagctatttggtttgccgcagtcggtgcaaggtaacatagccaccctgcgcgacggcgcggagatcaacgactgggcgcatgtggtattaaactacccggcgcataaagtgatcctgcactgcagcatgctggtcgcgggcggctcgtcgcgcttcaccgtgcacggcgataaaggtagcgttatcaaagcgcgggccgaccaacaggagagccagctgctggcgggcgtggtaccgggcagcgccggctggggccaggatgacgacccgctggttatctatgatgcctcgctgcaggcccacgcgcaggctaccccgcagggcgatcagcgccagtactatatgctgatccgcgatgcgctgaagggccagctcgccaatccggtgccgccggtggaagcgctggcggtgatggccgttctggaagcggcggtgcgctctgctgaaagtggtatggtgcagaccctggacctgtccgacgacgagcgcaacacgctgcgctaatccgccctgttctccggttacctgcgcggcccgcaggtaaccgctacttttgctccacattagaaaaaatcactatctatccgcagattaacattgctttatcctgctccatggcgcaaagcaccgctggaaatttcagccaattgggaggaggatagaatgcagatcgatcgtaatgagaaagaggttgctgacgctgtggacgcggcaaccgtactaccggacaggagaagcgcatgtattacacgttaggagataccactctccatttttatcgctatcagtgcaaattttacgtcgcccactgggaagggggtaacgtgatgagcgaaaaatttaaatcgtttatcgaacagatcactgagaagaccgggctggatgcgaaacgcgtcgagaccgccgcgcgcgattattttactaacgtggattaacaggcagtgctgttcgtaagagacaagctggtgcggtagccgcgcaggctaactccacctttcaccgccaggacgcctcgcgccgcctggcggcttctctattctgccagcattaaacggtagtcagttttgccagaatggcggcgaaggcgtcattaaccttatcgccggcgagcagttttttacgcaacgtgaagcttctgccgctggaacggatcagcagtcggactttcgcatcattattgctgcgttcaactacggcaacatcccgcaagggaataacgtaggtatcggcatagagccccggcgtaaatatcatcgactcgccgctcacgccaatcaccacccgattttgcagacgatagccattgcacagcgcaacaataccggcggcaataaatactccgcctatacccatgccaatcattaaaataatgatcccggcgatgagcgccagcgccccttggggataaaagcctgaggcattaaaggttaatagctgctggttatcagcctcgcccactgccgtggttgatcgccagggcgtaaatccggcgttaatccgcgtttgcaagctgaacagactacccaccagaaagatcacgctggcgggcaccatcacgatgccgccaataaacgccaggacgatggccagataagggtagcggcctgacagcattatgctgatcgcctgaaccaccacggcaataaacagggccagcaccagccaggaccatacgccgtccgcccgactatggaagttcagctgtccttcatcaagtaataaatttcgcgcgacaaaacagataataatattgacgaacaggcctatccaggccagcttgtgaacatgcttcatttcatactccattatgtattttgctattccattatcagacattattaaataaaatcgaatgccgcccggatagtaacaaagccgttggcaagatcaatcaaaaagcgtgtcaccccctctcctttagttattttcagattgatataagcaattagcatacatcgtgattatataatccattatatatattctcagaatttctttacgccgcattaatatcgccctgccattctggagagcgttggagatcgccttacctttattgcgcggatcccggtgcgaattggcagttattcacggcgcagccggcgagccaggcgggtccccagcgtctggataagctggacaatcacaatcagcaccagggcggtagtgagggtggcgaaagcgtcgaagcgctgatagccataggtaatagccagatccccgatccccccgccgcccactgtacccgccatggcggtggcgccgagcagaccgatggtcgccgtggtgagggccagaatcagcgatgccgccgcctccggcagcataaagtgccagacagtctgcagcggggttgcgcccatggcgtccgcggcctcgaggatcccctcatccacctccagcaacgagctctccactaatcgggcaatgtagggggcgacaaagacgatcagcggcacgatggctcccgcggtgccgatagtggtgcccaccagcagtctggtaaagggcaggatcacaatcagcaaaatgataaacggcagcgagcgcagcacgttaatcagcggattcagcgcctgatgcaccaccgggttggccacgatgccgccgggacggcaaaccaccagcacaatccccagcgggacgccgatcagcgcgccaaagcccagcgagacggcgaccataatcagcgtgtcatgcagcgccagcagaaactgatcgccggtgatggcggtatcaataagatcaaacatgggtgattttcactcctgcatcgaccagatgggtgatggcgcgttcggtttcgtcaggctcgccgagaagctgcacaatcataaatcccagaatccggccctgaacttcagacatgctggcaaacaggatattcacctcgacagcatactcgcggatcaggtggttaataatcggctgctgcgccgtcgcgccgacaaattcgaggcgtaaagcccgggcgccgttatcgcgctgcaggaacgacgccacccgctgcggcaggcggtcgtgcaccaccgactgcacgaaactggcagtgaccggatgctgcggctgagcaaagagatcaaaaaccgccccctgttcaacgatacggcccgcctgcatcaccgccaccttgtgacagattttctggatcaccgacatctcatgggtgatcaatacgatggtgatgccataccgacgattaatctcctgcaaaagcagtaagatctgcaccgtagtgtgggggtcgagcgccgaggtggcttcatcgcacagaaggaccgacgggttggtggccagcgcccgggcaataccgacccgctgcttttgtccgcccgacagctcattagggtagctgtggattttgtcgctcagatcgacgaacgccagcagttccgccacccgcgcctggataaaggccttgtcgcgcccctgtaaaatcagcgggatggcgatgttatggaaaacggttttcgaattcagcagattaaaattctgaaagatcatgccgatatcttttttgatggcctgcaggcgctggccgctgcaggcctgtagcggctcgccgtttaacagtacctcgccctcgccaggcgtttccagacgattaatcagccgtaataaggtgctttttcctgccccgctgtagccaataatgccaaaaatatcgcctcgctcaatgctgagattaatatcctgcaaggccagaaccggatgtcctttcctggaaaagcttttactgacgtggcgaaattctatcatcgcgttattcattttaaatagtcaggcagcaggtaaccatcatactgcggatggctgagaatatattttttgaactcggccgagtggtagccatcgataatatctttggcaaactgcgccttctgatttttaccggcgacggtcacgacattaataaaatggctggtggctgcttccagctttaatgccgaggtcagggacataccgctggagacggcaaaattgccctgaatcaggccatagtcgacgtccggcagagcgcgaacctgctgggcattatccatctcttttaggacaattttgtaaggattatctacgatgttacgctgcgaaaaagtggccggatcgctgtctggtttaattttcacccagccaaggctctccagcaccagtaccgcgcgatattcatttgacggctggtttggtaccgacacgacggtgcccgccgccggggtccccagggtggtcagtttcccaccatacagccccatcggcggcgtggggacctgcacaatgcccacgttatcgatccccagccgctcattaattgctttcagatataccggatgctgcataatattcgcttcgatatcgccgcgggctaccgcgtcattcacctgaataccgtcgctgaaatccttatattcgattttataccctttactcaataaatagggcgcgacgcctttctcaaattgttctttatacggcccggggttaaagccgacgcggataagatgagcgtcggcggcggcataaaaagaggtggccgacaacagggcgagagcgatcccgcgcgcaactgacttgttcataaggtattttcctggagggttggcgatattgaacgattaaatcacagccgactgtgggttgtaagccagaacgccgaatttccttttgctaattcctcattaacttttgctataccgacatatcttaaaaacaagaatcttttgcgtatattgttatttagccagccgctataaatcccttaaagatggttaattattcgtgatttaaaccgggaatgttatgcctgattttactgcttcgccgctggtggacgccctggaagagaatctgttcagcctgctggaaaaactggccgcggaggtcaacaccgaagcgctgccgctgatcgatctttccagcggcagtccggatcaacccaccccgccggaagtgattgactcgctgcagagcgctattcatcgtcgtgaaaaccatggctacccgtcgttctggggcaaaccacaggtccgcgaggcgatcgcccggttctatcgccggcagtatgatgtggaactcgatccgcacagcgaagtcgccgtgtttcaggggtcgcatatcggtataggcggcatcccgcgggcgctgctcagccccgggcaatacctcatctccaccgatccctgctatccgatttaccgctcggcggcgctgcagtcccaggcggcgttttatggcctgccgctcagggcggagaaccatttcctgccgaattttaacgatcttccccgggaagtcgctgacaaggccgggctggtggtgcttaactatccgcataatccaaccggcgccctcgccacgccggcgctgttcgccagcgcgctgcagtttgctcgtcgtcaccaggtgccgatcctccatgattttgcctatgcggccatcggcagcgcggccagcgatgcgccgctgagcctcttctcccagcccgacgccaaagcatggggagtggaaacctatactttttccaagacctttaatatggccggctggcgcttcggcttcgcggtcggcaacgcctcgattatccgggcgtttaaaaagctgcacacccatagctacagtacggtgtttggcgcgattcaggatgcggcgatcgccgcgctcaacctgccggccgaacggattgcgcagctgacggcggtctatcatcaacgtcgggagtgggttctgcgtcgactggctgcgctgcgctggccggcgcgtgacgcacaaggcactttcttcctctggctcggcgtgccgcccggctaccgttcgcaggagtttgcccgcctgctgctgcaggaagcgcatattctggtggcgccgggcacgggttttggcgcagggggagaaggatttattcgcatcagcctgaccgcaggggacgaggcgctgagcaacgcgctggaccgtcttgcccggctggcgctgttttagtccgccgcagggagaagcaaaaacgcaaccctggccgtcggggattacccggctgacgagtccatcaccgacagcacgattttgccctcaagatgcccctgcgctgctcgctcatgcgccatctgcgcctgcgcaatggggaaaacgctgtcaattgcaacctggatgaccccgacgtccagcaggtcggcaagccgggcgagctgcgcgccgctggagcgtacctgggtggtggagaccgtcactccgcgctgtcgcgcctcttccgccccggcaaagccgagcggaaagatcgggtacagcgcgccgccgggttgcagggtacgcaaaaaacggccgctggccggcccgcccggcgcatcaataaccaggtccaggtcacgcaccgtctcttccactgcggtggttgtatagtcgataacgctatcggcgccgagctgacgtaaaaaggcttcatggcggcccgcggcgacggcaatcacctcggcgccctgccactttgccagctgcacggcgaaatgaccgactccccctgccgcaccgttgaccaggacgcgtttacccgccagcggcaccggccgatgcggccccggctgcagcggattcgccacctcatgcccgggatcgatcatgaactgccaggcggtgaggagcgacatcggcaccgcggcggcctgctgatggctcagggttaggggtttgcgagcgaggtcgctgaccggcacgctaacgtactcggcgtaagcgcggctgccccctgccgccccttcgggaaaacgcgccatagcatacacttcgtcgccgaccgccacctcccggacgtcatccgcccgcgccaccaccaccccggagagatcggtcccgaggatcaagggaaagcggacctcgggccgccactccgggggcagctgttgatagccatcgcgcagatagctgtccggcgggttcacgcccaccgcgtgcacctgtaccagtacttcaccggcctgcaggaccggcatgggcgcatcctcatagctcaggacttccggcccgccaaaggagtgctgttgaacagccttcatcatctgcgtcgacatcgctttctcctcatatggaaatgcgttatatttaacggagcactgttccgaatatatggagcagtgctccgattgtcaaggaacgccaatgagagctgatgccagaaaaaattatgacctgttgatcgaggtggcccgggacgtctttgtggagcagggcgccgaggcgtcgctgcgcgatatcgcccgccgggcgggcgtcggaatgggaaccctctatcgccactttcccaaccgcgacagcctgctggaagccctgctccgcagccgctttgcggcgctaaccgcccgggctgagtcgcttctgctcgccgccgatcctgccgcggcgctgctggagtggctggccgagagcgtggcgtttacccatcagcatcgcgggatcatcgccccgctgatgagcgccatcgacaatcctgagtccgccctgcacagcgcctgcgttgccctgcgcgccgccggtacgtcgctgcttacccgcgcgcagcaggccgggctggcacggccagatctcagcggagaggagctgttcgatctgatcgccgcgcttgcctggctgcgggagcaaccgtcccatgccccgcgcgcagagcggattttagcggtgctggccgacgcgatcctgactgccggctagcggcggccggtcaccgacgagacagcgcgcctggcgggtaaccagaacaccagcctttaacgatcaaacgcccagcgagccccgctggtcagcgcccgctcgaaggcgggacggccggggcctgccagccagccggcgaaggtgtacagctgcgggtgcagctggcgcagggcgtcgaggtcggcgtgcccggccagccgcccgtcgtccaccagcccggtcagcttgtgcagaaaaggactggcggccagcacctcgtcggaaaatcgcgaataggggatcggccgtcccgccgccgcggagaataacacctccagctgacgaccggtcacgctgtcgctggcgatctcgaacgtcttgccggcaaaccgcgccggcgcggcaaaaaccgccgcgacaagatggccgatatcctccaccgccagcacctgcattctcccctccggcaacataaaaaattgaaaacgaccttcatcaaggccaaaaccaggcatcaccagcagctccataaaggtggcgggccgcacgatggtcgccgccagcggcaggcggcgaatatgccgttcaatttccgctttggtgtcataatgcgctacgccggtcggcgtctcccccgtcgcgctgccggagctgtacaccagatgcttcaccccgcactcgacggcgagatcggcgatggttatcccgtagcgtacctcctgctcatcggtcaccgtccctcccggcgaactgggctggacgctgaagacgccgtcgaccccggccatcgccgaccgcattgccgcccggtcttcaaaggttcccacgaccagctcggctccccgcgccgccagcgcagcggccccggcggagaaaggatccctgaccagcgcccgaacccgccagccgcggtgcagcagcgcccgcgccaccgagccgccctgctgaccggtggcgccaaagaccaacacgctttgcgcattattcatcactcttctcccttatctgcagcctgtttcccggcctctcgccagcgatagtcaccttgcttatccttctccagccagccgcaggaaggcccggcaaaatgcccggtgaaccattgagcatgatggcttgccccccacgccatcatctcccgtcgcgagacttccgcctgccggggatcgccgcagaacgctgaattccactgcggatgggcaaactggatcggggaatgcagaagatcgccggagaaacaggcgtagtcatctccggcggcgaggaccagcgcggcatggtccggactgtggccgggggtgggaataaagtcgatccgtccgccgacccgcggccgggtcgccacatcgacggtctccagctggccggcctcaatcaccggcagcaggctgtcaagccacagcgcccggtagcgttcgctgtttttcacccgcgacagctcttttgccgagcacagatagcgggcgttgggaaacagcggcacccagcgatcgtcctgccagacggtattccatccgacatggtcggtatgcaggtgagtcagtagcaccagggtcacgtcctccgggttcacccccgcggcgcggagattctccagatacggcgtgttaagttgatgatagagcggattgccgccgcgctcccgaccattgccggtggcggtatcgataacaatcagatcgtggggggtctgcaccacccagctgtggattgacagcgcaatcggctgaataacggcctccgcctccgctaccgggaacgcctctggatagagcgctgccggctgcagggaaatctcgcgctccggcactttgaaaatcaggctatcgcctgtctggtaagtttgcatcactccctccgcgcgcattgcgctggttgatttatcggggtgatattcactatgctgccgggataacccacattcaaattgattatcataatgaacaaaatcattgaaaatgattttagtcgtatcgatctgaatctgttgacagtcttgatggtgctgtaccgcgaagggagcgtcacccgcaccgcagaggtactgcatcttggccagccggctatcagcggggcgctgaaacggctgcgcgagatgtttgacgacccgctgttcgtgcgcagcgccagaggcatgctgccgacgccgcgggcgcaagcgctgatgaccgacctgcagccgctgatggaaaaccttcattcggcgatgtttggcgccggagagttcgtcccggcgcgcgcgcagcagctttttcgcatcggcctcagcgactggagcgaacactggctgatgcccccgctgttacccgggctgatgcaggaggcgcccggagtgtcactgcagtcgatagccgccgaccccttccaggttcgccagttgctggaggaggagcgcattgatgtcgcggtgtctgtcaacaaacagagccgcggggaggtggtcagcgagccagtgatgaccatgggagtcaccaccctgtggtcgccgcagcagatcccctgccgcgggccgctgtcggtgagcgactttgtcgcctgggaacacgtgatggtggcctatcgcgaaaccggccacggtgaaattgaccgccagctcgccagccagggactcgcgcggcgcgtgcgctttgccacgcagaatttctccacctttcccctgctgctgaccaccctgccgctgttcgccaccgtcccgcaggggctggcgcagcgctggcaggcgcagtatgcgctgcgcgcggacgctccgccggtagcgtatccggaatttacgctgtgcattttgcggcacaaacggcgggcgcaggatccggcgctgaactggctggtgacgaagttaaaacaggccatgcgcggccaataaccgggccgatgccccggcatcaggcctcgctgtgcgggggttgcagcacgcgcctgctccagtcataaaacgcgcgcaccgccggcggcagatagcggttttgcggatagaccagcgacaagggaagatcagaagcggcctgctccagacaggcgaccagcgccccgctctgcagataaggttgcgccagatagctggcgacgcggatcaggcccagcccctgaatgccggcctgaatgtaggcatcggtatcgtcgaccaccagcgtctcccgcatgcggatcgcgtagtcgccttcatcgagggagaaaagccagtcgatggtccgcccggtacggtgattcaggtagcccaccgcccgatgctggtgcagttcgtcgatgctctgcggccggccgtgggccgcgagccaggccggcgaggcgaggaccatccagcggtagcgggccagaggacgcgccaccagggtggtggaatcttcgatccgcccggtacggatcacgcagtcgaatccctcctgaataatatcttccacgttgtcgcttgagcagaggatcagctccaggtcgggatactgctgcaaaaactcgccgatcctcggcagaatgcagtggcgggcaagggattgcggcatccctaccttgaaccgcccggcgggctgagccgagcgcccgggaaaggaggcttccatcgccgccatctcggccagcagccttttacactcctcataataccggcgaccctccgccgtcacgctgagcttgcgggtggtgcgctggagaagctgcgccccgagccaggcttccagctccttcaccacccgcgataccgtggagcgcggctgcccgagcacctccgccgcgcgggcgaagctgtgggcatccacgaccgcaacatagacctgcatggcatccagtttatccatttcgttaccccccccggcgctcattatcccaatattacgaacagtctaacccgaaacgctgtacttatcgaatgtcgaccgtccccctacactgagcctgtagcccgtcaacacaaggcttaactgagcaaggagttaaaatgaaaactgataattttaatcatgcggaaaaggtattggtgctgggagcgggacaactgggcgccgccgttctcgatgcgctggtgcctgcggtaatcgagcgccagggcacggtctcggtcatcgtctcgccggcggcctgggatgaagccggccagctgcggtcggcaaaccatcaggcgctggccgacgccggagccaccttcctcgccgtcgacatcgccggtagcgccatggagacgctggccgatcagtttcgcggattcaccaccgtgattaactgcatggggtttgtcgccggtccggggacacagctgaaaattacccgcgcggtgctggcggccggggtaccccgctattttccctggcagtttggcgtcaattacgatgtggtaggcaaaggcagcggtcagccggtctgggacgagcagtacgatgtccggcccctgctgcgcgcgcagcgggccacggagtgggtcattgtctccaccgggatgtttaccagctttctcttcgaaccagacttcgatgtagtgaatttatccaaccgaacccttcacgcccttggcagctgggatacccaggtgaccgtcacctcaccggcggatattggccgcctgaccacggcgatttatctgcatcagccgcggatcgtcaacgaggtggtgtttgttgccggcgaaacgacctcttaccgacagttggcggataccgtggagcgcgtaacgcagcagacgttcagcaaagccgtccacaccctgcccgccctgctggagcagctgcggacaaacccggatgacgccatgctgcgctatcgcgccgccttcgcccggggggatggcgtgtggtggccgatgggcgacacctggaatgcccgccaccagctgccgacccaggacattgccggctggctgcagaccgcgcgctgattttctctcacaggacagaatgacgatgaacaagttaattccactgatcgtattgagttgtctgctgcccctggcggcaaatgccagaaccatcaccgccaccggcgataccctggaccacgcggagagcaaaatccgccagcatgccgcccgcgagggcgtgactacctatcgcatcactgaagcgcgaatgggcaacaaagcgcatatcacggcgaaaatcgcggactaaaccaccggcgtcaggctcagggatgagctgccggcagcccgcgcgccaggtcaggcgctcattttttcccgtcgacgatcgcggcccggcggcgcgccatacaggcgagcgtattcccgggtgaactgcgacacgctgatatagcccacctccccggcagcctgtgcaatactcatcccttccgccagcatcaggcggcgggcgtggatcaggcgtaactgcttctgaaactgcagcggcgacagcgtggtcatggcgcggaaatgacggtgaaagacagagacgctcatcccggcggcgtcggccagcgcgtcgacgctgactggctgcataaaatcccggcgcagcatcgccaccgcccggcggatccgcgccgaatggctgtctacggcgcccagcgcccggatggccggcccatggacactctgcaacagccagtaatgcagctcccgccgcagaccttcccccagcaccgccagcgcccccggttgatcaaacagccttgccagccggtaagcggcatccgtcacatcggcgttcatcggttcgataccaacgcggggcgcctcatccggccctgacggcccggcctcctgcagctcgcgcaggatagccaggtccagctccagcaccagcgcgtaatagggaaaacgctgactggcctcggtgatctggctggtagtgggaacatccgcggcgatcaccatcgcctcgcccggaccatagtcaaagcttgccaggccggtggtcacgctcttacgcccctggagcagcatggccaccagcggcctggcgatagccgcctgcaggtcaccaggatgcagggcccgcaccagagtaataccgggaaccggggtaactgccaccccgctgctatcgacatgagcatcggcaaaccggcggcagagatcgaacagagcgtcgcgcataagatcctttcaggcaagttttaaagcctgagtatgcgctatttcccggcaaaagggagtgaacggagagaaatgggcaaaaaataacaaggattgggcaacccggcccggtgagcctctcctattgtaaggactccacataccagagaggaccgaacatgactaagattgcacttattaccggcgccaaccgcggccttggccgtcagaccgcactggatatcgcccgccagggtggggatgtcatcgtcacctaccgcggcagtctcgaacaggcggaagcggtgggcgccgacatccgcgccctgggccgcaaggccatcgccctgccgctggatatggcgcaaaccgccagcttcccggccttcgccgacagcctcggcagcgcgctggccagcgtctgggggcgggccactttcgaccacctgatcaataacgcagggcacggcgaattcgccccgctggccgaaacgcgcgaagcgcagttcgacgggctgtttaacgtccacgttaagggggtatttttcctcgtacaaaccctgctgccgctgctggcagacggcgggcggatcgttaacttttcctccgggctgacccgcgtctcctatcctggcttctccgcctacgccgccgccaaagcggctgtggagatgctgagcgtgtacatggcccgcgagctgggcgggcgcggcatcaccgtcaataccatcgcccccggcgctatcgccaccgattttggcggtgggctggtgcgggacgacgcagaggtaaacgcgcagtttgccgccatgacggcgctgggacgggtgggcgttcccgaggatattgggccgatgatcgccagcctgctacgcgacgataaccgctgggtgaccgcccagcggatcgaggtgtcgggcggacaaaccatctgacgactcaggctggcaggatgcgctccagcgccaggcctgccagccgcacggtctccagaagacgcggcagactatccccttcccgcgctttcgccgacaggccaagcatcaacgtatccatatagtcagtcacccgcagcgcgtcctgcgggcgatggcgggcgatatactgctggattttggctcttgccgcagcatgccattcgcctgccgccacccgggcatcagcatcctgacaatgtaccccctccagcaccaggcagccggcggcggccggatcggccacatagcggcgagccgcctcctgcagtacggcgatgagcgacgccgccaccggctggtcgtctcgcagcagggcatcgatgggaatggccccggtctggctgtagcgctgcaggacgcgggtatacagcccgagcttactgccaaaagcggcataaaagctcggggggttgatgccgaaagcctgggtcagatcggccacgctcaccgcgtcgtagcctcgcgcgtggaagaggcgttgcgccgtttcaatggcctgttccgcatcaaactggcggggacgtcccggagtacgcccttgttttgtagtggtcactatattaatccttgacagcttgtttagccgcagcatattgtaatcatcactacaatatcatgaggtgcgggatatgacagcgtttcacaacaaatcagtgctggttttaggcgggagtcggggaattggcgcggcgatcgtcaggcgttttgtcgccgatggcgcgtcggtggtgtttagctattccggttcgccgcaagcggccgagcggctggcggcagagaccggcagcacggcggtgcaggcggacagcgccgatcgcgatgcggtgataagcctggtccgcgacagcggcccgctggacgtgttagtggtcaatgccgggatcgcgcttttcggtgacgctctcgagcaggacagcgatgccatcgatcgcctgttccgcatcaatattcatgccccctaccatgcctccgtcgaagcggcgcgccgcatgccggaaggcgggcgtattattgtcatcggctcggtcaatggcgatcgcatgccagtgccgggaatggcggcctatgcgctcagcaaatcggccctgcaggggctggcgcgcggcctggcgcgggattttggcccgcgcggcatcacggtcaacgtcgtccagcccggcccaattgataccgacgccaacccggagaacggcccgatgaaagagctgatgcacagctttatggccattaagcgccatggccgtccggaagaggtggcgggaatggtggcgtggctggccggtccggaggcatcgtttgtcactggcgccatgcacaccatcgacggagcgtttggcgcctgatacctcagggcggcgatgcgcgctttgcaccgccgccgcggggacgtcatcgcctgtcagggatcttcaggccaggctgtcgaccgccataaaaaagcgatcttcggtaagcataagccgcgcttccggggactggtgcgccttgcggatcatccagccctcctccggggccaggctcagataaaacacctcccgggatcccgcgccgtcgggcgcctcaagactcagggtcacgatccccttttccacgccatccaacagctgctgcggcacgatattgacgctgcgctcgccgttttgcagacgaatggccgggatatcgtagcggcagatgccgctgttgaggctgtagccaagggtactcaggtcgtggagatggcgggtcgaaatcaccacctcaataccggttccatcaaaccactgacttatctgctgagccagctccgccatctgctgacgaaacctggcgatatccgcggcggccgacccgtcgagggccgctgtccgccgcggattttgctgttgctgcagtttcttaaaaaaacgttccctcgctgtcacgttatctccctgtgctgtggtgaagccgctggggctggatcaagatggttatcgcccgttcgctggttacgaagattgagggcgaactggcgcgatggccccgccgcaaatgtttgtttttttttacgttacttcgccgcttcaggcctgagccgtagctggttgtgttcggcggtgaaaatgcgcggcttgtccggatccaattcctcacgcgccagcacctgcttccaggtatttctttgtgtgtccggatggcggaacaggccgacaaccgccacgaacgtcgcctccgcttccagcggcatattgagactggcgtcccctccgggaccgatcaccacatcgcgactggcgaggagatcggcggcgagcagaatatccccctcctccagcagctgctggtaaaccagccggtcaaaggtctggcgatctttaagctgatagatgcgcaccaccaccggttcagagagcgagtgattctctctggcatcggtgttgagcgcttcgcgcgcggtaaagtccagatgcagcgtattaattttcttataaaaaacggcgttgaaggcagactttgttccctccgagacgcgctgggtgagtccgcatccgctcaggcaaagcgcaagcaggggcagcagacaggcggttttagtcaaacttatacgtaacacgtcggtttccttgtagaaaggtggcaggctgcaggcccgtataggtacccagctcggtggtaaaggtctgaggaatatcgtcctcactctcgccctcacccacgcccagcacgccgttcataccgagccagaacggctcgtccccaagcggcgggacagccagcagtcgggtcggcgcggtcagggtgatgttggcccggaatcgccagccgaggtatacccgcagcaggatgagaaagtcccgaaacagcgggccgtcaggcttccagccctgcgcctccgcgggattgtcggtggtaagggcaacgaggagctggctgctggcatccatcgcttcgtcacccagcggcgtattgccgtccaggaagaagtcgtcatcgccgtaaaaccccagcggctggctgatcgccaccggacgcaggctgtacgggctcaccctgacggtggtctccggggccagcagggtgaccagcgcctggatcccctgctgggttttgcccggctgacgcagcacgccggttagcgccagaaagcgcgacgccggcgaggcgatatgctgcgtcgtgccggggatgcccagccccgccaggcccagtagcgactgcgagagacgatcggtgccgccgggctcaaaggtggcgggccaggagtatttccgccagatgcggtaaaactgcgtcatgatccgatggctgaagatatccagtaagccctgcagcgcttcatgcccttccctgtgctgggcgatatcatcgagatatgccgtcgggagcggcgaatcgacaccgtacaaccccataaaggtggtgcggatgaccggcggcctgctgtcatcggcctcatcgtattccacggctttcagttcgctggcgggaaatcccattcccggatgcgggtaaaaacgcaccggatcgtcagccggatggctggttccccccatcagcggttggccgggacgccgtttttccagaagctggcagaagcggtaaaaattgatccgcggcaggtcggcctccagccgcggggtcagccgggaatgcggcggctgtgcttctcttcccattccagtcgttctccggttggttgcagaatgataatcaggcggttgaacaagtagatgtcggtgtagagcgcgaagaagcggctaagcatctcgccaaacaggcatatatcgccacgtccggcaaagccgtgactgtcgagggtgacttcaatctgcacgccgcgcaccagatggccctgtgcaaagcgctctgttgcgcggtgcttcacgtcgaggatggcttccagacgccgacgattcatctcgctgtcggtccattcatacagcgccagggtgccgcgcaggacctccgcgttatccatcagggaaagaaaactgctgcccagatggctcagcacccgccagtgaaaacggtcctgggcggggggatagcacggcagcgtcggcgcgcagaggttccgcactgcaatactggcggaagtggttttcatcaccgtatcgagcacggtgctctgcagcgcgcgacgcggcagctggccgttggttccggtgagggtcagcgacaggctttcatcttccggtacggtatgattatcaaaggcttctccgccgacgataagccaggtgttgtacagcccggaggggccacggcgcacccgggtatgatagtaatagtccgccgcgtcatgacgcatcatgccgcctttgtggcgaaaacttgagaacggcgcgtaaacctgctggtgtgaggagatcacggaatcgacggtgtaaatttcggtgtggccgtcctgcacgcgcatcgggcgcagcgggtattcggtctgcagggaattgatggtcagcggatcggactccagcggaaacaggttgatcactggcacgcagtgcaggcgcaggtgcttttcgctgaagcggaagtcatgttcccagcgttccgccagcacgacgtcgatttcaaaccacgccagtccggccggaaaaaccaccgtctccagcccgcgcagatcgatgaacatgaacttttcgcggaaggtaaaatactccagcagcagctggtaaccgcgaaaactgcggccatcttcaggccagaggccgtcatcctcgccaaatcccagcgcgctgaaatacccgtccagcggccttctgtccacctcatcggggatgcgcagccacatccgggccacattgagggtaaaggcctcgtgcatggcgcaggccagcggcgcatcggcgttgcagtacagcgggatatgactgagatcgacccggcgccagtccgtcagctggctgcaggtaaagcgcagcgtgatcaccgaacggccatccgtatcggtggccagctggacgcgttccagggataacggctgcagagcgatcgctttggtggtggtgtaccggcagcgcgtgcccttttcaccgatcggccgggaaagcacttcaaagcctttggccatcggcatcggctctttcatttccgaccagtcgggggtgaactccacgaccgacatcgagggaatggtacgtaaataatgtggccacagcagactgaccacgccttcggtcagctcaggcagatcgtcatcgagtttctcgcgcatgcggcccatcaggaaggcaaaaccttcaaacagacgctcgacaaaggggtcgcgagcgcccgctttgtcgagattgagcattgccgcctgctcaggatgagcgcgggcaaactcttcacccgcttccagcaggtagcgcatttcagcgtcgtaataacgcaaggttaaatcgtccataaatcaccagtatgagtaatagctttcagatatgcagagaaccgcaggtgcagggagtgcaatgtgaatgatgcgtgaattatgcgcacagcaccgcggcgcgagcaggatccagagcgatgagcccggcaagcaatgactccatttctggcagcaagcgatttttttctgcctcactgcgcccggccttgcctctgagcagccggagtcggcgggctttgacctcaaagataagctccggcttccattgttcgagcgtcatttcccgggcgcggctgtcgagttccgccagcagatgcagcgccatttcattttttccgtactgctcgctgacccgcgccatcagtaagcgcatcagccaccgattgcggctggtggtatagcccggctgcgcctgtaaccagttcagcgccgactcaataccttcatcgtccgcgcgggtgagcacttctggctccagcgacagcacctcatcagcgctggtcgccgccattaccggctcatcttgccatccggccatctcatccaggacacgttcgttaagccagttgagcgtcacttcatcggcgaatggcgtaccatcgttaaacgccagggtttccagccccggcagacgagccagcagccctttcatatcccggcacaggatatcggcccgtacactgtcagcatccagtttcagcaacgcctgccaggcgtaccactgcacatccagccacagatggttgacgccttgcgccaacagcgtgtccgtatgctccagcagttccgaccagcttttctgtaaatacaaacgcttaagatgggctttactctcaggcttgggaggcaatagccgtgtccggccggaggcatccagcggcggtaactccgttaacgtatcccaacgcacactcttcatcagatgatgacctgccagccatccgccgggacactcacgcagatatttcgccagcaccttagcctgatcgagcaaatcacgacctgacgtgacggtatgcattaccggtgcggtgtccgtatgttggggtagcagatcgtgttcttcgcggctggtctgcggcaccagactgtgggctccgccgctttgcaccaggcggttctccagtatctgatatagcccggaaagatcggggcgagatgcttcagccaagccggaaaaagtggcttccgccagcaataacgccccgataatgacctgcatagtggtcatgtcgacttccggataaagagacaggctgtccgacatccggcgactgccaagccattccagcgctgatttacagctacgttcacgctgtggatggagcatagccccaaaccgctcaagcattgccgccagcagcgtaacgccctccgccagaccggtttcaccatcccgctgcagacgcgcccacacgtaaaaggtgatcacgcgcagatccttgcaggtctgagtcagcagtttttctgccagctggcaaatcagttcggtatcgacgccggagatcttattgacctcatcgcggatacgctgaaaatcatcgtcatagcccggatcgtccccggttggttgggcgtcactgattggcgcaagccaggactgccactgcgcctgacgtgaccgggcctgctggcgcagtacgctttcatccaactgactggcggcaaccaaattttgtaaaatactcataattccatctcatccatgtcactattccctacccccgtcgtcaggacctgtgcgctctcagccgcatcgacagtaaaaatctgatccggcagggtcaatccgcgcagcgccagaagcgccagcgggccgctcccaagctgggagcgcaatacccactgcagagtgcggccatccggggcggagaagctcatcatccactggctgcgatccagcggatggcgtttaccctgctccagccagcgaataaaaccccaggtaccgctgtagtcaccgaacaggcgcgtgcccgcattgacggtggtccaggtaagcagagtgccgggtttatacgtctcccccggccagcggaaagtctgccagtcggccatttgattgaaatagcgcagcttttggccgtctatcgtcagctgtgtctcgacaacctccggggcaggcctggcctgtaactcaaagctgatcccctggctgccgtcggtgaaaagaatgtcggacagctggcttagctggttgatcgcgcgcagaaaggccggattaaagaccaggccgtgactgttgaccttatccggcacccattgactgccttctttatgcaggacaccgttcagctccgtcgtgagaaaacgttcgattcgcccgctgtctttgcgcacaaactcagccagcatcggcagggaggcatcgcttttgctggcggcaaacggaaagcgtccgtcaaaggcggtgtgccagttggcgaccaccgagcggcgccatttatcattcagactggccgccgacggcagaagcacggtttcccaggcctgagtcagcggctgcacaaacagagtattaccgaagccactccactcttcgccaaggcttgccgaaatcaggctaccgtactgttgcgtgtcggtcaggtcgacgcttttcccctggaagacggtctgcgccaggacctgcatcatttcctgcggatcggaggcattcgcaacctgctgcaggcgcaggcgcacgcgggtgatacgggtcagataggtttgcaggctcagggtgctatcggccgacatgacgttgctgcccgtgtttttccccatcagctggagcagtgggccgaacgtgtcatccagaggcccctgcgggccggctgccgactggtcgatgaccggcttgtctttcccgcccaccagatctttggccgatttaataaggctgtccgacagcccctccctttgttgccccgcctgcccctgccaggcaagggtattcatcagggcaatcagcggcgactggcggacatcgcttatcagcgtgagctggtcggtaacatcggcaatggtggtcgccgggttgagtcgcaggctgttgagaaaattcagccagctgccggcgaaatcggtgaagtagcgtcgggtcagacgcgctttcagcgcctccggcgacaggtctgtcgacaccgttttgcgcgaatcgctcagcacccagtcgatttcctcccggcgcgagctggctgccttatcaatggcctgctgaatgccgccttcccatgccgggcgggtaaacatccccgggaccacttcatcggtggtaaacaggcggcgcgcgtcggtgccactggtcatgtcttccagcgacacatcggcaaaattacgacgcacggatttgagcatgttctcatataaggtgctttcggcattgcggcgacctagctgctgcaacagaacctgacggctctgactcacccgttgcgcatccgggatgatcttccactctggccgctcgggcagcagggagagataaaaggcccacaaatccggcgccagactttgccacagaccggtcgagatccccattcgcgtcggctggaccgttttcatggtctgcgcaaaaaatgcgccatcggctttatccggacgagccatcatcagccaggctttcagctggtcatagcccggtttcgccagcctggctcgttggtcgctattgggggcggagttgaccagcgcgctgagcgcctgctgcaacgcggcattggccgggtcacgtatcaggcgatgatttgccacaccgtaccagggtaggacggcgtttaatagttgctgatgatggtccagaccaaagcgccgataccagggcgctcccttctgcccatcgtgcacgagacggccggcctcattgcgcagggcatggagggccgtcagttgatagtcaaaaacggaggggtgggccaccaggtcgcgggcttttcccgctaccgaagcaatctgactgtaattgagggcaaaggagagcagcagtcccgccgcccacaggccgaggatggccagcagaccgcacgccaggccccgctcccacgccattcccacgtgatgcccgcgtaaacggcggcagtcatcgacgatccccagccaggtggcgggcagcgtcaggagatgaggctggcccgcaggcgaggtatccgcctcctgatacggatctacggtacgaggctctggcaggctaaacatcaggcctcgcagcgcaagccgctgccgcgaggcggtcagccacggcgccagctgccagcgccattgcgcgatccccccgtcgataagctgctgccccagacgcagcagaaagtcgtggcgggtatctgctgcgatctggtgcatcccctgctcccgtagcgtgggcaacatctgcgcaagctgacgggcgacatcttcctcagtggcgcgcaacgggaagctaacccctaccgcctgcaccgcgcggtcagcctgcggccactcactgtcgcacagtttccataaccagaccggggcggcatagcccagcagttcgctgattttttccagcccgtgcaggtcgctctcgcttatctgcggcgtcagggtcagagacgacggcatcacccgcacaatcccgtccagaggacggccacggcgcagcttgcgcagcgcggcgtatttttcttggtcgggctctgtgatcaggttaccgccgtaaatcagcacagtgcggttaccttcaagccactgctgctgacgcagaccaggcgccagttgttcgatttctgcctcgtcgccggtaaccagcagcaggcggactttgcgccgccagcgcaggcggtaacgtgcgtgaaggtgctttttcagcggggcataaagggcttcgcgcccggcgggcctggtgggttgccgcacaggcgctgctgaaggcttaaccttatcttttatcagcagtcgaaaggccataaaccccagtaccagcaggctgagtgccatcccccagataataaagcccgtggcgataagcgggcgcagcgtttcccactgcgtggcacgatccatcgcccatagccaccatgccagcccgcccaggagcaccagaagcgtgaccgcagcaatacagacgataaccgtagccgccacagagatagctgcaggtttattgacgttgtccatcaggttttacaattccaattgcgagggtattcaagggatcgcgggctagccagccacacggttgttggtagtgcgcggcgtagatcgccgccagcgacaggacggtcaagccttccatctcgccgatgtctccccaacaggcatcctggcgatacaggttgatatcccaaccgctgtgcgccagcgcttccagccccggctgaaaaaacagcgcacaggcttccggggggccgctcagttcgttctgctccagcacacgagcggctacagcagtcagggcctcccctttttctgcgcaatatatttcccccctggtcaggtgcaccggaccgtctcgtccggcgagccacagtaccgcagactctccggcgggttgcaccgcccccgtctgggcgacaaccacctgacatccggcgataagcacagtgtcatgggggtcagcttccgccagagcgtgtgctatctccgcgaggctggcctccccacgccaggcatacgggcgtgagggtagtgtcatctgcgcaacagtgagggtcatctgtgcacgaaacgcctgccaggcgagctccgttccctgccagtagcaacgcagcggcggcgtaagcgttctttcactgcgctgtcgttgccattccatcaccagtagttccgccagccgtttttcgcgggcgatagcctcagaaactgaaaggtatggcgctcgcagcgccctgccgccgccctcgttctcttcctctggcggacgctggtgacggcttagcacccgcagccagtcagtggtcgttttgcccatgggccccagcaacagaccttcctgtaacccgatcggctgccgatgctccgcccaccattgctgttgttcgtatgccaccagttggtcatagaacctggcgttatgcacgctcatgcggtagtacagcagccggatcaaccagccggtacctgccagcaccagagccaacaggatcccggtggcggccagggcgcttttcccttctgacgaggcaagtaaagcgctgaccccgccgctaagcaggaccagcagggccgaagccgatagccacctggccgtaccaggcggtcgcgcgtctccgtacgggggatactccggtaccggcctcactgatcaaccccgcagtctgggttagagctgaccagcgtgcagccgcaggcgcagcgatgaccgtgcagcgcaaccggctggccatcaatcgtggttcgtgcgctgccttcagcaatggtcgtcataccgtgtttgttacacttgaccgggtcgcccttgcaggcgaatcccagaccaaaacactgataatgccccatcagcaccctgcccccatactcccgcagggtatcgcctttgcgaatgactttattcatcggatcctccttatccgcgttcagaccgttgtcgtcagaacgtcctccagccagctggccggcagcgcggcttgcccccgcgccagctgctcttccgctttccgcgccttttgctgtgcgacaacggttcccggctcgtgggtaaatgcccgcagctgcgcccctccgggcagctccggcagcgcttccccggttatcttgtccagcaccgccacctccagcgagcgcacggcgcctgtcgcagccagcccggccagcttgccggtcaggcgcttttgccggaaactgagcacgacacccgcggtcacggtcgcaaaacccaccaggtctccggcgagcaccagcggcgagagcggtttactgcagcgctcgctgaagtaaatcatccggtagcggaagtagccggtccacatctcgcgcgtgccgagcgcggcatacataaaccaggcgcgtgagtcatgtatctggtcatcaaacagcgccctcaccagcccggcaggctgctccgcgttgctggcctccccggcctctgggaacaggacggccacccgggcctctccgtcacgcttcatgcgccggtattcctgcgcttcatcatcggtattcagaatgaaaatcaccggctgcagcacggtatccagcaccagctgcgccaggttatccgggatacggtaaccgtcgtggtaatcttttccgaactccttcgccgcgtcgaacagctgggtttgatccatctttgggtcaaaatccttcacgcccggctgcagaaccagctcatccatcctgtcaggaggctggtttgctatctggttctggcgagcactgagcaccttctcctgttctttatcacgaatcacttctgccgccttacgcgcggcaggcagcgcttcggtattcgtggcgcgctgatagaagggcgttttcagcatcgagcctctggcatagcggtcgatgcgccaggcggtgatccaggccatctgctcagcaatgacggtttccagactgccgccggcggcaggtggttcgtagtgagaggctgc

SEQ ID NO: 67 - DNA, 116715 bp, Unknown
  source: /note="Description of Unknown: KP2-Mcoc1 Bacteria Sequence"
gcccaaagcgggtgaaatagccgtcggcactgcgcagcaccgcgcggccggtgagtttctccaccacttcgcgccccagcgctctggcgatgcagaagcagagcccggccccgaccatggcgctgaaccacgacagcgccccgccccagaaggcgccgaacagggcggcgttcgccagggtaatcaggaaagccggcagcggagcgacgatcgcctggaggatcatcagcgcaaatgagaccagcgcggcctgcggcccccaggcggcgataaaccctctgacctgctgcggatccagggaggctaatgccgtcagactctgctgcagaaaggtacgcccgccagggaaccacagccaggcggccagagcggcggcgaccacgacggcaagggccagccgggcgcggcgcaggtgacggcgatcaggttgggtcatggcgcacctcctcactgcacgccgccacgcgacgggcgcgggcaaaccgtttacctatctgcaccagggcaaacagcagcccgccggcgagactcagtttgagcgcgaaggcgagggttaccccctcgcgggccagttcgctggccattaccgaatagatgaccagacccggcagggtggtcacggccgagatcagggtaaagggccagaagcggatcgccgtcaggccgtaggcgtaattctgaatattgtagggaaagagcggcaccaggcgggtgaggatcaggaaatcgcagccgctgtgggcgataccgcgctcaatcgcctgaaagacggtggtatggcccacatagcgctgcagcagatcgcgtccaagccagcgggcgattaaaaacgacagcgaagaggcgagggtggcggcggtaaacgagagcagggagcctgttagcgggccgaagagcatcccgccggcgatcaccagcaggctgccggggatcagacacaggatggcaatgataaacagcgcagcatagaccagatatccccaggcgccctgatggcggagggtgtcctgaagcagatgcaggtgagtcagcagatcgtggagaccgacgcggtggctgataacagccagcgtggccaccagcgcgagaagtcccagccctttaccaatggccggatgacggcttcttttgcatgagaggtgctcctgtacagtctggacgcggtggacatcaaaaagtgcgcgcgacagtatcctgttccgacaacggtcacaatcctttaccgtcgctttgttgattttgctcaggaaattctgccccccgcacagcgggaggcgagagaagggcgtgaattatggccggaaggtggcccacaccggcgcgtggtcggacggtttttccatcccgcggatctcgtaatcgatcccggtttccacgcagcgctgcgccagaggctggctggccagcagcagatcgatgcgcagcccacggttatcgtcgaagcctttggagcggtaatcaaaccacgagaaatgctcatgattgtcggggttagcctgacgccaggtatccaccaggccccagcccagcaggcggtccatccattcccgttcttccggcaggaaggaacatttgccggtgcgcagccagcgtttgcggttctcttcaccgataccgatgtccagatcggtaggactgatgttcatatcgcccatgatcagcaccggattctctttgttgagttcggtctccagatagttctgcagattctgatagaacgccgctttggccgggaatttggtttcatgatcgcggctttcaccctgcgggaaatagccgttaatcactgtgacgttgccgaagggcgacgggatctccgccataatgatgcggcgctgagcctcttcgccatcgtccgggaaaccgcggcggacggcaatcggcgtctctttggtcagcagcgcgacgccataatggcctttctgcccgtgataaaagacgttatagccgagcctggcgacctcttcgagagggaacatgtcgtcgtgaactttggtttcctgcaggccaatcacgtccggctggtgtttttcgacgatggcggccagttggtgtgggcgggcacgcaggccgttgatattaaaagagacgaatttcatagtcgctgccactgtgcaaggtgaatagtgcagggatggtagcagaaattcgccaggctggctgccaccggatgcgtcattctgccaatcgctgcgcatgagcgtgccgtgggtgccccttttgcgggcatgccgcgccaaaaaagggcaaatagctacgataaatttcgcagaggatcacaattacagaattatatcttaccgttgcataatttatcttctttaatcactgtttatccccctttgtcggatacttattcactaaatatgcattttatgtgaatagcgttcggctgtaactcattgattccgcgttatctcatccgatttatgcatttttatcgctggctggcacgaaccgtgcaatctacatttacagcgtaataactcatatttattaacattattgctacttttaatttaccggaagaggtcgatatgtctcagtcaattacgcgtaaccactttgatgaatggatgatgccggtctacgcgccagcggcgtttattccggtgcggggcgccgggtcacggctgtgggatcagcagggcaaagagtatatcgattttgccggcggcatcgccgtgaacgcgctggggcatgcccatccgcgtctggtgcaagccctgaccgaccaggccggcaagttctggcataccggcaacggctacaccaatgagccgatcctgcgtctggccaaaatgcttatcgatgctaccttcgccgaccgggtcttcttctgtaactccggcgccgaggccaatgaggcagcgctcaagctggcgcgtaaatatgcccacgatcgctttggcagcgagaaaagtggcatcgtcgcctttcagaacgctttccacgggcggacgctgttcaccgtctcggcgggcggtcagccggcctattcccgggatttcgccccgctgccgccgcagatccagcatgccgtatttaacgatctcgagtcggcaaaggccttaatcaatgagcagacctgcgcggtgatcgtcgagccggtgcagggcgaagggggcgtggtgccggccagcgtcgagtttttacgcggcctgcgtcagctttgcgaccagcacaacgccctgctgattttcgatgaagtgcagaccggggtcgggcgcaccggcgagctgtatgcctatatgcactacggcgtgacgcccgatgtgctgaccaccgccaaagcgctgggcggtggtttccctattggcgcgctgctggcgacagaggcctgcgccagcgtgatgaccgtcggcacccacggcaccacctacggcggtaacccgctggccggggcggtggccggcgaactgctgtcgatcgtcaacaccccggaagtgctctccggcgtcagacagcgccatcagtggttttgtgaacgcctgcaggcaattaacgcccgctatggcctgttcaaggagatccgcggcctgggactgctgctcggctgcgtgctaaacgacgcctgggccgggaaggcgaaaaccctcagtaacctggcggcggaagagggggtgatgattctgatcgccggcgccaacgtggtgcgtttcgcgccggcgctgaacgtcagtgaagaagaggtgaacagcgggctggatcgcgtcgagcgggcctgcgcgcgtttcgtggcaggagtctcatcatgatggttattcgaccggtggagccgggcgatttgcccgggctgctgaagctggcagcggagaccggcggcgggctgacctcgctgccggtggatgaagcgaccctcgcggcgcggatcgcccgctcgcagcagacctggcgcggcgagctaccgaaaagcgagcagggctatgtctttgtgctggaggagagcgaaagcggcgcggtggtgggcatctgcgcgatcgaggtggcggtggggctcaacgatccctggtataactaccgggtcggcacccaggtccatgcctcgaaggagctcaacgtctatcaggcgctgccgacgctgtttctcagcaacgatcataccggcagcagcgagctgtgcaccctgttcctcgacccgcagtggcgcaaagagggcaatggctatctgctgtcgaaatcacgcttcttatttatggccgcctttcgcgagcgcttcaatgagaaggtggtcgccgagatgcgcggggtgattgacgagcagggctactcgccgttctgggagagcctgggcaaacgctttttcgccatggagttttcccgtgccgactacctgtgcggcaccggacagaaggctttcattgccgccctgatgcccaagcatccgctgtatatcgatttcctttcccctgaggcacaggcggtgatcggcaaggttcatccgcagaccgccccggcccggacggtgctggagaaagaggggttccgctacctgaattacatcgatattttcgacggcggcccgactctggagtgcgacatcgaccgggtgcgggcgatccgcaaaagccgtctggtgaccaccgaggcaggtgaaacctcgcccggtgactggccgctgtgcctggtggcgaatgaacagtatcaccagttccgcgctctgctggtgcatgccgatccggatggcgacaccctgaccctcagcgcccgcgaactggatatgctgaagtgtcatgccggcgaccaggtgcgcatggtgcgcctgatccctgaggagaaaactgtatgagtctgtggattaacggcgagtggcggcccggccgtgggccaggtttcagtaaacaggatccggttaacctgaaggttgtctggcagggcgaggcggcggatgccgggcaggttgccgaggcggtggcggctgcccgccaggcgttcccgtcctgggcgcggctgccgtttgccgtccgtcaggcgatcgttgaaaagtttgccgctctgctggaagccagtaaggcggagctgacggcggttatcggcgccgagaccggaaagccgcgctgggaggcggccggggaagtgacggcgatgatcaacaaggtggcgatctcggtgaaggcctaccacgtccgcaccggcgaacagcacagcgacctgcccgacggcgccgccacgctgcgtcaccggccgcacggcgtactggcggtgtttggcccctataactttcccggccatctgccgaacgggcacatcgtgccggcgctgctggcgggcaataccgtggtctttaaacccagcgaactcaccccgcgcagcggcgaagcggtggtgaaactatggcagcaggccggcctgcccgccggggtgctcaacctggtgcagggcggtcgggaaaccggcgaggcgctcagcggccaggcggatatcgacggactgctgtttaccggcagctcaaccaccggttttcatctgcatcgccagctggccgggcaaccgcagaagatcctcgcgctggagatgggcggcaataacccgctgatcgtcgacgatccgcgggacgtggatgccgcggtgcatctgaccatccagtccgcctttattaccgctggccagcgctgcacctgcgcccggcgtctgctggtccgacgcggagaggcgggcgatgtcttcctctcccggctggtgacggtgagccaacggctgatcccggcagcgtgggacgccgagccgcagccgtttctcggcgggcttatctctgaacaagccgcgcagaaagtgcatcaggcctggctgcagcgggtcgccgctggcgcggtcaccctgctggagccgcggttattgcaggccgggacgtcgctgctaacgccggggattgtcgacatgcgcgacgtggccaatgtcgaggatgaagaggtgtttggcccgctgcttggggtctggcgctacgacactttcgaggaggcgattgccttagccaacgctacccgcttcggcctctcctgtgggttaatctccccggaacgggagaagttcgatcgactgctgcttgaggcgcgggcagggatagttaactggaacaaaccgctgaccggggcggcgagtaccgcgccgttcggcggcaccggggcgtccggtaaccatcgtccgggggcctggtatgccgccgattattgcgcctggccgatggccagccttgaatcgccgaccctgacgctgcccgccagcctgagcccgggtctcgactttctggccggggaggcgtcatgaccgcccgcgaagtcaactttgacggtctgcccgggctgacccatcactacgccgggctctcctttggcaatgaggcttccacccggcatcgctatcgggtgtctaacccgcagctggcggcaaagcaggggctgaaaaaaatgaaagccctcgccgacgctggctacccgcaggcggtgatcccgccgcaggagcgtcccaacgtgccgcttctgcgccagctgggctttagcggcagcgatgagcaggtggtggcctgggtggcgcagcaggagccggatctgctgtcggcggtgagttcggcctcggcgatgtgggtggcgaacgcggcgacggtgtgtccctccgccgattcgctggatggcctggtgcatctgacggtggcgaatctgcaggataaattccaccgcgccagcgaagcaccgactacagaggcgctgctgcaggcgattttccccgaccgcacgcgatttgctatccacccggcgctgcccgcctcggcctggtttggcgacgaaggggcggcgaaccataatcgtctcggcggcgagtatggtgctcccggcgtccagctctttgtctatggccgccgccgggggagcgaggaggcgccgcgtcgctatccggcgcggcaaacccttgaggccagccaggcggtagcgcgcctcaatcaggtcaatccccgccagctgatcttcgcccgccagcatccggcggcgatcgacacgggggtttttcataacgacgtcatcgcggtgagcaaccgtcaggtcctgttctgccatgagcaggcctttgccgaccagaccgcgcttctccagcagctggcgcagcgggtgccgggttttacgccgctggtggttcccgccagccgggtctcggtggcagaggcggttgccacctatctgttcaacagccagctggtgagccgggcggatggcagcatggcgcttatcctgcctcaggaagcgcaggagcatgccggcgtctgggaatacctcaatgagctgctggccggggataaccctatcgccgacctgcgggtgttcgatctgcgcgagagcatggccaacggcggcggtccggcgtgcctgcgcctgcgggtggtgttgacggccgaggagtatcaggcggtcaatccgcacgtcctgatgaacgatacgctgtttgccaccctcaatgactgggtggatcgctactatcgcgatcgtctcacccaggccgacctcgccgacccgcagctgctgcgggaagggcgcgacgcgctggatcggttgacccagatcctgcagctcggttcggtttatccatttcagcaataagggggcgcggtggaacattttctggcattaaccctggcggggcgtttgccccaccattttcacggcgagacggcccatttcctctggcactggctcggggaagggatccttgagctgacgccgcatgcgcgctgcgagcgcgggctggtactttcctgcgccattcatggcaacgaaacggcaccggtggagatagtcgaccacctggtgcagcgactggtccgggaggcgctcccgctgcgctggcggctgctggtgatcgtcggcaatccaccagcgctgcgggcgaataagcgctatctgcacagcgatatgaaccgcatgtttggcgagcgctggcggcagtttccgctcagtgaggagacgcagcgggcgcagcggctggagcaggcggtggcccgcttttatcgcgaccacgatggcccgcgctggcacctcgatctgcataccgcgatccgcgggtcgctacatccgcgcttcggcgtgctcccggcccgcgatacgccgtggcaggaggattttcttcactggctgggcggcgccgggctggaggcgctggtgtttcatcgccagcccggcgggaccttcacccacttcagctgcgaacggttcgcggcgctggcctgcacccttgagctgggcaaagcgctgccgttgggggaaaacgatctgacgcagtttgccgccgtccagcgggcgctctcccggctgctggtgggggatctggccattgccgacgccccagcgccgctgcgctaccgggtggtacagcagctaacccgccatagcgatgatttccgcttgcatatggcggatcagacgctgaacttcacccccttcgaacccggcacgctgctggcggaggagggcgagacgcggtatgtggtggggcctgagacggagtatgttctgtttcctaacccgacggtggcgaaaggactgcgcgccggcctgatgctggagaaattatcctgagggcaagccgtccgccgggcggcctgctttattgtgcgcgtcttttttcgccatcttattttttcgtgctccactgtaaatttgcagattattcctggtaaaatgctttgtttttaatctcccctcctttatactctccataatttctctgcaaaacagtaagttatttattttttattgcaattcttcggctaaattccttattttctccataattggcgagaaactgttttttacactttcattgttttactcttgctctgactaattgacgattaacgtcgtaaagttaatctcgtcaacacggcaacgcgccgtaagaataacgtaaagtaaggattgaatgatgaagaaactcactgcactgtttgttgcctctactctggctctgggcgcggctaacctggcacacgccgccgataccaccaccgcgccgagcgacagcaagccgatgatgatgcatcataaaggcggcccgggtcagcatgacatgatgtttaaaggcctgaacctgaccgatgcgcagaagcagcagatccgcgacatcatgaagagccagcgcgaaaatatgaaacgtccgtcccttgaagaacgccgcgcgatgcacgatctgatcgccagcgacaccttcgataaggcgaaggcggaagcgcagatcgataagatggaagcgcagcataaagcgatggcgctgtcccgcctggaaacgcagaacaagatctacaacattctgaccccagagcagaaaaaacagttcaatgctaattttgagaagcatctgacagaacgcaacgcgccggcaggtaaaatgcctgcacctgctgaataatgtagcgcaccgaatcaagaccgccggtcttgcccaataatgccatcaggcgttgggcagggccggcggttttttattggtggcttctcagccaagcggatgcagcggatagtctccgctgagcaaaggcttacagaggatcttgtaaccatcctggtcaaatccggcgggcagacgggtcaactccgccgcctggtcgagcgattcaacggcgcccagccacagccagttatgaatgacgtgatactgcgtcatgtccgggccgcgctcctccagcgccacgggccccgcccacggccagcacaccagctgcagtctgctcatctgcgccagcaggcgctctctgtgcgcctccacgctctcctttccacagcaggccccggcgcagcggcccagcgcggagcgaaagcaggcgcggccgcggctgagtggttccagaccaagcaggccataacagaggcgctgttcgtcagcgaggctctgcagcatctgcagcgccgcccgccggttggcgaacaggccatagagatgctgctggtgcgagaaatcaacctcacgggcatagacaatctgcggccggtcgtccgcaagtagccaggcgcagagctgcttgttacgccgtagccgcttgttaaacagcggctgctgctctttaatcaaccgcgcctccagcagcagcgctcccagctcgccagcggtgcgctgccaggtgatacgccgcgactgacgcagcatcgcggcctcttcaggggtgcgcaggtgggataacacccggctgcggaggttgacgctcttaccgatatagagcggcatcgtgtcgctgtcgccgtgaaactgatagacgcccggcagcttcggcagcgcctccagccacgggcgaagatgttcgggatattcatagatcgccgccgcctcaaactcgagacgcggggctgattgctttctggccacaataactcctggtactgtctatccatccagtatagcaggccatttttgcggcgaaaaggacaaaaaataaccccggcgcaggccggggcggggggagagactattttttccagaaatcgtcaaagacggtgatcggcggccgacgcttgtgttcggttttcagataccagccctcgatcgttttggcgatgctcgggtccagcgttttgccttccagataatcgtcgatgttctcgtaggtgacacccagggccacttcatccggcagggaggggcgatcgtcttccaggtcggcggtgggcagcttcttatacagatgttccgggcagccgagatgggccagcagctgtttgccctgacgtttgttcaggcggaaaattgggttgatgtcggtgccgccgtcgccatatttggtgaaaaagccggtaatcgcttccgccgcatggtcggtaccgaccacaactcctttggtcattccggcgatgctgtactgggccttcattcgctcacgggctttttcatttccgcgaacgaagtcgctcagttcgatgccagcttcgcgcagcgcctgttcgctggccagcaccgcagctttaatattgactgtcaacacccggtcaggctggataaatgcgatggcgtcctggcagtcctgctcatcagcctgcacgccatagggtaaacggacggcgataaactgcaggctactgtcgccggtttcggcacgcagttcgttaatcgctatctggcacagttttcccgtcagggtggagtcctgaccgccgctgatacccagcaccagcgatttaataaacgggtaggtctgcaggtatgacttcaggaaatcgacgctgcggcggatctcgcctgcgacatcaatctgcggctttgcgcccagcgcctgaataatctcttgttgtagcgtcatcgcgccctccgaaagtgaatctgtttggcaagctgttggcttaaagctacctctttgccgctgaaacgacaaggaccggggttttgactgccggaaaagaaggcaatcaatgacataggttttcattatagatgctgtaccgcgcattgcgccgccgtccgacgtcggcagaacaatcctgtttacgcaataacataacctgacatgatttcgctgttcggcttgaaaaataacactatttattccaggcttatcgttacacagtagaaaagaggaaccaaaatgaacaaaagcttagcaggaatactgggcgtcaccgtcgcgttaaccttactggcgggctgtaccgcttacgatcgtaccaaagaccagtttacccagccggtggtgaaagatgtgaagaaagggatgtcgcgtcagcaggtgatgcagatcgccggcaaaccttcaacggaagtcaccatggtccatgcccgcggcacctgccagacctatatcctcggtcaacgagatggtaaagttgaaacctactttgtggccctcgacgaaacgggtcacgtcatgaactccggctaccagacctgcgccgagtatgataccgacccgcgcaacgccaggtaagcttcctactgtttactgacttctacgtaagcccgaccactggtcgggcttttttgtgagtaatgatgcttatttaattgcgcgaattatttggatgaaaatgtgagggtagtcaaaaccggaggtcaatgagagacaattctgttcaacagcgaattatcctggcggctcagcttgccgtatactcaactcataaacagaattaaccggatgttaccagtcttaccggctctcagcggttactgaaggccctggtctcacacattgaggaagcgttcatggaaaagaaacacatttatctcttctgctcggcaggcatgtccacgtcactgctggtctccaaaatgcgggcgcaggcggaaaaatatgaagtcccggtcattattgaagcctatcccgaaaccctcgcgggcgaaaaagggccggaagccgacgtagtattattagggccacaaattgcgtatatgttaccggaaattcagcgcctgctgccgaataaaccggttgaagttatcgactcccttctctatggcaaagttgatggtttaggggtattgaaagccgccgtcgcggctattaagaaagctgcagcacaataattttaacttttaaaactcgatgtattttgacgcctggcggctgcctgttgccggacgtcaaaaaataatgagtttattttcccgtcaaagagtaatttcatacatcatcgccgtaatagtttattgcggcttttaagggtattgactatgagtaaagtgatcgattcgcttgaaaaggtactccttccttttgcagtgaaaataggaaagcagccgcatattaatgcaataaaaaatggatttattaaattaatgccgttgaccctcgccggggccatgtttgtgttaattaacaacgtttttctgagcttcggcgaaggctctttcttttattccatgggcattcgcctggatgcctccaccattgaaaccttaaacggctttaaggctatcggcggaaacgtctataacggcaccctcgggattatgtcgctaatggcgccgttctttatcggctccgcgttggcggaagagcgcaaagttgacccgatggcagctggcctgctggcggtggcggccttcatgaccgtgaccccgtatagcgtgggcgaagcctatgcggtgggcgccaactggttgggcgggcagaacatcatctccgggatgattatcggtctggtcgttgcggaactgttcaccttcgtgatccgtcgcaactgggtgattagactgccggacagcgtgccggggtcggtatcacgctctttctcagcgctgatcccgggcttcttgatcctctccatcttcggcattatttcgtgggccctggcgagctatggcagcaacttccaccagatcatcatggactctatctcgacgccgctggcggcgatgggcagcgtggttggctgggcatacgttatctttaactctctgctgtggttcttcggtgtgcacggttctctggcgcttaccgccctggataacggcatcatgacgccgtgggcgctggaaaacatcgcgctgtacaaccagtacggctctgttgatgcggccatcgaagcgggcaaacagttccacttctgggctaagccgatgctcgactcctacatcctgctgggtggctccggggcgacgctgggtctgattatcgccatctttatcgcttctcgccgcgctgaccatcgtcaggttgctaagctggcgctgccgtcaggcatcttccagattaacgaaccgattctgtttggtctgccgatcatcatgaacccggtgatgttcatcccgttcgtgctggttcagccgattctggcggccattacgctggcggcctacagcctggggattatcccaccggtgaccaacctggcgccgtggactatgccgaccggtttgggagcgttctttaacagtaacggcagcgttgccgccctgctggtggccctgttcaaccttggcgtcgctaccctggtctacctgccgtttgtggtgctgtcgaataaagcgcagaccgttatcgagcaggaagagagcgaagaagacatcgctaacgcactgaaattctgataccgcgcggtacgggcagcgtcccgtaccgcctgaaaatgagggaaatattatgtttgatctggacaacatcgacgcggtagagaccccggaaaatgacctcgaagaggtagtgatggggctgattatcaactccggacaagcccgtagcctggcctatggcgcgctgaagcaggcgaagcagggcgactttgccgcagcgaaagcgatgatggagcagtcgcgccaggcgctcagcgaggcgcatcgcgtgcagacccagcttatcgaaagcgacgagggcgaagggaaaatgaaggtcagcctggtgctggtgcatgcccaggaccatctgatgacctccatgctggctcgtgagctggtggccgaattgattgagctgcacgagaaggtacaataggccatcgcgacgatgaggcagcccagaatgatgaccaccgagatcagtaccgcccgagaacaacagctgttcaacgggaagaactttcatgtggtcatctataacaaaacggaaagcgtgagcgggcttcaccagcatgattactacgaatttaccgtggtgttaaccgggcgctattaccaggagatcaatggcaaacgggtgctgctggagcgcggggatttcgtctttatcccgatgggctcgcaccaccagagcttttacgagttcggggcgacgcgcatccttaacgtcggcatcagcagacgcttctttgagaaacactacctgccgctgctgccgtttggtctggtggcttcgcaagtctacgccgtgcagagcgcttttctcggctacgttgagtcggtcatcgcctcactcaattttcgcgaaacggaatttgacgaatttatcgagctggtctccttttatgtcattaaccgtttacgccactatcgtgaagagccggttgccgacgtgacgccgcaatggttaaaaaataccgtggaagccatgcatgataagctgaaattcggtgaaggcgctctcgaaaatatggttcgcttatccggaaaaacgcaggaatatttaacccgggcgacccagcgctattatggtaaaacgccgatgcagataattaatgatatccgtatcaactttgccaaaaaacagctggaaattaccaattattcggtgacggatattgcgtatgaatcaggttacagcagcccgagcttgtttattaaaacctttaaaaaactgacgtcgtttacgccgagcagttatcgcaaacatttgaccagtattaattaaacccgcgcggcgttcgccgccaggtttataccgaaaatcattcaagttaactgtccgcattgttgcggagagcggcctgcgtccaggcgcagcgcctaagggagaaaaagatgagccagaaattaaaagtagtcactattggcggcggcagcagctataccccggaattactggaaggatttctgaaacgttatcatgaactgccggtaagcgaactgtggttggtagacgtcgaagagggccaggagaagctcgatattatccacgcgctgtgccagcggatggtggaaaaagccggcgtgccgatgaaagtctataaaacgctggatcgccgcgcagcgctgcagggcgcagatttcgtcaccacccagctgcgcgtgggccagctgaaggcgcgtgaaaaagatgagcgcatcccgctgagtcacggctacctgggtcaggagaccaacggggcgggcgggttgtttaaaggactgcgcaccatcccggtgattttcgatatcgtgaaagatgtgcaggaaatttgccccgacgcatggatcatcaacttcaccaacccggcgggcatggtcaccgaggcggtctatcgccacaccaatttcaaacgctttatcggcgtgtgcaacattcctatcggcatgaagatgttcatcaccgacgtgctgcagctgagcccgagcgatgagctgaatatcgacctgtttggtctgaaccacctggtgttcgtccgcgacgtgctggttaacggcgtctcgcgcttcgatgaactgctggacggcgtggcctccggccgtctgaccgcgaactcggtgaaaaacatcttcgacctgccgtttagcgaagggctgatccgctccctgcgcctgatcccatgctcttacctgctctactactttaagccaaaagagatgctggcgattgagatgggcgagtactacaaaggcggtgcgcgcgcccaggtggtgcagaaggtggagaaacagctgttcgagctgtataaaaacccggatcttaacgttaagccgaaggagctggagcagcgcggcggggcctattactctgatgccgcttgcgaagtaatcaatgccatctataacgacaagcagactgagcactatgtgaatatcccgcatcatggtcatgtcgataatatcccggcggactgggcggtagagatgagctgcaccttaggccgcgacggcgcgaagccgacgccgcgcattactcatttcgatgagaaggtgttagggcttatctacaccatcaaggggttcgaagtggcggccagccaggcggcgatcagcggtgagctgaacgatgtcctgttggcgctgaacttaagcccgctgatccattccgatcgtgacgccgaacagctggcgcgggagatgattctggcgcatgaaaaatggctgccgaactttgcggcgacgatcgaaaaactaaaatcgtaacgggagtagcaaatggaacgcgtattgatcgtcaatgccgacgacttcggcctcagtaaagggcagaactacggcattatcgaggcctgtcgcaacggcgtggtgacatcgaccaccgcgctggtcaacggcgcggccattgaccacgccgcccagctgagccgcagtactccggagctggcggtcggtatgcactttgtactgacgctgggcgagccgctgtcggccatgccgggattaacccgcgatggccggctgggcaaatggatctggcagcaggcggaagaagatagcctgccgctggaagagatcgcccacgagctggcgtgtcagtaccatcgttttgtcgaactcttcggccatgagccgacgcatatcgacagccatcaccatgttcatatgttcgcccagatttatcccatcgtcgcggcctttgcccgcgagaagggcattgcgttacgcattgaccgccaggtggcggcgcagagtgggctcgaccagcaggcggcgcgcagcagcgccggcttcagcagcgagttttacggcgaagcggtctctgaggaactgtttctgcagacgctggatgcctccatcgcccgcggggagcgctccctggaggtgatgtgtcatccggcttatgtcgatcggatcattatgggcagcgcctactgctatccgcgactggatgagcttgatgtgctgacatctgcctcgctgaaagcggcggtggccgaccggggttatcgtctgggaacctaccgcgacgtgtaagcccgacgggggaaagggaaagtgaatcaagcccggcacagcgtgccgggctttttactacgccggaatagcggcgattttcgggcttctcgaccacacgcggtgggccgtcatcagggcgagcagtttgtccgccgctggcgtgtcgagcgcatcggtgacgatgaccccctcttcaccctgggtcggaacatgcagaacggacgtcagctgccgcgcatcccctgccagcaggatcggcttcagatgtttataggcttccagcaggtaatagcgcgcgtcaccgctctgactcagggcgctgaggtcgccgccgggcaccaccaccgcatccaccgtcagcgacggggaaccggcgaaggtgccggcgatcggcagcggagaaccatcgtcggcaatgacttcgcccattcgcgagtagagcagcttgctgtgcacgccctgggcctgcagcgcctgcaggagctgaaccagatcctgcgctgaggtgcgttcgttgagcaggactgccaccacgcgacctttcacatctccttcggcgtcggcgtagaggctgaggctggggtctttctccacgccattgaccggggcgggcagggtaatgttgcgctgatcgtcgctcagttcgatccctaagttcgccccaaccgcttccgcaagcttagtatcaatgtgggccagatgatcgaccacccgctcgcggatccaggtgcggaccactttgctgagttcgaagctgaaaccatcgataatatgctgctgttcaatcggcgtctggctcagccagaacagacgcggctgggcgtaatattcgccgaacgaagggctgcgctggcggattttttcgccgtcgacgcgctcggcgagggactcaaagccaccgcgtttggcggcaggcggcgtctcgcgcggccagttgtcgttaatcgagttgggctcgtagttggccggattggtgtcaatgtccatccggtgcatcccgtcacgctggaaattatgatacgggcaggtcggacggttgatggggatttcatggaagttcggcccacccaggcggctaatttgcgtatcggtgtaagagaagagacgcccctgcagcagcggatcgttgctgaaatcaatgcccgggacgatatgtccgggatggaaggccgcctgttcattttcggcaaagaagttatccgggttgcggttgaggaccattctgccaacccgctgcaccggcaccagcgcctcggggatcagcttggtgggatcgagcaggtcgaagtcaaaagcaaattcattctcttcggggatcaattgcaggccaagctcaaattccgggtagtccccggcttcgatggcctcccatagatcgcggcgatgaaaatcggggtcgcggccggtcagcttctgcgcttcatcccacaccagcgacgccttgccggcgaccggtttccagtgaaagcgaacgaaggtggctttgccctcggcattaatcagacggaaggtgtggatcccgaagccttccatggtgcgatagctgcgcgggatgccgcgatccgacatcgcccacatcacgttgtgcagcgtttccggctgcaaggaaacatagtcccagaaagtatcgtgggcgctctgcccctgtgggatggcccagtggggttcaggcttcacggcgtggacaaagtcggggaacttcatcgcgtcctggatgaagaagaccggtgtgttgttgcccaccaggtcaaaaatcccttcgtcagtgtaaaacttggtagcgaagccgcgaatatcgcggacggtgtccgccgaccccgcgccgccctgcacggtggaaaagcgtacaaacaccggggtgattttatcggctgacgaaagaaaatcggctttagtcaacgcagccaggcttttgtagggctggaagtagccgtgggcggcagagccgcgggcatgaacgatacgctccggaatacgctcgtggtcaaagtgggtgatcttctcccgcaggataaaatcttccagcagcgttgggccgcggctaccggcgcgcagcgaattctgatcgtcagcaatgcgcacgccctggttggtggtcagcggaaaatcttccccccctttgcgttgcgcctccagggaatccagtttgctgttatgagtatcgggcgctttcaggctgcctggggcggtgggttcgacgcccggagcggtaggtttcggcgtggggcgccactcccgatcgtccggcgccagcgaatcgagacccggctgcgcttcctcgctgtcgtggaccggtgcctgctgttggtgagggttcgggtgcttatcagacattactcgtctcctgctttcattgctaaaagtggtcgttgatagaccaaaacccttctaactatagaacattacgttgtctgcgcccggcgagggggcagggagttatcctaaaatgcgcatcggcggcgaaggggcgacgaacggggccacaatcggctatgatagaggtttctatttcccgctatgtttagtgaatccatttgttatgaaaccattgcgccaacaaaatcgccctgtcattagctacgtgccgcgcgtggagcctgcgcccccggaacatgccgtgaaaatggaccattttcgcgatgtctggattttgcgcgggaagtatgtcgcttttctgctgatgggggagcatttccgtcgctcaccggcattcagcgtgccggagtcggcgcagcgctgggctaaccaggtgcgtcaggaaggtgagattgaagcctgagtcggctgcagaaataaaaaaaccgctgaatgatcagcggtttttttgtgcttgccgtttagcgatgcgccagttcggcttcttcctcgctatcgaagatcgacttgtcggtctggcgcagccactggctggtcagcgtcccggcggtcattgagccgttaacgttcagcgcggtacgccccatatcgatcagcggttcgacggagatgagcagggctaccagggtcaccggcaggcccatcgccggcaggacgatcagcgcggcgaatgtcgcgccgccgcccaccccggcgacgcccgccgagctgacggtgacgatgcccacgagggtggcaatccacataggatccagcgggttgatgcccacggtcggcgcgaccatcaccgccaacattgccggatagataccggcgcagccgttctggccgatggtggcgccaaaggaggcggagaagctggcaatcgactccggtacgccgagacgacgggtttgcgcctcaacgttcagcggaatggaggcggcgctggagcggctggtaaaggcgaaggtgatcaccggccagactttacggaagtacttcagcgggctgacgccgttaatcgccagcagcaggccgtggacgacaaacataatacccagcgcaatgtacgaggctaccacgaagccgccaagcttgatgatgtcctgcaaattcgacccggcaaccactttggtcatcagggccagcacaccgtaaggggtcagctgcatgaccagacgaaccagcttcattacccagccctgcagggtatcgatcgcggtcagcacgcgctggcctttttccacatcctctttcagcaacttaagcgctgcgacgccgaggaacgccgagaaaatgacgatgctgatgatggaggttgggttagccccggtcaggtcagcaaacgggttcttcggcacgaaggaaaggatcagctgcgggacgctgagatccgctactttccccacatagttgctctggatggcgttcagacgggcggtctccgcgctgccctggaccagaccctcggcggtgaggccgaacatattggtcaccagcacgccaaccagggcggcgatcagggtggtgaacaacagagtaccgatgctcaggaagctaattttccccagctgcgaggcattgtgcaggcgggccaccgcgctaaggatggaggcgaagaccagcggcataacaatcatttgcagcagctggacgtaaccgttgccgacgatattgaaccactggatggaatccttcagcacctggctgtcagacccgtagatcagctgcagcgccagaccaaataccacgccagtcgccagaccgaccagcacttttctggccaggctccactgtttatgacgtgtttgccccagcgcaaacagtaatacggcgaacacgactacgttcgctattaatggaaagttcatccccgttctcctgatatttttataacctgggctggtggataaccagctcttatgacggcaaggttagcagaaggcgttatcaaggacttatattcaaatggaatgggttataaccaaatggcgttttccgccgctttatcgcccactctggtgacttataaagcgattgaaggtgatctgcagggaattgatcaccccggatgaccagcgtatcgcgctgttgtccgccagcgtctgcggcatccagacggcatagacgaacagcgccatacacaaggcgcgttcgagctgattgcccttgcgcggcgcaaggatcggcagccggaagcgccagcgacagggccacagcagcggcacaccggcgggggtgagcatatcggcgagaatgtggctgagatagcccagcaccaggccctggagagcgtctgccgggacaatccagctgtcaggcactttcagatagaacagcgtcagcgcgccaaagacggccagcaggctgtgggtgaagccgcggtggccaaaggcccgcgccacgggctttgagatccagctcagccgttggccaagaaacgacttggggtgatcgatgtccggcagcaggcaggtcaataccgccgagggcacaatatgccaccagtcgccctgcgccagcaccggcgttaactctgcgtttttggcaaatactgcgcaggcgattgaaaagaagagatggccttccgccgtcatgataacacaccctaaactgtcgattcatacagtatagggtttttatacagtgtacggaagaggtgacggtgtaactctttgtcacaaactctcagcgcgccaaccatccgccatcgacggccagcgtatagccgttaatatagtcggccgctgatgaggcgagaaacaccaccggcccctgcaggtctttcggcgctccccagcgaccagcgggaatgcgctcgaggatcgcctggttacgctcttcatcttcgcgcagcgcctgggtgttattggtggccatatacccgggcgctatggcgttgacgttgataccctggccagcccattcgttggccagcagacgggtcaaacccagcacgccgcttttcgaggcggtgtaggaggggacgcggatcccgccctgaaacgagagcatcgaggcgatgttaatgattttcccgccttccccctggcgaatgaactgcctggcgaccgcctggctgagaaagaaaaccgctttgagattcaggtcgatcaccgcgtcccagtcgctttccgtgaaggtcagggcatcatggcggcggataattccggcgttgttgaccagaatatcgacccggcccatcgccgccaccgcctggtcgaccagaccgctcatatcattctcttgactgagatccgcctgaatggcgtgaaagcggcggcccagcgccagcacctgggcggccgtatcatggggaattttacggttgatgccgacgatatcgcacccggcctgcgccaggcccagcgtcattccctgtcccaggccggtatcgcaaccggtcacgatggcgaccttacccgtcaggtcgaaggcgttcagtaccatattcacctctgtcagctgatctactggcgtacgatgacgccacctgtgaccagcatagagggaggaaaacaaaattacaattaaaatgaaacaatgttttgattttgttgctggcggcgtgacagcgattgttgcacccgccagcggtcttagccgagcaagttctcagcagtgagtgccagcagtgacgaaagcttgacgtccgccagcgcaaagcgcgggtcgcggctgttctccgcttccggcaccacgatagaccgcatgcgcgcggctttgctggcgatcatgccgttgaccgaatcctccagcgcgacgcagcgctgcgggtcgactcccagggcagcggcgcaattgaggtagacctgcgggtgcggtttgctccagggtaaatgctccgcggaggcgagagcatcaaactggtcgcgcagttcaaacatatcgagcactttctccagcatcatcagcggcgaggccgaggccaggcccacctttaagccctgagctttacacagggccactgcctcgcgtacgcccggcagcagcgggcgtgaggcttccaccagctcaatggcgcgacgaataatgcgcgcggtagcttccgcccggtctacgccgtgccacggctgctgcgcgtaccacagatccaccaccaggtcgattcgcagaccgagcaggtcgggcagttcatcgcggcgacgggtatccactcccaggctctccatgacctcgacctccgcctgatcccagagcggctccgagtcaatcagcaacccgtccatatcaaatatcgcggcctcaatgcggcgcttcgctgacatatgtccttctcctgttgcgtaatcagataaacgaatcggcaatcatggtatatcataccgcgcattattgggcgaaattcgccatggcagatagacttatacccgacatactcgggggagcgagggaagccagcgccacgcaacaggcagcaggcgaaccaccaacgcgtctttaacaaggggaactcatgacgtaccaacaagctggacgcatagcggttatcaaacgcattttaggatgggttatctttattcccgccgtgctgtcgacgctgatttctgtgctcaaatttatgtatgagcacagtgaaaagaaacccggcattgatgcggtaatgatggattttgcgcacgtgatgattgagatgatgcgctttaacacgccgttcctgaactttttctggtacaactcgccgctgccggattttcaccatagcctgaacatcggcttctggatcatcttcattctggtgttcgtcggcatggccctgcaggcttccggcgcgcgaatggcgcggcaggcgaaatttctccgcgaggggattgaggatcagctgatcctcgaacaggccaaaggcgcagatgggttaacccgcgagcagcttgctgaacgcattgtggtaccgcgccatactatcctggtgcagtatttcccactgtacgtgctaccggtgatcgtgattgtcatcggttacttcttcttttcgctgctgggctttctgtaagtcaggtgcccggcaagccgggcaccttcttattccgctggcagaggacgtggttttccctgattatcaacggcaacgtagataaacagcgcttccgtcgccttgtagcgctggccaatcggttctgaagagacttttttcacccacacttcgatattaattgtcaccgaggtgttgccgcgcttcacgcagcgggcgtagcagcacaccacgtcgccaacggcgaccggacgtaaaaaggtcatcccatccacccgcacggtcaccacgcgaccctgggcgatctctttggccataatggcgccgccaatatccatctgcgacatcagccagccgccaaaaatatccccgttggcattggtatccgccggcattgccagggtgcgtaaaaccatttcgccctttggggcgagatctgttgttgtcatgctctactctgctgtggtcaaagacgatcagcgggatgctactatgaaaatagcgcagtgagaataggggaatacgcccgctggcgcgggcgcggtggttcagaaggagagggtaacgccggcgtaatacgcgcggccaggctcattgtaggtcgaggcgccggcattttcgcgatacagttgtttatcaaatagattacttattccggcattcaggcgaatatcccggtttagctgatactgagtaccaatacccacgatggaataggcgccaacctcggtggtggcaagggtcccggtttcgttgcggatctccgcatactgacgcggcttctgacggccataaagcgtccagttcacattcgcagacagggcgtcgtttacctgccagtcgagcatcgtgttaacggtatatttcgggataaccgacagcgggttgccagtctctttactttcagatttgagcatccaggtggcattggtccgccagctgaggacatctctcagcaccgggatcagcagatttccttccagcccctcgaccacggctttgctgccgttctgccattgcaaaatattattgccgctggaggtatagcccagtacctctgttccggagacgattttgtttttgtaatcgttgcgaaaccaggtgactccggcagcgtaaccattaaggttaaattcgataccgatctctttgttgatactgatctccgggtcgaggtcagggttacccagcaggtagcagctgccttcagcgatcgtgtttggacaaccgttgccgcgggtggagagcaaatagcctttactggattgatagaggtttggcgctttaaacacgcgcgcgataccggccttcagcgtgaacatatcgccgagctcctgggacagattgaggctggggctccagttactgccaaactgattatgataatcgaagcgaatgccggggatcaggttggtgccgggcacggcttcgatattatcttccagatagataccggtgagggtggcgctgtttttggtactgcgttgcgtagggtcgcccgaggtcccagggatagtctcgccgttgctgttagtggcctgcattgatgccgggtcgtcgagctgatcatggttccattccattcccagcgtcagcgtctggtccgccagccagaagaaaggcacattgaattccgaggtagtacgccaggattccagacggctggtggcataatcttcactgttgatcatgccttcgacgcggccggtagagccttcctgcaggcgggtattgttggttttctcgtagtaaacaccggctttggactgaccccaatcccatagaccgttgtaggtcagtccccaggactggcgatagaggcgatttgtttcgtggccatacagggagtccaccagcccgttcgggctaagattgccgttgctgtactgggtatcaccagcatagatattcccctgacggctataggcgtagctgaaatcgaggatctgttgcggggtcattttccatgacagcaaggtgttaatatctttattgcggaccccttcgcgtcccgcagcgtaagagccgttttgcgcatggttaatatcccaggcgtcgggttccgttttattgatattgccatacaggcgcatcgtcagcgcctcgccggccagtgggccgctgagattgaagttagcgcgattggtcgtgccttctttgttgttttccggctggttggtgaagaaagacagcgaaccgtgccaggtgttggtcggacgtttggtaatgatattgaccactccgcccgccgcgccggaaccatagcgcgcggctgccggaccgcggagaacttcaatccgttcgaccatttcggcaggtacccagttgctgtcgccccgggtatcgcgttcgccgcgccagctatagcgaaccgcgttacgtgaggtgaccggtaccccatctatcaggatcagggtgttctccggccccatgccgcggatatcaatctggcggttgttgccccgactgccgctggcgctgttgccggtcaagttcaccccgggcattttacggatgatgtctgagagatcgttgaccggcggctgcttagcaatatcctcagccgtgataatcgacaccccgggctgttgcttaagcgcctcttccgccgtactgcgcacaatcatcgtttcggtatcttgttctgattcttcagcaaaggcgttaggggcgaggagactggatatgaccagcgccagggtcgtgggcacagaatattgcggcgatctcatgtaaatatccttttcaaaacaatgcaaaatgagatcgagaatattaatgataacaattatcattacaatgtaacgagatgaatctccataaaatcctcacaattaccgcaactttttatgcagttgagagaaatcgtgaagagagcctgcacagtgtggccgggaagctgtcagcgtatgcgctgaggttgtgtggttgcagggaatgtttgccagtgcagtaagcttatagggggcgagcgcggcgcgcgatggcgcgccggcggaggggttagtggtggtcgtcctgcggcatatgacggtagatgtagatcccgctcagcaaggtaaagaccagcgtgagggcggttaaaccaaagaccttaaagttaacccagatattctgcggcagccagaaggcgatatagatattggccagcccgcagagaataaagaacagcgcccaggccaggttaagtcgcgaccagacctgctgcggcaggctcagctctttacccagcatgcgctggatcagcggctttttcatcacccactggctgaacagcagcgcgccggcgaacagggcatagatcaccgtcaccttccatttaataaactcatcattatggaagaagatggttaacccgccgaagacggccaccagcacgaaggtgatcagcgccattttttccactttccggtagcgcacccagctgtagatcagcacgacggcggtcgccacaatcagcgccgtggtggcggcgtagatatcgtaaagcttataaaaggcaaagaagaccaccagcggtaaaaaatccagaaactgcttcatacatcgatcccgtctttcaggacggaccggggaaggccccggtcctggttaaaattagctgcggataagcatatacacgcggaataaatagatcagcaacagggcggaaatcaggttgctgatggtattaatcaccaccgcgccgacgtttggcgtcagggcggcaaagctggaagcaaacagtaacagcagggttttcgccaccagccaaccgataatagccggcgccaccagtcgcagattggcccacgccaggcgcatgctgctgcgcatggcgccgaggatgcccattttgtcctgtaccagcatgatcggcgcaaaggccagcacgatggccagcagcacgccgggcaccagcaccagcatcatccccatctgcaccaggaaggtggtgaacaggatcagcagcagcagcttgggcagcaccggcgccgaggcgccgatggcgcgcagggcgctaacgcgatgaccggcggagaccagctggatcagcagcaggacgccgccgacgaggatcgcattacctaccagacccgagaaggttgatgccgccgaggcgcgcagcagaacctgctgctgctccggcgtcatgttctgcacaagctcgaacagcccggcgctaccggcgaggttatcgccttcgctgagtatcgacagctgctcgtcgctgggtgaaaaggcatggccaagtactaccgtaataaacgcgcacaacagcgcaatcagtaaaatagtaatgaactgattacgaaaaaaattcccggtgtcacggtagacggacttcgccgtgatagacatgcattctccttgagtgtcgcaggtgttaactagccggcgattgtaccgcaaatcgttccgtcgtagcactctctgcgccggtcagggcaggtatatctttgtaaagaggccgcaatggtggcaggccgtagcgcgcccgcgcccggttgcaggcatcgttttcctcgccattttccccggacagggcgaattcgcgacacggcgaaggccggttttcataaatagtgcagtgaacggcgtcgccgatatcgccagacagggccgcgcagcggctctggcgctgattggtgccgctcatgcagcgcaggaaaggggtcagcggttcggtcagcgcggagggcaccaggccgcccgcatcgtcggcttccgcccagtagaaagagactcgaaaatacgcacaacaggcaccgcacgtcatgcacgggttgatttcactcataattacacctgaaaaaaacgcatcaacacagattgtcggcagttaacttatccagccgcctcagcgtcggcaagaggggcagaaataaatttttgcgcgaaaagtgaaaattgatgtgcgaacaattcaaggcattgcgatcggtagcgaaaattaatctggatcaataaatgttaaatctgaggacttagtgtgatctaaaacagatcaaacgtaactcgttataggtatatttggccgcgctgaaaaaccataatgaggaagtggatatgaagaagttagcagcggcggcattgattcttggcacgctttctatcggcagcgtctgggcgcatgaagcgggtgagtttttcattcgtgccgggaccgccaccgtccgaccgacggagggctctgacaatgtgttaggcagccttggcagtttcaacgtcagtaacaatacccagctgggtttaacctttacctatatggcgaccgataacattggcgtggagttgcttgccgcgacgccgttccgccataaggtcggcaccgggccaaccgggactatcgccaccgtccatcagctgccgcccaccctgatggcgcagtggtactttggcgatgcgcaaagcaaggtgcgcccgtacgtgggggccggtatcaactacaccaccttctttaatgaagactttaacgacaccggcaaggcggccgggctttccgatctgagcctgaaggactcctggggcgcggcggggcaggtcggcctcgattatctgattaaccgcgactggctgctgaatatgtcggtgtggtacatggatatcgacaccgatgtgaaattcaaagccggcggcgtggaccagaaagtcagcacccgtctggatccgtgggtgtttatgttctccgcaggctatcggttctaaattcttctgtaaactggccaacggatggccagttcattgtctcgtcacacctgtctgccgcaagcctctgtcatcaacagcggatcacacttccgtccactggcgcagcaggttgtgatacatgttgagcagggagaggacctcttctccgtcgccaaagcgggtcttcagagactggatggtgcggtccaggtcgtaaagcatcgcacgctgcttatcgtcgcggaccatcgactggatccacaggaaagaggcctggcggacgccgcgggtgaccggggtgacgcagtgcaggctgctggcgggatagagcaccagatgcccggccgggagcttcacccgatgttggccataggtgtcttcaatcaccagttcgccaccctcatagctctccggatcgcaaaggaacagcgtcgctgacagatcagtgcgcatccagcccgcctcgccgttctggcgaacggcgccatcgacgtgaaaaccataggtctcccctggcccatagcggttaaacaacggcgcggaaatcgtccgcggcagcgcggcggaaaaaaactgcggatggccgcgcagcatatcgagcacagcggcctgcaggcgggcatacagcggcgttcgggtatcgatctgctggttctgtttgacggccgccccctggctacccaccgtaacccgcccgtcgacccactcggcctgcgccagctgccgggtaaattccgccacctggtctgtcgatagcacgtcaggaatgtgatacatcatcgcggtgttctctctaaaaggtggggcgcaacggccccacgcgcagactcagaaatggacgttcgccgtcagcataaaggtccggggttcgcccggatgatagcgatagccgctcttgttgatggaggccacgtaatcggtatcaaacaggttatacatattgagctgcagatcgaggttgctgttgacccgatagcccagtttggcgtcggcaacccagtagccctcggtgtgatccggggtaccgactgcaccatcgctgccccggcgcaggcttccgacatagcgcacaccgccgccgacggacagatcgctggtggcctgatactgcgtccacagcgtaaaggcatgtttcggggtgtaggccagggcggaagatccatcctgtgcaacgttctgtccctccgtcactgtcgcatgctgctgagtgtagccggcgataatcgtccagtccggggtcaggtttccggtcgcggagagttcatacccctccacgcgctttttgccgtactgcgaccaggttccgtcatcgttggcggccacttcgttttcaatatcggtgcggaataacgccgcgctgagcagcagacggttgtcgaagatttgccacttggtgcccagctcgctggatttcgccttctgcggcttaaagtcggtccggttagcgctgttgccgctgccgctggcggccagggcgaagctgctgcctcccggcggctgctgtgagatggcgtagttgacgtagacattgccctgctcggttaagcggtacagcgccccggctttccagttaaccagattgccggatttagcggtatcgacagtggtgaccgggctgccggtcgactgtccgggcgggcaggcgatagccccgcgtccgctgccgccgcaggcggtggcgctgtcatatttggtatggtaattgtcgagacgcagcccgccgttgatctcaatccgctcggtcagcgtcagcgtatcgaaggcataaatcccgaaggtatcggtctggccgttggcgttcgccccgtttctgtccagcccgccaatcgacaggttgctcaccggatggtagagattcaccgccggcgcggtcctggcgttaacgccatagttggtctggttttcccgggtaaactccacgccggcgctgacgtcatggcctatcgagccagtattgaaagtcgaggtgatattggtctggttggtcagaatgcggttgctgacatctttggtattaaccagacgcgaccagctccaggtgttgacgtcattgatatcgggggcggtgatattgttcgcgccgcccatcaccgcggtcaaaagatactcctgtttcactcgcgaccagcgggtggtattgcgcacggtggtgctctctgtcagatcgtgttcgaagcgcagggtaccgctgtcggtagtagatttatcgtaatcggagtcggtgccatagaaattgctggtatcgaccttcccggcggagttgagtgcggcatacttcggcgaaggcgccgaatagcccggcaggccgacggtagggatcccgccatccggggtgttgttctgccggacgtgcagatagttcagatacagacgagttggggtatcaaggccgaaggccagcgacggtgcgatgccatagcgttcgttttcaatgcggtcccgaccagcgtcatgggttttttcccccatcaggttcagacggaacgcagcgttgtcgctaaacgcctggttcaggtcgagagtgccccggcgcgaccaggcgctgccgatgctggccgagccgtcgatcccggagtcaaggcgcggctgcttgctgatcatattgatcgagccggagggcgcgctgcggccatagtccgtgccggcgggccctttgatgacttccacctgctgggtattgaaggtatcgcgcgtcacgctgccgatgtcgcgaatgccgtccacatagatgctgttagaggtatccacgccgcgcataaagatggcatccccggtggttgagctgccattctccccggcataaaacgcccccacgccgggaacgtttttgagggcgtcagtcaggttggtgacgccctgatctttaatcacctgttccgggatcacggtgatggtgcgggtggtatcgaccagcggtttattgaacttgggatcggcggaagcgccgggggagtagagtgaaggcggagcggcttccactaccagcgtctcttcactatttttgaccgaattttccgctgcgatgcctgctgccggcgaggctcccagacacagacctgtaaacaatgccaatgagttgaaactgccgaaaggcagagaagcgtttttttccatgataaatgcaggcttattttttgttatgagcacatatcacaccgcgcaaaagcgacgttattcgtcgtctggcttgcgctgacccggtgtgattctataaatgataaaaagaatagttatcatttgccttaatatttacatagaaaagttgaccttaaaacaactttcttcacttcgatttacataattcacattttttgaacgataatgcgggaatatagggaaagtgctgcagaataaggtcggtagcaagccgcgccgggcggggttaacttccgggcggccatatgatggttgttccggctcggatcaccagggcacggtacggccctggtaatcgagatactccagtcccggacgttgccgtttgtcgagcaggacgttcaccaggcgtgggatcgtctcttcgatggtcagcggggcatctgccccgccgagctcggtgcggatccatcccggggccatcaccaccagcggatgggaggccgaggaggggcgagcggcaaagctgcgcataaacatattcagcgcagctttactcccgcggtagagttcccgctggccggtaaggttattggtcaggctcccctggccagaggacatgacgccgagcagcccctgcggtttaacggcctgctgcaggcgctcgataacccgcatcggcgccagggcattggtgagcatcacctggtaaaactcctcggtggagacgtcgccaatggtctgcgacgggtcacgattggtggtgccagcattgacgaacagtatgtcgaggctcgcggcgggaagcgtcgcctgcagcgcggtaagctgggcttcatcgcggatgtcgagcgtcgccaggcgtagccgcaggggatgcgtcttggccaggtcgtggagcggcgtgtgggatgataaatcgcgcacggtgccgatgacctcccagccgtgctggaggaacgtcgccgccatagcatggccaaggccgcgcgaggcgccgacgatgaggatagtgttgtgctgatcggatttcatgatgtctctcgctgcagaagggaggtcttcactataatcaggcccgagatcgggcggaagacgccgccagtgcactcatatcttgcagcaaacgccctgtctggcgactggagcgataatgaacgatcccgattttaatttgctggcggcctttgatggggtgcgggcggaggagagcgtggcgggcgccgcccggcgtctcggcctcagcacctcggcgatcagccgtacgctcacccggctgcggcatccgtcgccgcaggggatagtgcgttttccgctgccggtcagcactgaggtgattacggtgtcataggcgtggcatccgcgcctggagcaggcggcgggccactgctggctgcggcaattggtgcgtgaggtgtgtcgcgagtaaaaaaagcccgcacaagtgcgggcaaaaatactggaagcaatgtgagcaatgtcgtactgaatacccgagtgatttactcaactattcagtgatgagaaagataatatttctcatttaagatatcaaccccatcttttgtgcggaagcgattttttatccgagggtgaaaaccgtgcgcttttggctgtcgtcctgcggccaggccgccgcgatctcctgcagcggccgcggggtggtggcgatggtcaatttccccggcaccgccgcctgcagcatttcaccggtcgccgccagcagttgcgataccgacaggctaccgatcccgctgcccatcagcaggagcggggcggaacgcagcactgcgccatttaacgcgatatcggcgccagccagggaacccacctgcacatagcgcaccggactgccggcaggggtatatttcgccagtgccggcaataataattccgcgctgtgtccccacaggtaatcgatgaccacatcgatctgcgcggcgctgaccgctgaaaattgcccgctcaaggttttatcatcagcggttaactgaatacactcatcggcgtccagcgccgccagcgtctgcgcattccgtccggttgcaatgatttttttcgctcccagatagcgggcaatctgtaccgccaactgaccggcgctgccggtggcgccattaatcagcaccgtttcgccggcctgaagctgggcgcgtgtcaccagcgatgcccacgcggacataccggggttggccatcgccgccgcctggatatcatccagcgcatccggcagcggcagacaattctgcagggcgaccggcgcccgctgcgccatactgccgaagggggcggtggggaaggcgaagtagacgcgctggccctgaggtgtggtgccgacgccatcgataccgggcacaaagggcagattgccgtcgaagctgtaatggcgtccggatgcccgggccttaaccacatggcttatcgcggcggcgcggacgtcaatgagcgtctggccgggcgcgggctgcgggtcgataaaatcggcccaaaccgggccttctgcgaggtcaaaaaccacggctgctttcataaattatctcctgtcgggaattatgtgtaaaatacacatattgttttgcagcactatacgcggaaaattaatatatgcaagatgcacataatgactacgacattaccgactttcacggcgcgctactggatatcatcagcgtgatgaaccagccgctgcgcgacgagcagatcctccaggcggccggcgtccagctggaacagatgctgtttccgctgctggtggcggtaggacgccatggcccggtgggggtggttgagctggcggatcatttagggcgcgattacaccaccgtcagccgccaggtgaaaaaactggaagcccagggactcgcctgtaagcaacctaaccgtcatgaccgacggatcagcgaagtgacgcttagcgccagcggacaacagatgatcgacagtattgcggtagcgcggcggcggttaatgaatcaggtgctggcgcagtggccggaagatgaagtgcaggcgctgtttcgcttaacgcgcaaatacgccgacagtttgcagaaatcatcgccgcctggcgcgatgccaggcggctgatggtcaggcggttttggtcgctgccttcaggctctggacgaaggctttcagctcgtcgagcatggtctgcggctcatcgaggtggcgttcgatgattttgacgatggcggaaccggagatagccccggcggctccggcgtcaatggcggcgctcacctgctccggcgcggagataccaaagccctgcagcggcggcgcggcgtgatattccgccagcttctccaccaggtggtgcagcggaagcgcggcgcgattttccgcacccgtcactccggcgcgcgacagcagataggtgtagccgcggccataagaggcaatctggcgcagtaaatcgtcatccgcattgggcgggcagatgaaaatcggcgcgatgttatggcgcatcgccgcctggcggaacggggcggactcttccaccggcacgtcggccaccagcaccgagtcgacgccgacgcgggcgcactgggcatagaacgcatcgatgcccgggctgaagacgaggttggcatacatcagcaggccgattgggatggtcggatgcttctggcggatcgccgccagcatctcaaagcactgcgccggggtcactcccgcggcgaaggcgcgcagggccgcgccctggatggtcgggccgtccgccagcgggtcggagaaagggatccccagttcaagggcatcggcgccgccttcgatcagcgcatcgataattttcagcgactgctccggtcccggatcgccaagggtgacaaaggggacgaaggcgccttcctggcgatttttcagttgggcaaacagcgtctcatagcgttccatcagatttcccctcgcgctttcaggatgtcatgtacggtgaaaatgtctttgtcgccgcggccggagagattaaccaccagcagctgctctttttccgggttctcgcgcatcatcttcagcgcgtgggccagagcgtgagaggactccagcgccgggataatcccttcgtggcgggaaagcgctttaaacgcgtccagcgcttcgtcgtcggtgatcgacacataatcagcgcgaccggtgctgttcagaaacgcgtgctgcggcccaacggacgggaagtccagcccggcggaaatggagtaagactcttcgatctggccgtcggcggtctgcatcatcggcgacttcataccgaagtagatcccaacgcggccatgcttcagcggcgcgccgtgctcgccgctctcgataccgtgtccggcgggctccacgccgatcaggccgacgttggtttcctcgataaaatcagcgaacatgccgatggcgtttgatccgccgccgacgcaggcgatcaccgcgtccggcaggcggccctctttttcaaggatctgcgctttggtctcttcgccaatcatgcgctggaattcacgcacaatcgtcgggaacgggtgcggaccggcggcggtgcccagcatatagtgcgccttttcgtagctgccggaccagtcgcgcagcgcctcgttacaggcatctttcagcgtggcggagccgctgtgcaccgggatcacctcggcgcccatcaggcgcatacggaagacgttcggcgactggcgctcgacgtccttggcccccatgtagatacggcatttcaggccgagcagggcgctggccagcgctgaggcgacgccgtgctggccggcgccggtctcggcgataatttcggttttgcccatccgtttggccagcagagcctggcccagcacctggttggttttgtgcgcgccgccgtgcagcagatcttcgcgtttcaggtacagggtggtgcgggtgccttcggtcagattccggcatttggtcagggccgtcggacgaccggcgtagtttttcagcaggtcggtgaattccgcctgaaaggccgggtccttctgcgcgctgacaaaggcttcttccagctggcgcagggcgggcatcaggatctgcggcacatacatgccgccgaattcgccgaagtaggggttcagtaaagtgctcattattgctccttaatatgcgcgcagcgtctggaatacggaggccagcttgctggcgtctttcatcccgtgttgcgactctacgcctgaattgaaatcgagtccggcacagccgcttttggccgcttccacacagttatcggcgccgaggccgcccgccagcatgacgttgcgcagatcctggccctgcagcaggctccagtcaaagcgctggccgctgccgccctggccgttgtcgagcaggtacttgtcgacatggcggagcgtacgggccgggaaggtttcgccgacgctcagcgctttccagatgcggacgttgtccgcgagggcgtcgcgcagcgcgtcgatataggcctggtcttcatcaccgtgcagctgcacggcggccagccccagagcctgcgcgcgggcgaccaccacctccagcggcgcattgcggaagacgccgacgtactgtagcggcgcagcggcgatcaccgctttggcctgggcgtcattcaccgctcgcggcgaggtcgggacgaagatcagcccaccgtaaatggcgccggactcccaggccacctgggcatcctgcgggcgcgtcaggccgcacactttgttctcgccgagcagcacgcgtttaaccgccgtttccagatccgcctgctccatcagggcggagccgatcaggaagccgttggcgaagtggctcagctcgcgcacttcggcataggtatggatgccggattcgctgatcaccgtgacatccgggccgagacgcgccgccagctgacgggtgcggttaaggtcaatcgacatatcgcgcaggtcgcggttgttaatgcccaccaccttcgccttcaggtcgatggcgcgctccagttcctcttcattgctgacttcggtgagcacgcccatattcaggctgtgagccaccgccgagagctgacgatactgttcatcgtcgagcaccgagagcatcagcaggcaggcgtcggcctgatagtagcgcgccaggtagatctggtaagggtcgatggtgaagtccttacacaggatcggctgcggcgcgacctggctgacgatcggcaggaaatcgaagctgccctggaaatatttctcatcacacagcaccgagatcgccgaggcgtagtgcttgtagatgctggcgatcgctgccggatcgaaatcctcgcgaatcaaccccttcgacggtgaggccttcttgcactcgagaataaacgcggtgcgggtgccggccagtgcgtcatagaaattgcgctgcgtcggaacgatctcattttgaaaactggctaacggttgttgttgtttgcgggcttccacccaaatcgctttgtcggcaacgatttttgctaaaacggtttgcattatttaccctcttgccgctaaggcggtcactctgtcataggccgcgccgctgtgcagcacattcagtacctgctgagcgttagctttcagatcttcatgcccgtgtaaacgcatcaacatggcgacgttggcggcgacggcggcttcgtgagcggcttcacctttaccttgtagcaagcgcgtcagaatgtcacggttttcttccggggtgccgcccgccagctgcgcctgatggtaaggcgtcaggccgaagtcgtcggcggtcagctgatagcttttaatttccccgttatgcagttcggccaccaccgtaggcgcatgcagtgaaacttcatccatcccaccgctgtgcaccaccgccgcgcgctgataacccagcacgcgcagggtctcggcgatcggcagcaccagttccgggctgtagacgccaatcagcgccagcggcggatgcgccgggttgatcagcggccccagcacgttgaacagggtgcgggtcttcagctgctgacggaccggcatcgcgtggcggaaaccggtgtggtacttcggcgcgaacaggaagcagacgcccagctcatcaagcgcggcgcgggatttatcggcgttcatatcgagattaatgccgaaggccgccagcaggtcagaagagcctgatttactggagacgctgcggttgccgtgtttcgccacttttaacccgcaggccgcagcgacaaaggcgctggcggtggagatattgatgctgttgctgccgtcgccaccggtgccaacgatgtcggcaaacaggtagtccgggcgcgggaacggcgcggcgttttccagcagcgcggtagcggcgccggcaatttcctgcggctgctcgccgcgcactttcatgctgaccagcgcggcggccagttgctcaggcttcacttcgccgcgcacgacggcggagaacagctggtggctctcctgctggctcagggtttccgcctggtacagtttctcaaggatcggctggagggtgttggtatgctccagcttctgcagcgcccaggccagggtctgctccagcagtcgcgcgccctgggtggtgaggatcgattccgggtggaactggaagccgcacacccgatccgcatcgtgacgcaccgccatcaccataccgttgaaattggcgttaatcgtcagcccggcgggaatattgctgccgaccagcgagtggtagcgcgccaccggcagcgggttagccagaccggcaaacatcgcctggccgtcgtgctcaatgctggaggctttgccatggaggatctcccccgcctggccgacatagccgccgtaggcttcgacaatggcctggtggccgaggcagatgccgatgatcggcagcttgccgcgcatacgggtcagcagctccggcatgcagccggcttcgctcggcgtacccgggcccggggagagcatcagcaccgggttgtccatggtgcccagacgctcaatcagcgcctgcgccggaacggagttgcgataaatcactacgttatggccgttggcgcgcagctggtctgccaggttataggtaaaggaatcgatattatcgagcagcagaatgtcagccatcagaaaatctccttcgcgtgatgggcctgggcaatggcgcgcagcaccgcgcgggctttatttcgggtctcatccgcttccgactggggaaccgagtcgagcacaatgccggctccggcctggacggtagcgataccttcctgcacgtaggcggaacggatgacgatgcaggtgtcgaggtcgccgtgggcggtgaaatagcccaccgcgccgccgtagctgccgcggcgtttaccttcggcggcggcaatcagctgcatggcgcggaccttcggcgcgccgctgagggtgcccatattcatgcaggcgcgataggcgtggaggacgtcgagatcctgacgcaattcgcctactacacgggagaccagatgcatcacgaaggagtagcggtcaaccttggttaaatcagcgacatagcggctgcccggggtgcagatgcgcgccaggtcattacgcgccaggtccaccagcatcaggtgttcggaaagctctttatgatcggtgcgcatttccagctcgatgcggctgtcgaggtcgcgatccagcgagccgtcggcgcggcggccgcgtggccgggtgccggcgatggggtagatctcaatctgacggctgacggcatcatacttcagcgagctttccggcgaggcgccgaacagggtgaaatcattgtcctgcataaagaacatgtacgggctggggttgctcttcttcagcacatcataagcggccagcggcgatgggcagggcagcgagaagcggcgggaaggaaccacctggaagatttccccggcgcggatcgcgcgctgcattttgcgcaccaccgcgccgtactcttcatcgctctggtcaacgtcgcagcgcatttcggccacggtggtaaccggtagcggcgccggcggctcgttcagctgctgacgcagctggctcaggcgctgctccaggcgctgtttttcactctccagcggggtgaacaggctggcctgaatgcgggtatgcttggtctgatggtcgatgaccagcagggtttccgccagatagaagcagtagtccgggcaggcggtgtcgctttgcaactggggaagatcttcaaaaccggccaccaggtcataggcgaacaggccgccgaagaacatcgcttcgcgctcgttgtccggaacgctcaccagctcctgcaggagacggaaggcgtcaaacaccgacagtgagcagagacgggcgtcttcatcgagcagggcgctgacggccgggaaggtcaggatgcggccgttgggctggcgctgattgttgatcccggagggcagcgcgccgtccagtagttccagcagcgccgcgccgttggcggagagggcctgaatagtgacagtgtcaccaagggccgtaatgcgcagcgcgctatcgaccagcagcaggctttttaagtcatctttgctgtcgatgtcagcggattccagcagcagcgtcgccggacgggcgccgcacagttggtggaataacgccgtcgggttctcccggtagatggcgtcgctggtgagaagctcgagtgccggtttggatgtttgcattattgttctcgcctgttcgtattatttttgtccaataaaaagcccgctcattggcgggccgggtatctgtatgctgaatgcaaaacgcgatcacgccgcccgtcgtcaggaggtgcgccaccagctgtgcagagtgataaagtgcattttcatcgtgataccccttcatgtgaactttcgtactagttaactagttcaatggaataaagtcaacccttgtttgcagattttctctgcctgtcggtatgataatgcgcttatttacgttgatgtccagcaggagtccttttgagcgacagccaatacgcagtgatttacgatctgcacagccataccaccgcctctgacgggcggctgactccgcaggaactggtccatcgcgcccatgagatgcgcgtcggcaccctggcgatcaccgaccatgacagcgtggcggcgatcccggcggcccgggaggagatcgcccgcgccggattacccttgaccctggtgaacggcgtcgagatttccaccctctgggagaatcacgagattcatattgtgggtctgaatattgatattgcgcacccaacgatgaccgccctgctggaggagcagaaagcgcggcgccagcagcgcggtcagatgattgccgagcgcctggagaaggcgcggatccccggcgcctgggaaggggcgctgcgactggcggacggtggcgccgtcacccgcggccattttgcccgttttctggtggaggccggccatgcgaaaaacatggcggaagtcttcaaaaaataccttgcccgcgggaaaaccggttacgtgccgccgcagtggtgtacaataaaacaagcgattgatgtgattcatcattctggcggcaaggcggtgattgcccatcccgggcgctacgatctttccgccaagtggttgaagcggctgttggcccactttagcgagcagggcggtgatgccatggaagtggcccagtgtcagcaggcgccccatgaacgcgcccagctggccaccctggccgtgcagtttggtcttctggcgtcgcagggagccgattttcatcagccctgcgcgtggatcgaacttggccgtaagctctggcttcctgccggcgtggaaggcgtctggcacagttgggaagcggccgccgaataaaaattgagagggaagtatgagccagtttttttatatccatccggataacccgcaggcgcggttgattaaccaggcggtggagattgtgcgtaagggcggggtgatcgtttatcctaccgactccggctacgcgctgggctgcaaaattgaagacaagggggcgatggagcggatctgccgcattcgtcagctgccggacggccacaactttaccctgatgtgccgcgatctgtccgagctgtcaacctacgcttttgtggataatgtggcgtttcgcctgatgaaaaacaacacgccgggcaactatacctttatccttaaggggaccaaagaggtgccgcgtcggctgctgcaggagaagcgtaaaaccatcggcatgcgcgtcccgtctaaccccatcgctcaggcgttgctcgagaccttaggcgagccgatgctctctacgtcgctgatgctgcccggcagcgactttaccgaatccgacccggaagagatcaaagatcgtctggagaaagtggtggacctcatcattcacggcggtttccttgggcagcagccgaccacggttatcgatctcactgaagacaccccggtggtgctgcgcgaaggcgtcggcgacgtgaggccgtttctctaaggctatctgccgggcggtgcatcatgcgccgtccggtaccccgcgttttcgccccgacggcacgataatcatccatagcgctacacaaaccagcagcgcgccgagaatcaatccttcctccaccgtctctccgaggcagagatagccccacagcgccgcaaaaggtgggatcaaaaaggtcaccgacagcgaacgcagcggccctatatctgcaatcaagcggaagtagagaatataccctgccgccgtgcagaccacgcccagcatgactatcgctatccacggcagactctgccgccagtctacggcaggcccatgccagcaggaccagagaaagaaaggaaacagaaacagcgtggcgccgacctggctacccagcgcgacgcgttcagcctcgaggccgcctcgctgctggatccagcggcgggtcagaaagccggccagaccgtaacaggcggtcgcggtcaggcaggcgccaatccccggcagcagcagggcggcgctaaggccagatgtcgggcgcgcgatcaccgccacgccaatggtgcccagtatcgcgccgccgcctttgcgcagggttaacggttctgcaaagcataacgcgccgatcagcacccccatcatcggcgccgtggcgttaagcgtggcggagtaccctgccggcagccattgcgcggcaaggcagtacatgagaaaaggaaggcctgaattaatgacccccagctgcagagtggatgtgaattttccctgatacccgctccatttacgctgcacgccgagtaacagaccgagcgcgatagcggcgaacagtacgcgaagaaaagcgctgttcaacgccccgaaggccggggtggtgatgcgcataaacaaaaagctggcgccccagagggcggcgagcagcagcaggcggccatagtcgataacacgcatgattgactccttgtagtcacgaaggaagtcaactgtagaacccacgtgcagcgtgcgacaaacgcgttatgcttacatgattaagtttttcttaactgaggttccatacccatgaaactcccgccgctgaatgcgttgcgctgctttgaggcggcggcgcgactgcttagcctgaaactggccgccagtgagctttgcgtcacgcccagcgccgtcagccagcagattgcccgccttgaggagacgctgaatgtcccgctatttatccgtactccgcgacggttacagttaacggcggtgggagagatctacctgcgggccgttcagccggcgtttcatcagatagccgccgccacccagcgtctgcaggtgcccccgggaccagaaaaggtagctatcagctgtaccagcggcttcgccattcagtggctgctgccgcggctggctgattttgaacgacgctatccgcagatagagatccagatcggcaccaccaaccggcgagtagatttgctgagtgaagggatcgattttgccgtgcgtcatggtgtcggcggctggccggaactgcaggcttaccgcctgctggatgacgatctgatgccggtctgtagcccgcaactgatcgctccgcgccggacgctcaccgatgcgagcgatctactgcagtatccgctgctgcacgatgaacatcgtgaagactgggcgctgtggtgtgaggccgtggggctggcgccgcacttcgcgcggcgtgggccggtgttcactgattccaacggcgtgacggaggcggcgttcgccggtatggggatggcgttgctgcgacgctcattcatagcgcctgcgctgacgcaggggcggctggttaatcctctggcgcagcccatcgcctgtccgctggcctatcatctggtttaccacgagaccgcgctgctggcgcctgccaaccgctgttttcgcgactggctgcttggccagcgcccggccgttgctgaggagcgcgcgtaatgaggggggcgctgtccgataaagatccgtatgcgtgaatgggcacaggagaatgaggaaaatctgttccatactaaagacggggcgcggcgaacagaagctttcccgacgaagttagtgtagtatgttcggccacgaatacgggctcgcggtggatatcctgaacgcgccgacgagactttacgttaaaagtatatacgtaacaatgagttgtgcttatggcctcattgtttcataaagcataccagacgcctgggaaggcgacaccttaaggaagctcaatgagcgagaaactgcaaaaagtgctggcccgtgccggccacggctcccgccgtgaaattgaagcgaaaatcgaagctggccgcgtcagcgtcgacggcaaaatcgccaccctcggcgatcgtgtggaaattgtccctggtttaaaaattcgtatcgatggtcatctgatctcggtgaaagagtctgccgagcagatctgccgcgtgctggcttactataagccggaaggcgagctgtgcacccgtaacgatccggaaggacgcccgacggtatttgatcgtctgcctaaactgcgcggcgcgcgctggattgccgttggtcgtctggacgtgaatacctgcggcctgctgctgttcaccaccgatggcgaactggccaaccgcctgatgcacccgagccgtgaagtcgagcgtgagtacgccgttcgcgttttcggccaggtggatgatgataagctgcgccagctgtcgcgcggcgtacagttagaagatggtccggcagcgtttaaaaccatcaaattcaccggcggcgaagggattaaccagtggtataacgttaccctgaccgaagggcgtaaccgcgaagtgcgtcgcctgtgggaagcggtcggcgtgcaggtcagccgtctgatccgcgtgcgctacggcgatattctgctgccgaaaggcctgccgcgcggcggctataccgagctggacctggcgcagaccaactacctgcgcgagctggtggagctcacgccggaaaccagctctaaggttgccgtcgagaaagaccgtcggcggttgaaagccaatcagatccgtcgggcggtgaagcgtcacagccagaccagcgctaatccgcgccagggtaacaacagcaaccgtcgttccagtactcgcaataagactaacggttaatgttatgcgttccggtgacttgccgccggaacgcttacttccttccgcgctatcaggccctcagtagtctatccccatctgcgctttaatcccggcatcaaatgcatgcttgaccggacgcagttcgctgacggtatcggccagttcaataatatcgcgatgacagccgcggccggtgatgatcaccgactgatgggcagggcgctcacgcagggcgctcagcaccgactccagcggcaggtaatcatacgccaccatgtaggtcagctcgtccagcagcaccagatcgagctggtcgtcagcgagcatacggcgggcatgctcccagaccgccaggcaggcggcggtgtcgctgtcgcgatcctgggtgttccaggtgaagccggtggccatcacctgaaattcgacgccgtgaggctccagcagattacgctcgccgttaggccaggtccccttgataaactggatcacgccgacttttttgccatggccgacggcgcgggtcgcggtgccaaaggcggcggtggttttgcctttgccgttgccggtaaagaccatcacaatgccgcgctcgtcctgggccgccgccacccgggcgtcaactttatctttcagccgctgctggcgttcgcggtagcgttcatcactcattgggcaattcctggtttacgtcccggttgggcgtcgaaggtcattcccgtcttgcgacgactgtcgtcacccatcagccacagatagacgggcataatgtcagcgggggttttcagtttcagcggatcttccgtcgggaacgcgctggcgcgcattccggtgcgagtgccgccggggttgatacagtttacccgcaggtggcggctttgatactcgtcggccagcacctgcatcatcccttcggtggcgaatttggaaacggcataggcgccccagttggcgcggccctgacgaccgacgctggatgaggtgaagaccagcgagcccgattccgaacggagtaataaaggaagaagcgcctgggtcagcataaaggtgccattaacgttcacctgcatcacctgctgccagacctccggcttctgctcttccattgggcagatgtcgccgagcaggccagcgttatgcagcacgccgtcaaggcggggatagtgcatgctgatctgctgcgccagctgctggcacgcctggggcgtacaggtgagcaggtcgagggtaaaccagcgagggggaataccaccctcacgctcaatctcctgggcgacggtgcgcagtttgtcgtcgttgcgacccagcaggataacgctggcgctatagcgcgcgtaggtcagggccgcttcacgaccaatcccgtcgctggccccggtgaccaggatgatgcgatctttcagcaagtgacgttgtggttgataatgcacggcaactccttgggcgatcggttcccgatcgcgcttcatctttggtatctcacttttgcgctgttatgcctgaaagcgcccgccattgcaatcggcgaagcggaaagtattcacaaaattaatatcttgcaacgatttcagccgcgcgaaaaaaaacggaatccgctgcgcagagaacacaaagcacaaagacttctcgccagcggctgaggtacactgtgcagcaacgtcagtgctttacacaaggtgaaaacgtggaattacttgctcagtacggcttatttttagccaagatcgcgacggttgtcgtcgccatcgcggtgattgccgctattatcgtcaacctcgctcagcgcaagaagcagcgcggcgagctgcgggtgaccaatcttagcgagcattataaagagatgaaggaatcgctggcggtggcgctgctggacggcccgcagcagaagcagtggcataaggcgcagaagaaaaagcaaaaacaagaggcgaaggcggccaaagcgcgggcgaagctgggtaatgccgagccggaaggcaagccgcgcgcctgggtgctggatttcaaaggcagtatggatgcccatgaggtcaatagcctgcgggaagagatcaccgcggtactggcggcggcgaaagcgcgcgatcaggtggtgattcgcctggaaagccccggcggggtggtgcacggctacggtctggccgcctctcagctgcagcgcttgcgcgacaagcagatcccgctgacggtggcggtcgacaaagtggcggccagcggcggctatatgatggcctgcgtggcgaacaaaattgtctcggcgccgtttgcgatccttggctctattggcgtggtggcgcagatcccgaacctgcaccgcttcctgaagaataaagatatcgatatcgaactgcacaccgccgggcagtacaaacgaacgctcaccatgctgggcgaaaataccgaggaagggcggcgcaagttccgcgaggatcttaatgagacacatcatttgttcaaggatttcgtccaccggatgcgtccgggacttgatattgagcaggtagctaccggcgaacactggtacggggtgcaggcgctggaaaaaggtctggtggatgcggttgaaaccagcgatgagctgctgctggggctgatggagagccacgaggtgatcggggtgcgttatcaacagcgtaagaagatgctcgaccgctttaccggtagcgcggcggagagcgccgatcggcttctgctgcgctggtggcagcgcggtcagaaaccgctgatgtaaataacataacgcgaggcctgggcctcgcgttattgttttcactggtcttaatcgaccaggtggtacttgtccgacagctcgtgagcaagatacttaaacatgttaaataccgctgtactcttcggcgtcggtagtccctgctcatcaaggtaaaactcaccgctaaacaccaggacattgttgcgctgaacgacgtcggtggcttcgataccggctaacgtatcctcatgttcgcgaataagtttgttggctttttcgagcagcgtctggcgatcgattggttgggttgtaccttgcataacggactcctctttttctccgcgcgtagtttacgccgcgcggcggcgtggggcaaattttccatgcataaatcaggggtaatggtaaccagtggagaaacagccgtttactggcgggatttgcttttgcatgctaataaagttgcgtaacgaattttatcaggtacagtgtgacgctttcggcgatctggcaacagatttgcttgacattcggccaaaaattcttcgtgctatgtcacctgacgagaaaaagtcagcaaactcaagcgcctggttttacggagatgaaacgggtgttcagggttgatattcaccgacggtgccgcaacatatgaggcagtcgccagtggagggtgtatgaatgtgcgatgtattcctggatgaatcaaattaggtaaaggtgaatatgggtaaagctctcgttatcgttgagtccccggcaaaagccaaaacgatcaataagtatctgggtaatgactacgtggtgaaatccagcgtcggtcatatccgcgatttgccgaccagtggatcagcttccaaaaagagcgccgactctaccgccaccaaaggggctaaaaagcctaaaaaggacgaacgtagtgctctggttaaccgtatgggcgtggacccatggcatgactggaatgcgcactatgaagtacttccgggtaaagaaaaggtagtttcagaactcaaacagttggcggaaaaagctgaccacatctatctcgcaaccgaccttgaccgcgaaggggaagccattgcctggcacctgcgggaagtcatcggcggcgatgaacagcgttacagccgcgtggtgttcaatgagatcaccaaaaacgctattcgtcaggcctttgaaaagccgggcgaactgaatatcgatcgggttaacgcccagcaggcgcgtcgttttatggaccgcgtggtgggctatatggtttcgccgctgctgtggaaaaaaatcgcccgtggtctgtctgccgggcgcgtgcagtccgtcgcggtccgcctggtggtggagcgtgaacgtgaaattaaagcgttcgtcccggaagagtactgggaagtcgatgccagcaccaccacgccaggaggtgacgccctgccgctgcaggtgacccataaggacgataagccgttccgtccggtcagccgcgatgagaccatggcggcggtatcgctgctggaaaaagccagctacagcgtactggagcgtgaagataagccgaccagcagcaagccgggcgcgccgttcatcacctccaccctgcagcaggcggccagcacccgtctgggcttcggcgtgaaaaagaccatgatgatggctcagcgactctatgaggcagggcacatcacctatatgcgtaccgactccaccaacctgagtcaggacgcgctgaacatggttcgcggctacatcagcgacaaatttggcaaaaaatatctgccggatagcgcgaaccagtacgccagcaaagaaaactcgcaggaagcgcacgaagcgattcgtccgtctgatgtgaatgtgctggcggaaacgctgaaagatatggaagcggatgcgcagaagctttatcagctgatctggcgccagtttgtcgcctgtcagatgacgccggcgcagtacgactccaccacgctgaccgtggctgcgggtgatttcaaactgaaagcgcgcggtcgcactttacgtttcgacggctggacaaaagtcatgccggcgctgcgcaagggcgatgaagaccggacgctgccgctggtcaaacagggcgaccgcctgagcctggtggagctgacgcctgcgcagcactttaccaagccgccggcgcgtttcagcgaggcctcgctggtgaaagagctggaaaaacgcgggattggccgtccgtcgacctacgcgtcgatcatttcgaccattcaggatcgcggctacgtgcgggtggaaaatcgtcgtttttacgccgaaaaaatgggcgagatcgttaccgaccggctggaagaaaacttccgcgatctgatgaactacgattttaccgcgcagatggaggatcgcctcgaccaggttgcgaaccaccaggccgagtggaaagaggtgctgaaccacttcttcggcgattttaccacccagctggcgacggcagagaaagatccggaagagggcggcatgcagccgaacccgatggtgctcaccagcatcgactgcccgacctgcggccgtaaaatggggatccgtaccgccagcaccggcgttttcctcggctgttcgggctatgccttgccgccgaaagagcggtgcaaaaccaccatcaacctggtgccggagaacgaagtcctcaacgtgctggaaggcgatgacgcggaaaccaacgcgctgcgcgccaaacgtcgctgccagaagtgtgggacggcgatggacagctaccttatcgatcctaagcgtaagctgcatgtctgtggtaataacccgacctgcgacggctacgagattgaagagggcgaattccgcatcaagggctatgacggcccggtggtggagtgcgagaagtgcgggtctgaaatgcacctgaaaatggggcgtttcggtaaatacatggcctgtaccaacgacgagtgtaagaacacgcgtaagatcctgcgcaatggcgaagtggctccgccgaaggaagatccggtgccgctgccggagctgccgtgtgagaagtctgacgcctactttgtgctgcgcgacggggcggcgggcgtcttcctggcggccaacaccttcccgaaatcacgggaaacgcgtgcgccgctggtggaggaactgtaccgcttccgcgatcgtctgccggaaaaactgcgttatctcgccgatgcgccgcagcaggatccggaaggcaataaaacgctggtacgctttagccgtaaaaccaagcagcagtacgtggcgtccgaaaaagagggcaaagcgaccggctggtcagctttctttatcgacggtaagtggacggaagccaaaaagtaatggcgttcgttcgggcaggaaaagcgcgcttttcctgctcaggcgaccggcagagagagtgcatttctctgccgtgtcgtcttcccctctttgcgttaatttcctccccttataaccacctatattatttttcgttagcgtctatacagtgttgatataaatgatatagtggttatagttaatgccttttttattattaaaacgtcttatacatcatcgctttcaggatgcattgcggcgccactatggccaactgccgggagcccagggccttcatcggcgacaagttgcctgaacgtaaagtgtattaagcggcttcattttacgcgcaaacggatatcagccatgaaactacaacagcttcgctacatcgttgaggtggttaaccataacctgaatgtttcatccaccgccgaagggctctatacctcccagccgggtatcagtaagcaggtccgcatgctggaggatgagctgggcattcagatctttgcccgcagcggtaaacacttaacccaggtgacgccggccgggcaggagatcatccgcatcgcccgcgaagtgctgtcgaaagtcgatgccatcaaatctgtcgccggagagcatacctggcctgacaaagggtctctttacgtcgccaccacccatacccaggcgcgctatgcgttaccgggagtgatcaaggggtttattgaacgctacccgcgggtgtcgctgcatatgcatcagggctcgccgactcagattgcggaggctgtgtcgaaaggcaatgccgatttcgccatcgccaccgaggcgctgcatctgtatgacgatctggtgatgctgccatgctatcactggaaccggtcgattgtagtgacccccgagcatcctctggccaccaagggctcggtgtccatagaggaactggcccagtatccattggtaacctatacctttggttttaccggccgctccgaactggataccgcgtttaaccgtgcgggcctgacgccgcgcattgtttttaccgccaccgatgccgacgtcatcaaaacctatgttcgcctggggctgggggtaggggtaatcgccagcatggcggtggatccggtctctgacccggatctggtgaagctggatgcgaacggtattttcagccacagcaccactaagataggtttccgccgtagcaccttcttacgaagctacatgtatgattttattcaacgttttgctccccatttgaccagggacgtggtagataccgcggtggctttacgctcgaatgaagatattgaagcgatgttcaaagatataaaacttccggaaaaataaccctgaaaataataatggcactccctgcgaggagtgccattaactatgatggactgtatttaacaacttaaacctcgaaccaatcacaaaattaataatttttggcaacacgtttttcattatgcccgccgcgatcaaataaccggttaaatatattccatcaggcctaaattcactggattaatcttttatccataattaagatttatctgtacctgatgatttgagcaattggtggtgacaatatgataagtaatatcgattacatgaaactggcgatgtcatacgagaatgacaaaaccgaaatcgatcccgttctgcgtagtcgcgtatggggcgtagtgttggtagggttggcgatgttctggagcatcatcgcgctcaccatctgcaacatctggattgtcagctaaagctgtaggtcatcgttgtagatacatgtcatttttatgacagtgaaaagaaactgtaatataaaatcagtgaccggcaatacagggagaatatattttgccgctggattcatccaacctgaaatcactcatcagagctaatcactgcccgctggccgattagctctttttttgtcctcgtgtactaatacaatatcggcatacgccctctttgcactattttggtgctatttcgcctgctctcggataattcccgtttcctctctctctgtctcgccgtatttagcaatttgggttgttatcaaagtgttatgctcagtatgtgttatctttaatggagaccctgaggagaatcagggtatgccatccctgagataaaggaggagctatgtcgtcaaccctacgagaagccagtaaggacacgctgcaggtcaacgataaaacctggcattactacagtctgccgttggcggagaagcagctgggcgagatcagtcgactgcccaagtcgctgaaggtgctgatggagaacctgctgcgctggcaggacggtgactcggtaactgaagaagatattcgcgccctggccggctggctgcaacaggcccatgccgaccgggaaatcgcctaccgtccggcacgcgtcctgatgcaggactttaccggcgtgccggcggtagtggatctggccgccatgcgcgaggcggtgaaacgccttggcggcgatacggcgaaggttaatccgctatcgccggttgacctggttatcgaccactcggtgaccgttgaccgcttcggcgacgacgaggccttcgaagacaacgtccgcctggaaatggagcggaaccacgaacgctacgcttttctgcgctgggggcagcaggccttcagccgcttcagcgtggtgccgccgggcaccggtatttgccaccaggtgaacctggaatacctcggccgggcggtctggagcgaggaggtgaacggccagtggatggcgtggccggatacgctggtgggcaccgactcccataccaccatgattaatggtcttggcgtgctgggctggggcgtgggcgggattgaagcggaagccgctatgctgggccagccggtgtcaatgctgatccccgatgttgtgggctttaagctcagcggcaaactgcgcgaaggcatcaccgccactgacctggtactgacggttacccaaatgctgcgtcagcatggcgtcgtcggcaagtttgttgaattctacggtgacggcctggataccttaccccttgccgacagggcgaccatcgccaatatggcgccggagtatggcgccacctgtggctttttccctatcgatgacgtaacgctcagctatatgcgtctcagcggccgtagcgaagaacaggtcgcgctggtggaagcctacgctaaagcccagggcatgtggcgccagcctggcgatgagccggtctttaccagtaccctggcgctggatatgagcagcgtcgaagcgagcctcgccgggccgaagcgaccgcaggatcgcgtggcgctgggcgatgttccgaaagccttcgccgccagcggcgagctggaggttaaccaccttcagcgtcagcgtcagccggttgactatacgctgaacgggcatcactattcgctaccggatggcgcggtggctattgcagcgattacctcctgcaccaatacctctaaccccagcgtgttgatggccgccggcctgctggcgaaaaaagccgtcgaacgcggcctgcagccgcagccgtgggtgaaagcttccctggccccaggctcgaaagtggtgtcggattatctggcccatgccggcctgacgccttacctcgaccagctcggcttcaatctggtgggatatggttgcaccacctgtatcggtaactccggtccattgcctgaacctatcgaagaagcgatcaaaaaaggcgatctgaccgtcggggcagtgctctccggtaaccgtaacttcgaagggcgtattcatccgctggtgaaaaccaactggctggcctcgccgccgttggtggtcgcctattcgctggcggggaacatgaatatcgacctcacccgcgagccgttgggacagggcaagaatggcgagccggtctatctgaaagatatctggccgagcggggaggagattgcccgcgcggtggaacaggtctccaccgagatgttccgcaaagagtacgcagaagtgttttccggcactgaggagtggaaggcgatcaaggtggaggcgtcagatacttacgactggcaggaggattcgacctatattcgcttgtcgccgttctttgacgagatgggcgccgagccgctgccggtagaggatattcgcggcgcgcggatcctcgccatgctgggcgactcagtcaccacggaccacatttcgccggcggggagcatcaaagccgatagtccggcaggccgctatctgcaggagcatggggttgcccggcgcgactttaactcctatggttcccgtcgcggtaaccatgaggtgatgatgcgtggcaccttcgccaatatccgcatccgtaacgaaatggtcccaggggtggaagggggcatgacccgccatctgccggatcctgaaccgatggcgatttacgatgcggcgatgctgtacaaggctgagggcacaccgctggcggtgattgccggtaaggagtatggctcaggttccagccgtgactgggcggcgaaggggccgcgcctgctggggattcgggtagtgatcgccgagtccttcgagcgtatccaccgttccaacctaatcggaatgggcatcttgccgctggagttcccgcagggcgtcacccgcaaaacgctgcggttgaccggggaagagcggattgatatcagcaatctgcagtcgcttcagcctggcgctacggtgccggtgaccctgactcgcgctgacggctcgcaggaagcgatcccttgtcggtgccgtatcgacacggcgaccgaactcacctactaccgcaacgacggcatcctgcactacgttattcgtaatatgctgtgaaacaaagggccagcatcgctggccctttttcggttattccaccagtttattccgtcggcttgctgttcagcagatggcccatcttggcggctttggtgtccagatagtgagcgtttttcgggttacgcccgacgatcagcggcacccgctccacaatgttgatcccggcttcggtaagaatttccacttttttcgggttattggttaataaccgcacctgctcaacgttgagcaatttgaacatgtcggcgcacaaggtgaaatcgcgctcatcggcggcaaagccaagctgatggttcgcttcgacagtgtcgtagccctgatcctgcagcgcgtaggcgcggatcttattcaataaaccaatgttgcgtccttcctggcggtgatacagcaggatcccccgaccttcttcagcgatatgcgacagagccgcttccagttgaaagccgcaatcacagcgcaggctaaacagggcatcgcccgtcaaacactctgaatgtacgcgggcgaggaccggcgactgccctgatatatcgccatataccagcgcgacatgatcctgtccggttgccagttcttcaaaacccaccatcaggaaatcgccccagggggttggcagtttggcttctgccacacgtttaagctgcatgtgattctccagattctgtcagcacctgactgtgctttctgtttcccgctattttgccacaacgcctggacgttctcctaatcgcgaacggttagccgtgtggaaagcgcacaaacgatctactttccgctatgatgttcatctacaaggagaaggagagaaaatgctgttgatagcccgacgaactgctctcgcggcggcgctgctgctggttatgcccctcacggtctggctttccgggtggctgtggcagcctggactgccggttgccatgttgaaaagcctgtggtgggtgacggaaacggtgacccagccgtggggaattatcactcatgtcgtgctttgcggctggttcctctggtgtctgcgctttcggctgcgcgcggcgttgatcctgttccttatccttgccgccgctatcctggcgggacagggggcgaaatcctgggtcaaggcgcgggtccaggagccgagaccgttcgtcatctggctggaaaacacaaggcaggtgccggtgacgcaattctacgcgttaaagcgtaaagaacgcgctaaactggtgcatgaacagctggcgcaggcgcaggacattccgtcatttttacgcaaacactggcagaaggagacggggtttgctttcccgtcaggtcacaccatgtttgccgccagctgggcgttactcgctgcggggctgctgtggccgcgtcgccgctggggcacaatcgcggtgctgctggtgtgggcgacggcggtgatgggcagtcgcctggcgctgggcatgcactggccgctggatctcatcgtcgccacgctgatctcctggctgctggtcacggtggcctgctggctgacgcagcgcctttgtgggccgctctcgccgcccggagaagaggcgcaggatattaaaaaacggatgcctgaagcggaataatgttgattttagcggcatccgaccgcatatcctgaagagttgccatgctttttcattccaccgctgcggcgaaaatgatactttatagggctgaaagcgggcttttttcgcgcaacccacataacgggaagtcatgtgaaatatttactcattttcttactggtgttagcaatcttcgtcatttcagtgacgctgggggcgcagaatgaccaacaggtcactttcaactatttactcgctcagggtgaattccgcatatcgacgctgctggcggtgctgtttgccgcgggctttgccattggctggctgatctgcggcctgttctggctgcgggtgcgtgtctcactggcgcgcgcggagcggaaaattaagcgtcttgagcatcagattgcccccgtcagcccggcggctgtcgacgcaggcgtgcctgcggtgaaggaataacctcttatgctggagttgttgtttctgcttttacccgttgctgccgcttacggctggtacatggggcgcagaagtgcacaacagtccaaacaggacgatgcgagccgcctgtcgcgagattacgtggcgggggttaacttcctgctcagcaaccagcaggataaagccgtcgacctgttccttgatatgctgaaagaggataccggtaccgttgaggcgcacctgacgctcggtaatttgttccgttcgcgcggcgaagtcgaccgcgcgatccgaattcaccagagcctgatggaaagcgcgtcgttaacctacgatcagcgcctgttagcggtgcagcagctgggacgggattatatggccgccggactgtatgaccgcgcggaagacatgttcaaacagctggtggatgagaccgatttccgcctcggcgcgctgcagcaactgctgcagatttaccaggcgaccagcgactggcagtcggctattgaagtggctgaacggctggtgaagctggggaaagagaaacatcgtggcgaaatcgccaacttctggtgcgaactggccctgcagcagatggcagccaacgatctggataaagcgatggcgttgttgagaaaaggcgccgccgcggaccgcaacagcgcccgggtatcgatcatgatgggccgggtgtggatggaaaagggcgactacgccaaagcggtggagagcctcgagcgggttatcgatcaggataaagagctggtgggtgaaacgctggagatgctgcagacctgctaccagcagctcggcaaaaccgatgaatgggaagtttttctgcgccgctgcgtggaggagaacgccggggcgaccgccgaactgatgctggcgcagatccttgagcagcgggaaggcgtcgaagcggcgcaaaactacgtcacccggcagctggaacgccacccaaccatgcgcgtcttccataagctgatggactaccatctcaacgaagcggaagaagggcgggcgaaagaaagccttggggtgctgcgaaacatggttggtgagcaggtgcgcagcaaaccacgctatcgctgccagaaatgcgggtttaccgctcatacactctactggcattgtccgtcctgccgctcgtgggcgaccattaaacccattcgcggtctcgacggccagtaaagccaaaaaaaagccctccattagttacaacatacttatcgcttcactcctctccaggcgcggcctcggcagcgccatcgtccggtcagggcaggtacggcagtctgttattttgttcgcttcacaggtagaatgctgcccgtttaccttttttgcgccaccccggcgcccatcaacactaaggtctggtcatgacgtctacagctatcccatcttcccgcgctgtcacatcctctcccgttgtggttgcgctcgactatgataatcgcgataaagcgctggcatttgtcgaccgcatcgacccgcgcgactgccgcctgaaggtgggcaaagagatgttcaccctgctgggcccgcagtttgtccgcgatctgcatcagcgtgggtttgaggtgttcctggaccttaagtttcacgatattcccaacaccaccgcccgcgcggtggccgcagcggctgagctgggcgtatggatggtgaatgtccatgcttccggcggcgcgcgaatgatgaccgccgcgcgcgaagcgctgctgccgtttggcaaagatgtgccgctgctgatcgctgtcacggtactcaccagcatggagtccagcgatctacaggatctgggcattaccttatctccggctgactacgcggcgaagctggcggcgctgacccaacgctgcggccttgatggggtggtgtgttcagcccaggaggcggtgcgctttaagcatgagctggggcaggcgtttaagctggtgaccccggggattcgtccgcagggcagcgacgctggcgatcagcggcgaattatgactcctgagcaggctcaggaagctggggtagactatatggtgattggtcgcccggttactcagtcggcggatccagccgcgacgctgcgggcgatcaacgattctctgcgcaagggggcataatgagcgattccaacagccgtctggtctactccaccgaaaccgggcgtatcgacgaggcgaaaccggcgccggtgcgcccgaaaggcgacggcattgtgcggatccagcgccagaccagcggccgcaagggcaaaggcgtctgtctgattagcgggattgatgccgatgatgctgcgctaaccgctctggcggcagagttgaaaaagaagtgcggctgcggcggcgcggtgaaagacggcgtgatcgagatccagggcgataagcgggatttactcaagtcgctgcttgaggcgaaagggatgaaggtcaagttagccggtggctgatcgctattttccctctgctccagtggtctggttgaaataacaaggccgcggtaaatgccgcggccttgaatgatttaacgtgcgtaagtcaattcgtgtgaattattcttttatttcgtcagataattaaattatttgccgacctggtgaccaataataccaccgactgctgcgccacccagggtaccgagcgcgctaccgtcagttaacaccgcaccaccgatagcgccggcgccagcgccgatagccgtgttacgatcgcgtttagacatgttagagcaagcgctcagagacattgctacagtgacagccagaacgacagcagccatttttttgctcgttgaagtcatcattttttttctcctgaataatctattcatggattacagcgctcctctaagcatagcctgataaagcagctttagggcaattccatgaagttaaggtgcgcaggtgtcacgaaaatcacgcaggtgatagtcacttcctgttatatcgctaataataattttactttttttaaaatttatcgtcaggtaaaaagtcttaattagcggctcggaatactctcagagcgataaagcgccccttccggcgctttggcaggagatggggcggcggaggatcagatgtagggcacgatatcgacggtcaggccgctgcggagcaattgttcgcgacaggcgtccggtaagcgatcgtcggtaataacgcgattaaagcggccggcgggaccgagcggatagggatgtaccgcgctgaattttgaactgtcgctaagaataattgcctcacaatgcttctccagcacggcgttcaccacgtccgcacgcatcatatcgcggccggtaaagccggtttccgcctgccaaccgtcgatcccgatgaaggctttgctgaaatgcacctgctggatgaactgacgggttagcggaccgaccatactctcactgcgtttctgataaattccgcccagcaggatcacctctcctggggtctctttcagcagatgggcgatatagctgctgacggtaatgatggtgatatcgccgcgctcggccagcgtacgcgccagcagggcattgctgctgccgttttcgataaataccgtttcaccggtattcactagcgccgcagcccggctggccagctcacgcttaatggcgaaatgggtcatcatgcgggtttcgacatcttcgctgtccagcggtacggcatagccatgagtacggcgcaaatagctctgcttttccagcaaattcaaatcctgacgaatagtaacctcagagacaccggtcatcttcgccagatcggcgacgctcatgcggcctttatcgatgaccacttgcaaaatactttgttgtcgggcgttcatagcaacatcactgttagggggctatatggcgagcaaccggtccatatggccggctgcggcatggctgatattcagatttcccagggcgccttgggttggttttgttgttcagcatcgtccgccgccagcgccagcagctccgctttgaggatctccagattatggatcgcagaatggtaatcaccggcaaccagaatatccagcacggtatcgatacgttgagcgagcaggtgggcattcacatctgacatggcattatcctggtaacaaaaacgaatgaaatcaatgatgctaaaaatgaatgaaaaagagaagcgaaaaaaacgcacaaccttaatcggtgcgacggaaatggctggatagagaggaaagaagcagcggttcccgcaggaaccgctgtgaaggggcgtcagaccgccggacgcgcaataatgctgcgggtttccatgcgaacttcagcgatagtgacatcgataacgtcagtcactttatagactacttcacctttgatctgcacggtaccgttctcctggctgcacaccagttcgtcgcgcacggcgtggaggaacggggccggaataaaggcgaccgcgccattgtccaccagacgcacgcgcatcccgccgcggctgacgtcgatgatctccgccgcgaagcgggtatcggtcccggctttatcgttgaggaaacgggcgtacagccagtcggcgacgtcgcgctcggccatccggttgagacgacggcgctccgccatctgcacggtggcttcatcctggggacgcgcaatggtctcgcctttaatgatggctttcagcagacggtggttgatcatgtcgccatacttacggatcggcgaggtccaggtggcataggcttcaagcccaagaccaaagtgcgggcccggctcggtgctgatttccgcaaacgactggaagcggcgaatgcggctgtcgaggaaaccggtcggctgagcgtccagttcccggcgcagcttgcagaacccttccagggtgagtacttccgtcgggtcgacgtgcacatcatgggttttcagcagggcggccaactgctcggtattcgccgggtcgaaaccggtatgaacgttataaacgccgaagccgagcttgtcgcgcagaacgcgggcggcacagatgttggcggcgatcatcgactcttcgacaatgcggttggcaatgcgacgcggttccgcgacgatatccagcacttcccctttttcgccgagaacgaaacggtagtccggacggtctttgaacaccagcgcatgggtctgacgccattcgctacgacgctggcacacgtccttcagcagcgtaatttgctgcgcgatcgcctcgctgtccggctgccagctgccgcggccttccagccagtcagagacgtcgtcataggccagcttggctttcgattcgatggtggcggcaaagaactcgatattgtcttcgatggtgccatcggcccccagagtcatccggcaggccagcaccgggcgcacttcgttagcgcgcagggagcagagatcgtccgacagctcgcgcggcagcattggaatgttgaagcccggcagatagttggtaaaggcgcgcacttttgcggcgttatccagcttgctgccttcggcaatccaggcggtcgggtcggcaatggcgaccgtcagcagcagtttgccatcagcagtggactcggcatacaacgcatcgtccatatcttcggtgctggcgctgtcaatggtgacgaagtcgagggtggttaggtcgcggcgcgtcagcccctcgtcgagcatctcggtggcgacgccgtccggtgcctctttctcaagattatggcgcgccagggttacccaccatgggacgaagtggtcgtcgctaaaagtgatgaactgggtcaactccgcgtaaaatccgcggtcgccttttaatggatgacggcgcatctcggcgacggcccagtcaccctgtttaaaatcgtgctcaacgccgcgggcggcgcggcagggaatggcgtctttcagcagcggatggtcaggaacgatagcgaggcgatcgtctttcttctggactttaccgacaaaacgagtcaggaagggctcaaccagcgattccggctcggcgctttcgcgttctttttcagaatggatcaccgcgacgatacggtcgccatgcatcacttttttcatctgcggcggcggaatgaagtagctcttctgagcgtccacttcgaggaagccaaagcccttttccgtgcccttaacgaccccttccgcgcgcggcgtctgggaatgcagttgctgtttaagctgcgctagcagcgggttatcctgaaacataattaggtattttcgtggctaaaagagcggctgacatttttacgcgaatatgcctgccgcagcaagcgctgtttcagcaatttacgtctgctgacgcacattgccgagggcgattttcagacgattcatccatccgcacagcccgctccagatcaacagatcgattgcttgttgcgcagagagtcgatattccgcgaggggcgttaactgggcggcgctaaaacggtcaggcgagcgggttaacagctgcaccgcggtcacgagagaccgggcctgaggatgctgctggagccagtgatggagggcctggtcgccctcccgcaaatggctggcgaactcctcttcaccctgccagtgggggagccaggcgtcaaaacaggtggggctgccattggtgcgcgccgtgagtaaggcgacctgcgggccaaaggtatcatccgtgctgagctggcggatcaaggtctccagaggcgcgaataactgtgggtcgcaggccagcagcggcgccagctcgcccagaccgggcagcgactgccagccggcgatgcgccgctgacgctcatcatcggcatactgcaggtcgggatccgcaatgtctgcctgccatgctcccggcggcggggcgaacagttccgcgggtgcctcctcttgctggggcataccggggatccagcgcaccggaaagccctgggccgcctgcaggacggcaatcgcccgcgcctggaagccgacgaatccgataatctggttgaacagaataatgtcccgactggttaagcccacttcgtccagctggctacgggagagagcgttaataaccgagggcgaaccggcaagctgacgagcatattgcgtgatttgcgccagacgacggttgctctcgcgcgaggagtcggggcctggcaggggagcaaggcgggcggcgtagtggttacacagccgctggacgccgtagacctgggcgacggtgagcgcggtgctgagtcgatcgtaagcggtaaaggtctgcaggcgactcaccgccacctggtcgggaaatagcagttcggccagctggcgtgcggggtgtagccagtcagcgtgggcacttagccaggcggccggcagcgtcaggtccagcaaaaagcggtcttcaacatgggcggcttcagggacgagcggcaggacatccaccgggcagattgttgactgggtttcgtgataccagtgatttttgccattcacgcggcgtggctccatgggctttccttgttcggtatgtggcgaaccgccgttccgcggatcgtttatgcagaactatcctggcgtaacccggaagcaggagaaaatattgatacgtgctaacaaatagccgattggaataacaggtggggtgtaaggcgtgggggagggaagaaccctcctcaccggggcgaggaggggaaggaacttatttcagttccagctcgttcatggcggcgatattgaacccgccgtcaacgtgaacgacttcaccggagatccccgcagacaggttggagcacaggaaggctgcgctgttacccacatcttcaatggtgacggtgcgacggatcggggtgaccgcttcgcagtgcgccagcattttacggaaatctttaataccggacgcggccagcgtacggataggaccggcagagatggcattgacgcgaacgccttccggacccatggcgttagccatatagcggacgttagcttccagagaggctttggccagacccatcacgttatagttcgggatcgcgcgctctgcgcccaggtaggagagcgtcagcagagccgaacccgggttcagcatgccgcggcaggctttggccattgccacgaagctgtaagcgctgatgtcgtgcgcgattttaaagccgtcgcgagtgacaacgtcaacgtagtcgccgtctaactggtcagccggggcaaaaccgattgagtggacgaaaccatcgaattttggccagactttttccagctcggtgaacagcgcggtgatgctctcatcttcagcaacgtcgcacggcagcacaatgtcagaacccagcgcggcagcaaactcttctacgcgacctttcagtttctcattctgataggtgaatgccagttccgcgccttcgcggtgcattgcctgcgcgatgccgtaggcgatggacagtttgctggcgacgccagtgatcaaaatgcgcttaccggaaagaaaacccatagctttaatccttatcgttattgcttatttttactttaacaatcataacgttaacattgttatttcaaaataactcaaatttagccgggaattatatcccactgacgaccccttgtgtcacgatatttttcagccggtccgcgccgcgcggggcaaaagtacatcgcgatagctgcagtatatcatctctcctgacgattatttgagcgcgatctccgccagcagcaggcgtccattgctgcccaggggacgcagattccgcggggatccaccgcgccagcagaggccgctgccggccgcgcagcgtcgcccggccagatcccactcgccttgtagaacataagctaccccctcgctggcagggcattgcaggtcgctaacgacctgaactgtcgccgacgcgcgcccgcgctgagtcatgatattgaagtccagccctggcgcaacgatcccgacgctggacagcgcccattcgccggggaaagcccacggctgccagagcgccagcggttggtcgatattctcgccacacagccgtagcggctgccccgccagcagagtaatgacccggtcgacgccaggaaagggggagaaagggccatccgcctgcagggtggcaatactcgctcgccagagaaaaggggcatctggagcgggtacgcagatgatttcgcgcgtctctccgccaccgtttttccacggcgtgacggggagcgtcgaaagttgaaaagggaccatcatgggcagcataccttagttaatcgcttccggcgtcaacaataagcaccgccttgagctagttcagtaactttctgcagtacaaatattttacatattcgtcacaaaatgagagtgcatgcaaggcggtgagttgtcaatgcttgtatatacaagaacgattgagtgaggtgatattaataacttgagtgaggaacctatgtcttcgttttcgtctacagacgggcagtcaaagagcaattatgctggaatgagtgaaaggcggtcgattgattacatcccggaaagcgaacggcatggacacccttttagccagttcaccctttggtttggcggcaatctgcaaattacggcgattgtcactggcgctttagccgttgtgctgggcggcgatgtagtgtggtctctggtcgggcttctggtcggtcagatgctgggggcggcggtgatgtctctgcatgcgctgcagggaccgcgactgggacttccgcaaatgatccttagccgcgcccagtttggggtttttggcgcggtggtgccgctggtgctggtttgcgtcatgtatatcggtttttctgccagcggcaccgtattggccgggcaggcaatggccaaactactgaatatcagccacgtagccgggatgctgatattcagtgcgattattatcgttatcgccgtcctcggttataaggtgatccacaagctgggcaaactggcgagtatcgtcggaattctcgccttcgtttatatgttcatcacgctgctactttcggccgatctcagtgcgctcgcgcacaataaccatttttcgctgccgacgtttttattagccgtatcgctatcctcatcgtggcagatcgctttttgcccctatgtatccgactattcgcgctacctgccatgcgatgtttccgccacgaaaacgtggtgctcagtgtttttcggcaccgtatttggtacccaaacgtcgatgacgctcggggttctgacagcggccattgccggcagcgcgttccctggtcatgaggtgagctatctggtgggattacgtaagagtcaggcgatggccatggttatctatttcgccatctgttttggtaaaattaccttcactaccctcaatgcgtacggcagctttatgtcgctgaccaccattgtttccgccttccgccggcaaaccgtgctgtcgcaaaagtgtcgcattgcattcgtggtgctgatggtgacggcttcctgcattatcgcgttgcttagcgaacccgctttcttaaagcatttcacgcattttcttctgtttctgctggcgttcttcgtgccgtggagcgccatctgtctgacggattattatcttatctcgaagggcgccatcgatattccggcgctaagcgacccgcagcaacgctacgggttctggaacctgtacgcgatcaccctgtatatcgtcggtgtgcttatccagttgccgttcattgagaacccgttgttccatggttcgctcacgtggatcttcgccggtaacgatgtctcatggataataggctggtttggcaccggggttctttactacgcgctgcgccgctttgaccgccggtcgctgccggcgcagagtcttttcccttccacctgaatgacaagggcggcgtgagggccgcccctgccgttgcctgccagctatttcccgtctttgcgccaggcgtcggcggtgagggcttccccgaagtggccggcgatcaggcgccgggtcaggtcgtgcagcggcgaggccagcacatcggcagtgctgccgcgctcgaccacttcgccgttatgcatcaccagcacctgatcgctgatgtgtttcatcattcccaggtgctgggtgacatagatataggagatgccctgtttctcctgcagctccagcatcaggttgataagctgggagcgcatcgacatatccagcgaggccagcgcctcatcgcagatgataaccttcgggcgcaggatcagcgccctggcgaggccgagacgctgcttctgaccgggcgccagcatatgggggtagtagctgacgtggtccggcagcagaccgaccatgcgcagggtgtcgattatctgcttctgccgcgcctcggcgtcgagatcggtattcagtcgcagtggaaaatcgaggatctgcgagatgcgctggcgcgggtttagcgaggtcgacggatcctgaaagatcatgcgaatcttctggctgcggtaggagtaatccccaaaagtcagcggatgatcatcaatcagcagttcgccgctggtgggttccaccatgcccgccagcatcttcgcgagggtcgatttcccggagccgttctcgccgataatcgccagcgtctgccgttcacgcagggtaaaactcagcggcttaaccgcctcaaccgtctgacggtgaaaccagccggtgcggtagcgaaaggtcttactgagttggcgaacttccagcaatgtttcgaccatttcactctttctccatgttcaacgggaaatgacaggcgtacagatggttgcgcgccccggtaagacgcggcgtttcgatacactcgcgctgggcgtacgggcagcgcggccctagccgacagccgataggcaactgctccagcagcgggatcgctccaggcagggtgttgaggcgacttttatgcggcatggcgctaccgaaatccgggatcgcgcggattaacgcctgggtgtaggggtgatgtgggagggtgatcagctcttcgctgggcccactctccaccgtctgcccgcagtacatgacgttgattttatccgcccatttgctgagcatttgcaggtcatggctgatcagcaagatggtggtgttgttgttctggttgagccgcgtcagcaggcgaataatctgcgcctgggtggtcggctccatggcgttggtcggctcgtcggcaatcagcagacgcggctggttggccagggcgatggcgatcatcaccttctggcactcgccctcggtcagctgataggggaagctgcgcatggcatctttgtgatctttaatgccgacgcggtgcaacagctcgatggcccggcgcttgcgccagcccagccgttgccaccagcggcccttgtaggtccagccggggatactctgaatcagctgctggccgatgcgctcagagggatcgaggcacgactggggctcctgaaaaatcatcgacacgttatggccgatcagcttccggcgctcgcggttcgacagtcgcagcaggtcgatgtcatcgaagcgcatgcggtcggccgtgacccgccagttgtctttggtcacgccgcagatagctttggcaataaggcttttcccggagccggattcccccaccaggccgcggatttcgccttcggtcagcgtcaggctgacgcgatcgacggcttttacccagccttcgctggttttaaattcaatggttaagtgacgaatatcgagtaacggcattattctaccccggcaatgatcgcccggcgaataccgtcgcccagcaggttgaccagcagtacgctgagcataatcgccgccccggggagcatcacggtccacggcgccacatagataagctccagcgcatcgcccagcatggctccccattccggcgaaggcagctgggcgccgagatcaagaaagcccagtgcggcaatatccagaatggccatcgacagggcgcgagtgatctcggtcaccaggccggaggcgatattgggcaggatggcgaacagcagaatattcagcgtcgaggcgccgtcgaggcgggcggcgatgatgtactctttctccagctcatcgtggaccatgctgtagacggagcgcaccatgcgcggcagcagcgccagccagacggcgaacatcgcatggctcagatgcggcccggcaaaggcgacgacgataatcgccagcagcagcgaggggatggagagcagggtgtcgaggatatggttcatcaccgccgagcgcaggccgtgggtcgatccggcaatcacgcccagcaccagaccaaacagcgtggcgccgagggtgacgacaaaagcgccgccgacggtgggcgccgcgccgctcagcagtcggctcagcacatcgcggccgaggtcatcggttcccagaaagaaggagacttcgccatagcgcgaccacgacggcggcaacagctggtagccgaggaactgctggtcgatgccgtagggggcgaaccagccgccgaagacgcagagcagcaacaggcccgcgcagccgtacaaaccgatcatcgccgtggtgtcgccatagaacttacgccatacggtgcgcagcgcgccgggcggacgcttttccagataaacgctatcgtagggcatatgaatccgttttaagtttgttagtcatgctttaagtcttttcaaaaatcccgctaataccaataccttgctagcatagagtgctttaattttgtgtgttctgcattgatttgaaggttatcaatttaaccaaaatgtgtacactgatgtgtatatcatcttccggagtgtacacattgcttaccgacacaaaattaagaaaagctcttggcaaaaagagagaccagatcgaggtcatatcggacgcccatggtctgaatgtccggttgtctacttccggcagtataacattcttttaccgctacagatggaacgggaaagccgctcagctaacgattggcgattatcccaccacctccttatctcaagctcgcgaacgtagacagcagttcagggcctggttgacagaaggactcgatccgagacggcaaacagttctggagaaacagaaaaaagtcgaagcgctcaccgttaaagaggctttcgattattgggaaaagtattactgcatccccgaaggtcttgtgaaaatcaaggttaaccgacgggacttcaataaccatatagcgcctgtgctggggaacatgattgttgatcagaccactaaagcgcactggcttaacctttttgatggcatggggcgaagagttgtcactggtcagatgcttgggctgatgcagcgtacgttccgtttttgctccaatcgaggggtaattaatgtgaacccaattgagagccttaggcgctctgacgtaggtctcacagcatccgtcaaagatcgcagattgagtgatgaggaaatcaaaacagtttggaatatccttcctgaattgaagtacagacaacagctgataatgaagtttctcatcatgactggctgccggagtacggagatcaggacggcaagatgggagtggttcgattttcatgagcaaacgtggaccattccggcaagcgattataaaaccgggaaatcggtcagaagggcacttcccgaggcagtagtaagaatgatgttagcagagaaggaaacgtcagtttcaaaacacgttgtgacactgtcacgctacagagggccagaagatgacagaccgccactacaaccaaacgtcgctctgttttctgctcagattatagctaaaacaggcatgaagccctggtctctccatgacctcaggcgaacagtggcgacacgcctttctgaattaggtgcgccgccacatgttgtggaaaaactgcttggccatcatatggcaggtgtcatggcacgttataacctgcatgattatctggatgatcagcgtcactggcttgctgtttggcaggatcaccttgagaagctggttggtcagcctctggtttgatccccacgttatcttcccaggccaacaagtctgaaagtctccaccttttagggctgccatttattttaggctgcgggaatggctgagcaaagtaagagggcatccgggatggggtgctccagaaataaagtgtgctgcgcgatattttgtatctggacagaacgtcatcggttatcaaaatttcatctgatttatgagatgtattagtcataaaaaccccttagttacattgtccaggcagatggtgtagccggcgcgcgcagctcatggctgtggccacatagctactttttctgttaacaacttctacagtgatctttgagccttgaaccaccaccgtataagttctctttgttttctgtcgcccgtaggctccataaagctcaacgtgttttgccagtgccgcatcgcacgcttggcggcccagaggggagtgtctgcttcggttaatcaatcgcatatacattcctttatcgggagagtttcccctcccaatctggttaacccacgtattccggtttcatgtcgtccagggtgatgcggaactggtcatacagttcatcaccgaggtggcggcgcgatgaggtcaaggtgctttctgccttcgcgaataatgcttctgcttccggatcccccgggttagggagtgaatttatggcggcctcaactttgttcttcgcatcaacaaggtagtagcgtttcaccgccttactcttcagttcggtatacaaagcagtacccagcagagctttctgtgattcgatgtctgcacgaatggctttggcctggtccactgagtcagctgtatcaatccggtctcggagttcgtcagcaacagagtcaacgttagatgcaggctcttgcgtgctggtggaatcgccaacggagtgtgttatctcattcagcgtgaccttttctgtctgcgccgggttgataaccctttcttcgcgttcgtcaatttcatcggcggtatagaccccgaggatcacatccgggcagtacagtcgcgcccaacgtttaacggcgagataggccagttgctgacgggggtcgctcgcccacagtgtagagttgcggacttgtgcctgcgaaagcatcagcacaagctcgcgaggttctgattctcctttgagggttgcccaggcgcggacgcccacgccagcttcatcttgcaaatcccagcccggcgcgatgtagtcgttacctttgccgctggtttttttaatgaagcggccaacgatattttcccatgcaccaaaccattcaaagtgaatacggtcttttgtcggagccatggtgttaattaccgcattcaccagttgtgcctcatagccaagcacacctgagttacccacgatgaaggttttctgtgccactgcaaacggatccataccccaacgcgctgcctgcatcactacagccatgcacgcatctggtttcccgcgataatgctcaggcacgaagtttccactattggccattacttccgagagcgtgcgcaggcggttgaacaattcaccgttcgtcaggatagaaacgttgtcgatcttctgggtctggttttcagtagttgcgactaaattggacattgttattcccccttatgcctgcacgcgcagcgcttcgagacggcgcatatcaaaatcgttaagttcttcggtgtagtcttcggtaatcggcgccggccattcgccagtgtcgaaaccgttcgcaatggcgcgcatagctttgcggtattccagcatgccgagttccagcagttcttcggatgcctcgatgatggcgatccagtggtagttctcgtctttgttaacgaatatccagaagaactggtcaagggctgcggtttcgcagtacatagccgcgctcaggtggtaatcgcgctcgatgatttcccggtgcagcttcgcgcgcaggccttcctgcttgatgttccacatactgatggttttcaggtccgcaccgatgcgcaggccgcccatgtctatctcaaggtcagggcgcacgcgaacttccagcccggtttcctcatcaatgccgaaatagctcacctcgacggcacggctcgggtgcgtcaacaacttgccagcggtcgggtgattcaacagtgctttctgaatggccagtgccgtagccagctgctggcgggtaaccagcacttttccttccgggttctcgcgccatgcatccagcaactcgtcggcaaacacggcatccggttttaccgatttcacggcctgaatcagatcggcctttgcgccagagactttcagcggctgcgccttctgtgcttcctgagcaaccatgtcaggattaataagcgccagctgttccagtaaggaatcgcggctgccgctggttttcacctgggcgggcagggtcgcgttgtattccttgatgcatgccttcatagcggtggcagtttgcttctgaccgtcttcaatgcgctggaactcagcaggtaaagacatatacccctggccggtttcttcaactgaagtacccaagggaacctgggcgggcagggtcgcgttgtattcctccaggaatctcttgatgtcatctgcgctgagcaaaaccggaagcccgttgttgtactcgtcgataaacgcgcggatcgtcgcagtcgtggtgaatgcgccttccgggatttcgggctcgatgctgaattctttttccagctgatcaggctgcagcgccagtgcatgcaccagatttcccatatccagaacaggggagcgtaccttctggatggtcttggatacgtggcgcgcctcgaaatacatcagcgatacccgcgcatctttaaccatcgtggagctgatgccgttagcggcgtggtagacctcatttggcacgccttcatatcgacccggctcgaaatactccggccatgctggcgctatttgttcagcctcttcctcatcatcaatgtgagcattctcagaaacctggcttttcagcacttcggctgtaaggtccgggcaacgttcagccagtatttcgctcatgttcacggcagttgtttgcgcaggaggttcatcagcgctttcgcctgttgataccgaactatcaatttcgtttttgactgactgatccgcttccatctgcacattgctggtggttccttcttcggtggcatttgtagccggtgaagtcataaggccttcaattgaaaacattccgccgccgagatttgcaatttccggggctctgggtttggtcaggtcttcggttatccacttcggatccgtggggtcactgataccttcgacatattcgccacgttcggcggccagaacctgattagcgtcaggacgtttcttttgcgcttctttcaccagttcggtgccaattacctgaaagtcagttgggagagtttccaggtccggcacaccttcatctccatcgatagcctttttcacagcgtccagagtgacggcggcagatgaaacatgaccagctttttcaagcgtctcagcagaaggggcgtcatgcttatgctcggtcaggttcgcattgatataggtctgcagacttaccgggaaatgatgaatatcgctggtggcgccacgaataagggcaaaaatcgcggcgcgggaataatccaggatgcctgcaaccttgcgcagcgcagccgaccattccttgaacggactttctttcttctgaacgatctctttggcccggcggtgaatagatgccgggaaattgtagatatcgaaatccattggcattgtggccagggctatttctacatcgagcgtatcaagggtatgggtgtagtcagggttgcgatcggttttattaccgccgccagcattagttcctgcatcagttttcaaaaccgaagaaatgcagttaccggcagcccattccctggtgagaatgccgcggtcgatcgcgttcgtggcgaaccacagctttgcaaactgaatacgtttgccgagctcatgccgtttcccttccgggaagacttttttattggcgctggtgaatttccagagcgccggcatatcgtattttttgatttcagggacattctcggcggccaggatcagatcctggacggctgcgttatcagtgtccatttcaagagctgacagctcctgccggtgaggcatgctgatatgataaacgtgacgttcttcggccatgtactgcgccagcagctgagcgcgaaaagggagttctgccacattaaatagcgcgctcgaatcgtcctggtattcatcgctaccgaaagtttccacggtctcatcttgtgccgcgtcgccagtagtattggcatcaaccaactctccagtaacggcctcagaggatactccggcattatcgccgtgatgaacatcagcaggcgccagtcctggcttaagagtccaggtgcggccatcgtcgccgagctggtagcgttcgcaccatgagtaatcgagaacaccctccgctggcaggtcgttgaataccgggaaatcggtgcgaattggtttttggtaatccttaccgcggcctgtttcgatcccagcgtcttccagatcgacgtccagctgcagaagggcgcgagcttctgttttattagtgcgccagattacggcatcagctttacccgatttttgagtcgcttttatcagataaaaatattccatgtgatagcctctattttggatgtagaatcccccgggccattggtagcgcccattcagggtggtcattggttttggtaatttccggtgtaactttggtcggtggcaccggacgtacagcccgcttcggcgggtttacgttagccctcgtgagccatctggtcgtgagaggcgcaacgttcagagcaatactctttttctttccgtgcgagctggttcccctggaggtacaacagggtgcttaccactggttttccctcgattgctttacggcagtaaccgcattttttctgcattcctccccctacatttgcaccgtgaacccggccggatgcttgtccagtacacctttcagcggataacattcagctttcacgtgttgctcttctgcagctgccttgcagtcattctcagtgtcgtaaacgccgagcaggacatcctgattaccgcccgtcagcatgctgacggtgagaaccagggcaaacatcgtgctcatgaagggtctcctttttgcgcgagcatgtagcacactcggcggatgaaagctgacagcggatttaaacgaacagcctgctgacgagcgggtttgcgtgcgaaatcattcatagaaacaatcccctcagtgcgctgaaaagcgcgatccagatgaagagcccaattactgctgaaatgaccatggctctgataccgtgcttgctcatttcaactcctcatgtatgcctgtcttttaaccacttcaggctcggtggtatgctggtagttctcacacagccagcaaggaaataaaaatgtcaaaactgacaacgatgaaagttgcttgccctgattgcggaagcgagatgctcaagcgtcccgatgatttcgactttgatacaaattttgttggcgtcagttgtgccaactgtggtcgagaaatcactaaggacgatgtcgttaagcaagggacggatgttgtcaaaaagcaggttgacgacattctcagggatgccttcaagggaacgggctggaagctcaagtaaccccagtagttcctcgacctgattgattacttccgtggcgtctatttcgagttcaataggcgccacctttaccttactcatctcatcctcattgccttgtcgccggccagcggaacgttactacctactgcgcattgatatttccacctcatcccggcattcgtatgctccgggcagctacttcgtgggcgtcctgccttggtggggtgttgctggagttaattaaacacaatgtttaatgttgtgtcaacattgtgagtaattaaacgtaaacaaaaagtttataacgagaggtgggttagtgcagggagtatgtttatgggtctattctttggttttaaaaacatctatgagggctaatggtatgcggtatgacgatgagtttttcgcgaagatgcacccgcaaatagcgcaggttatcggggtagcggttatgcagctactggttgagaagcaagagccgtcaagagaggctctgatagagatgatttaggtgttgtggcaggaagaccatgtcgatctggctgtggaattggcccttgacgttctgtcgctaccgaaagagtaggggcaataaaactcgacgcgtggccgggctactggcgctgacaatacggcaatattttttcaatcgctgattgaataaatgaagggctatgaaagtcaggatctttcaacgggtcactgacatcaatactgttttgcagggagcgctgatattcactccagagttccgaaaggtgtttcttgttcttggggctgcagatatcaatgaacgtatcaatctctcgctgtgatattgatacatttccgccaccgggaaacactccattctcaataagtcgcaattgatctcttaatttttgtcttattatatcgcttattgcattgaactctttgcgtttttccccttttactgcatatctgtagctaaagtaaccgcttgcaggaactgctgtgatagatacaatcattgcaatagttgcaacgatgtcgctatagctcatggaggttttcctatgtctggctctgatatcttggccacagttgccttgattatttcagttacaaacctctccgtaattctctacgggatatggcgcttacgtgattaaaccgttgtgatgattattcttcatcgcccttaatccttcgccccatgtacttggcatacagctcatcgagttctttgagacgcagagatacgatccgcagcatgttctgttgctcttcttcgttggggagttggttatagagttccagcaaccgtttctcgtccgggcgtaaaccatcatttgcatcgacgtcctgacctaaaacccactcaaggcttacgccaagagcatcagcgagctttatggcagagctctttccaatcgctccccgcacaaaccagttgttaaccgattgcgaacttacaccacaaattctcgctatatccgctttggatatgcgcttcatctcaattatttcattgagcctttggacctgtgggttgtcggactggtgcgtattttttctcatatatcacgattttaaactaaatgtttaccgtctcaacattcataaagttgacattaaaataaacataatgtttaatccactctgtaactttaatggagtggtttatgaacgcattagaaaaagccatacacatcgctggtgacgcaacgaagctagcagaaaaactggacgtctcatctatgacgattagccattggaagcatcgccatgggggagccgttcctcagtctcgggttttccaaatcttccgggtaaccggcgttactccgcatgaacttcgcccagatctttacccaaatccaaacgacggtttgtcttcacaaaatctggtgggatgaccatgcaaacactttcctttcaacaaaataccggattcaaccccggcgctctgataaagcgaaatcaggcgaaagtggcagatcacgacggcattcgttctgccgttcgcgcctgggctgcagctgaaggtcaggatgttgtatcggcgtacatcatcgatgagtggcgccagcagggcggggaagaaattgaatttcctgcggacatcagccgcgcccgacagaagcttttccgttatctggataacgaggtcgattctgaaaagtatcgcgcgaatgtgcgtcttctgacgccagccatcatggccgtcctcccgttggaatttcgccaccgcctgttgcctgaagacaatttcatgtcccgactggcacggctggagaaagagaccagcgaagcgaaggttgccgttgccatgggagctccacgtcatcaaaagctgaaagaactgagcgagggaattgtcgagatgttccgggttgacccagaactaacggcgccactgatggccatcgtcacttcaatgctgggggttttgtaatgtcgggtatcaaaaaggcgaaagccgcggtgctgtaacaccaacggctttcaggtgcaaaaacgaagaggtaattgcgaggtaagtatgtcagaaacaaagactgaggtaaacgcccaagcgacccataaatgctccttttgcggagcgagcaatattgaggtttcgggcgttctaatcgccggccccggcgtatccatctgtcaaaaatgtgtctttcagtgggttgatattgtctttcaacacgcagaaaagaccgataaaccaacgtcataagttcaggggtatctatgcgtgactatgcaacagtcgcaccgcaattctggctggggaaaacaggtcgggaactgcggaaaaaaggcgctgaagcgcaggtggtttcgttttatctcatgacctcgccacacgcaaacatgctcggtttgtattacctgccaattctctatatcgcccatgaaacagggctgggcttagaaggggcttcgaaggggcttaaaagcaccatcgaagcggggttttgtagctatgacgaggacacagagatggtctgggtgcatgaaatggccgcctaccaggtaggcaaggcattaaagccaggtgataaccgttgtgcgggggtcaggagtgagtatgcatcactttcagaaaacccttttctttcatcattttacgagcgttataaggatgattttcatctgaatgtcaaacgcgaatcgtgcccaacgccagaaggggcttcgaaggggctaggaagccaagatcaggaacaggatcaggaacaagatcaggataaagatatttcggggcatggcgacgccacacccccagatggtggatcctccgatgaagctccatctgaaaagccgaaaagcagttacccggaggaatttgaactggcctggagggaatacccaaaacgtgccggaggcaatagcaaggtcgatgcgttcaaagcctggacagcccgaattaaatcaggcgcaacagcgcaggagcttaccgatggtgttcgacgatatgcggattacgtcactgctgccggaaaactcaacactgagtacgtgaaacaagcgtccacgtttttcggtccctcaaagcactacgaggagttgtggagcttcgaagtaccaaccggtaaacgggatccgaactcaatatcccagccagataaattaattccgagtgggttcagggggtagtgatgaaaaatatgattggtactggtagtgcgctggagcggctgaaaaaactcatccctccgggtgtagagcctaagtttggcagtgtagaggagtggagaacctggcaggccgaggaagggcgcaaacgctgcgaagaactggaaaaacaaaaccagcgtacccgtgctgaaaaaatattcggacgagcgggaattcaagatctgcatcggagctgcacgttcgcaaattaccaggtggcaggagatggtcagcgccgggcgctcacgatggcgaaaagttacgcacagaacttcggttcagggttcgccagtttcgtattcagcggagcgccgggaaccgggaaaaaccatctggcggccgcaatcggaaatcacctgctggctggtggtcgctctgtgctggtggtgactattcctgacctgatgctacgtgttcgcgagtgctacgacgacgggcagtcagaggcttcgcttctggacgacctttgccaggtagatctgctcatcctggacgaagtaggcattcagcgcggcagcagcggcgaaaaggtcattctgaaccaggttatcgatcgccgcctgtcgtcgatgcgtccggtcggcatcctgacgaacctgaactacgaatctctgacgggcaccctcggcgcgcgcattctcgaccgtctccagatggacggcggcatgtgggtgaacttcgactgggatagttatcgcaaaaacgtccgccatctgcgcgtcgttaagtgaggaaaacatggctagagcattttctgctattgagcgccgggagtatgtccgcgcagtgattcgtatcaccagacatcaggggcgactcacgaccgccgaggcaatgaaaaaactggggctgagccgcgctactgtccaacggtatttttccgaagcagaagcgactggtgaggttgtccggcatggtcgtttggggctgttccgcgatcagcgggccgtcatcgactttgacatgaagcgttttggcctggtgccgaaagttgctgttgggatgaattacagcctgcttggcagtcctgtttttcagcgagttttagatgttcaggaggctattcatggctaagaattcaatcgatgtatacggtgccagcggcaaaacaaacgtgctcaatttcgagcctgaaaacctgcacctggtcaccgataagacccacccactttacgatgagcgagtacacctgccgatcgaggaagggatggtactgaacattgcggagctgggtgtactggagccaatcatcgtctggaaagaccctgaaacggggctcacttgcgtagttgttggccgtcagcgcgttaaacatacccttgaggcaaataaactccgtctgaaagaaggcaaagacccactgcttgttcccggagtcgttaagcgcggatcagcaaatcagatggctaaatacatggtcagcgaaaacgaaattcgccgacctgatacaccgcttggccgggctaaaaaaatgtcagacgcgctcgaccgcggactcgatgaggacgacattgcggtgttgtttggctgcagcgttcaaaccgttcgtgcaacgctctcccttctcgatgccacccaggccgtccgggaagcagtggagtcgggcacagttaccgttacccaagcccgccagcttggcacacttcccccggaagagcagcgggaaaaagtgaaagagattgaatctgcgaccgctgggactaccggtcatgaaaaagcccggcgtcagcgtcagatcctcggtgaggcaaagccgcgcctgaaaacccgcaaagaaattactaaagccctggaatctgccgagggtgagtatgcgagcgcactccgttgggtgcttggggaggccgtatgacaatcgtaaaaacccataccggcaccgtgatcaccaaagacggtccgaaggtaaaaaaactgcaccagacagagcggatgtgggtcgtcggcaaaagcgagttttaccacaaagaaacagggcgccgtcactttgcagaaaatacgcgccgccggctgctgctcgacaccatcaagcctatcgaggtgaagcatgtttaaaaagaacaaaaaggctatttcacagattgcggaatatatcccgcgcgcctgccggggtatgcagctgcatgaagcgaaagcgcgtctggagaaaaaaatcgcgctctataccgatgacggctgtgatgttgccgttcttaatgcggcctttgcgccagctcttaacagtcatacgcgggagtcttttttttcgagcatcgcagcgcagctgcatgagggggccaaatgaccgagcaaaccatcctcgacatgtgctgtggctcccgcatgttctggttcaacaaacgagatactcgcgcggtattcgctgacattcgagccgaagagcacaagctgtgcgacggccgccgtctggttatcagtcctgatctcgttgctgacttccgtgcgctgccgttcgctgatgcctcatttccggttgttgtgtttgacccgccacatcttgagcgcgtcggccagaccgcgtggatgggcaaaaagtacgggcgcctgaacaaaaaaacatggcgtgccgacattcgcgcaggattcaaagaggcgtttcgcgtactgcggccacatggtgtgctcatattcaaatggaatgaaacccaaatccccgttagccaaattatagctttaacagacgagaaaccggcgatcggccagcgcaccggaaagaacgataaaacccactggatcatcttcgtgaagggagctgcggtatgaaaattaaatgcatcaaagacacagagggatactggactgaaggtgaaatgtatccggcccgtgtagttgctggcggttttgttcaagttggcgacgattacgatcgcattggcgagggctggagcgctatgcctatcgaataccgggatgacggctcgatcgtttatgaattggggggtattgaagatgacgttcagtttgaggaacgtgcagcatgcgcaaatcattaaccgcacgctgtatgtggatgggaagttgagtttaaaccgtattgcgactcgaaggttagaccgaagtagtgcaaaaccccacgcaccgaccagcagcgcgcggcatgaaggactttgccgcgctaggcttctacgtggtggcgctgcatagcaaagcggtgggggaaattattcccccacaatgaaattaaggctttttgggaggtggtgccggttgagaagtttgcttagcaggctgaaaaccattattagccaaatcatttttaggttgataacccttttctaggggcttgtaaccatcttccttataagtttttttagtttctgacatatacaaaatcctctatttctatgggtaggtagtttgctgctgttcaaagcggaaaaactctaagtgctcgatatccttacttaaaatcagtattcctaaagtggaagtgcgctgacgttcaaaaccaccgtcgctgtttaattcccaatgttcctcaagatagatctgttcaggttctggagcgctggacgcaaacgagttagctccatacttacccgctattttcttcccatcttttagcgtgataatcatccagcatggaactttcagaccaaaaaaataatcccatgccctacctgtggggtgaggcatgtatttacatagccaatcccattcgcgcatcctcgaaaacaaaaaagccaacagtgtcgggctagcaaataatataaacaagtaaaataaaaagtaagcgaaaggatgcgctgcataaaccttgttagattctataaaatacacagggataaaccagattgcataattaatacagctatacgagacaatttcaataattgctttagatgtatcaaaaaaagcattgggtctaagtacgctatacatcttcatacttatgaagccaggtataacgaatagtaaaaatattacaattttgctcttatcccagatatccattttgttttccaaggcgtagaggtcacataggtcacccctcatatgatatcctttaaacctacaagttaccaatcccttctcatgaaccacgaaatggatatcgcgcgttgcgacatatgggtggacatagcatgggtaaaaccgtggcgacgctgatctcgttggaaggtatctttttgggcagagcagagacacagtcagcgaaagtacttgcttcgctgttacggctaggacattgcaggatgaggccttgtcatagggtgacctgcgcaatatcgaagtgtagctattgaaaacgcgcactgcggcaacgctgtctcgcctccttttgctgaggcgctggtgagggctaatttaccggagatgtgcctgaaaaaagacattgcagcatgataaaacccgcttcggcgggttttttaatatggaaaaacatcaatctaaacataagcatggtgttagcaaaaagtgctgcagaggggttgaacatttcatgcaaccggtatactgtttatttatacagtatccatgtgaggtgctaaccatgaaagttgaagtcacaattgataaacataaaaaactccctgatggcgccatacctgcgcttgagcaagaattgctgcgccgcttgtcccagtcttatgatgactgcaaattaactattagacgcacaagcaacgatggccttagcgttttgggcggcgctgatggcgataaaaaacgcgttgagcaaattctgcaagagacgtgggaaagcgcggacgactggttttactgattcaccttttggtggctggcatttcccaaagcatcgcaataagcgtgtccctttgatgctgtcaccggacttttttttgcgtctgtatgtcgctcagggggtagtgtgagtgatggtattgaggttcctactaatcattcctggtacgatgttgtcaggagatcagatggcgccattatttgtagcttcccggccgaaggaaggcatctgatttacagggttaatggcataatttcaatgcgacctttattgcctgaagaagaaatttttactctaaacggatttatgaaatttgcggaacgacttggctaccgagttctcccaccttctgataatatgaaatcaacggcctgaacaaccgttacctactgcgccacggagagaagccatggcgcaattgcacttaataaaacaatctcaaggtatcctgatccccgcgacgccggagaccagtgattttctgcaatcaaaatgcaagctcggatccgttctggaagccgattataagcttgtccgcaatccggcgtttcaccgccgttactttgctttactcaatctcggctttgaatattgggaacctaccggcggggcgatttcgtctaacgagcgcaggcttatcacaggttacgccaaataccttgctgcatatggcgggagtgaatcggcgttgcttgatgccgccgggcaatatctcgaccggatagctgagaagcgatccggctatatcagtatttgcaaatccttcgatgcttaccgggcgtgggtcatcgttgaagccggccactatgacgccatacagctgccggacggcacgctgaaaaaacaccctcgcagcatttctttcgcaagcatggacgaatgcgagttccaggaactgtacaaagcatcgctggatgttctctggcggtggatcctctctcgttcattcaacagcctgcaggaagctgagaacgccgccaaccagcttttaagcttcgcggggtgatgccgatgaaatactcatggtttcagcatcccgaatgcactgcggagcaggcagaacagttggtgtccagatatcaggcgcgtggcatcgtcaccgagaaaagccttaacccggattatctgagctggacggtcagcgccaggctgccggtttgtgctcgaccggagtatacgccgcgatcacttcgtcaacggatttgggggtaagcatggctaatcttcgcaaagcggcgcgcggccgcgaatgtcaggttcgtatcccgggcgtctgcaacggtaaccctgaaaccacggtattggcccatatccgcattgctggattgtgcgggaccgggattaagccgcctgatctgatcgccgctatcgcctgttcatcctgtcacgatgaaatagaccgccgcacgcgcctggtagatgcggagtatgcgaaggagtgcgcgctggagggaatggccagaacgcaggttatctggatgaaagaggggctgataaaagcatgaaccaatatcgaatttcattaccctggccaccaagcaacaaccgctactaccggcataaccgggggcgcacacacatcagcgcggaagggcaggcataccgcgacagtgtcgccagaatcatcaaagacttgatgcttgatatcggcctttccacgccactgagaatccgtattgagtgccacatgccggatcgccggcgccgtgacctggacaacctgcaaaaagctgcattcgacgccctgacgaaatcgggtttctggctcgatgaccagcaggttgactactacagcgtgaagagaatgcctgtcgtcaaaggtgggcggcttgagctaaccattaccgaaatggaggccgcatgagccgtgacgttatcgaacgcatccacgaccgctggcaaaagctccgcctcctgcgtagccgcggcaccgtgctggttgactacaaaatattacgcaatttcgtccgtatctataagcgcctgggagaagaagcatgacagctcaatacttggaatttgttcgccagcagctgatagtggccaccgccgatctgagcggcgcgacgaaagggcaactggtggctttcgcagaaaatgcgcaattcaccgctacggcgcgcagccggggaaggaagaaagtagccgacccggtaaccggccgcatggtaaacccatccagcccgccaattcccgggcagcagtcccgcgctaagggttcatcaatcgctctcgttcttcccgttgagtattcgacggcaagctggcgccgggctctgctgtcgctggaagagcatcagaaagcctggttgctctggaactacagcgacaatatccgctgggagcaccaggagacaatcacccggtgggcatgggagcaattcagcgagaagctggctggcgtgcgcattgcaaagaaaacggttgatcgcctccgtcaacttatctggctggcagcgcaggacgtcaaagccgagctggcgggtaagtatgtataccagcaccaggatcttgcagccctgtgtggcgttaaacctgataactggtgccataactacgctgattactggcggactatgtgcgccatttttaagcggcttgatagcgactctcttctctgtgtcgtgagaacacgatcacaacaaaaagcgactttttcgcagcagggtcttgcaaaagtcaattaaatgcgtcatatttgagtctactttgatatgctgccttaactttaagtggcggcatgaagatgatagtcacataccagtttgtaaaattagcctcggcatcccgccggggcttttttatgcctgcgatccggtcagggctcttgggtagagacgtgccgcacgacacgttaaagccctccgcgcagagccctgaaccagatttctggtttagctcagcaataagaaaactgcatgccatcatttgcttacatcttattgaccagaaaaataacatcttgttaatctattcatgtggtgaatccccctgtgcggtggggcgaccagtcacttacagtgatctgtaaatgcagcgcgagtcatgtcggctgggacatgctcaccgggaggcacccggcaccatgcaatactactaagacattaggttgtgggttgccgtttcggcttctccagctatgtttaaaaggcagtaacggaaaaagcgagcgctctcctggtaaatcggtagctcggactattaggtgcgttttcgtttgttactacctagaatgcctactttctgcccgttcctctgagcgggctttttttcgccatgaataaggctcctcggcaagctgaggaacaaatcatttgaggctgcgcttatgcgcggccttttcattttcccctcaattctgagaggactcacagcaataagagggggcttaatgtccgatcctttaactggtaccggcctgatttttggtggcggtttaattggttccgtcatatatggcgttatcacccataccgattttggtgtggtatttggggcttttggcggcgcagtgttttacgtggctacgaccgcaaacctgacacgtggaaggcaaatagcttacttcatgacgtcgtttattgtcggtgttctggctgcaggattattaggctcaaaatttactgcatggacaggctatacggatcgtccgcttgatgcgctcggtgcggtggtggcatctgctgtaactatcaaggtcctgactttcattaacagccaggacttgagcagcctgttcggattactttcccgattaaggggaggaggttcgagtggtaataaatgacccggcagcgctggtcaatgcggtgatatgtgccgttattgtctgcgctttgatgttttatcaacgtcgcggtgccaggcatcgccctggtatctccattcttgcttacttgctggtattgatttacgcgagcattcctttccaatttatcttcggtctttacgtacagtcccactggctggtggtaatggcaaacgtaatgatatgcgccgccgtgctgtgggcacggggtaacgtggcgcgtctggtcgatacactgaggcactaatgaatcaaacacaattccagaaggcggctggtatcagcgccgggttagctgcgcgctggtttccgcatattacagccgcgatgaaagagtttggcataacagcagctatcgatcaggcgatgttcattgcccaggtagggcatgaaagcacgggatttacccagcttgttgagagcttcaattatagcgtggccgggttgaatagttttgtccgcgccgggcggctgacgcagggtcaggctaattcgctcggccgccgtcagggtgagccctctttgccactggagaggcaaagagcgatcgccaacctggtgtacagcaaacgcatgggtaataacggggcaacagacggctggttttaccgagggcgtgggctcatccagatcaccggcctgaacaattaccgcgactgcgggaatgctctgaagattgatctggttaaacagcctgaattgctggcccaggatgagtatgcggcgcgcagtgctgcttggttttatgcctcacgcggctgtttgcgttatcccggtgaccttgcacgcgtcacgcagattatcaacggcggacagaacggcatagatgaccggcgcgcccgcttcctgaaagcaaaagcggtactggtggtgtgatcatgggaatcgaagcaatcgcggggctggtggttgtcatcctgggtgctatcgctggcgcgttcggcatcggccacgctcgcgggaccagtaaggcggaagccaaagccgatcagcagcgtaccgaagagaacgccgccgccaccgtcgccgcggcagaacgtaaggcggaagttgtgaaaggggccagtgatgtacaggaagacgttaagcgtatgggcgatgacgatgttgatcgcgagctgcgcgaaagatttacccgccccggtagtcgttgatacggcctgcaactgggtgagggtcatctacctgaccgaccacgatattgacgtgatggatatgcagaccaagcgcgacattctggcgcacaacaaatcggtacaggccaactgtccgaaattatgactaaccaaggcctcgcaatagcggggctttttattaccagaagcaggagaagaagcatgttaacagtaaaagtgatgtcaccagatggtggcgaagaaatccattgtggcctgagtgttggtttcaaccccaaccagcagagtattgccgtatcgggaatggaccagaacgtattcctgaagcagggagaggttgcctatgtgatgaacgcaaacggcaagaccatttcccgttacgaacacagggtccagcagtaggcattacagaagctcctgagctaggggcttcgataatgctaaaccgaaagatcgggttaaagcctgataaaaaaccccgtggaggaaatcccaaaactacggggtgctgaacagccagccaatggcggattgtagccacatagttggtttattatctactggttgagaataaaactgagagcctagaaggcttgagagtggctcatccctgagctcacgggtagaacggcagactttgtcatggcagagcaaagtcataacttagtttaggtaacatttcggatataacaagcgtagcgggcgtgtatcaattagcggagttcagcaactgaggaatcgagcattcactgagtgccatagataatgctatagttcaccaggaaaagcagattgcatgctgtcatgagatgcagttcatattttgaacgtcagggttaagtcagtagtgaatataactattaatagtggattatttggttatttgtttttgttattaactatgtggccagtttttataacactgtgtctggcaatgtccatagcattttacggagtgttaatgaagaaggctgcgcttgcgtggctgattgccgctttattttttggcattcttggggggctgcgtgggtattgactctctgatattgaggttatttcgacgtctgtaaggatccatagctgccgtcatccatcgaattcatgtatgctgataaggatttttaaaggaaaaggaatggatgatgaatacccataagcttctggatacatacatgttagttggtaccggtctttctcgcgtcaaatatgagattttttcaggagatgaaggatcatatgcgtttattacgatttatgcatatgagcctcatttccatattaagggccatgattccttaaagttagacgaagctgttgatgtcagatctcagatcgaagggcattttgcagatagctaccagtagccaaaccatttatctgaatctacagccccgtttgtgcggggctttttattgcgcctcgaatgctaagtagtaaccaatgccaccgttaattcccccgcatgtcgtaagcgcggatgtgcaagcataattacggaccgctcaggctgctgcgacaagcaccgcaatgacggttgacagcaattcaagggcataagagtgactccctcggatagtgggaaagcattacagaagctattctgccgagtggtttctataatatttcccacatcgcacagaggtaagacatgtcagagatcaccacatccgagcaaatccgcctggatatcatcaagaaagttaactacgacaccgcagcggccaagctggccattgactgggttggtgatagcaatctgaaagctgagctattcgctgactctttcgatcgcgtcttcactgaaagtgagattgtctcgaagacccgtaaagcgattcaggaagcgaccgaagcgctggcgctttttgataccgcagctgagtaatcatcacaaatgccacctacgggtggcttttttaatggttatcgaatagggggagtctatgccggtatgcacgatttcaatagaagtaaaaagccgctggtggctgccgctctacctcaaaacgctgatgctattctgccagatgattcagcgagagcctgattacgaaaagatttccgcattcatcgcggagtatggcatcggccagaaagtgaaggcgggaccagtgcgaaagaatacggagtaatccatggcaaaaccggactggggcgagcttcagcaacggttcctgtccgatcatgccgcaaccggcgtatcaccgaaggattggtgtgaagcgcagggactgaattacgctactgcccgccgatacatcaagaaacccactgcgcaaactgcgcaaaaacctgcgcagaagaaactgcgcactgcgcaaaaggaaaagtgcgcagaagagctggtggatgatgatggcctcaccgatcagcaacgtttatttgtcgcagaatacctgaaggaccacaacgccacgcaggccgctatccgtgccgggtacagcaagaagactgctgaacaaattggctatcagctgcttcagaaaacttcagttgcgcaggccattgcgcagcagcagaaagcatccattatgcgcacgcttggcagcgctgatgaagtgcttgagcagatgtggcggctggcaacattcgacgccaaccaactttctcagtatcgccgcgggagctgccgctactgctggggcttcggtcaccagtatcaatggcgcgatgcggtggagtacgaagagaagcggcttgaagcgcttgagcgtaaacgtcgagagcctttggatgatggcggctacggttacaaccacaccagcgcacctaacccggaatgtcctcgctgcaatggtgatggcgtcggccagccattcttcgccgatacgcgcaagctggcgcctgatgctgcgcttgcctattccggcgttaagctcgggaagaatggcgtggagataaccgctatcagccgcgagcgaatgtacgaggcggtgatgaaacgtctcggcctggctgacagtgagttcacccagcgtctacagcagattgaaatcgagcgccggcagctggagatcgacaagctccgtaaagagctggccgctgacccggaagatgacgaaccaacgccagttgcgatcaatatcaacgtagtcgatgcgcgagtgagggaagaggatggcgatagctccgacgcttaacgttccccaggctcgttttctggctatgcagcagaagttcaaagcctatgtagctggttttggatccggaaagacatgggttggctgcggtggaatatgcaaagggttttgggagttccccaaaataaaccagggctactttgccccgacctatcctcagatccgcgatatcttctaccccacggtggaagaagttgctcacgactggggactgaaagtcaaaatcgttgaaagcaacaaagaggtccatttctacagtgggcgccagtaccgcggcacgacaatttgtcggtcgatggaaaagcccgacacgatagtaggctttaaaatcggcaatgcgctggtggatgaactcgacgttctgaaagcggataaggcgcgtcaggcgtggcgaaaaataatcgcgcgtatgcgttataaggttgatggtctgcgtaatggcattgacgtgactaccacacctgaaggatttaagttcgtctataaccagtttgttaaggctgtgagggaaaagcctgaactaaggtcgatgtatggtctggtacaggcttcgacattcgacaacgaaaagaacctgccggatgactatattccttcgcttctggcgagttacccgccggaattgatcaaggcatatctgaacggccagtttactaacctgaccagcggcaccatttatcatcagttcgacagagtgctgaataattccagtgaggaagagcagccaggtgaagcgctgtatatcgggatggatttcaacgtcgggaagatggccgggatcgtccatgtattgcggctcggcttaccacacgcggtaacagagattatcaacgcttacgatacgcccgacatgatacgcatcatcaaggaacgtttctggctgtatgccgacggtgactaccgcaaggtccgcgagatttatatttacccggatgcctctggtgattccaggaagtcaaacaacgccagcaaaacagatattgagcagctccggcaggccggatttaacgtcatcgttgatgatgctaacccgccggtaaaggaccgcattaactccatgaacgccatgttctgcaatggtaatggcgatcgccggtacaaggtgaatgtggcccgttgcccggtctatgccgactgcctggaacaacaggtgtgggataaaaatggcgagccggataaaaagagcgataacgatcaccccaacgatgctgccggttacttcattgtgaagcaattcccaatcgttcgacctgcattctctatttcactggacacgacattctgatggccaataacgatattacttacgttcgccctgaggtcagggcggcaatgcccgtgtggaaaaaaattcgtgacgtgtgcaaaggggctgatgctgtaaaggccgccgggaatgaatacctcccttttctggatccgtccgataagtctgcacgcaataaaaagcgcaatgctgattacattcagcgcgccgttttctacgcgataacgggcaatacaaaagtgggtctactggggctggcattcagaaaagacccgaccatgaccgcgccggataaactgaattatcttcgtgacaacgccgatggtgctggtgccagcatttatcagcagtcccagcaggttacagaaaatattctggaggccgcgcgcgaggggctttatacggattatgcagctgagaccgacgaggcgatcatccttcgttatcaggcggaaagcatcattaactggcgcaccaaacgcatcaatgggcgtgatcaactggtgctggtggttttacgcgaatgcatggaaaaggaagatggttttgcgtacgaggatgaaatccagtatcgcgaactggctctggagaacggaaagtttgtctgccgggtatggcgaaagtcagctgacgcaggctctttttccgtcacttccgagtatcatcctaagccaaaaggtgaggatttctgggatgagatcccctttaccttcgttggtgcgcagaataatgatcccaccatcgacgagtcgcctttagccgccctcgttgaaattaaccttggccattatcgtaattcggcagattacgaagacagcgtatttttctgcggtcaggttcagccggtgatttccggtcttgataccgcctggcgtgactggctgcaggataagggaattcgtgtcggttctcgttctccattcctgctgccgaaggaggggagttttacctatgctcaggcgcaaccaaacaccctggctaaagaggcgatggacagtaagcgtgattattctgttcagcttggcgcccggcttatcgagcagaacggcgcggttaaaaccgccacgcaatccagcggcgagcaaaccgcatccacatcggtgctcggcatttgcgtttccaatgtctcggaggcctatacgctggcgctcggctggtgcgccagatatctcggcataaaaggcgaggaatatcgttacagcatcaatcaggagtttatcgccaaagtcgcagaatccggcatggtaacggcaatcgtcaatgcctggcagtacggtgcgattcgcgacactgatatggtcagagctctgcagaggcttgacctgatagatcctgctgacgaccctgaaactgtcattgacgctattcgtaacggcgcgcctaacctgattggtggcaataatggcaacggcgaatgacaaactgcaggatgaatccatagcccacgctatatgggttagtcgctacagcaccggcgttgccaacaggatgataaaagttctgaatgacagcgacgccgaacttaccgccaggctgctggtggctatcgatacgctggatcccgagagctttaccgtttcgcgtctggaagcgttactggtcagtgtcagggcgataaacaaggatgcgattcagtcgatgtatgcagctcttactgccgagttgcaggaactggcgaagcacgaagccacttttcagatgagcctcttccagtttgccattcccgacgatgttcttgctcttcatccgctggtgggcatctccccggatgcggtttatgccgcggcgatggggcgtccattccagggacgtttgctgagtgaatgggccagcaacctcgaagctgatcggatggcgcggatatccaatacggtgcggcagggattcctgctgggcgatacgcaggagcaaatcgcaaaaaaggtccgtggccatgctaatcgtggttaccaggatggtgcgctgcagatgagccgggccaatgcagccagcattgcaaaaacggcagtagggcatcttgcatcaacagcaagacaaagctttgcgtcggcgaacgacgacattctgaagggtaagcagtggttatccactttggataaccggacatcaaaggattgtcggatccgcgaccgactcaagtacacgctggataacaaaccgataggacacaaggtgccttatttgcaggggccggggaaaatccacttttgctgtcggagcaccgaaacttacatcctgaaatcgtccgaggaattgggtattaaattcggcgaaatcaaggatagctcacgcgccagcatggatggacaggttccggctgacacgaattaccaggactggttctcccggcagtcgttcacgcgacaagctgagattgtcggagaaacgcgcgccaggctgattcgtgatggcggcatgtctcccgatgagttctacaacgacaggggcgagtggctgacgcttgaccaattgcgcaaccttgacgcgcaggcgtttaaggatgccagagtgtgatagagtaaattcgtggtgaatgcaggatgctgacctgcgcgccaaagcgtcccgtgagaaacgggcaagccggaaaccagactcacttcggtgagtccccgccgttctgaagtatcagaatgccgtggcagcaccggccaccacacctaattgtattgtcagtggctagggtcgctcccgaaaagcggaatcgtcaccacctacaaccaataacccgacaagcaacgagacgaggttgttatggattcacaaaaacaaagagaccttattgcaagcctgtatgaagagctggtaatcgcaagagggctcattaaagagatttgcacagtgcgaagcattgcagagccaaagtcttctttgcagagaatggataaagccattaaagatgcaaaagaatatatgctagaaaatagctaaatgaagaggtcgccttagcgcggcttttttattatctgaaatttacaacaggctgcctaagggcggccttttttattgggccaggcccacagttactatcccaaggggacaacatgcttattcgtaacatgctcattaaatattattcggcagctggtggtgaaggtggtgatggcggtggctccggtagtggtgcgcccgagattacgccggaaatccaaaagctgatcgatgagcaggtcagtgctcaggtttcaggcctgaaaaataaaaatagtgagttactcggtaagctcaaagagtccactgagtcgcttaagcgttttgaaggtatcgatcctgacgcggtgaaaactattctccagcgtttctctgatgatgaagaggcgcaactgatcgccgccgggaaaattgacgaggtactggataaacgcactgagcggctacgtgctgatgttgataagcaaatcaaagccgctaatgaacgcgctgaaaaggcggaagcgttctccaacaaattccgtgatcgtgtcctgggtgatgctatccgcagcgcagcgcttaaggctggcgcgctgccagaagcatccgacgatctgattcttcgtgctaaaggcacattccagctcaacgacgaaggcgaggccgtagcagttgatgcaaatggcgatgttctgttcggtaaagacggcaaaactccgctcaccccggttgagtgggctgaatctctgaaagagacggccccgcacctgttcccgcgcgccgaaggctccggggctggtggtcataaacccgctggcggtggcggtagtctgaaacgttcagaaatgagctcaagcgacaaagcggactacatccgcaaacatggccagcaggcctatctcaaattgcctaagtaaggactaatcaatgcctacgaccgtaaacagtgacctgattatctatgacgacctcgcgcagactgcgtttcttgagcgtcgccaggataatctggaagtcttcaacgccgcttcaaacggcgcaatcattctcgacaacgaactgatcgagggtgattttcgcaagcgcaccttctataaagttggtggttctatcgaatcgcgcaacgttaactccaccgacccggtaacgggtaaaaaaatcggtgccggtgaatctgtcagcgttaaggcgccgtggaaatacggcccgtatgaaaccacggaggaggcgtttaaacgtcggggtcgcgacgttagcgaattctccgaggtgatcggcgtcgacgtcgctgatgcaacgcttgaaggttatatcaagtatgccctacagggtcttgttgcagccattggcgcaaatgctgacatgacggtatccgcggatattgccactgatggtaagaaaacgctgacccgtggcctgcgtaaatacggcgataaatttaaccgtgttgcgctgttcgttatgcattccacgacctatttcgacattgttgatcaggctatcgacaacaaaatttacgaagaagctggcgtggtggtttatggcggacagccaggcacgttgggtaaaccggtgctggtaactgacaccatgccagttgatgcgattctggggctggtggccggcgcggtatccgtaacggaatcacaggctccgggcttccgttcctacgatatcaacgaccaggaaaaccttgccattggctatcgcgcagagggcacggttaacgttgaactgctgggttacagctgggatgagacgaagggcgctaaccctgacctgaccaaaatcggcaccggtgcgaactggaagaaacatttcaccagtaacaaatccactgcaggcgtactgattaagctggaagcccctgcgggggagtaaccctgtcagtggataaaacttccgcaactgctgacagtaccgacgcggtgaccgtttcgctcaagtacaccagaaatggtgcaggagtctccggggcatctgtggcgtggacgtctacaggcggcacactcagtgcttcgacgtcacagacagggtctgctggtggctcgacggtgaaactcacctctgctacggccggctccttcacggtgacggctaccgttgacggtgtggtgaaaacaactgaagcgattgcgttcactgctcctgcgggtggttaaccgacggggcgaaagccccgtttcttttggtgaggatccgatgaccgtttatataacaatccaggacgttgacgagttgctgggggatacctgggctgccgccgacaaaaagggtaaagccgtgctccaggcaaacacctggataacggcgcttaaccttcaggatatcgacccggagcatattcctgaagaagttaagcaagccggagcgtttatcgcttccgtagccgctgcaggcaatctgtatcagcaaaaaacagattccggcgtggtgacgagcaaaagcgttgaggccgacgatgtgaaggtttcccgcacttttgccgagctttcaaccaccagcactgaattactcgatcctgatttgcagctggcgctggatatgctcaaaccgtggatgattaaccctttccagacattctttgtgagggcgtgatatgtccgatttgaaggtggtcccatttcaaaagcccagccatcacaacctcgataacgaccaggttattcgcctgctgaaacaggctctggagagagccgaaaacggcggctgccacagtgtcgcagtgatactgcttgatgatgagggtaacgcgattgattgctggcataacggtggacgcccctatgtgatggttggcgctatggagtcgcttaaaaccgactttatccatgctcatattgagcggcggtaagggggtaacatgcaaaatccatatgtgcattatgccggcgacgggctcggtccccgcgatgtgtttgtgaatggaaacccgatcagacatgtcgtttacgcaaaccaggcaaagggtgttgtagagtttgctccgctcccgctgcgggttaagcgcaatggcgaaatttatacccgcaaactccacggtacagtgatcgttaaacctcagcagcgtattggtgggtgcaatgggcattcgtgacgagctgcaaaccgaagtcgccgcggcattcgataccgacctgcaggatgccgttaaggatttcactgggtcatataccgttcggggtgcctgggacccggtgacggaaaccggcactgaaacgcaggtgacttactcggggcgtggagtactggcgcgctataagctgcgccgtatcgatggcgttaacattctgcatggtgatgtgaagctaaccgcactggttaacgaggtgactgataagccggccgtcgggcatatcatcaccgcaccggatccggttacgggtgagcttcagcgctacgaggtcatcaccgcttctgccgactctgctggcgctgcgtactccattcaactgcggagggcgtgatatggctaagggctggaacattgacccggcggcattcgccgggctggtggcagaagatgtcaaactacgccagcggacaatcgccattcagctgctgaatgaaatcgttcggcggtcgccggtaggaaacccggagctgtgggccattaacgcgaccgcggttcagtacaacaaagctgttggggaatggaacgaatctctttatgccgatcctgccaacctgacaaagacaggccgtctcagaaagaaagtccgtgttaatgacagcatggatatcaggcggccggctgagtatcgcgcaggaaccttcagggcatcgcatttcgtcagcatcggcgaacctaatcattccgtcccgaccgaaccggatccgcgcgggacaatgacgtttcttaatggcaaaaatatcattgaccaggcgccagcctactcggtgatttacatccagtcgaacctgccttactccgtgcctctggagaatggccactcaacacaggcgccgacaggcgtctatgccgtctcgtttaatggtgttattcaggcctacaaatgacccttacagaaatcagaaacgctgtcatttcccgaatggcggcacagaccgctattgcctctgatgcggtggattatccgaatggcccggtatttgaccccagtaaccgcgatatctgggcccgactaaccaacattgctgggcaggctggcgcaaccgagatcggggacgggccggtagtccacaggacgggcttactcatcattcagctttttgttccggtcggttccgggacgttgcttatctcccgaacggccgatcagctaacggagctattcgagtttaaggatgacggaaagctgagttatttcgctgtttctgctgtgccggcgggtgagaccgatggctggttacagctcaatcttcaaattccttatcgcgctctgtagcgcacaaaaaacaggaggctcctgtgagctcaggtgcaaaagtagtagccgcgtttattcgcgagacaacgccaggaatcacgcctacagcaggggcgtggaacctgctgcgtcgttcttcatttggtctgaaaccaacgcagaacaccaacgacaatgacgaaatcgctggtgaccgcatggcgcaaggtgtttcacgcggcacagtggatgtcggcggcgatgtcggcacgcggtttcgctggaaccagcatgatgattttcttgccagctgcttcggttccgaatggctaaataacgtgctaacgatgggtaatggtcgcattacgttctccgtggcgacttttgccagtgatgtggggatcgcccagattgcccgcggttgccaggttggcaccttccagatggaaatcccggccgatggtgatatcactgcaaccattacgtttgcagggctggactgggagacgaagggggacgataccagctatttcaccgcgccggtggatttagcgggggcgctgcgttactcctttaaagaggtcacgaacatccggctaaatggtgttgatggcgggacaggtttctgcgtcgacaccttcaacatccagttcaacaacaatatgcagactcagcgctgcattggtaccggttcggcattcgccagcgcaaacattccgacaacctttaccccgtcaggtcaaatcacgctgtcatggtcaaaggctgcctgggaggtttacaaaaaaacgttcaccggcgaaacggtgccgtttagcttcacgctggagaatgctgaaggcgcctataccttcgatttcccggaagtgcagatctccggcgactggccggatgcggggagcactgacattgttcaggttcagctggatatcaccgcggccaatactccgccaactatcacccgcgttcccaaagtgccggcgacggcaatcagtgttgcgccagccacttcaactggagcagtgggatctactgtgacgttaaccgccacgcttacgccagctgattcaactgataccgtccagtggacgtcatcggatccgactatcgccagcgtggtttctaccgggcagaaaacagcgaaagtcacacgtaacgcagccggtactgcaaccatcaccggtaaggcccgcacctttaccgcaacgtctgaaatcaccgttaccgcgccttaatttacctggcccgttctgcagtcatcgcggaacgggcttttttgggagtctttatgctgattatttcttctcaaattgatttgaacggagaacgctggttttacccttacaaaaagccagcaggaagtaaaaagaaattcacgccggaagacgaggcgctatttaaactccgtctgctggtggccagtagcgagaatccacaataccgctcacgcaatgcgctggtgcggcgccatatcgacaaaatggacgcgagctaccaggtcggtacggatgctttcgatctcgccagtgtgggcgagattgactcggttgatgatcttctcatcgacaattgcgcgcgctttcttctgaaagactgggaaggcgtgggggagctggtggatggtactgagacggccgtaacgtatactccggagcgtggtgttgcgttactgaaacaaaacccctctctgtactggcttattctggctgaggcggcgtccattgctcagggtaaggagcagcagactcaggaaaccgtaaaaaagccatagaggcccaaaaatggctaagggaattcgccggcgagcagggcgagaaagcaaagtggcgcagggagaaactaaatctcccgcccattccggagcctgaaatcgatgcagttactggggagatcatcagcgcttacgccatgatatcgcgcggcaggaagtatgccggcatggccggggtgccgctccctctatccctgaatgatattgagctttacctggcatcgcgcaccatcctgatcgagcgcattgagtttgacgcagcgatactggctctcgatgatgcctggagggctgagtgggccgaagagcaaaaaaggcgggcgatagtaaaataacctaatcattgtttagctgcctctatatgttaggatgtttctgattgtaatcacgggaaacataaaatgaagaaactaatgatggtaatagctgggatgtttgttatttctggatgcgctactaagcagtatccgcaagctccgtccgtaactagcgaagagtctgctgcgttagattgtgccgcaattaagcaggaaatcgcaaaaacgcacagcattcagaacgaaatcgaaactacaggtcagtttgatgggcgtaccgtattgggggctttgggagatttcggtatcggtaatggtatggccaaaagtgaagcgcgtaaaaaggcgcaggcacgtcttcagcagcttgaatctcttaaaactattaagtgttcagatagcaaagtctcaggttaattctggcagcgattgtctctgttgcaataatcgcaacaattatcgtatatcgacagtaattgtttattaaaaatctaacctcgccccggcggggttttttattgtccggagatcgttaaatgacagaacaaacctcccgccttgccattgttattgatagctccggagcagagaaacaggccgataatctcgcaactgcactggtaaaaatgacacaggcaggtgaacgtgctgccatcagcgcagtgaaggtgacaaaggccactgatgaagaaaaaaagtctctttctgaactcttagatcgcatcgacccggtaaacgccgccctgaacaaactggataaacagcagcaagatcttgcgaaattcaaatcaaaggggatggtagatgccgatacattcgatctttattcaaagaaaatcgaggaaacacgaaacaggctaactggatttcgtgacgaccttggaaaaaccggccaatcagccgcacagactgcctttgccatgcgcatgatcccagcgcagatgaccgacattattgtcggcttatctacaggtcagtcaccgtttatggtgcttatgcagcagggcgggcagttaaaagatatgtttggtggtattggtccggcaattaagggtgtgggcacctatgttatggggttggttaaccctttcactcttgcagctgcggcggtcggttttcttggtctggcctattacaaaggcactcaggagcaggacgaattttataagtctctcgttctcactggtaatctggtaggcaaaacctccggtcaacttgccgatatagctgccagcgcaggcattgctgcggattcaaccactggcaaagccgcatcaacccttaaccaattggtatcatccggcaaagttgctggagattctctggaacgcgtgacaatcgctattgttaagatcagtgatgcgacgggtattgctacagaaaagttggcgagcgactttaacgatctagctgctgatccagtagcggctataaccaaacttaacgaccaataccactttctgacactggcaacctacaaccagattaaagcgctacaggatgaaggtaatcagcaggatgctgctcgggtggctactgatgcttacgccaatgccatgcagcagcgtgcgaatgatattcatcaaaaccttggtcttcttgaaagtgcatgggactcgctgggtaaaacggccaaaggcgcctgggatgcgatgctcaatattgggcgtgaacaaacactaacggataaacttgccaccttaaacgaaaatattgctgaagcccaaaaagggcaaaaagatggtgggttctggaacagttttagcgcgaggtttaccaacctcccggagatgataaaacagagagatttgctcgaatcagttgccaatcttcagggggatgtaaccaaaggacaggcgaaggctaaggaagccgaacagcaaagaattaaaacgcagcaagaagcagatcgcgttaaccagcaatatttgagcaatgcggataagcgcaataaagctattaagcagcaaagcgagttcctgaaggctggtgcaattactgcagagcaatacgcaaaaaacgtctcacgtattaacgagatgtataaggacccaaaggcacctaagcaaaaggtctatacagaggacgcggcaacccggctgcttgatcaaataaaccagcagacaactgccttgcagtcccagctggatgccagtgacaagcttaacagcgcaacccaggcgcgggtaaagttcgaacagcaaattgctgacctcaagtctaaaacgcagctcacagccgaccagaagtcgattctttcccgttcagatgaaatcctccaggcgtataagcagcaggaggcactgcaaaattccgtaaaaaccctggacgattaccggaagatgcaggaacaggtaaagacgaaggatgagcggaccaacgatctgcttaaaacccgtcttgaactgctggagaaggccaaagcaacggggcaacttaaacccggtgaatatgaaaaaacgcgggcagatatttatcaaaacaccgatatgcaactgccctcgacggttcgtaatgttgtaggaaacctgacacccacaggagggcgactctctggaacttttgaggggatgcaggggcaaatcaacgaatatgaccaggctcagcaagagctccagcgctggctggcagctcaggaggaagcttatgcgaaggccggcgaaataactgccgagggtgaggccagaatgacctcgattcgtcagcgtgcagcggatgcaaatcaggtcatagaggctcagaaaaacaccatcatatctgcggccacgcaatccttgtttgacagtaccgccgacatcatgcgaactgggtttggtgagcaatcggcaatctacaaggttgcttttgctgcgagcaaggcattcgctatcgctgactctatggtgaaaatccagcaggctatagcaagtggggcagtaagcgcgccttatccggccaacatcatcgctatggcctcaatcgctgcgcagactgccagtatcgtctcaaatatccaggctgtttcaggagttggcttcgcctccggcggttacaccggccccggtggtaagtatcagcccgcgggtattgttcacaaaggagagtacgtcttcgaccaggcgtcaacgaaccggatcggcgtgtctcagcttgaggcacttcgaaatggccaaccgcttgatgcaactctggggcgtacagggtttggtactggtgtccagaacgttaacagcgataacagcagcaagaccaccatccatgctcccattgagcagcatttccatacgccgcccggtgtgacacctgatcagatggctctctccatggctcaaacgcagaagcgggcgacaacggaagccctggatcaggttgctgcgcaattgttgagaggggacgggaaagttggtaaggcaatgcgcagtaaatattcaggcagagggttagagtgatgactgatatctactacccgcatgatagtcttccgatgccattacaggaaggatacggattccagcctgtaagcccgttaaaacgaacacagttgaccaccggccgcgcgcggcaaaggcgagcttatacgtccacgccgacgcaggccagcatcacctggtttatggaaaccgatgcgcagggactggcatttgagtcctggttccgtgatgcgttatctgacggggctgcatggttcatgatgaagctgcagacgccggcaggcattaagttttacaaatgccgcttcacagatatttatcagggaccggtgctggtggccccgatttactggaagttcacggcgacgcttgaattatgggaacgcccccttgctcctgccccatggggtaattacccggaatggatcgtcggcagctcgctgctggatattgcgctgaataaggagtggcccaaggcttgattaaaaccgtttctccttcataatcacttgtgtcgatttgtgggaaagtccttcatgccgctccgtagccggagcgtgaaataaagcgcggaatagcgatcctgccggtgagggtacacccacattcgacaccaatttttaaggtcaccttcgggtggccttttttattgggtaaaaatcatgacaagactcaaccgcctctacgccagcagcggaccggaggtgatcattgaaacgctgcagatcaccattggctctgatgttcactacctttgccagggttacgacaacatcacggcgacgacggagaacggcgataccgtaacgttttcagcctgtgcgatagacattgcgctgccggcgcgcaatgcggacggcacgcaggacctcaaatttgccttgtgcaatatcgatggtgttgtgtccacggcgatccgcaatgcgctggctaaccgtcagtctgcatttctgacgtaccggtgttatatctccacggatttagcggcccctgcggaagtgccgtatacgctgaaaatcaagtctggttactggactgcgaccgaagggcagattaccgcgggttatatgaatatcctcgataccgcctggccacgttaccgctacacgctacctgtattccccggactgcgttatatcagctaaggaattccaatgttcaaccctgataaataccgttctgttaaatggcagaagggcggtcgctcttttccaaaacttgactgcttcggcattgtgaacgagatacgccgcgacctgaatttacccgtctggcccgattttgccggggtcaccaaagacgacggcggcctcgaccgggaagcgcgccggatgatgcttacccttgagcgctgcgaaccctgcgaaggggctggggtggcctgctattccgggtcgaccgtcacccacgtagggatcgtggtcagtatcggtggcctgctgcatgtggcggaatgcaacccaggcacgaacgtcacctttctgcccttgccgcggtttaagcgtcgatttgtcaaagtggagttctggcgatgaccattcgtttttacccgtcccggcttcccggtgaaccactcgaaacgcatgagcatggtgtaaccagtattcgcagctggctggtggcaaatgttgaaggctacgaggatcgggatgtcccaccgctgaccgttgaggttgaggggctgttaattccgccaggcgagtgggctaagtgtgtgattcgccctgatagtgatgtcaggctttatccggtgcctttcgggcttgaggccgcgacaattgcctggataggagtgggcattgccgtcgcatctgcggcttattcattgttcatgatgagtaacattgatgccggcggctatacatcatccacaggtcgaagcctcgacctgaaccccgctaaagcaaacagcgcgaaactgggtgatgcgattcgtgaagtttttgggcgcgtgcgtatttatccggattatgtcgtgcagcccgttacccggtttgatgccgccgatcctacgaaaatgcgcgtccagatgctgctgtgtctcggtgtcggtgatctgatttataccaatggcgatatcagggttggcagtacgccagcttcaacgctaccgggattcagcagcacccattacccgccaggcgcggacgtttccggtgatgagcgcagcgaaaactgggtcaactccaccgaagtgggcgggacgtcatccggcaccgggctggatatggcccagacgtcgccggacgcagacgacattatcgcagacagcatgaccgtatccggttcgagcgtaacgtttaccgggctggacacggatgatgatgacgataatgacgagaacgataacgcgctaccgcccagctgggtcgccggcgccgtggtcgaactgaaagccccggctaactaccagatcacttcggcggctggatacagtgttatcgccagcccgctgctgacggagatcgcgccggtagtaggtatgccggtcacgctggggtttaactctgtcgattacgatctgtttatcgcgtcatatacccccgctcaggctgcagtgcccggcgccggggggagtgcggcaaaactccaggccagtgcggccccgaccacctacgatttttcgaccagctccagcacgttcacgatcacctggcagggggttacctacccggtgtcgctggtggctaactacgtctctatgtcgggactgctggcggccatcaccgagggactcactggctccggcctggttgcgcaggacaacggcggaactgtactgataaccgagtcggccagtccgttcgcgggtggggcgatcacgtcctcttcactgcctgcagctgttttcggtgatgccccggtttacacctccggcacggcatcaaccggcggcagcccggcggtaacggcgaatgtgacactcgcctataactctgccacgggcaccgcattctccgggatgccggagggggtgcaacggctttcacttgctcactgcgggaatgagtaccggattgtgtcagctgacggcacgacggcgtcggtggcgcgcctggtttccggtgccgttgatgagtcatggccgggattcaccgcccggacgatgatcgactatgaggcttctggtcttaacgacacgctgagctggctggggccattcctcgtatgccctgagaatgaagtggtggatgcattcgaggtgaatttctccttcccgaacggcatctgtggctttgacagtaagggcaaaaaacggatccgccacgttgagtgggagattcagtatcgcgtctacggttccggttcggggtgggtgagtcaccagggcgagtatgcgcttaaaaacgtcaacgggctgggattcactgagcggatcaccctcagctcaccagggctggtagaggttcgctgccgtcggcgcaatgagcagggctcaaacaacgcgcgagacagtatgtactggcaggcattgcgcgggcgactgctgacacgaccttcatcctatcccggcgtgtcgctgatggcggtgaccgttgagacgggtgggaagctggcggcacagtcggaccgccgcgtaaacgttgtggccacgcgcgcctatgaaaccggaacggccagaactatctcgggggcgctgctgcatgtcgggaactcgctggggctggagatggatgccgacaccatcaacgcgctggagtccgcgtactggacgccacggggcgagtatttcgatttcgccacgggcgacagtatctcagcgctggaaatgctgcagaagatagccaacgccgggaagtcacgttttctgctgagtgatggcctggctaccgtaagcagggaagggattaagccctggaccggagtgatcactccgcatgagatggtggaggagctgcagagcggatttaccgtaccgtccgacgatgattttgacggtgtcgacgtgacgtacatcaacggcgtcacctgggcagaggagaccgttaaatgccggacgccggacaatcccacgccggtgaaaatcgagaactacaaacttgatggggtactgactcaggatcatgcctaccagatcggcatgcgtcgtctgatgaaataccttcagcagcgggtgacgttccagaccactaccgagctggacgcgctgtgctacaacacgggcgatcgcatcgtgctcacggatgatattccgggtaacaacacgatttcctgtctggtggaagcgatgacaacggctggtggcgtgacaacgttcaccgttacggagccgctggactggtctttcgaaaatccccgagcgctgatccgctatcaggatggatttgcatccgggctgatggtggcgagcagggtgggtgattttcagctgtcagtcccgcacctgagcgagtttgatgacccgatgaaggttgacctgtcgtcggcaaccatcgagccgatccgcctggtgttctgcggctcaacgcgccacgtctacgacgcccttgtagaggagatcgccccgcagtctgacggaacatgccaggtcaccgctaaagagtacctcgaatcgttctatgcctacgacgacgctacataccccggcgacgctgcttaataccaaaaaaatccctttcaacttttctttcgctcaaaccctcgtttgggcgaacaccgttttggagcaaaaatcatggccgaacttaacccgcctttgggaacgacgacgcctgcaatattcctggataacgtcaagcgcgctgacgagctggttaacggtccggccggaacggttaacgaccgcgcaggcgaaccgctcgatacctggcgccagatgatggctaagaatgacgaagttcgg

SEQ ID NO: 68 - DNA, 110391 bp, Unknown
  source: /note="Description of Unknown: KP2-Mcoc1 Bacteria Sequence"
ataagccagctaatgcattgaaaataaaatatagctctcattatgaagatttaaatccattactctgtacgttattttgaacgcaagttgtatactacttattgggttttgatgaagaccttgactaagttctcctttctctcaaaagaggacattccaagcatacagctcaatgtatttctacgaaaccttaattataagagccctgatttaagggctcttaatagtaattagtcaattatatgagctaaagctgctaaaatatttgtgattaagtttctagggaggttaggttttttgaaaaattcactgatgtaactctaaatacactttcttcaaattttacattcagaactgtaaaatttccaacccttagtctttttttatcttctccaaaatcatatctttgatggaaacattattatcctttgcaagatgatataatatataaaaggttttctcatcgatccttaatacgaaagtgagcttgatgatattttcataaatatatgcagaagatacaataacaaagaaagtaattaaagatattaataatgcctctaatcctttatctaaatatgtaaaaaagagaatgccaattggagcaattaaaaatataatattaaagattagaaataaaaaagcagaaccaagaccaaaattcttatactcgtttgtggtttttttcaatatgactatagatacaaagacaaaggggattaggataattccgacccccatacatttcaaatattccaatgtggttaggttaaacattagctgttcctagcaaaagctaaaagtattgaaaggtactataatgggaacataaaaatatgtccataggtgttgaataaacgactttaaattacgttttatccttacaagcggataagaggtctcaacgtttatgtgtgtagactttagtttggtgcagttttataacttaaatgaaaattagactcactttcattaatcattgagtattaagctcactgcaatcataccttccctatcaatactgctcaactgtcagtcataaatataaggcgctaaatgtctgttacgtgtagtgtttagaataatgttcctaactacttttccgttatccacgctgagaccacacctagatcctagatcatacataagtgtctagctctatcttataaaaataggtatgtacttacttattttttttgcaataatatcccgcctgtattttttataatgtgccgtgcttagttggttgttggcctgttttacatgcttaaaatttatatcaaaataaccacaaaggaaaattcacatgacgttgccatatggggtgatctccgatccccattaccacaaatgggattcattctcgacgaccgatgcagatggtctcaattctcggctagccattcagctggaggccacaaaagaagcggccatcgctatgaaaaaagcgggctgcagccacatgctggtggccggcgacacattccacgtccgcggaaccgtatcccctaccgtactcaactacgtctccgatgcgtatgagtggatcgtcaaagatctggggctcagcgttgcgatgctggctggcaaccatgacctcgaaacaaacgactctgtctacagcgctaacgccgctgcggcgctgaagtcgattggtgtacagatcgtctgcggccgtaagccacacagcatcaaattgggtgacgtcacagtccatatggtgagctggcgaaataaccacgccgagttaattagcgacctgaaagcacttcgtgcgcggcttgacggggatctgcacgacgtcgtgattcataccgccatcaacaaagctatcccaacaatgcctgatgttggcatcgatgcgcaggagctgaaagacataggctttcgcctggtactgtccggccattaccacaaccacaaggaggtgatccccggagttatcagtgtcggcgcgctgacgcaccaaaactggggggacgtaggttcgctggcgggctacatgattgtgaaccctgacggctcgttcagtcatttcgaaacctcggcgccgaaattcgtaaacctggaagacgatgtggatgacaagcagatacgcggcaattacgtgcgcttccgggccgtcgtcgaaaacgatgaggaaggcatcaagctgcagaacgtcctgaagtccatgggagcgaaaggtgttgtatgcaacttcatccgcaagggctcaatgatggagggtactgccagtacctcagagaccagcaaaatcgacagccttggcgagtctgtttctgcttactgcaaaatcgttcatgacacagacggtggatttgacctgaccaaactgaatgccttgtgtcaggagatcctcaccgaagcggaaagtgcggaggcggtgtagtgacttcctcccacaataatttctgggatttcatccagatgattaaacggcttgaaagcgggaagcccgttttattccagaagccctatccgccagaaggaaacccacaggcgttttaccttggtcaactaacgaaacgtggcctcctgtcacgcaactccttcccggcacatacggaataccgccttcgcaaagggcagaaattgactaaagcaattcgaggcaaagcatgaaatttttaacgctcgaagtggaaaacttcatggcgctggcaaacgccaaggtcgagcttgatcagcgtgggctggtgctcatccagggtgttaatgccggggactcatcggccgccagcaatggcgctggcaaatcaaccctcatgaatagtttgatgtggtgtatttatggcgagacatcccatggcgttaaaggtgacgacgttctctctacgggccatgagaagaactgtcgagtaaaagtcaccattgaagacgaaggtaaacgctacgccattatccgtcaccgcaagcataaggaatttaaaaaccggcttattgtccgtggcgaagacggcgacatgacaaagggtaaagattcgctcacccaggagtttgtagagcgactgatcggtgcgtcaaaagaagtatttatggcatcgatctatgccagtcaggaggcgatgcctgatttgcctggcatgtcggataaaaacctcaaaaccatcgtagaagaggctgccggcgtcgatcgtctcaccaaagcctacgctattgctcgcgaacgagccaacgcagctgccgcacgcatggagaccactaaaaccaagatggacgcctgcttgtctctggtcgaatcggcccagaatgagctggagtctgccaaaacctcttctgaagcctgggagcgagaccgcagcgaacggcttgatgtcgcccgtgccgatctggttggggcggaagtcacgctcactgaggtcgaaatggagttgcgcagtctgccagagcagatccgcgatactgaaaatgccatcggtaaagagcgggaaaaacttgcgtccaaagaagaacatgacgccaagctggttaaggttcgtggagcgatcactgatatacgtgccagcatccgcattaccgaaaacatccagaaggaagcgatgcaacgtgctcgcgcactcaaggtgaaagcggaagaagtaaataccaaagtcggagagccgtgccctacctgtggcaaggcttattgcgttgaagatctgtctaccgtgaaggagagttttgttgaacaggcgcgcagtgagatcagccaagcgcaggcatctgcaacgtcagtggctaaataccaagagcatcttgagaaggcgctcaaaattgaatcatcacttgtcgccagtacaccagatgtgtctgccattatttcccgaatcgaacaactgactaaagagctgggaacgcttcgtcatcgggaaaaagaagtcgtggctgtagaagctttggttgcccgggcgcggagcgaagtagatcgcattaccaaagaaactaacccatttctggctgtcatcaaacgccatgaagaaagcctggctgccaataaatctaactatggtgtacttaaaactgagttaaagaatatacaggagcaggctctgctgcttgataaagcgcgccaggtctactctcctgccggagttcgctcgcatatcctgacctccgtgacgcctttcctgaatgcccagacagcggaatatctcaatacactgtcagacggaaacattgttgcggaatggtcaacgatggaatcaaccaagaagggcgagtggcgcgataagttcaatatcagcgtgcgcaagatcggcgccagcaaaaccttccagacattgtcaggtggcgaaaaacgcaaagtgcgcattgcgtgctccctggctctgcaggatctggtggccagccgcgcgagcaagaacatcgagctgtttatcggtgatgaaattgacgatgcgctggatactgccgggctggagcgtctgatggggattctggaagcaaaagcgcgcgagcgcggcacggtgatgatcatttctcacaaagaaatgaagtcatggttccgggaaaccatcacagtggaagtgaaagagggtcgcagctatgtcgtttaatcttagccgcccgcagtttttgcaaatgtttgctgtgatgcagtcattcaggctgattaacagctataccgctgctggggcggctcctggtgtcggttggcaaaatctcaatattgagacggagcagtttacggctctgaaagatctacttttcaagaccccgttaatgccaagtctgaaatcgatgccgtcaggaagtacagcgcccattctgatcaacccattttcggaaggtggctatcttccacacactgggcctgggttcgtggtgatcccggaatcacctgagatggttatcaaagatgatgcgcagtacggggctatagaggcgcataccagcagcgcgtttactaacctgactcgactggcaaatgcacgtgctgggcaggttgcaatgccaggcaaggcatttgctggcatcgatttcaattacgatacacttgagacatttccaggaagaggcaaattaagctttgagactgaagatggcgataaggcaatggttgagctctctgtcccctatgtacttcgttttaacgggatggttgcgcgtaagctgatagatatcatgtcctacttcatcgggcagagcatgatcgacgcagacatagaaaatggtgtgctgaccagtgacaacatacatgtggtgagccgcattccagagcccgttcgcaagtctccagttaaaaccctggaagagaaattaatggaatgcccggtatgggcaacatggtaaggaaactctatgagtaaagtgatcaaagtagttggcgtcgacccttcaatgagcaacttcgggctggccattggtacgctggatctggatacagacaaacttgaaatccacggtcttgaactggttgaaaccaaagccggcggaacgaagaaaaccgtcagagtaaacagcgatgatctgcgccgggccaaagagatctggcgcaccgccaggcccatcattgaacaggcccacatagtgttttgtgaactgccggtaggtagtcaaagctctcgcgcgcagacttcttacggtgtgtgtatcggcgttcttgcttgcgttgataagccacttatccaggttacgccaaatgaaattaagcactacgtcgggaataaactgaccacatctaaagaagagatcatccagtgggcgattgcaaaacagcctgatgccccttggttgcgtcggaaacaagcgggaaaagacgtactcgttgccaagaatgagcacctggctgatgccatagcttcgatatattctggaatgcagacagaccagttccgacaagtgcgcgacgttcttaaagggattttataatcctcaattgataggtaagtacttatttaatactataggccactacatttagtggccttttttgatgggtgatacatgataaggattgtcaaacgtaatggctccacagagccgctatccgaagagaagtacaaccgcgtcgtgatgtggggggtagaaggtatacgtaacgtaagcgcctctgccgtagccatgggcgccgccgcgagcatctttgacggcatgacaacttcgcagcttcatgaggcattggttaagtcggctgcagatcttatttcgcctgaaactccgaactactcccaggtcgcagcacgcctgaacatgttcaaaattcgcaaagatgccttcggcgaatacgcttacccaagtttctatcatcatatcgtcagcaacgtcagccgcggcgtttacgatgaggatttgcttaagttttactcccgcgaagagatcgctgaacttggcgtgtatatcaaacccatgcgtgacgaactctttggctatgccgcgactgttcagctggcgagtaagtacctcgtccagaaccgagtcaccggcgaaatctacgaagccccgcagcagctgtatatgctggtgggtatgtgtcttttccagaattgggaagatggttgtgccggcaaaacacgtctggaaatggtgaaggggttctatgatgtcaccagtacattcaaattgtctctgcccaccccaatcatggccggcgtccgtaccccgacgcgccagttctccagctgcgttctgattgagtccgaagacagtttgaaagggatcagcgctgcgtcatctgccattatcgattacgtgtcgcgtcgtgctggcattgggattggttttggccgactgcgtgcattggggagtgagatccgcaatggagaagccacccacactggcgtaatcccctttctgaaacacttccagaccgctgtgaaatcatgctcgcagggtggcgttcgagggggcgcagcgacggctttctaccctatttggcatctggaagttgaaagtctgctggtattgaagaataaccgcggcatcgaggagaaccgtgttcgtcatctggactatggcgtaatgatcaaccgcctgatgtatcgccgcctggtacgcaacgagaatattacgctgttcagcccgcatgatgtaccggggctctatgatgctttctttgttgatcaggacaaattcgaagcgctgtacctgcaatatgaagctgatgagagcatccgcaagaaatccgttcccgctgttgatctgttctcaaccctgatgcaggaacgagcctctaccggccgcgtgtatattgcgaacgttgaccacatgaacgaacacggcgccttcgatccgaaagtcgctccagttcaccagtcaaacttatgcatggagattacgctgccaactaaaccgctggcgtttaccgatgaccccgatggtgagatcgccctttgcacactgtctgcgtttaatctgggggcattacgctcactggacacgctgaaagaggttgcattctatgcggtggctgcgctcgattccctactcgactatcaggattacccgatggccgcagcggaaattccggcaaaagcacgtcgtagtttgggcgtcggcgttaccaatcttgcgtactatctggcgaagaacggatttaactactctgatccggccggcaaccagctggtgcatgaaacgtttgaagcgatccagtattacctgcttgatgcaagttgccggctggcggaagccaaaggtgcctgtgattggttttcccaaactaaatatgcccagggacagctgccgattgaccattaccgcaagtcgcttgacgctaaccctgatacgtcctttgagctgaaaatgccttgggaagagctgcgcgaccgcatacgcgaatatggtctgcgtaactctaccctgacagctcagatgccgtgcgaaacgtccagccaaatcaccaactccacaaatggtatcgaaccgccgcgtggccctgtttccgtgaaatcatccaaagacggcattgtgaaaatggtggttccggactttgctgagctgaaagatcagtacgagtacctttgggatatgccggataaccgcggctatctgaccaaagttgcgatcattcagaagttctttgaccaggctatttcagccaacaccaactatgaccctactcgcttcccgggcgacaaggttccaatgatgaagttgcttgaagatctgctcttcgcttatcagcaaggcgtgaagacgctttattaccacaacacacgagatggtgccggtaagcgtgaagacgatgatctggcctctgttgcgttggttgagccagaagatgagtgcgatggtgcatgcaaaatctaataagcgtggggagatatccccacctttcacttcattgaatgcctcattttaaccaataagataataatttgtttagaagtgcatctaatcaaattgtttaataataccgataacattcaaagggaaacacatgagttactccactttccgtttgggcgctaacgacgcaaccaaagagcctatgttcctcgggcagtctgtcaacgttgcgcgctacgatcagcagaagtaccgcgatttcgaaaagctgatcgaaaaacagctctccttcttctggcgcccggaagaagtcgacataaccaccgatcgcatcgatttcaatactaagctgcaagagcatgagcggcacattttcctgagcaacctccgttaccagactctgctggattccgttcagggacgcagcccaaacgcaacgctgctgccgcttatttcaattccagagctcgaaacgtgggtggaaacatggtcgttctctgaaaccattcacagccgcagctacacccacattattcgcggtatggtggatgatccgagcattgtcttcgatggcattgtgaccgacgaggaaattatcagccgggctatcagtatctctacagagtacgacaagctctatgagatgacctgcgcgcgccagcacctgggagaagatgaattcgaacggctctacgtctccgaatttgacggaaagccctaccctctccagcgccagctgttccgtactttggtatccatcaacgcgctggaggccattcgtttttacgttagcttcgcctgtacgtttgcttttggagaaaggaaattacttgagggcaacaccaaaatcatgcgtttcattgcgcgcgatgaggcgcttcattgcgaaggcacagaacgaatgctccggtttatgcgtacaggccgcgaaggcttgctatgggcccagatcgctgcggatgaggaaccattcatctatcagaccatgatggacgttgccgaacaggaaatgcgctgggcagattatctgtttaaagacggctcaatgattggtttaaacgccgatatcctgaaaagctatgttaaataccgaaccaatcttgcgatgcgccgtcttggcctgaaaccactgtacccggagataaaagatgacccgctggtgtggatgaacaaatggctgttgtccgacaccttgcagattgcaccgcaggaagctgagcaaagcacttatctcgttggccagattgactccgctgttgatcgcgctggcctaagccagtttgccgatttgtaagcctggataaagattttgtggcctggtcgctctgggccacaatgaacgcgaaaaaaagcactaaggaaagataaagcatgaaattaacgaaactgaccgaccatctcaagctggccaccgataaactggtgggcttcaaaccagagccatatgagctgaaccccggttttggagaagcgacagagagtatttacaagatggttgaccagttccacgagctgtttcagcacccgcgtcgtgtaatgcccactccggagctgctgcgcctgcgcgctaagctgatccatgaagaggcggtagaagaagggctgcctgcagcgaaaaaaggggatatgcagggattgctggatgcaatggctgacttcctgtatgtgggtgtcgggacgatggtagccatcaaaggtgggctatcaactggcatgagctactacactcaggagcaaagcgtcgatcgctttattcataccattatggtgcctggaaataccgtcttcgacgatatggccatccccttcaatgaagcagaagaagctgcgcttatgttggccgcgctggccgataaacttgaacataacaaggtaggtgatgctgagctgattcaggatctgcgccgcgtgatgaacaaaatctatgtggcgtgcatgatggtgtatcgcctggctgaattccttggcgtcgacgtcgtggagctggtggcggagatccaccgttctaatatgacaaagctgtggccggcggatgctgaagcgcgtcgtcttgccgttgagagatgtagatatgataagaatgacctcggattccgccatgctgacggcactgacatgatgatcggctatcgcctgtctgatggaaaaatccttaaatcgccgacatatagcgatgccgatctgtctcgtttccttgagcaagcacaggcatcttcgctgtatgaagtggttaaaaacaccttgtaagtactaacttatcaatatatattgaaatggacgtgtgatctattgtctatttctatccttatcaatctttattttcgataaagttgagcgttggtggccccgtggccaccatttttttacttaatttctagcctggatgtcttctctgtgtttaaaatgataggtatgtacttacttattatttgaggtcatcttgtcttttttacttaatcgagaattcagtaacggtcagctggcttcgagctcttatggccgtgtcattcagaccgttgttgataccggcgttccttccgaagatcgcaccggcaccggtacgcttggcgtttcttatgtgccttcctactacatgcttaccggcggggctgttccgctcatttcttcaaaacaggtaaaccttaaaccgctactggttgagcttgaatggtatttacaaggttcaggcaacattgggttccttaaagagcatggtgtgaagatctgggatgcttgggccgacgataatggcgatttagggcctgtatatggcaagcagtggcgccgatgggaggacaccaggattgtcccttacagcgagtatcgccttaaggaggacatcttcatggaacgtggttatcgcgttgaaggttacattgggctgaatgaagaccgcgtcgttatcacccgtgaaatcgatcagttacaacgtatggttgatcagttgcgcaacaacccgaccgatcgccgcatcctgcttaatgcctggaatgttggtgagctggaggatatgaagcttccaccttgccactttgtgttatccgtatggagtcgtgagctcgatttccagacccgtttgtctatggccaccgatattggcatccagcataaccggcatggctatgaatcgatctatacccagatgctttgcctgatagagcagcgaggcagtatctctgagccaatgctggatgagcttggtatccctaaacgtatcctgaactcctgcctggtgcagcggagtgtcgatactttccttggtatgccattcaatattgccggttacggcatcctcacgcagttcattgcgaagattacgggtcacatggctggcgccttcgtccatttcggctttgatgttcacatttacaacaaccacttggagcaggttgaagagctactggctcgcgaacatccggagtcgtccgaccccatcgtcgtcttcccgcacgaatgggaagagctggatgacttcaaatgggacggcgtgcagatcttcggctacgaaccacttccatggattaaggctccagtggcggtgtgatatggccagaggcatgtatgtgttatgtgaaattgaagatgtgctggcgagagccggccatcgtcaagccgctgctgatgaaaacgcagacactctcgttgcaggtgatgagctcatattccccaccagccgcatgttgcgtggctttgctcgctccggtgctgaagtggtgcttatcagccaccgtccggaagcgctcgaaagcgcaaccaaaaaatggctgagagatttcggcattgattatgactggctgcacctggcaccacgtggagtcaattacgaaacccatataaagcgcacgcttgccgcgcataaagatgatctgatgatcgcggcactggtgagttcatcacgtctacgagctgctctgtctggttttcaccagcgcccggtaatgtatgaggtgtctcaatgaagatgattgcagctgtcggtcgcaattatgaaatcggcattggcaacgaacttccctggcgttgcccgaccgatctgaaactgttcaaacaactcaccaaaaacgccactgtcgtgatgggacgtaagacgatggaaagtcttaaacgcccgctgccagagcgccataacctcgttttgacgcgctctcgtggctatatccccaatgggttctaccccgctggcatcgatgacgttttgagactaccagatccggtctgggtgattggtggcgggcagatttactcgctctttatgccacacgtagaagagatatggctgtcgcatattggcgtggatgtgccgggcgcggatgcgttcttcccggcgccaatgatgcgttctttagggttcgtaccagtcgaaacggcttatacccaacgtgcaaatgaggatgagcttggctttttgcagatcgtatacagaaggtcgtaatggattaccggattggaatcactggcgcacagggcagtggaaaaacaaccctggcaaggtacatcgatgcgcattatggcattccgtatgtggatgccggcgttggcaagctgatgagcagtctgggggtgaaggttggcgagcgtttgcccctttacgaacgtcttcaggttcagatggagattgccagacatatcgagatgatcacccgcggcgttgaaggttttgttatcgaccgcacgccagccgatgtcatggcttatacgcttgacctggtcggccagaccaatgaagaccgctgcatcgagctggctctcgacattgagcagttttgccacaaagcggccatttccaacttcaatgctatcgcgggtcttcgcccgggcgttgagctttccagcaaagatctcgcgcgtccccagcgaggatcgcttgaccgtctctatgttgctcgcatcgatgcgcttatgtgcggtgagctgacgaaaatcaacacccttccccaaaccggcgatctgcaggtgttcgttatctctgaaaagtgtcgcacggttgaagcgcgagccagatcggtattgcgagtgctggacagagctgctgaaaacatcgagcgccgtataacaggacgagtgaccttccactgaatgttgctcccctgttgggcagtgtgacaataagacacgcgaaatgaatcgaggaaaaacagaatgatagacgaacttcccctctcggatgaattagatcgtaaagcgattgaagcactgatccgcattgctgacgaacaatcccgctctttgatgagtgaacgtgaagcacgtctggctatccgcgcagtgtttgagtccgttcaagggcttgttggggaagaggtaggcgaagccatcaatgtggcgatgtcgcagttcaatggcggcaccaagcgccctctgtttcctatgcacctcaaactctcaggcggcacggttctgttcgtatccgtttgcctggagaccaaccaaatccagatcctcaacacatcaacgggcgaatggcgcgcgccggtcgtctgcgaaagtggcgaggacgcactgaaaaaggctgctcagtttgtgcgtggcgcactgctgaaaggcgcgaagaagctgtaaggagtaccaatgaccacgattgtcggtggcgtagatattgagtccacagggctggacttcacatccggccacaaaattatcgaaatcgcgataacccgttatgaacttgaaacccagaagcacatcgacagccttgagatgcgcttcaatccgcgtcgcagtatcgatccgaaggcgcaggcggtgcatggcatttcactggaagatctggcgacggaaccgctgctggctgaccacgcaggcaagattgctgcgtacatgggcgcatgtagtgcgttagtcgcccacaacggagaggcttttgaccttccgtttattcgccacgagttcggtagctatggggtgaaattgccaaatatccccatcgtagacactatgctagatgggttgtgggctaccgaggatgggaagcgtccacgtctggaagagctggccttttcacttgggttcacttacgaccgtgataaggcccatagtgctctctatgataccgagctgatgatgcagtgtttcttcaaagctcgggaaaaatatggttttttcgacttttaatataattaacggtgcaatttattgcaccgtttaactttttagaatgaaacttttgccttcagtaacttggctgccatttcaaaatcaatttcaccggttttagactcagttgcaagcttgtatagaaccagaacgtatgtatcgcctagaacttttgtgattgcacttgccgttgttgcagatattgcccctccaacaaggctccctacaccaggtatcatctttaatagccctgtgacaattgttcgtcctacaaaaactgcaccaccagcacctattaaagacgttaccattgttgttaaggccactttagatacatccattccaaaggtgtaactgatttttgcaatcattgcgacttgaattggcactaaggtaaatgcatctgaaaatgggactggtgttgctgcggccgcagctgcgatggccgttgcggcaataacttctttactggcttgctccttttttatatccaatgctttcttgtttttaattgaaagagcattggaaaatgcctttttttgtgcttctggaataacctcatacgaggtttggatcaaatcatctatgcctctaacctttcttttacctatgatctcatccggttcatcttcatcataaattgtttcttcaatagcacgagtcagacatacggaatggctatagtttttaaatgcgacctcaacctctttcgcaaattcattgtttgtgaaattatttgtttttgttagtactactatgactggtatccctttgtttatcaggaatttagctatatccaattccgcattttcataacgtttaccggtgtcattaatacatagccaagcgagatggacataattctctgatttttcactattgttatgttcatttatatagttttcaatttttaatctggttttctcgtaatccgcaacttcaagtccctgagtatcaatgatttgtaatgggacgccttctttcttaattacatttatattttctgttacggggcgccctactccagttctcgcaaagtctccacgaaatacactattaatgagagaacttttccctacaccagtctttcctatcacgatgatgttagctacgggcatatctttgactgcatcgtttaaaatggcatttacatcaatgttcacattaatcactcctttagcagaagcctttcatcatagctgatgcttttaaatttggaaaaacatatgagctttgtagggaaaaaaatcttcaaaagcgtgagataaatctcctgtaatgacctgaatttacttgttttctgcctgataggttttgtcagaatacgctcaaccaaaacgcggaaacgcaccaacgaaaacataaggagttaaaaatgagcgcagttaccaacaatgttaaaaacgatgacctggatgaactgactgcgatgctgcaatctctcgacgaaccagttcagaacgctgcgaaaatgagcggtgtcgacgagatcgacgatcttctctctggtctggatgatgcaatcgcaaaaccagtcgaggcggtggcggatgaagtaatgaatgccagctctaccggggatctgagtagcgtgctggaagagcttgagattgagcacgaatcggtgaagatcgaagaacccgagcgtgacctgattgcggagattgtgaacgagccagcgcctgaacttgacgctcgaagtactgagactaccggtacagatccaactcctttaccttcagtggcgtcagagcctaaacctgaagaagagcagccaaaacgccagaaggcaaaatcagagcgtgcgccggccaaacctcgcttcacgctggaaggtaaggacgaatcgttctatgcgtcagccggtctggaaagtgagagctttactgctgcattcgaaggggcgccagtcaaagcgaaagacaagatcttgaacctgttgaactggtttaacggtgggccggaaatcagtgtctacacggtaatcgcaatgcgctatatccttgacgcgaacacggtgaccagcaatagcattaaactggcgctgatgagcaacccggagaaaccatacccgctcaacactgcttcgactcaggctggccagatgatggctgtgtttccagcgactggcatcgcaaccagagaaggtgggaatttaacacttaataaagagtcgccgatcgtaaaaaaatttatagcggagtattccattggatgatgtcccccaactcgatttaaagccatctgatagcttaaagatgctgggtgagcatatttcatatccagcatcgaaaaaacgcgccagagagcttcccttttgcgattctggcgcgttcttctttgtttgctatccgttggattaaatgaaaaaataggtaagtatttatctattagaggaaagcaatgatcgcagccgaaaaaatcaaaaagcgagagcgtgatgcctctcttcgcgacctttggcgcacaccgcagtggttgtttgtcgccatccaacgttacataggcgtaaagttcgatgtggacgtcgcctgcaacaaagataatgttctcttgccgaacgttatcggtgttgagcgtgatgcgctcaagtgcagctggggagaacctggcacagtggcgttccttaacccgccctactccagaatcaacccctggatagacgcagcaattcgcgagcaggcgcgcggagtgacgacagtcatgctgataccacaatccctcgatacgtagtggtgcgagcgtgcggctgaatgcgccaacgaaaccatcatcttgtctggcggccgcgtggcgttcatggaacctgacgtcacattgggtctggttgaggtcaatatcaacccaggcggaagtatgctggtggtcttccgcggattctgtcagaacgttggtcacttcatgaataaagtcccgctgacggtgatgaaaagtctgggtggttacgatcctgccaaagtgatcaggaaaaaaagaccacggaaacaggctgcttaatccgagtctgggagcgtttcataacctgctttcgtatatataaataactaagtactaattataaacatatacgaaagcaggcttttccttgtcgatttcaaaccactcccagaccgaaacaagacgcccagaccactctggaacccctttccagaagctatagaatcgtttttgtgaacacaagtaaggaaaccatcatggcatacccgaccaacgttgtagcgctcgttgagagcgattttttggctaacgctcgcgaactcatgaaggatcgtgaaaaggcattcagtctttacgagtggtcactgaaatgtttgcacactggcgaacacaaagacctgattgagcagctccttggcgagctaatcaacgaggtttttgctctgcaagttcagcttcatggtagacaaaatgatcagtcaaaaaagtaagtaagtagttaccgtttacgatgtatcatagtggttgtagaatgatgtcgatttcgacctgaatcgaaatctcggtctggtgggtggaggatagcgtcactggcaccagacttaaaaaagcccacaaccagcgcagaaccagcccttttggggtttggggaagggggaaccaaagtgggcagagagaagggtcactttatgattgtcgagtctgggtattttgagaggttgaatccagtactccccttcatgaagtgtgggaagatctcggttctggggtgctgtcatccataacttcccaagcctaagctggcagtagacttaggtcataacttttcaggttatgaaacgaccaggttggtgaggattttttactcacctccctgggagagtattacctgaaaagacaacctctcacttcgttcgaggtgaacttcactcacttcgttcgctcagttcaggtaaaaataaacccgatctgggaagtaattcattgaaaataaatatgtataaacacgcgtgcgcacacgcgcgaggaaaaacgggcggcggcgcacgctttggagttagagatgacgacaagcacacacgccagacgaaaaacggcagccggccgtgcgcagcaccagtatcaaaaacacccccgcaaaaacttcaaaacgccagttgtcgaatttaatccccggtttaagacggtcaaagttttcagtgatggctcttgtctcagaaacccaggcgggcccggtggatatggcatcgtctttcagttccgcggcgaagaacgcgagttttccgacggcttccacagcaccacaaacaatcgcatggagatgatgggcgccctgatagctttggaacgccttaaattctcctgcaacgtgatcctgcactcagatagccagtatctcaaaaatggtatgaccctctggatgaaggggtggaaacaaaatggttggatcactgctgacaagaagcctgttaagaatgtcgacctctggaaacgactcgatttagccgccagtcgccacaatgtccggtggaactgggtaaagggtcacgccgggcatcgagaaaacgaaatatgtgacaggctggccaagatcgcagcatatgcggcagctgatactccacacaaaaaagatgctggtttttggtataaaatgataagtaagtatttacctataattttgtatcatgtatcttacccatcgtcaggatgacaacgtgctggttaggcacggttccaaggatggaacgcaaaaaacggcggctggacattccagccgcaactctttctgacattgaaaggatttcaaatggcacatcaaacgccttcctcttctcttaagaaacacccccgttcgctacgactcatcctggcggagttattctccggccgtgtgtctgcacgcctgtccgaactggaagagaaagtaggtcaaatggagcatcgtctggatgaccatgcggtggccatctctaacctgggggctcgtgtggcaatgggggaagtgatgaagacccgaaccgcaaaaatcctgcgagacacctggggcgtgcgagccaatcaaacgcgcatggagagctcagatggatcaatttcaacgaaaaagactacttccaatggcctacgggctgatcacgatttgtctggcagccgtagcaataccgtcgactcaggcgttgctgatgccggactcatgcaaaacggtttcgcagcagacgccggcaccagtcacggaaagcacaaccagcatcaccaccatgccccggtctgccactctggatgggatgcggttggattcgattcctcaagttcgtcctgcgactccggatcttcctcctgctgcgactgaggtgatggcgtgatcttcttactcaaaaactggtcattcatttggatagccattctgcttttggcggtgggtggctggatctcaaacatcgttaagctggcactacacggtgatttatttcttcactcaggtatgacgatcgctcgtgttgtggggatttttgtcccaccgatcggctctgttctcgggttctgttaatgggcgtaggggttgaagccttggaggctctctttgctgccttaatgtttatttgtatacgaaaacaatttgtttaagcacataacatatagggaaaaacacatgttaggtttcttcaaaaagaaaactcgtaaagcggttattgaagttaaaaaaatggagaaccgcgatgcggtcgaagctactgtctggggcgcatacatgatcgcttatgcagacggcaactgtgatgcaaaagaaatcgctattctggagaagaccatctccgcattgccagctttctcaccgttcgcgggtgagatcgcccagatgagcagcaatattcgtgctcgctatgaagcttctcctcgttccgccaacgcacaggctcttcgggagctggctgatgtcgccggcactccagaagccgttgatgtgttgtgtctctgcctggatattgccgatcaggatggcatcggcgaagaagaagaggttgtgctgaagaaaattgctcaggcgctgcagttatctctggatgcgtacatctaatggcagagaaattaaggctggccgtcgtcgccattcttctcgtgctggtcgtgctggtggacttcactggcaaactgatgtctatcgcggcagatggcgtgttggttggattggctatctactttgcccaacctctacttaaaaaatcgaagtgatcgccgagggccacctggccctcgattcttctggtttaaccgttatgacgcgtttgcccccctcttctgaattgtcagaataaagcaatcaagaaaacaaattattttaacaattaaggaaaaacacatgtgtgataaatgcaccgccgctaacgctgaagtaaagaagatcattaatgaagtcggggctaaaaaactcgtagggatgcttgattctataactggtcatggtgacgctcatccgctggaacgcatcatggccatcgtccaggtcatggacttatttgacgaaccaatgaaaatcctgatgcttgctcgtcactttggcggggcgtatgtggaagagcatgaacgtgccaataaactgcaggcaactctggacatgatgagcgaaccaaaatgcgcgccggcgccagagctctccggagacaatatgggcattgaaagcaaagagcgggagatcgccagccttaagtcttctttaggcatgttaattaccgcctttaaactaatggcaacccataacggtttcaaaatgccagagctaaccggcgatgaacatcccgctgctattcgccagctgcttggtgtgatggcggataatatggatgaagcgaagagccgtatcgaagacatgatgcgagaacttgcccaccgccacgatctaaatgaccagccgcacaagatgcagcaagtcagccactgaacctgaaatagcaagggggcgaaagcccccttcccctcctccgtagccctctggatagatctttaacgccttttcttatctaagataataaaaccaataataaaacaaattgtttatatggtgggattatgagtgctgcgctttctgtccttgagtcttttgcttcgaacaccggtatcgaccacagcaaagagatgaacgtcatccatgcaatcgtggccgagtgcgagaaagggatcgcgttcatgcaccaggttcacgacttcacttatggcgacgaacgtcactggaataagtgtttaagatttgcactacgtacattggaagtggaaattatttggtagggatataagatcatatccctaagctcttttaagaaaaaattgcttaataacctaatgtaatttaaatccttcctccaacccctttaaatttttcgataaacgccccaattttttggaatacggtctgctttttcgttttgtactgaggattcagcggactgagttttggtagcgtctcatttaactccgtcccattttcggtagcatattcccgtttgagtgatgtacggatatagcgccttgccgcctcttcattgaggttttcttccttaatcaacgcttccgcttcccgttgctgttcacgctgagcataggtaaagaatgcatcaatgatactggccttatccggcatgtcatcaaggttagtttgctgaataaagtcaacaatcagaccttctttggcacggttgcccagacttgagcggattaagcgtcggacctcttcagtcagggcttctttaccctttttctgacggttgtggtcaaaaatcaggcccagaatgtagtccaggttaatctcttgcgacttgagcaggtcaatttcaaacaccacgtcatcccagtccgtggttgatgtatccctgtcgtttgctgctttttcacgtcgctgccagtcccggatatcattgtaagctgagcggtagtcctgaactttacgttcggcagggaggcgaatggtttgtaattcagcaaatttttcatcatccacgtagtgctctgctttaaaggtttctaccgcttccgggtcactaatatcaaccttctgcagggctttcagcgtggcaaattcatcgtagttttgcaggatgttttctgcccgcagatattcaccaaacagtttgacgaaggcttttttctctttttcactgtcgatactggcagggtcagggaagcgctgctccagctccgaaacaatagacataaaacctcgtttagcttcgccggttgccgcatcgctaaagccctgcatgtactcttcgtagcttttttccagtaccacattcttggtgtttttgtcgccaaaaagtgtaatggcatcaatggtgggacgctccaggtccctgaaagtcacgatattgccgaaggttttggttgcatcatagatacggttggtgcgggaaaatgcctgcatcaggccgtgataacgcaggtttttgtcaacgaacagagtgttaagcgtcggggcatcaaagccggttaagaacattcccaccacgatgagaaggtcaatatcctgatttttcactcgttgagctaaatcgcggtagtagttctggaagccgttactgtcggtactgaaattggttttaaagtggttgttatagtcatcaatagctgaatccaggaattcctttgcgctgctgttcatcgcgctggtatcaaagctttcgtcagtaatatcaccaatggcgctttgctcttcatttgcagcaaaggagaagatggttgcaacccgaaggcgtttatagctgcctgatttttttgctgcttcttcctgtagcattttaaacgtcgagtaataagcttttgccgcttccacactgctaactgctaacatggcgttaaagcccttagctcccgggaaggttcggtgcgttttctgacggaagttattgataatgtattgcgttatttcctggatacgtagtgggtgcaaaaatgcctgttggttttcagccgcgctgagttttttctcatcagtttccgtttcaagagacttaaaccgtgggcggacatcgttatagtccaccttaaacttcagcaccttttcatcacgaatcgcatcagtaatgacgtaagaatgtaattcacgcccgaagacgctggcggtggtttctgcccccagtgcattttccgggaaaataggcgtaccagtaaaaccaaactgataaaagcgtctgaatttctttttgaggtttttctgggcctcaccaaactggctgcggtgacactcatcaaagataaacaccacctgctgctgatagacgggcaggtcagcttcggctttcatcaggttattgagtttctgaatggttgtgacgataattttgttatcgtccttatccaggtttcttctgaggcctgctgtattatccgaaccattgacactgtccggagagaagcgctgatactccttcatggtctggtaatcgaggtctttcctgtcgaccacgaagaagactttatcaataaagtccagctccgtagccagtcgtgcagccttaaagctggtcagggttttgcctgacccggtggtatgccagataaatccaccgctttcgggttttgaccagttcttcgctttaaaagagctgttgattttccagagaatgcgctcagtggctgctatctgatagggacgcatggcgagcagagtctggctgctgtcaaacacgctgtaattaaacagaacattcagcagggtatgcttctggaagaaagtggcggtaaagtccttcaggtccttaatcaaggtgttatccgatttcgcccagttcatggtgaaatcaaagctgtttttatcccgtttagtggtactggcaaagtaccgggtatcagtcccgttggaaatcacgaagagttgcaggtatttaaacagggagttatcgctgttaaagctttccttgctgtaacggtgtatctggttaaaggcttcacgaatcgccacgccacgctttttgagttcgatttgcaccagcggcaggccgttgaccagaactgttacatcataacggttagcgtgtgagccggtctgttcaaactgctgaatgacctgcaccttgttgcgcagcaggttctttttatctatcagatagatgttttccagacgaccgtcatcaaacgtgaaatcacagatatagtcgatatggattttacgggttttgtccaggctgctgtcactagggctgtccagatactgctctgcgaagcgccgccattcactttcgttaaacaccacaccattaagatgctgaagctggtcccgcacattcgccagcatcgcagtccgtgactttacagagataaactcataaccctgattaagaaggtcctgaatcagctcccgctcaaggtccgattcgctttggtagctgtcgccagcatcctgaactttggagtatttatcaaggacgataaagttattggattcagcaatggtatgtatctgttgtgtcatggtgcatcctgtgcgtcgtctggcaaagtccggaagggtatcagaagcatcttccggcattcataaaacctgataccgggcgggtgagaacaaaccctgccggtatcaatggtccgtcagttgctggcggtttctggtttcgggaagctgaacagtaaatcacgatagtactcgtactgtttctggcgcagctcgatttcgcgccggaggccttctgtgattgaacccgtcaatgtgtcaaatttgtccagcattttagcaatatatttctgacgctctatggaaggcactaataatttcaattcctgcaatttccccacagcaagacccggctgtgcagatttcgacgcatattgatttagattcattgttgttaacatatgaaatgcccagtcaatatcaatcccctgcatggctgagactacaactgcatgttctgtagcgtagaactgacctttcattctttggacattgccacacagagcaccttgtcgccctattaatagatgttccccatcatgacttttttctttaacgtaaccacgaataccgtttccgccaaaacaaggatatacaaaatctccttctttcccatctactatatttctcgccgaaatatgctgccctgcacgcatcttcacaatctcacccaatgtcttccactcaaccccaccctcttcaaaactcagcaactggtcacgatagtaattgtactgctttttgcgcatggtaagctcagcggtaagctcagcggtaagctcagcggtaagcgcagtaaatttatcaagaatccggacgatttcagcttggatagcaagggacttttccggattttcggggctaataacaggaatcaaaacttttttgaatcgagactttgatatgttgaaacgagttacaccgcttgcggttttagctatctccgcacgcattaaattggttctgaaaaggtattttgagaattctggtttgattttaaccttttgattgaaccgaataccgaatgaaaaactatttaaataaacgggctcatcaaaacgagatgtgattgcggacgaaatgccagcttcctcagcagtttcagatgagccagtaaaaagcacatcaccatacctaacagcgtgctgttgctcaccatttttgacattaacaaaatctgttggtggttcatcaatatttatattgctaaatatatttttgtatgaaacatatttcgcattgccattttcaaaatcagccttggtcttgccggtaagtccaccataaatatcagcaatttctccaatcggcaaccactcaatttcaaccccatccagtaacttttccagataactcagctcactcatttctgcacctcgtcaccttcaatctcagccacaattgtatcaatgtctttacgtaactgatcgattttgctgacggtggtttttagctcgacattcagctctgcaatatcgacaatttcgcgggtattcaaggcttcgacgtagctgctgacagacaggttgtaatcattcccagccactttctcgaaggctacagatttcgccagatggtcaacatctgctttgctggcaaagacctgcataatcttttcgatatgatcatcagtcaggatattgttattggtttctttcttaaacaacccgctggcgtcaataaattgcacgcgggtatctgttttgtgcttggacagcaccagaatgttaacagcaatagtggtgccgaagaacaggtttggtgccagagaaatcaccgtttcaacatagttgttgtcgaccaggtactggcggattttctgctctgctccgccacggtagaaaataccggggaagcaaactattgctgcacgtcccttagcagacaggtagttaagcgcatgaagcacgaacgcaaagtcagcttttgattttggtgccagcacacctgccggagcgaaacgctcatcgttaatcagggtcgggtcgtcactgccaatccacttaactgagtacggtgggttagagacgatcgcgtcaaacggtttttcatcgcaaaagtgaggctcagtcagggtattccccagtctgatatcaaatttgtcgtagttgatattgtgcagaaacatgttcatacgcgccaggttgaacgtcgtatggttgatttcctgaccaaaaaagccttcttcgatgatgtggttatcaaaatgttttttcgcctgcagcagcagtgagcccgagcctgcagcagggtcatagattttgttgacgtgagtctgaccgtgcatcgcaagctgagcaatcaacttagagacatgctgtggcgtgaagaactctccgccagacttaccggcattcgccgcatagttagaaatcaggaactcgtaggcatcaccaaacagatcaatctggtgctcgttaaaattccccagcttcagcccctccacgcctttcagaacggcggcaagacggctgtttttatcttttacggtgttccccagtcgattgctggtcgtatcgaaatcggcgaacaggcctttgatgtcggcctcggacggatagccgtaggcagagctttcaatagcaacgaagatactgtttaaatcagcattcagcctgtcgttggtgttagctttagcggcaacgttgcagaacagctggctcgggtagatgaaatagcctttagtcctgatggcatcgtctttgatgtcatcggtaatgatgctgtcatcaagtgcagcataatgtatgctctcatcccctgcttccatgtagctggaaaaattctcactaatgaagcgatagaaaagtgcaccgagtacatactgtttaaaatcccatccatccactgagcccctgacatcattggctatggcccagatttgacggtgtagctctgcacgctgctgaaggcttgtcatcttgtatcctgttgtatgattcttaagtactgttattggcccgattttatcgcaatttcatattgatgacaggttttgtatgtcatgcgttgcactgagagttcgtttgcccggttgtgtagccaacgttctttcagtcaggccagtagaaacgttgcgctgacgataaatactgaagccccgatactatcggggctgagcgttcagtcggtgagaatttcttcatccgtatctattgtggatggtgatgaatctatttttgttgtaagaaatacccgattcagtagtctttgctttagggcgtttcttcgctcattgtagaattcctggaagcgactaaactcaatgttttcatctgaaactaacagcattgatggagtatagttgtttgatgagtgagatagccattgtttcagggatgtattctgtttacttgtattctgagagtgattcagtaaatgaagatttggtatggtgtcccagtgttccggattttcgtaaaagctgagtttctccggtgaattcgcaatataatctaatttttcaagatatttatttgaaaaatgatttcttggatgaaggtgatcaatatgaaacacctcggtcggattcatttcagggaacagaagatgcaatagtgcgcggcagcgaccttcgccatatctgatattgagaaggctttcgatgtattcgttgtcaaatctgaggtccttattcgagcctttgtacctgtcaataatcttctcaagaggaaaatgaacatctgaaagactattcttcattacgtctctgatgctcgtgagtagcgcatctgcctggcttccaaagatccctttcagaagtaccatgtaaaaccactggctaattactgagcgttcattgtggtttttattcaggagattaatcgttgtatataatgggtgtccattggtttgctttttgtaaagccagtagaccacaggaatgactgcatttttagatatcagtgactgtggattgatgccgaatcgcctgataagaacaaaagtctccttgatacaggattttatttcagaccattgttgttgtatcttaccgacctcttctgaagtgaaattttttactttgaaccggacgtcagagtcaataagcatcaggctggtttttaagaaccagtctctttcaatataaaaccccatttcattattctgatgaatgttttttgttagttcatccagttctcttctgaaatcaccctgccagtgtgctacagctattgacatcagtaagtcggagaactcaagttttgtccccccgctattcgtgcggatgaaaacatccaacacatgatcaatgtcctggctgctctcattgaagtagtggataagactctcagttcttatcttggtataaagtttaagcagggtttttctggagaattcactggaaatgagtcctcttttttcgagttctggtacgacaactttaaataagatatcatccggagaatcaatttgctcgtatttgaatatttcgtgaaggcagaaccagtgatgtttgttatcggtaagtgaatcagtgtattccttgtcggtgaggaacctgaagttgtacttcatcatgggctcatcgtctgagtcaagtggcgctgttaaatcgacgtaaagctttctgggcggcaggaagcgatcatcctgtgccgaaggccaccacacccggggctttttatacgcatacgttccacacagtccaatatataaagatgtgagacgctgctgaccatcaatcaccgccttaaaatcatgaaatcccgcatttgttggtacacatgggttttcttcattaaatcgctgacagtattctttcaggaattcatagaatttgtaatcgtttttaatactggcactacggatatcccacatcatgaaagagtttatcgggtagtctcgcatgatggaatcaaatagtagacatatctgcctgtaactccagacaaactttcgctgaattgcaggcagaaggtagtggcgtaaattaatcgaatctatcgcttgttttatcgttattgctttttcatactggccagccatcataaacctcatgtgttatattagctggctgattttaatctaaagggtgtaacgagtacagtatttgcacaagcataatttatgcagtggaaaagctgactgctcggtttgtgtttttcgttcgggtagactcgcattgcggacgcacaaagtgatgaaacctgtcttgctatgtttttaccaaagttaacaagaagtccatgctttatcttctcgccatctgttatgtctgccaggtcattaccaaacgttacgctggcagctttgtgacgcgtgatttggggggggatgaagcgtggctacgcgtacagactcccaggcgacagactaattaacgcgttgacattggcggtcactaattgaggatttctataagaactcgttgatcgccctcttccctactctccaacttcatacactccaggcgtggcaaggcttttacgcacattacacccacaagaaaacaaataaataacacatcaatgaaaagtcaacgctttaccctgatttggtctcaaaagttgacgttttgccatgtcacttcttatatccgttaagaagcgtaccagaaaccaacaccctgcgacgaaaacgccaaaaacgactcctgatagcaccacaaaacagacacgctaagaatggctctcgttgcgtttaatgagtatataaacaaattgttttaagcaataagaaaacaacaaaacaagataacgaagaaaaggaactgccattaccccacacccaggcaatacccacctcttcctgccaggctaccgaaaagaccaacctcattgccccaggctaccgaccccatgaagaaaatctcgaccaccaccaaaaagcgacgagacaaaggcaatttctctgaaggccattccccaatacacggaagagaatacccgggaagaaactccagacaagaccaggccagaacagtccccggcgccatctcgtttacccactcttacctcgaaagataacgcaaattcctgataagcagagaacgccattacttcacatgcggagaacgacaacagaccagaacccacatcacccacacttccacctctcaagatgaacgaaagaaattgcgcacacgccattactccatacccagagaagaactatccccacaacgaagaatacagaccagaggaaaaccacaagacaaccacctctacaacatctgcaaaaccacttaccggcagagagaagaaagtcgccttttctcccatacgaatggtcaccgtatagagcgctaataagagagatacgagtcccccataagagaggttgttcgagtcaggaaagagcacagatataagacagaggggatggagggggatcgctccctttcccgtatttattcaagtcctgattttatcccccgtaacatccctgcggtcgaacgagtgaaagggccaccgcgaaaatctatcgggagcgtccccgcagggggaaggctggctgcctgagtggaaacggctgggttcccgtcatggaaagggtgcgtgccggtatagagacaaaatgccgcggggacggctgatttcctggcggtacaccgtttggtgcgcggttggctttcttcccgctgcgcgcagctgctgatacgtattctgccagagcgttcgagggtcacaagctgtttcagtaggttttcgggaagaggaaaatactacccacaagccctgcggtgcacgttgagaagaataatgtaaaaagtgctcccgatacgttcccggatactcactgcttttccagcgcttcccgatacaaaatgctttttcgcctatgtcttattgcgataataacaccatcaagaaaacaacgtgtttagacaaaggagaaacacatgtacaagcatttgaacatcagcatcaccctttgcggagaagagacgtgtactgacgaactccagatctctctggatgacgttatccgctctgcggatgtcgctgggcgcattggtacgctgattggcgaagggtatcgcgagggcacgtttgattttcatatcgaggacaacgcaatgtccgtcgcgtggaactgcacaacgtcagagtccagataaaggaggaagacaatgaatatgcctgtgattgtggaagtatggagcgtggactcgctggccgaatgtcttgatggcgtagggccagcactgacccgtaaattatggtcatttgtaccagctaagggagagtcacccaaagggaaggatgtttggcacctgctgactgatgaagagaagcgggagctggtggccgcagtgaaagaggagttccctgacgaagattaacaacggccaccagcaggtggcttttgagtgattgtggcctgcggccagctgaatgccggaacgcttcgcttggtggccgtttacacactggtattatttacaccaacaagaaaacaagttgtttacggagtgtgtaatgaataccgagatgattttgaaactggataagctccagcctcgcaaagacaaacctgcagtactcggttcgatcactttactggacatagtggccaacggcacagccatccgacttttcaaagagaccgttgtcgtcttcggcgaaacttctcgcaagcgcatcgtaatgagcgtcaggcgctatagtgcgaaagggtgggtagctaaacaagttatctggcctgagtcagaactggagttggctttactggaagttaacaaggtcgcccagcaggaaattcaacgagcaacaaccctcgccatagcatagtcatgtgcaacacagattagtcgaatttacgacagccccgttgatccttcggggcttttttgtattgtaagtacttacctacggcgatagtattacgacgcatttacatggaggtaaaaatgagtttgaccaaagaagatttagtatttgacctttactacgcatccagcactgacgaagaaggcaataaactggcccagctgaccgttcagttccgtgatgcatcggctgttccgcatgtgaccacccagctggcccgcacaactcttaagcgagatcgctcgaaggtttatgccgtcggcgagcaatccgtgaaaaatggttcggacactctgctggccgccattgaagcctattatcgaacagacccgaagaccattttcgaaaacctgatggcacaggttcaggatatgatcgagggcaatctgggcgccaacaatacctgggttggttcatacggcataaccattgtgtctggcggctctctggaagagtatctgcctgagtccgtctacaacgtccagtaaaccagccaatggcgcgtaacccgcgccattttccccatcccgtaaacaagttgttttatacattttctgagttgcgataataacaccaacaagaaaacaagttattaacgaagttgaggaaatgttcatgggacttgatatctatattgagacgcagccaaaaaacgatctgaataacgaggcatccagaaagcaagttggctacttccgtaagttcaatgctctcgttgggtggatgaaccgcaacgtaggtgaagttgtaaattgtgaacttttagaagttacgatgaatgatatttgtgctctcaaggctgatttgattcgtctaaacgaaagtaattgtgaagaatatctgcctacccaggaagggtttttcttcggtagtcaggagtacgatgaagggtactggaatgacgtggaagagctgaaagagcttgtggatgagctgattaaaaatcacgacttctacaataacagactgacattttgcgcctggtggtaaatatgactgatttcaccatctccccgaaagcagaaaacgtatggctggaatcctggcttgacctgtcgccggccgagcaaaaagaaatggatcacgtcgaaccggacgaacaaaccagctcccgcttcttccattatcaggatagcgtttatgacattgccgatttcatgcgcgatgaccgcttcccggaatggaacgccggctatccactgaatgccttcgctatgttgatgatccgcttaactgattcaggcgacaccatcgacatcggattgcttcattgagagaggagggccaccgatgctggtggctcttaactaccacctgctttcccgcaggctaaaaacacccacctcttaccgccaggctaccgaagcacccaccgacttcccgacggccaccagctgccgaaacagaacgcttggacgcctcacacccactgcgataattaaaccaacgagaaaacaagttgtttaaaggattatcacaatgaactatatcgccactgtaaacactcccgcgcatggcaccatctctgttacatactccgatattgaaaagaacatcctgggcgcctggcgcgaagaagagaccatccagctgtccggaaaagagaagcagcagatcgccaacgacatcatttgcaaccgtcgattcacgcgtgtcttcgaaaaagcttatgtcaccacctcaggattcggggtgtttatcttcccggttcgaagcgggcggttctgtcagtcaaaactcatcgagctcgcaacacagattgctgtgtggatcaaaacagagtcagggttcgactttacagaccaggaagcaacagcgcagggtgtgcggatcgccgacaatgctcttaagtgcaaaaacgtcatttacgaagccggtatcgactcgtggaaggtcacttgcggggagttcgtgaaagagatgcacgccagtaatcggattcacatactggctggcaagtaagaggggagggggctggaaacgccccctttctttccgtccaccagctcccgcagggaaattcagaaacgggcagaaagccatccgggcaaccgacgggaaacggccagaaaattttcgggaaacggcgggggtcgcctcatgggaaaaatttgtatagagggagacgccagaatcgtcgccagctggtggacgtaagctgtttttgcgccatacgtccagcgctgtgatctgcgctgcattgttagcgcgtacacgttgcgccaacgtgctaatgatacgtgagcgcccacggatcgcgccaatattgccgacacgccccgaaggatagcgcggatcgcgtcaccagacgatcacgcccacgacacgacaaaataagccacgcgctaaaacgcttttaaacgcgctataacgtgttttttactgtgtgtaatgggtatgtactaccacacgtaaaaacacgttaaattggcgcgtttatggcgcttatttttggtgtgaatgagtgaacgccagataaaagaaaacgcgccaacaatggcgcgttatggtggagatcctgaaacgaaaaaagcgcccatagtgggcgctggtggctaaatgctgttttgcaactttccgatcatttcagacaagcgcaaatattctcttttccgtttacagtctcgcttgctgttaagcaaatcagagaacgtaaagtttagcgcgtcacgttgggcgcttaattcgtcgatgagttcaagtttataagcgcgatatttagcgcgatactccgcgcggatctggtcatagttaatcatgatttttatccttaaaactagcgcccactatgggcgctgaatccgtctacttatgctttgaaagcgtcagccagatagttataaaaatcatttttgataaagcgatattgctgcgatccgtttttggcagcgcccattcctttaatcttctcgaccagtcccagacgttcacacagattgatcagctggttggcttgcgtatatcctgcatctaacttaatttcatttgcttgttttgcttcattcatcaaatcgaaaacagcaccatttgtgaacgtgtcgatctcatcgttaatcatatcgattaaagcgaatacacgagatccggacatatcagcgactgaatacacacatttaccagacttgatagacttaaccagataaaccagcttttcgagagagtagctatttgtcatcgcttcgcggaaaaacacttctggcgtttgcttgcttgctttaatcgcgtagtagaagacaccagacaacttatcgtcgtttactgcgtttacaacgttattcacgaagtatgcgagtttagtagacgctgcaagcatgttagctttatctgctttggtgtgcgtgccattctgataatgttcgttgtaagtctgtgtagcttgatctgcttttaattgtaattcgtcagtgataactacagcagcatcaatgatggattttttagaaatggttacgttagacatgattttaatccttatgtaatattgaaaacttattttgtttttcgtctatcgtcagcatgtttgctttcgatgtaagtaattatcgacatgcaaaaaataaaatcaagcgtttttcgcaaggagtgataaaaaatttatttcacaaataaatcaaagtcttagaaataaatcgcgttttctcgaaggtgttgcctaaataaattctacactcggtgtattacccttatatatttagcgctgacaatactttttgtgatttaatttatcggggagtgacctataaaataataaccggacatagccggctattacccttataggcatttacatcttttttgcatagttcctgatttcttttattatatactccccaaaacgttccgagttttcgcatttgtctttcgaaggctcatcaagccccagcttgcatcccgaaacgatcagtctatcttgatatgcagcgcctaaagccatgcttagctctaacatgcacaaatcgtagtcttccgcctttgaacacacctttgtagagacacgttgagctcgttcaatgctattttcttgagaaaatgcggaagagctaaaaatgaaagttaagaatgttaatgctgctacagttttcacatcaatatcctaaaacggcagaattcgttcaacccaatcaaacaggacgatcatttttcgcccgttcccaacggcaagtgtgacctgacaagcgtcgacgccaagtgacacaccttcaatttcgcggccgtccgccatgtagacccttacagatttatggttctcgtgagcctggcggcaaattttaaagaaatcacggcgggatggccggttatcaacatagtctggatgtacggttacgcgaccaacgaaatcatgggtgacagcgtcatttacacctgactcgatagtgctgattcgctcaagtggcaaccttacacgattgtctttgtcgaacggcgccgggcatagatctaccttgttacgggaggacatcgtcccctgaacgtacatgcagaacacctggccatcttccatcgtgacctttacgggaatttgctccttgcgccagaacatcaacgacgcctctacttttgagtaatcgcgcggccagacctcagcaggtatcccgtaggtgatatcggtaatggtattgggcatattttaaacgcctcatgttatgcgataaaaattaccagaaggtacgagtcaccattatcttctatttccttagttttgacaggcgaaaaagcgttaccttgttgcaaatacttagaattgttatagtttgcaggcaagtttctatatggtgaagaatgatgaataagtgcgcattaatagctttgataacctccagtttactggtggctggatgttcaacccaggcggtcaggacgagtgctgccgacccagtcccagcttcgagaatactgtcgaccaaatacaatacgccgtcagagaatacgcaaaaaatcatcgtgaaacgagactctggcagtaagggcgcgctttgtaccagccggctttctgttgatggtgagccagttgctgatatcaaaacatctgagaaggttgagttaaacctgccttatggcgagcatattctgtctgtagatcagcagggtatgtctattatgtgcggcaagatgaacaccgaaagagaaatcatggtgtcaaaagataagcaagacgaatatcggatcggggtgacggtgtcggcagagctgttcatcatgaaaacagcctataaataaatggtagaggagggcgagagcgtttcacccacgccctccgtaagtacgcgttagagacgtttgaggatatcttccaagtcttccttggtcatcccggagttctcgtagatctgcaacactttctgtctagcgttctcagccgctgccatcgaggtcgcgatcttctcaaactctgctgtgctcatcttggtcagaacaaggttgatgatgtctgacttcgacattttgatgttgcgctctttcaggcgcgttttgaacgaaccaagcttttcgttggctttttcggtgagcttcacctgacatgaaattgagcgattttcggtcataattaatctctttgtaatacaccaaagtcaaaactgctcccgacaggcaacacgccttccgcaaacccgggagtggtgtcaataatgtgttttcgttcgtatgagtgtgacatcaggtgtttgttgcttatatcgataaaatccgaaataaaacacacatttgcctgattcttcttggcacgaaggccgcgaccaacacgttgacgcatttcgacttcggccttgcctcctccggcaagaattacggcgccaacacttggcacatcgacaccgacatccagtatcgtagagccgatcagcacatcaattttccctgtagccaggctgttaagcttagcctgtctggtactctggttggattcaccgtaaataaaatctacccgtaagccgctctctttcatcatttccatcagtatctgaccgtggcgtttgatcctcaccagggtcatacagttcagtccatgatcacggtacatcagcgcgtcgcgaacgacggcctcgttacgtccaatattgtaaacgataccgagctgataagctttctgatacggcgtgctcataccaactctgaagttcagatgcttggaagcgagctccgctcgtatacgagcctcatccggagtgtacgcgattttatggtatacgaagtaaggtttggccaaaatacctcgctcgatcagatatttttcagtgacctttatctcgatgcgtcctgcaaccgccatcagacgcatattggcctcagttgaagccttcataaacggggttgccgtcagcgccaggcgatagtctgcgttaatgcaaagcctggcgatgtcataaaagtttgaaccggaggattcgtgggcttcttcgaggattagcagtgagacgcttgagaggaatcgcttaaccagctcccggcgcttaagatgataaacctttttctccgccggcatatcgcgtggaggctcttcaagaaaactcgccagggtttgcactgttgcgacattgatatggcgagacacctgaaactcaccagaaccaatgatgccaaccttctgacctttaagccacggctctccattctcagctcgatagtcgatcgacttctggaagttatctgccatttgaaacataagaacagagcgggtggttaaaaacagcgtcatgcgtccaatacgcgccgcggctttgcaagctacgttcgactttcccccgcctgtggcgatctgcgcaatcatcattccttcgcgaaccagtgtctctacagcctgatcttgatacgcatagtccggattataggggaaggggttaactgccgggtttggtttaccaagcgccggaaccttgtctttgcgaatatgcacgcatttaatgccagccttcaccagatttgctgctaccgatttagcaaaacccgcggggaaggcatttttgctccagttgaacatagtactggtgcctttccagtcgccagcttcgacttcgtaactcagcatttcctggacgagtcgcttcacgttgtcatcagcgccggagaccatagcgttgaccgcgttcgaaacaatcctaacagtcataaatatctttccttcgtgccttttatatgttaattggctagaatagtaagtaagtaagtacttatgcaatggattgtatcaaaaagtatgggcgtaaaaattaccattctgcaggtagaagtggccagactccggccaaatccctggaacaccaactcggttggtgctcaaaacttcgaaaaactgaaaggctccatcgaaaaactgggttttttcaagccaattctcgcgcgtgagctggacggtggccaatttgagatcctcggcggcgaacatcgctggcgagccgctatggaacagggtatttccacggttcctgttatatcggtgggcaaaataagcgatctggtcgcgaaacaaatgtctctggtcgataacgagcgatacggcgaagacgatcaggtcgcattacagcgtctgatcgaggaaattcagtccgaactcgattatcagctgtcggaaattgccccttacgacgacgaactggcggccacactggctcgtgagtcggcaatcgacctggaaatgcttgaggcgttgtcgcgtggtgacgaagagcccgttgagaaggactctcgtgaaaaagctgagcgtgttggggcggaacaccagactatgcgcttcaaagtgacgtttgacgcttctgatcgcgttaccgaaaccatcaaatccatcatcaaagagcaggcgatcaacaccggcaacgacatggagaatgctggtgaagctctggtatggctggtcgataactacaaggagtgtatttaatgaccaaaacgttcgaaatcgtctaccgagacccggcagagctcattccctatgaaatgaacgccaaaaagcatgacgagcagcagatccgtgacctggccgcagccataaaaaagcgtggttttgaccagccgatcactgtcgataaggacgatgtcatcattactggccacggccgccgcgaagctgcgcttttagcggggctgaaaagtgtgccggtgatcgttcgcgacgatctgtccgatgaagaagtgaaggcgaagcgtctggaggataaccggctggccagcattgattacgatgccatcaagttacagaaagagctggagtctctggtacttggtgacgttgaagtcttcggctttgacgagcgtgagctgaacgtgctggtcggtagcatgaccgaagaaatggatactggcgcactggttatggatctgggggaggaaaccgagcgccagaaagaagagcacaccgaaatcagtcgcgaagtcgccgccgaagaggttcgagtggtcgatgttctgggctttaaaacgctccctgctggctctgcgattgtcgtgggggatttgcttgcccatatggaagaaatcacgggagagagcggggtagacgcgttcgttgcttatgcgcagaaagtttcctccggcggagtcgaagcatgagcacatataccatcaacgtatcgttccagacccgtgtcaacaagactactcgcacgcttgagatcgccgaatcgtttgggcttggcctggatgaaaaagactggacgctttacgacaatcttgagctggaagttgagcagggtgatgtggtttacatcactggccagtcaggttccggaaaatctgtcgtgctgcgtgagttacaacgccagatgaaagaggaagggctttcagtcgcctccattgatgactttacctttgacaacgacgtcaatgtcatcgaccagctgggtaaaaccaccagcgaagcgttagggctgctttcgatggccggcttgaacgatgcctatctctttgtgcgcaaaccttctgaaatgtcggatggccagaaataccgtctcaagatcgccaagcttattgagtcgggcgcgaaggtatgggctgcggatgaatttggcgcagttcttgatcgtgttaccgcccaggttgtggcctcgaacctccagcgtgccgcgcgaaaggtaggtgcgacggtaatggtggcgacgacccacgaagacctgaagaacgcgctgcgcccggatatgcagatcaccaagcactacaaggagcgagtgaaggttgattatgcagattaaaaagactttcccgatttatgagggcccagatctgcgccgccgctggactacagaagccgaatggcgagattggcttcgtgctcatggcgcgtatggttttcgcgttaccccgtatttcaatcgctgctgtgtcgtctttggtgaaagacgttatgtcgagacgataaaacagctctatggcctcgatgaaagcgagttcgtatatggggttggcggcatggtgacaactctgggctatattcaggccgacacgatgcttcattgcgtctacctgccagaaaattacgatgaaacagtctactggcatgaggcactacatgtggcgctgatgaccgcagaatatcacggcgtgcagctccatgatcaggaggcattgacctacctgcagggttatatcgcggaagagttcaatcgttcccgactacagtttatggccgacaagaaagctggtggactgcctgcgatcgagggaatcgtgactcgtccagcatccactatctgccgtggcggtttttgcaatcgtaaggtggtgatgcgatgactgacatcatcattaaacggtatcgcccggaggagttcccgcgccatctggactttcttgagcgcatgaccgtcaccagggggacggtagaagactggcacgcgcttaagtcacttcactacaagacagatgggaagccgttcgcccctacctactatcgttgtgagctagatggtcggttggtaggcgttgtagttatggccttccctaaactgctgctggcgccgcggcatcgcatgtttccaaaactgaaacccacaaccaacaccaccgtggcaaatcagtactggggacgttacgtaaacaataacttcgctgtgatcagccgctctgtagtggacacccagtatcgtggcgtcggggtatcgtatcgcatgattaatctggttagcaggatgcatgaccggccaatcatcgagatccagtcgtcgatgagcaaatataacccgtttgctatgaaagcagggttttgcttcatacgtcctgaacgtccgaagagctacgaaagcgcacttcgcgtctttcagcgccattttcgttctgatcccggcgacaacgaagcgattgtgaaggagctgtttgcgatgactgattcacgccggcgccgcgcactgcgagatctggtggcggactatcacaagaatagttctctggcaaaagcaggccgcaaccgtggcactaccattcaggatatcgcggatagcctggtggatgaggccagcatcgtgaaactgctcaaggatattcacaacctgagcttcacttcaccgctctatggggtttatcgcaaccctgattttggtcgccagctgccagacacactgccactgctggcttttgataaacaaccgctgaatgcaccactggatattgcgttaccggcataaggatttgccatgacactgactgataaacagaaagacatcattaagaccatcaacttaggccatgaacgtggacatttgctcgatctggacgagctgctggaagtgctgccttaccggacgacaaagcagtctatgcaattctccctgcgcgcgctgatcaagaaaggtttggtcgaaaagcacgactgccggccgcgagaggattctggctaccagcgtcgaactctggggctgacgacattaggtcgagccagagccaagttactggtgatgtaagttggtcgggggagtcagattaacagcctgcgtctgtatatataactaataagtcacttattaaatatatatacgaaagcaggctctcaaacggattccccagacctaattaatacaaccagaaaacaaattgtttaagagcgcaaggaagcgctctgtgtgtgttttagagggatctatgactgtcgaaaaagacgagagcaaaactcgcctgactccggctgaatgggcggaagccgaagcgaaatggacttcgggcgagtatacgctctcaaaactggaagaagagtacggcatccgtcgtgaaacgctctccagacacttcaaaaagcgtggattagagaaaggcgccgattctgttggaaagatggtgcgcgagtctctcaagtccgatgcagaactgcgcgctaaagcccgagccgaaaagatagaagaccgccggacacgctatgacggctgggcgtatgcccttggtcagatggtgatggtcgaggtcactacagcaaagcgcgaaggtaagccactggcctcgattgaggacgatcttaaaagcctgcagcgcgccagcggcacgctggctaaatgcttcgaaatttcctccaaggcattgggcatggagaaagaagaaggcggtgaagaggatattccgaaccttgtctttggcgagctaaccccatcacaggtggcccagctgcgcaaggaagatgatgagcccgaagtgattgatgacgatctgttggaatcacttgaagaagaagcgctgagcgaagctgagagcgattttgacgcatcgggcgaagacgatgatggagatgcataaccatgtccatcccgtcgtctctaagtctcgtacagctgcactccgggcagatgcaagtcttccagtcgccacatcgtttcaaagtggtgtgcgccggacgacgttggggtaaatcgaggctgtcgatctcaaccatcattcgcgctgccgctaaggaaagaaaacaacgagtttggtacgtcgcgccgacctatcaaatggcgcgccagattttgtgggatgatctgcaggaagttctgccgcgtaagtggattcggaagaagaacgacaccacgatgaccatcgtgttgaaaaacggttcggagatcgcgcttaaaggcgcggataaaccggatacgcttcgtggtgttgcgctgcatttcgttgtgctcgacgaattccaggatatgaagccagacacctggtacaaggttctccgtccgacattgtcatccacccgcggcggcgcgctgatcatcggtacaccgaaagggttctccgaattccataaactatggactatcgggcagaacaaagagctgcagcgcaaaggtcagtggaaaagctggcagtttgtaaccgctgattcaccattcgttccgacggcagaaatcgaggcagccaagaacgatatggaccctaagtcgttcgctcaggagtacctcgccagcttcgaaaacatgtcagggcgcgtgtattacccgttcgatcgtagcgttcacgttaagccgctgcagttcaatcctaaattaccggtgtgggtaggccaggacttcaacattgatccaatgtcgtcggtcatcctgcagccacaaccgaatggggagctgtgggctgtggatgagcttgtcttgttttcgtcgaatacggcagaagtgtgcgatgagctggagcgtcgcttctggcggtggaaatcgcaggtcacaattttcccagacccggccggcgcctatcgtcagcacgctcgtggggaatcggacatcgacatcttcaaggagaagggctttctgcgtgttgattatccgaaaaagcacccaccgattgctgatcgtgtgaactcagtgaaccgcatgttgatgagcgcctctggcgaaactcgtttgtatatcgaccctaagtgcaaacatctcatcgattcactggagaaagttatctacaaaccaggctctcgcgatatggataagagcggggggattgagcacagcgcggatgccttgggctacccggttcatcgtaggtatcccgtaaaaaatcgtgttattcttggtggttcaagataagtaagtacttacctatcatggaagagaagcaaatggaattgactgagaagcaaattaaggatcttgtggcaagacgccaccccgaatacataaagaaaaaagagcactgggatttcctcgccagcacatacgctggcgggcgtgcctggttcgatgacaacattttccgatacttcaaagaaggtgatcaggagttcaaggagcgtctggaacgcgcctaccgcttcaatcacaccagggaagtggtgaacctgattaataaatatctcttcaaagaggacatccatcgaaatgtagaagaagcgcctgagccaattcagaaattctggaaacgcgcgacacgacagaatgtttccatcgatggctttatgtccgcgcttgacctccagtcctccatctatggccgtgtctgggtggtggtcgatagcacgatggatagtgacgcagaatccgtcgctgacgagaagaagaaggatgttcgcgcctatgcctactggatttctccgcagcagatgttggatatggcgtgggacgatgacggtaatttgatctgggcgctgattgtcgaagtggcgcgcgatgatcaagatccttttacctcatctggccaggaatatcagcgttatcgtctatggacacgtaacgagtggtttctattccgggaagaggttaagaaaggcgccgggaatgccggtcgtcggaccgcaaaagttgtgcttgaagataaaggcgaacacaaacttggcgttgtacctgtgtttcctgttgattgcataggggagagcgaatcgccgtattttagcccgtcgcttattgatgatatcgcctaccttgaccgtgcagtagccaactatctgtcgaaccttgacgccattattcaggatcagacgttcagccagctggccattcctgttcagtcgctcctgccaggcgatgagaatcacgcaaaggtaatggaaatggggacaaaacgcgtcttcacctatgactcggaaagtggcaaccagcctttttatttgtcgccagaccctaagcaagctcagatgatcatcaccactatccagaccgtgattaatgagatctaccactccgttggggtcgctggcgagcgaacaaagcaggataacgctaaggggatcgataattcatccggggccgccaagttatatgactttcagcgggttaatagtctgcttattactaaagccgagcgtcttgagcgggctgaacgccagatgatgtttttggcggcgaagtggatgggggtcgatctcgatgaggagcattcgctgattgcctatccggagagctttgatatccgcggtctgacggatgaatttgccgttgccgagaaacttgggctgctggaagcaccggattctgtgcgtcgatatcagatggaaatgctcattgagaaaatcttcccgaatatttcggccgcgatgcagaaagaatttgagaaagatctcttgaattttccgccaaaaaatgctcttaacacccttgaaaataagtcagtacttacttatcatcgtgatacagtccaagagagcggacaagatctatcccaagggaatgggaactcatcaactcaagcaaccgagtgataagtaattaaaaggaatttttatgaatctgtggcaaatgctaatggcccgtcgtggcctcatggatgtcgccgaatcacatgaacgtggtggcgcaggtgctggagctcccactggtgcagaagagcagggcacccaggaatctggtaagcagaacggcgagcagaaagatcagccgaaaatcgaagacgatgaattcggagggatgactcaggaagagttgctcgctgaattgcgtaagtccaagaaagccggtgctgacctgctgaaagagaacatgaaacgcaaggaaaaagagcgtgccatggccgatcagctggctcagtacggtgatatcgatccggtacgagcacgccagcttcttgaagctgagcaagccgcagaaaacgcacgccgtgaggcggagcaagctgaactggaacgccgtggtgaattcgatgctgtgaaaaagcaaatgatcgaagctcaccaggctgagatggctcaacgtgatgaacgtttttccgctctggagagcgaaaacgccgcacttaaagcccagctggttgaaatgaccgtcggcgcttccttttctggctccaatttcctgcgtgaaaaagttctgatgactccggctaaggcccgcgttatctacggctctcatttcgaagtgggtgaagacggtaacgtcgttggctatgacaagccggcaggtcagaaagagcgtgctgttctggttgacggcgaaggtaagccgttaccgttcgaatccgcgattgagcgtattttacgtgcagatccggaagctgacgctttattgcgcagcgaagctaagcagggtgctggttcaattagtaaaccgacccacaaagtaacccagccgaagaacaagtcgacaatggataagttgactgccggtttagggaaaatcggaatcaagtaacatcttaaatcatagggaaatgaaagatgccattactgcgtgaagaagctgaaaagctgtctaataacgagcttgaacagggcgtgatcgagaccattatcgatcgtgacgacctgtttgccgtcctgcctttcatgaagatcaattcgaaggcatatctttataaccgcgaaaaaaccctgagcgaagctactttcattgatgtgaacgacaccatcaccgaaggtgcagcaaccttcgaagagaaagttgcgaagctgcgcattctggctggcgacgttgacgtcgacaaattcctggctaccactatggctgataccaacaaccagctggctatccaggttcgtcagaaagtcaaaggtctggctcgtgccttccgtcgcaatctgattgttggcgactccaccactaacaacaaagccttcgacggtattccgaagctgatgcatgacgatcagaagatcgacatctccggcgcctccatgactttctccatgttcgacgaactggtcgacgcagttaaagatctgggcgcagactgcatcatgatgcgttctgagcatcttcgcgcatatcgtgcgctgctgcgaactgtaaacgtaggcccgtccgaaatcatgatggaaaacttcggtcgaccaatgttgtgccataacggcgttccgtttatcgtaaacgacttcattccggttgcggactccaccaaagcggatatctactgtctgcacctttctgaagaaaacggtgtaactggtctgtatggtggtgaaaacgccggtatcgttgtggaaaacatcggtactgttcagaacaaagacgcagttcgtactcgtgtgaagtggtactgctctctggccaataagcacgacaaagctatcgcggcgctgactaacgtcaaaatttaatcctaataataggtaagtacttacctattatttttaaatgggtgggctatacgcccgccctttttataggagcgatatatgtcagaaaaaaaagtgaagatcactgaaaaggccttcaccgactttacgggggttatgttccgtacttctttcactaaatcggtgtccgatcatccagtaaacgagcgcatgcagaaccgtatcaccgcagctatgcgagcggttccgatggagcccactgtcgctgttactggtgtgtcggtaagtcctaagtcggcatcggtggaggtgaaaaaaacggttcaactcacggctaccgtggcgcctgctggtgctaccaacaagaaagttacatgggcgtcgaaaaatgctgaatttgcaacggttgacgcggctactggtctcgtgaccggcgttgcagaagggactgcaacaattgaagtcacgaccgcagacggcagccataaagcaaccgcaactattcaagttccagcagctgcagcctgattcagtaacaaagggtggctctggccaccctgttcagaggaaaactcatgaaaccagcaaaaattcatcttctggaacctcagttccttggatacacgggcatcctgtgcggcgtttactttaaagacggcatttccgtagcagagctgccattcctcgatcaacagcggatctgcgcctcaatgcgtgccgaaacgattgatgggcaaaatgtctctccatcagctgccttcagcaatcgtaacgagctggtggccgatcagattgtggagcctacggcccctgatattgtccctatgaaacgtggcgtcgcgaatgaggagacaaaacatgtgcagcgcttcacccgagaagaactggagtccattgctgactgtgaaggtatcgccggcctgcgccagatcggtaacacgcttggcgtgaaagcgaagggcattgttgaaatgattgagggcatcctgaaagcacaaggcggtgagtgatggctctgatcgacacgtttcgtagcggagacatcgtgtctctgaccttcgcctttaacgtactggatatcgactccgcctcttatacggtgcgagatagtgcaggcacaacacttgtggacgaagagcctctcgatattgcagaaggccaaatgtctataccggttgtaatctcagcagagcataaccagctggtcgaaaaagagcgtgatctgcgctacgtcatcgtgaaggccacagcgggtgggctaacccacgaagagcggcagatgtatgtgctgcttaatagctttgaactatccgtcccggctcagtcgtttgccaccgtagccgatgctcaaatgcaggccattgatatgatcaatggagatacattgctggctgatggagagggtttgatgcgcaagcggctaatcgaagcgacacggcgaattaaaaccttacctttctctatccggaggatcatgcgcatcgatttcgaccggtatgaccgtccccaaaacatgctgaatgtctatgacatcccctggggggctgacggcgtgtatcggcaagatttggtggactgggaacggatcacttcggagcagtttgcggatttaccagactactttaaagaggcgctgcttctggccaccgttaatgaggcatgcgagatcgccaatggcaacgatattgcgagtgcgcgagaagacggcattttgtctgaatcgatcggtgaaacaaccaatatgtaccgcacaagcaaagtggcgaatgtccgtgtggcccgcagcacctggcgattgcttattagttacatcaacaatcggatgattgttcgtcgtgcgtaatacacgtcgtgctctttacttctggtcgacaggccaaagacgggaaaccgcgcctccgcctggtaatgagtgcgacgacttcacacaaggagagtggatgaatatttcgtggcaagccgaattgtcgatctaccggtttggttccaaaaacgtctacggtgaagcgcaattgcagttcgtcaggaagacgaaagtaggcgtcgttaaatttgaacagagcaatgaaaaatcgtccgtcagggcagatagctctggaagccgcggaaaggcagcgctggagttgtttgacgcagtacttattgttccacttgaagccgctgttcaactcgatgacgttcttgtgctggaggggcagaagctgaaggtctcaagcgtacatcggcgatggggactacgtggccgccctgggcatcttgagctgggggcgaatatatgggtttgaaatatgacgcacaccagtttaagcgtgccggcgccagacttaataacagccagaaagcgttcaagcgatacctaatcagggacatggaaaagctggcgcgtctggttgaacgactggcacgagccatggccccgcttgaaaccgggtcgctggagagcgccatttttgcgcgggttgtaaaagaaggatacgcgggacttcgtattgagctttccgtatcaggcgcaaagcagcgcgaaggacatccaggcgttgaggttggggactatgccaaatacatggagcttggtaagtaccgtcttggttatttgtctcgtatgaagaatgttaccaaccctcctgtcgccggcgtgaagcctaaagtgggcccatatttccttgagcgagcgactcagatcagcgaaaagcaattttcgcagacgatcattgaagctgccagaaaagcaggatttacgcgagattgacatgtttgtagaagcattcgcaaaattgatacaaaaaaaggggcttggaaaagtagggacggacattttctgtcactatatgccatcaaaagttaagtctggcatcttgctgattaatcccaatacaggcatagccatcgacccggatttgcagggtttttacttcgactcattcacgatagtagttcgcaatgcgagtattacaaaatctgttgaaatggccaacaaaatcatggatatccttcctgttagcaacgttgagtctgaccgggtattcttcaaaatggttaggccgatggcgatgccaataacgtatccaataaatgacggatcgcttattgaaacggggattccacttgaatttgccgggtactttattgaactgaataaataagtaagtatatacttactattgtgtgtcggaatgacactgttttaacggaaaaaggagttttccaataatgtccaatacccatgttaaaaacatcaagcttggcgcctgcaaggtgtcgtttggtggcgtggatctgggttacaccaaaggcggtgttcaggttgaaatcgcaaccgaaacgctgaaagtgaccgtagaccagctgggccagaccacgatctccgagctgatccaaggccgcaacatcaccattactgcgccgctggctgaatccgtgttgaaaaacatggtcgatctgatgccaggttcaacgctgagttctggcgaagataccgtaactatcacgtctgcgcagggtgtgaacctgatcgacgttgcaaaagagttggtgctgaccccgcaggatgcgacggattatgttctgaccatccctaaagcagcaaccgcgggtaacttcaccatgacctaccagtctgacgacgttcgcgtgttctcagttgagttttccgcttacccggacgacgctggcgtgttggggaaaatgagcctcccaaagccggttgagagcgtcacgctgaccccgtcttcaccgaccgtaaaagtgggagctaaagttcagttgagcgcaacctttaccccggccgatgcaaccaataagactggcatgtggagctctgatgcgactgataaagcgaccgtagatcagaacggactggtaactggtaaagctgtcggttcagccaatatcaccttcacaactaatgacggcgccaagaaggcgaccaaagccgtctctgtaactgccgcaagctaaattgtgataacccaagaggcccatggatgggcctctgtatgagtttaaaaggatttaaaccatgaccaaattactcgatctcgactccattctgccgccgaaaaaaagcatcaaatttggtggcaaagaatatcccatcgttgaaatgaccgtcggcctctttgtttctatcaagcagatggaagacaaagacctcatgaatatgtctcccgtcgaccaggtaactgcctacgcagaactggtacgcaaagtcattccgtcagtacctgactccgttctggagaaactgactgtccagcaactccagcagatcttcaccttcgccatggaagtgattgatgaagagaacgaaaaagcggctggcgaaggggcaaagtaatatcccgcgatgaatccggggtaaagaccgtttcgatagatctcggattctatttcagtcgtgtagttgctcactacgccgtatcgccaatagagctactgagtgtcccgttaaccatgttctggatgctcagccgcaatatcgatcgtctgcgagcggaagaggatgtccgcaatctgcaggtcgcccgcgtcgcccaagcggatggcgatggcgttaaggcgttcatggagggtttgcaactcaggattggaaggccagtcgttactgataaagtctaccgtccgcatatggataaggcagaccccgacgccaaagagcagctgatgcaaatttttggcagaggatgacaagggaatgtcacaaaacgtagagtttatcctgtcgctggaagacaaacagtttacggcgtcaatcgaccgggcgggtaaattacttaccaaatttggcgagcgggctaccaaaccggctcaaaaaattaaaaacctcgagcgctctctgggttcggtctccagcattcttggcgctcttgaaacacgactcaattctacggcagacaaactgcaggacgtagctgccggttttgagctcgtttccaacacctctcgaaaggcacaacgtgaactgtccgctatcagcactgatttgcggacattcacagatcgcgttgattcggccacatcgtctacgcacaagttcctggcctcattgcggaaggttcagtcggaactcaatgagttttctgattgggtcaaatacgcaggagaccatgccggcaaattcaacactgagattaagggagccactacttctcttggtggaatgaacaccagactaaatgcgaccagcaagcgtctgagcaattgggggacaacgacaagccaggcggccgaggggttaaaaaaagtcaaagatcagatggatggcgttattcgaagccagcagctgatcagccgccctgtcagggtcagaacaaccacaacgggtgggggaggcagcggaggtggcgctgatcgatttaccgctgcgccccatcgcggtggcagtcgtgaaaatagcgtcttctctgggttacgcggcaatatttttcttctgggggaaattggcgatgcggccagaacggttactgacatcctgtttggttggcagaagccgatcgtagaggctgcggccgagatgcagcgtatgcgtgtcatgttgcgtggcttgaacaaggataaagtcaatcctggagaagccgctgctcaagatatgcagtatatcgtgaacatggcgaaaaacgccccatttgcgatgcaggccttaaccgactcatttgtgaaattccgttctgctgggctcgatcctactgatggctcgttaaaggcactggtggactcagtcgcacgttttggtggcgatagtgaattgcttaagcgagcggcggtggctgtccaacaaatgtctggtaagggcgtcgtgtcgatggaagagctccgccagcaattgggtgaagcggttccaaatgcgatgaaggcgatggcagatgcggccggtatcacgatgggggagctaaccaaagccgtctccagtgggaccgttgaagcgaaacaggctctttcgttgatgtttgttggtttgcgtgcggaaaacgaaaatgccgccaaagatatgatgcaaacctataccggtgcgttggcgcagctgcaaacctctttcactctgtttgctgatcgagtggggcaggctggataccttgactcgctgaccaaggggatgaaagagctggcggccataatgaacagcgcagaaggcatttcgttcgctaattcattgggagaggggcttaccaccgcgattgatggcctgcgcgagctggcgcaatggttggctaagaatcaggagttggttattacgctgggcaaaattgtcgccggattggtggcatttaaaatgctcagagcgggcattttaggtgttgtcggcgccggcggccagatgctttccaccttcatgaagatgtccactgtaatccagacaccattcacgctgggggcgacggcggtcactcgtttcaatcgtgctgcacgcatggggctggcaccaatcccatcgctcatttttgccattcgtggcgcgattacggggctgaaaggggcatttgctgggctgactgcgtttatcgcagcaaacccgattggtgctgcgtttactgttgcaacagtggctgttgccgggctgatcacctacatgaccatgcttcgcaacgaaacgtccaaagttgttgaggagattcgcaaaatccccgaagcgatgacggcagccaagcgagcacaaatggcggagcgcgcatcgcagctagagaagcaaattcagcgggaccagcaagcgcttaaaactggcgaaagtgttaactacatttccactgtcgccggccctgtcgccgttaaggagtctaaagaggttgttgaggctcgactgaagaaaaatcaggaagagtacaagagaaccactgacactatcgcgctgggggatggcgctgtatccaaacgtctggcgaaagaggctgctgaatcccagatcgagaaaatccgggcggataatcagctcttctcagctacgtttgttaaagcgcgtcaggaggcactggacaaaatccagaagatcaatgacgacaaaacattgtccgatgatgagaagaacaagctgcttgcaccgctgcgagagacagtaaacaaatcttatctgcagccggcccagaaacttgtcgactctttatcatcgcgtaagaccgcaactgaaaagcagatcgcacattttagcgatttgctggaaaaggcgaaaaaagaaggaaacacagaacaggtacagaagctgcagggcagtattcgcggctatcaggaacacctggagacgattgctcaggaactgacacaggctgagtttgaacgcgataacgcggcgaaaaccgggaagggcgtgaagaccaaccaaggaacagtgcttgggttgggcaccagcgacaaaggcgctgacaaagcgctcgcgcagtacatgcgcaaccagatggactctgcggtttaccagcgaacgctacctgatggcacaccaatgatggattttgaaggaaaacctatcattgggccgaagcagcttaaaactcagcttaacctgcagaaagcctcaactgcatcttctctggaaaagatgagcgagaaggagcgtgcagccgccatagccgcattaaccaaagctcgtgaacaagatgccgctgctgccgagagggcagggaagcgtactgcgaatgcctctgaacgcgcagcgaaaagggaggaaagagcgcaacagaagctggctgccggctaccagaaggctctggataaagctgatcagctcatggggcaaatgggcgaaagttcaaaggctactgtgtcgtttgatcagtcgctgcgtgatgtcaccaagtcactaaccgatcttgcaaacgccacgcctaacgagtttatctcgcaggagatggttgaccaggccaaaaaacgtctcgcggatttgaggaacgctacccccgaataccgcgaaatgtttaatcgccgcaacgtcgagcaaatgatcagcgcttgggcgccggaatcggattcgattatcagcgcaggcttgatgcaaagccatgaggagaaggctgccgagttttcggatacctacaatcgcaatcttaaggcgctgatcgagctgcgtgataaggcgactgacccgaaaatcatctcgctttacaacaagcagcttaatcagctggtggccgctggcaacaatgcgctgattaagcaaacaggtacagcgacccagcagttggctctggagtatgagaacctggctgaacagattgagggcacatggacagatctgtttagcggcttaactgacacgcttactgactttgttgttaacgggaagatgagcttctccagtctggccacatcgatccttaaagacatcaccaacatggtcgtgaagacccagatcactctgcctctcatgaatatgttgggaatgggaacgacaaacgccggcaatgcacaaagtggaaatctcatgaatggcgtagcgtctgcgatcgctaatcaaggggttcagctcggtaattctggtggggcggtggccaatggggataaatctgtcggcgaggccactaaggagacagcctccggcgtgaactctatggggcaagcgtctcagaatgcggccagcggtttaagccaggcggtgaatggtgtctgggactggacgaagtcattgttcaccggtactgacgctacgaaagatcaaaccaaagcggttaacagcagcatcctcagtatggggaatctgtctaccgcggcgggggcactggcagcaacattcgccatggtaggtgcttcgtcgtcgagttcgtccagccgttggctgaatttcggtctgtcactggccagtaccgcagtgtccgcttgggctgggtcttcgacgccatcaggctcaaagccaaatgtgaagaagcacgccaatggcggcatctttggcagggaaggggttgtgcctctgagagcttatcagaaaggcggaattgccacctcaccacagttggcgatgtttggcgagggctcaatgaacgaggcttacgttccgttgccagatggtcgaacaattccagtcacactttctgcagagtcggctggaaagagcacgggtaacgcggtgtcccctgtctcaattcagatcaatgtgaccaaggatggacgaaccagcgagagcagcagtggaagcgagagcaatctctggaacggtgcagcgcggcaaattaagtcgattgtgcttgagacgattgccgaagagaaacgttctggtggttcacttaatccgcataccaccagagggtagtaaagccggccgccttagcgggcggccatcacaaggaagtgatatgtcgaggaaagtatttaattggtatccagattatgagtctgagaaaacggtaaagcctaacgtgaccgtgctgaactacggcgatgattacgagcagcgccagtcgcaggggctcaatcggattaaagaagagtggtctctcacgttcacccgtagccatgacgtggtaaacgacgttgatgactttttgactgcccgcgcaggggtggagtcattcgtttggactaacccaagaggcaaagcaattatcgtggtatgtgatagccatacggtaaagcgttacccaggttatcaagtgcttacggcaacatttagacaggtttttgagtcttaatttgcgactatagataagtaagtacttatctattattatatatcaacgtcacaggatgtaacgttgagtttttcaaggatgaagtgatgggtattagagctgatattcagagtttatcgccttctgcgctcattgagttgttcgagctggatatgtcggtgacaacctccggcggcaagttgtatttccatgccggcaccaacgggcttagccagccaattgtctggcagggagtttcctatgagccgtggccaattaaagcgtctggctttgataaaagcggtcagggaacacttcctcgtccaaagattcaggtttccaactacgacggtgtaatttctgccgagctgcaggccaatgacgatctgattggctgcaaaatcattcgcaagatgacgctggcacgttttctggacgcggtgaactttcctgatggaaacccgaccgcagacccaagtcagcattttgctgatgaaatgtggttcgtcgaacagaagaccctggagacgcaccagtatgtcgaattcgagctgtccagcgtcttagatctgatgggcgttcaactgccgtatcgtcagatcatcaaaaacagctgcccgtggaaatatcgcggaacagagtgtggctacaccggcccatatttcgacaaaaacaaccagcaaacctctttggccggcgccgactactgcaccaagcgttacgacgcctgtaatgctcgtcgcaactacttcgcgaatggcgttattcattttggcggatttattggggcgacacgatatgagtaaccagacgttacctgagctgggctcagaagtcatgcaggatatctatcgctgcgctatccaacgttacccgaatgaagcgtgtggctttctggtacgcacacagggtgagaaatatcgctttatggaagcgatgaatgtctctgaaacgccacgtgaggattttgtcatgcgtgccagcgacattattgcggccgaagatgctggggaagtgatcgctatttggcactctcacgttgagcgcagcgcagaggcgtcagacccggatcgctccgggtgcgaggcgacggaactaccgtggatgattctggcaattcgcaaaaatgtggaaagcgatatgccattccaccttagcgaaatgaacgtcatttatccgtgtggttttgagatgccctacctcgggcgcccatacgtattcggtgtgtttgattgctggatgctgtgccgcgattacctaaagcgtgaatttgacgttgagctgaatgcaaacgcccacctgcatattccttcctggtacacgggggacaacgacatcctcgaccagaactaccgaaatgaaggacttgtccgcatggcgccggggacggaaccccagcgcggcgacatcttcttcatccagtacgggaaaatgccagatcactgcgcggtatacatcggcgacggcatgatcatgcatcaccagatcgaccgtctcagctgtcgggcttattacggtgggatgtatcagaagcacacgacgcatcacctgcgtcacagggatttactcaagggagacgagacgtgtctgaattagttcatgttcagctcggcggtgcgatggcaaagaactttggccgccactggaaattgaaggtgcgcaacaccaaacaagccatcgatttgattgaggcgaatcgcccgggctttaaagcctggattaagcgtaaccgtaaccacttcgataagtaccacatccaggtcacaaataagcagggccacaagtggtcaatggacgacaccgaataccagatgatgggcgagtcggaaaatatcgcaaaaatccgcattactcccgtaccacgtggcagcggtggtaaggcgtttgggtggttccagactttcgtgggcgccgcgatgatcgctgtcggcgctctggcctctgggctgacttttggtgcgtcttccgcgctggtaatgggagggatgtcattgatgatgggcggtgtgtccatgctgatttcgccgcaggcatcaaatgcgtctgtcagacaggcggataacacggattcgttttacttcgatgggcctcaaaacaccagcaaccagggaaacccggttcagcttaattacggcgaggaaattttagttggctcacagattgtgagttcttcaatcaccatagaccaactgtaagggaagttttttgaacatggatcagttcaagaaaaagagattgcccctcctgattgcgggagcgggcggcaaaaagagctcaggctcaagccgtacaccagttgaagcggatgataccgttaattctcgcaccatggcgtctatcctcgatctgctcggggaaggtgttgttggtgggttgattgacggtgctaaatctatcttcgtcgatggtgtggcgctacagaacgaagacggttcattcaaccgttccggtgtaacttgggatttccgggatggttcgcaagaccaaagcccgatgcctggtttcgattttgtcgaaacgccaaaggccgttaatacacagctgaaaaccacaaacgcggttacggttgccatcgataacgacgatgctgatcgtgtccgagtgatcatgaagttcccgtcgctgcgtagcattgacaagaaaacaggggacacaaacggtacttcggtccagtttaagttccagctggccaacggcaatggctctttctatgacgtgattgctgcaggtgagagcagctctgacgtgacgctgactgcgaaaaagactggtgtctactaccgcagttacgaaatccagcttccaaagcctgggcgtgcctataaagtgcgcgtgcttcgtctctccgccgacagcaacgatcagtatctctttaacgatacctgggtcgactctatcggtgagatcgttgacaccccaatgaactacccgaactccgttctggttggccttaaggttaactctgagcagtttggtagctctatgccgtcacgttcgtatcttatccgtggcctcaaaatccgtgtgccttcgaattatgatgaaaacacgaacacttataacggcgtttgggatggaacctttaagcttctgtcgtcttccaaccctgcatggattctgttcgatctgctgaccaatgctcgttatggcctcggcaaatttgtttcggagtcaatgattgaccttggccagctttatcagatcggtcgctactgcgacgaagaggttgatgatggctttggtggcaaagaaaaacgctttgcaatcaacacccagatcaccagtcgtcaggacgcttatcgtctgattcaggatattgccggcgctttccgtggcatggttttctgggctggtggcatggtgaatatcatgcaggacagcccgtctgaccctgtcatgctgtttaccaacgcaaacgtaaaagatggcctgtttacctataaaggctctgctcgaaaagaccggccgtccgttgcgctgattacctataacaacaaacaagacggctataagcagaacgttgagtatgttgaagatcaggaagcgatggcccgatacggggagcgcaagaccgaggccgttgcgttcggatgcaccagccgtggtcaggctcatcgtgtaggtttgtggctgctctataccgcgcgtatggagtcagacatgatcacctttaccgcgggcctggacgcctcgttcctgatgccgggcgaaaccgttctgatccagaacaaatatcgtgccggcaaacgcaattccggtcgcatcgtctctttcaccaaaaacagcatcaccctcgatgcacctgtctctctgaaaaagagcggtagcttcatccgtatcatcaatcaggaaggcaaaatcgttgagcgagacatcaacgagaccggcgacaacatcactaaagttaccttcaagacggcgttggccacagccgatcaaccagtagcgaatggtgtctggacgatcaccgaaccagacctggttccaatgcgggcgcgcgttgtcgctatcgcgcaaggtgaaaccccggggtcgtttgatatcacggtggtgcagaacaatgcatctaagtaccaggcgattgataacggggcagcgctcgttccagaaaatacgacggttcttgatcccacatattccaaaccgagcaatctggtcatctcagaaggcacttatctgtccagtccgggcaacttgtccgtgaagctgatgcttgcctgggaaggtaaatcaccagaatactgggtcagctggcgccgctccgacgagggcaacgtctccaactggcaatctgcccgcgccacggaagaacaatatgaaatcgtcaatgttgccgaaaatgggcgatatgacttccagctgtattccgtttccttcggcggcaaaaaatccgagatcattactgctgtctatcaggtaaaaggcacgatgacgccgccaggggcgcccacatcactgaccgcggtgggggattatcgtaacgtggtattgaattgggttaaccctgattcagtcgacctcgcgcagatcaacgtgtatgcgtccaagacaaataagctggacaccgcgacactcattgctcaggccgccacaacgactttcactcacgctgggctgggtgacaacgagacctggtattactggattcgtgcggtaaacaaacgtgggatggtaggccagccgaactcgaacctcggtacagaggccaccactcgcgacgtattgtctttcctgaaagataagatcacatcttctgaactcggcaaggagctgctcgacgaaatcgacagcaaagccactcaggaggcggtagacaacgccattggcgaggttcagaactcagtcaacgagtctatccagcaagttgaaaacgatctggcgcaaacctcctccgaaattaaggcgcaggttgactctgtcaatcagtcgctgaaagaggacataaagaccgtcaatcagacgattgttgacaacatcgataccgtcaaccagacgatcaataccaacatctccaacgtaaacagccaaattgaagctgcaaaacagtctattaaagacggcgacgcggctctgtcgcaggagattaagaatgcgcagtcatcactgacaacgtcgctgtcccagaccagcaaagatctgactgcggccattcagaaagagacgaatgaccgtattgcagatgttaatgatgcagccaagcaagcggccgaccaactgctgagcgcgaagaatgagctgaaaacctctatcgatagcttgtctgaggttgtgacctccggtgacgaaaacctcgcgcgacagatctcgcagattgccgctggcacaggggaacagtttgactctctgaaaatctggtatttcgaccaggacgctgaaggctggacggaagatgataatggctacacgccaatgagcgtcaccagcgatggctggctgaaagcgaacaatccgacctcaacctgtcgttcccctaacggcttgacgatcgatgcccatgcttatcgtttcattaagatgcgtattaaaaaggttggcaacccaacctggaacgccaaaatgttctggatcggcgctgatgaaaccggctggaatgctggtcgctccgtggttatcaatgaaccggaatacgatgacaagggtattgcgattctgaccctgcacgacattgagtggcgagattcgacaacgattcgtcgtttccgcttcgatttcacttcaggtcaggatgcggacaattacctgttattcgactggatcgctgtcggtcgaccgacgccgggcgcaggcatggccgcgttacaggaagagcagcaggctcgtgcgaatgcggattccgccgaagcgcaggcgcgcagcacattggctgcacaaatccgcggttcctctgaaagcggaaatctggacgacattcgctccggtctgatctatcaggagaaaaatgctcgtatcaccgccgatgttgcggaagcgagtgcgcgtgaatccttgcagactgaattcaacagaaacaaagcctctgttgcagaagagctgcatacgctgtccactgaacaagcttcccaggcaagcaagattaccgggttgcaaacaagccttggccagaaggccgatgccagtgcggtacagacaatttcccagaaggtcgaagagcagggcaacacccttaaatcacaaggggcggcattgtctacgctggataatcgcgtaggaagtgttgagtctggtgtatctgcgaacagcaaggcgatcacgggtctgcagtcgaccgtaacacagcaggataaaacccttagcagccagagtgaaagcatcaccaccctgaataactcgctgagcgatatccagagcgataccgatactgccaaaagcaacccgagcaatttgctggttaacgcctcctttgagcgtgacctggcagggtggtctgcagggaacagcgtatccagtattatcaaggcgagtgcgccccattctggtagcaaaattcttgtttgcgccgccggaacggtgcaaatcacgcaatctgtaagcgtcgtcgaaggacggacatacaagctgtcctcttttgtgcggtgcaccactgatgcggtgatcagcagccctggcaacaacaaactgcgtattggcgcggccacgttgctcaaagagattccgatccgtccggagaatctgcccaaagatgaaacatggaaagaggtctctgatacctggaaggcgacgctgaccggtaaagttgacgtatcgatcatgtcttctctcaaaaccggttctcagtacttcgatgatgttggttttgttgacgtcactgatgctctggcgattgaggcgaacgccagtgccaccaatgctttgacctctcgggtatcgtctgttgagggcaccatcacaagtcaggggcaacagatcacttcgatgcagaacagcatcaagaacaaagctgacgcctcagctgtgactaatctgacaaaccgcgtaactgctgccgaaaatcagatctccagccagtcccagagcatcaccagcctgtcaaactcgctggataacgccaatgctgatgcggatgcttcgaaagcgatcatcggcaacatgctcaaaaacaactcttttgaacgtggtttcgaaggttgggagtatgttggttggactctgctggaggcccaaaaccccaaatcggggaaatacatcatccaggcgggcaaactggcctctggcggtgactcgggctgcaaccaaacgatcgagctgcaggctggcaagacttatcgtatcggcgcatgggttcgcaaatccgctgacttcaccatcaataatgccggcaacaacaagattagtcttcgaaacgcagatctgacgccgttaaaggatatcccgatcactggcgccgggctgtcgactaactgggcgcttattagtggcgagtatacgccagccaaaaccgcgagcgtggttgtgtctctgcgcgcaagtgtcgcttccggctatatgtatctcgatgacgtcttctgcgttgacgtgagcaatgagaaggcgattgatgcgacgtccaatgcgttatcaaccctcaacagtaccgtgacccagcagggaaaagacattacgtcgaactccaacagcatcacttcgctgtcaaaccagatggttaacggccgccagaacatgtgggtgcgtagcgtatacaacgtacaactggcgaacaatgccaccgagccgacctttagcgatatcaacggtaaggcgccaatctcgatcgatgaggttcctgacgcggcaaaactggactttgcgagcgccggcagttacgtgatcgcgcattacaaagccttcgtgaaagtcaatgctgataccaccatcactatggcaccagggtctcgtgtttttgatgatacgggcgccgtgtacgtgaacggtgttagggttgcctttggtaatgcgagctggaatacggttagctttgatctgaaagctggctggagcacggttgagttcctggtgaaccaatggactggtcaggcttacattaacctcggttttaaactgtccgagaaggtagcccagctgaattctgctcttgggatgaacgcgctttcgaatgccattagcgccgtcacctcaaacgtcagcaccgtaggtgatcgcgtcacgagcacctcacagagcgttactgacctgcgaaatagcctcgaacagaccaacgctaatctggcgaataaggcagatgcacaggcgctgtctacgctgcaaaatacggtctccaagcagggggatacgatttccagccagggtaacagcatcacgaacctgaataacaccctgaccgctgccagaaacgccggtgacaacctgatcccgaactacgatttcctgcagggtgcaactgcgtgggatatccagtatccggcgggcgttactttcggcaactttggtgatggtaaggctggggttaagctgaaccggacgaccactaccagcccaggcatcttctccaacaacaacaagccgctgccgcttaatggtcagcgcaaatatcgtgttgtggttaaagccaagggcgtgtccggggcgatgaacatgttgatccggcgccagaataaaatcggccagaccgacagcaattatgaagataaaaacgtcacactaaccagtgagtggcagaccattacctgggagactggacttactgcctctaacgctgatggccagaactttaagctttacgcgcacccggctaatgccgaaatctgggttgatacctttaaggtctttgatatcacggatgaggtgaagatcaaggctaatagcgatgcgctgtctacgttgtcgagcacggtgacgcagcagggtgacaagatcaccagtcagggcaacagcatcactaagttgaccaatgacctcgaagccgctgacgcaaacatcgcgaaaaaggccgaacagtcggcagtcactacgctgacaggtcgggtagagaagacggagtccggtctgacggcggcgaacagcaacattacgtcgctcaacagctctctgaaccagcaatccaaacgcggcgctaatctgcttcctgatggcacttttgaaagctacgcggttggccacaatctatcaaataatcgcgttatcgtgaccactgatgactcgcatggcggtaataagtgcatccgtgtgacgcgtccgaatgattacaacgctaacgcaactgataacagcgataatcacattttcagcggtttccaggtacgcgataacgcagtcttctatatggaatgctgggttaagcgggatgccaagagtaccgctatggccgagaatgcacagatctccattggcttatcgctccagtatcaggacaactcctggcagtggccggcagttaccaaagcggcaaaggatctctcttcaactcaatggacgaaggtttctggttacctgaaatcaacgaagagcggtattaagcaggcaatggtcaggatttctattcctaacgttagcagcgttaaggcgggtaactcattcctcattgatgacctggtcattaccgaagtgactgatgcctacaatgcgcaaagtacagcagacgctaatgccaatgcgatttcgacactggactcgaccgtctcccaacagggtgaccagattaccagtcagggtaacagcatcaccaaactgacaaatgacctggcaacgaccaataacaacgtcagtaaaaaagctgatcagagcgctttaagcgtgttgtccgggcgcgtcgatcaaacagaatcgggcttatcctctgcgaatagcagtatcactgcgcttaattcatctgtacgcgcagggaatgcgacaagtggcgatttgattagcaacccgacatttgacccagagtttagtcagatgggcttcactgtggtttccagctcgtctgagggcgtgccagccaattgcccatacgcttatgttgcacgcattgcggctcgcgaccatcacccaaattttgctgctattccggcgacattgggggatgtctatgaaatgtctgctctcgtcgcgtgtggcactggctccgctgatttcaacctgtatctcggaaccgcaacacggccaagcggcagcgtgggcgcgcctctgtcatctggcggcaaccgcaaggcgtcggccacatggcagcgagtaacctggcgtttcaaaattactcaggggattgtcgatcgcggcttcttccgtccattcctgcaaatcaaccagtccagcccgttcggcaccgtctggtatgtgaccgactggcatctgcggaacgtaaccgactcctccaaagttcaggattctctcgatgctacggcgaaagcggttgattcgctgacctctacggtaaatcagcagggggagaacatctccagcattggtacacgtactaccaatcttgagaataatttgagaacaacaaatgcaaacgttgctcaaaaagcggacgccaatgctctgacggcactgaccaaccgtgttacccagaccgaaaaagacattaactcaacgagttcttctgtcacgaatctgaacaataaggttgatgcgatttctgtcggcggtacaaacctgatcaagaactccggcgatatgaccggctggtcgaacgttgtcagcgatacgtatcgtggtaatgcggtaattggcgcaactgtaaaagccggctccggttacaaggatctgcgggaaatcacgcttgagtcgccggtcgatgcaggtgagtacgtttacagcttctatgcgaaaggcggcgttactggccagacgatgacggcgttcttctacaatccgaacaccacaacgtctatcgagaccaaccagggtgcgaaaggtagcaacagtgatggccgtgcgcagttcacgctgaccacttcatgggcccgctattgggttaagtggaaacagacacctaccacgggcaccaagcgcctgattctgtgccgtatcgagagcaatacctccaaagaccagacggtgtacatcaacagtccgaagtttgaggtaggtaacgttgtttccgactggaacgagtctccgtctgatagcgccagtgcgtcggctgtggattcgctgacaacgaaagtgaatcagcaaggcacttccattagctctatcggaaatcgcaccacatcgctggaaaacgggctatcgacagctcaaaacaacattgccaagaaggctgatgcttctgcattgcaggatctccggaacacggtgacatctcagggtgacgatttaaccgcggcgaacagcagcattaccagcctgcaggcctcgatgaaccgtcgcactgtgtttactgtcactgcacggggtaatggcaacagcgttacccatggggtgtttgatgaaagcggcaagaatctgtttacccctggtcgcagctgggcgctggtcacttttgcaaaacacagcgacggatcaacggtgattgcgacctccaaaacatacgatgtttttggcagtgcgaataatggtgccacgatgtcggctgatatcgaggcgttggccagtggcacttacgtttgcgtcctgacattcgatgagccatctggcaaccgaggtaagatattgtctgctctggaatctcttggtggtacatccgaagtcgtcaactccttgccgtatcgtggtgcctacattctccttggccgcaaaggcatgaagcctggcgatggtctggaactgcgtgcgccaaccggtggcgacggcaccgcccacatttcgacctcagtcgagtttgtgaacggggtaatgatgggactgggcgccgccggcggtgtgatgatgaaggctgatgcgaacgcatctgcaattacaacgctccagaacacagtgaagaaccagggagataatattgactccctgagctcctcgacaacggcgctggaaaacagccttgcgtccagtaacgccagcgtggatgcagcaagccagatccccgggaacctgattgtaaacccgtcttttgagcgtggtacggagggctatacaggctggagcgggattgccacggtggtaacgctgcaggttccacatcttggcaccaaagccgccaaactggcggcgggtggttctgcaggcgtgggccagaagatctccttcaaaaaggatcggtcgtacaaaattggtatctgggcaaagcaggaccctaataccaccattcagtcgactgacaacacaaaattccgtgtggcagaaggtaacggtctaatcgcaagtaaggcttatggcccgtttacttcgaactggcaggaagtgtcctggacctggaaggcgacaaaggatgtcgttgctgacgttcagttcactgctttcttgtccgcaggcgcgatgtactttgatgatttttatgtcgtcgatgtgaccgactctgttgaaactcaggcgaactcgagcgcgatcactaaactcgatagtcgtgtgaccaagacagagaatgacatcaccagtcagggcagccaggttacgcaacttaagaatgaccttgctaccacaaacacaaatgtttcgaagaaagctgatgcggctgcgttaacggcattaacgaaccgcgtcacgcagaacgagaaagaaattgaaacccagagcagccagacaacttcgctcaaaaactctttgagcactgttcaggcgatggggagcaacccgtggtttgatggttctctggagacgtactccgaaaaccagcagatcagcggctcgcgtgcggtcgtcgtcagctctcagaaacgaagcggaacgaagtcgttgcgtgtttcccgcggcgccggtgagggcggaaacagcgataaaaccatcggtaagtggattgctctacgtgaaaatgcggtattccgcattgaactctgggcgatgatgccggcagatcagtcgccatcctctgggtggtcaacgatcgttggtttgcagacccaaaacgctgccaacaacaataactggccgtcggcgatcaccatcactgaaggttcgttggggggcagagggacctggaagaaattcaccggcacgctccgtgtagcgactggtcacactcgcggcgtgttctggatttctacccgcggatcaactggcgccggtacgccggggtatgatctgtatatcgatgatgtagttgtcaccgatatcacggacgcaaaagaggcacaggattcggctaatgcgaacgcatccgctctcaccagccttacctcacgtgttaccaatgtggaagggcaggtaacatcccaagcgtctcagctgtcctctttgacgtcccaggtgaatgatgcgtcttcgaaggttgatcagatggcacagaccattaccaacaacgagaaaacgcagtcgtcgctgaacaccagtttgcaatcgcaaattgacgcgcaggcatcggcaaacatcaaaaaccagacggagttgaataacgccaccacctctctggcggcaattaagtcaactcagcagacccaggccacaacgataagcgcactgtctcagcagcagacgaatttgacagctcaggtaggaggccagtcagccgagcttcaggagctgaagaaaacggttgttgaaaacggcaacgttaacagcacctggatggtcaaaatggaaaccaacagcaacggtaaaaagtatgctgctggtatagctttaggtatcgatggcaaaaatttgcagagccagtttctggttcaggctgatcgcttcggcttaatcaatacctctaacggaaacacgaccacaccatttgttgtggaaaatggcgttgcctacataaatgccgctgtgattaaggatggctccatcaccaatgcaaaaattggcggtgaaatccgatctgacaatttcgttaacggttcaaatggctggagaattggaaaagacggtagttcacagttcaacaacgtagttattcgtggtgaagttcacgcaaatactggtgtgcttaataacgtgactattaacgagaactgcactgtgcttggcactgttcaggccaataaaattgttggtgacgttgtgacaatgaccgaccgtgttgttaaaaactggccagcttccgggaatacctcatccggcacgcgctacctgattgcaacgattgacggtatgccctttgaacggcgtatggtgttcaatggttccgttgcgattgttcaggtatggcgtcagaacgtaacaattcgcgttgatgaaacgaccgtttggacttttgactctggaaacgatggtaaggactttgaaacatcaatcttctcaatccgtatcccggcgtcaaacttcggtcaacgtcaccagattaccattcagtggccgaaccgtggcgatagcggtcagttccggtttacaggggttgtctcgatgtacagaactactggctccatctctctggcttaagtttcaggcggctctttgagagccgctcattaaaattacaaggaatgtaattatggcaatgtatgaagttggcaccgtaacgggtgcagcaaaccaggcaaaggttactggtatttcaacaaagtggtcggagcccgcacttggtattcaagagggttcaattttagtcatttatcgcaatggaagtgctgatctgtatgccatcaaatcagtaaataatgacactcaactgactttgacgagaaacatcacaacagctttttctggcgcgaaatatggaattatcacatcagaaacagcgagcacttcatcatttgcaaatcaactagccagcgcatttaccctttggcgtaacgttgttcaaggatggtctacagcactaacaggtagtggcaatattacgatgacagaccctataacaggtacgcaggtgaccgtaccggcgattgccgggatggcaaaggcctcggatctggatgcgctggctaaactttcagggggaaacaacctcgccggctcgcaaattataaccagcgatagttccggttttattttgggcaggaacaacgatattggactggtcaaaaaatcaggcacctacggaaagctgatggtaggcagcggaacgcgcttcagcgtggtgaaggggaataagtcgactattagccctgaagatacccagacggagattatgggggtcgatagtgccggcaatatgactgttccgggcaacatcagtgcggggaaatattttgcgcaggcaattgagctttcgatgagcactccgtacatcgattttcatcataacaacagtaccaacgactacactgctcgtttcataaccacagccgctgatcaactgagtgtgcaggggagccatctacgggtagacagagacctgcgggtagggcaagcggccgacatcggcagctggatacagtgtcgctatgactgtgtgtcccagcagaccgacttcggttcccctgccattggcgcgttagtttccggtggcagagtccggtcccgcatgacagggcgtggcggaaacggcgacacgtctggagcgtggggtggtttctacctggaagaatacgttgggtacaaccaccgggtggtactgtatatggacggttttgacagaaaagatgcctggctcttttacaccggtgggacaatctccacacctaaaggcgatgttatgaccactggctcagacgtgcggctgaaaaaagattttacggattctcagaaaggggcatccaagcgtattaacgcgctgggggtatgtgagttcaacatgaaaggcgaaacacgccgtaggcgtggatttattgctcaacaagctgaaaaagtggacccgatttacactttccaaagcggtgatgtagaaattgatggcgagaagatcaatatccttaacgtagatcagacagcaattgtcgcagacctggtaactaccgttcaggagcaatgcaactgtatcgaaaaacttaaagaagagctcaaaaatctaaaggatctagtgatgcaaacgccagaaacagcagcataaaagcaatcgatattgtatgtaagtacttacctacaattaatttctaatttatgatataaatctgccatccgatttgacttattcatggaggaagacatgtcaaacgagatggcaggcgtgacgccagagcaggtggagcgcattgccgcaattgtggcgcgagaagtcgtaggaaaattaagtaaggagcttcgcgatgatattggccaggaggtcaacgatcagctgcgaacctactttggtgatatgactccggcgcaacatagcattcagcattccaacctggacaaacttcttaatcggctcgacacgatttcaagcgggttctttgggggcattatttccaagattacctcgttcctgatcaccgtgctgcttttgggtttggccgcttatggagtgaaaaatggactgcaataacaggagaacaaggatgagtactccaagaggcattcgtaacaataaccctggtaacctggataaggggtcgccgtggcaagggctagtaaacaatccggcggaaccgcggttctgcacttttaaagaccccgtatgggggattcgagcactgacagtaacgctcatcacctaccatgataagcgccgcgcaaaagacggttccagcatcgatacgatccgcgaagtcatcgagcgttgggcgccgccgcatgaaaacaacacggccgcatatatcaatgaggtctctaaagccgtaggcgtgacgccggacatgatcatcgatctgcatgactacaatactatgcggccgctggtggaggcgatcattcgtcatgagaacggtcgtggccctttgaaaacactcaacagctggtattcggcagaagttattgacgaaggtatgcgtcgcgccggcgtcgttaaaccggtaactgcagtgaaagcagtacccgtcacgaaagaaacagccggcgcaacggtgactgcaggtatcggtattgcgcagctgacggacgtaatgccgcagatctccgttgcgatggataaggcccagggacatatcaccagcggggataccgttcgcattatcttcggtattgcgaccattgttgtcgccggctttattgcctggtcgcaagttcgtaagcatcaggcaggagtggtgtaaccatgaacggcagcctgctttcaaaggtcaaatcgaccatcatgactttggctgccgtcttctttgtgctcgttggggcgtacacctggggtggacgcgctgcccggcgggccatggaagaaaaggcgcagagagaaaccaacaaacggcttcaaggcacagtggatgtgaaaaatgagacgattaatgaactcaggactaaggatgcttctgccgttcatcgcgagcttcgcgataagtggatgcgtgattagacctcagaccgtgggcgtacaattctgtgatggggcaaaccctatctacatcagcaaggacgacgccctgacagaagaaactgagagggaaatcctgatccacaacacgctgggtgagcggctgtgtcgttgggggtacgcgaagtagcacatacgccgcgcggacataattagcgcggccttagtcatgaactacaagatgtcagattttcacgttacttatctttaacccggctttctcctgtaactcagtaagtgctaagacattggcagggtggcgaaaaaaattgtatgcattcacggccacagactcgtttaaaaaaccatggcttagcagagagtccacgctggcatcgtatagcgcctcaagagaattgaatttctctgccagcaaccaagcttcttcctcttcaacaccgtagataccgcaggcgaaaagaagcgggcctaagcgaacgttttttgctcgttctataccctcataaattttcctagcctgcttcaaaccacctctgtcgataccaatcagcgctccataacctataaagaacatgtttagtggcttttgtattagccttttctctacgagctgcttgagagttttttcccctaattggtctatatgtactcctcgaggctcgaagaagcgccagcaagcagagtatgggtttcctgagttcagaaggccgtaagtgttttgggtactgcttagctcaatgctcatagtgagtactcgacgaaatgctagacgctaatcgtggtctatgttcgcacgatcaaggggttggcatattaaagcactcaccacatccgaaactacggtattggtcaaagaaactcgtgaccgtcgccaaatgcctttcatttcacctttacaccgcagccgtaggcatttaggctatatcgcatataagaaaacaagttgtttcatacgacgataaatcacacgtagggatatcacgaatgactcagatcattgtggtgggcggcaccaagggtggcccaggcaaatcgactgttgctcagcaaattgcagcctgtctgaaaatcaaaaagaaaaagaaagtccagatcactgatatcgacatccagcgcaccacgacagggtggtgtgaagaccgccggcacaatgaagaactggagctgatcccgttcgcctatgtccaggatgacatcatcaaacacatcacttcgcttcgcggccgtttcgattacgtcgtcgttgacgctggtggtttcgactccgaaattcagcgccaggctatgctgatggccaacgtgatccttatcccgcttcgcccgaaacgccgcgatctgaaatccttgcgtgacatcgaccccatcgtcgacagcgttagcagcgtgaatgaccaaatcaaaatccgtgctgtaatgaaccagtgcccgtctctgccctcccaggctgcgcgcattatcgctgcaaaagaaattgtcgaaacctttggtatcgaggcggtgccggtgaacctttacaaccgcaacgtctatgacgatgccgaagaggcgggtcgttccatctttgagatgaccggagccgaacgcgacaaaaaggctgaggccgagattgaagcattagtagaatacgtaatgaccttggagggtgaataatgtccatgaaaatgggtgatctggcaaaacgtccggctgcggaagctgctgcacctaaaagcagcaccccgatgcgccagcctgtccgtccacaaggccgtccaacacgtggcaaagagaaaatcaaaagccgcacgatgtctcttgaagacgagtatttcgaattactggagatgatgaagttcatccctcgcttcgagaagttcacccgttctgatgtgatacgtgcagccattttccatctggcagagaagtcaccgcaggaaattgaggacatcgtaaagatgaacgaagcgatcaccgctgctgatgtgacgatgcgtactgacgaaataaagcgcgagttgatgaagaaaggctgatataaatttctaaggctgtctatgcaggccagccttagaaatacaacgttctatgacagttattcgtagttaagttcaccgaacaggctgaacatcaagtcaccatccagaatttcaaatggcagctcaacatactcatccttatgcctcggaatcgctttgccgtcgtttggggcgttcttggtgtagccttttacatgctcaccgttttcctttgtatacggtagaacgactattcgaccgtgattttttgaaatgatagtaccttctttccagagcgtattgcctcttgaggtaatttcgctgtcatttgcttctttaacactccaacctatctgatttatgtcttcgaaccagaaaacaaagctgccaacgacgattatttttcgtccattccggagagcctcatccagcattctttttacgctggcgagttgtagtagctggttggcacgtggcagaagcattgagcgaatagtcgcttttgttttgccccaatgtgcagtgcctgataaaccaaaccctcttgcgatacgttcctggtagcaaattttggatgattttgctctggggctatgcacttgctcccaggtgttaggttctgttagtctgaaacatgtctggaaggtgggtaggaaaatccaatgcaagtaaggcatctcgtgtagtatgtctagcagatagggacgtacgattaacccttcaggtttgataattagctcatctgatgacaaacgtcgatcgttcgtgtgtcttctaatggcctcatttagcatcatatgctcctcatccatcagtcgcgattttgagatgagcgccttatcaatttttaagcgtagtgattctctttgctgctgagttaaagatagatcatctatattgaaagctatgtttttatttagttcttccgccgcttttcttgcatcaagatagctatcgtagacgtcatcaaaggcgaggtttggcatacctcgatcaacatatcgcctataccaagccagagttccatcatcacgaagtttcagacagaacatagaccaattatttcgttcgtatttaggctgaggccagaaagccagctcgggaagaccatatccgggaagtttgttcatgcgcatattgataatactcacgaggataaagcgctgattttaacatggtcagccttggttaatcagtcagttctgtcagtaacatagcatctgggaattaaatcaaattatgtgattctgggcatctgttttgtagcctgcttttgtatataaatactaagctacatattatttatatggagacaggctttttataccaaattcccagacacattcccttccgtttccacttccaaaaacagtaactagtcgctatgatcagccaaatgttaagtaagtagttacctatcggtgggggcatgagccagatcttttttgataccataaacaacggccagtacgacttcatgacagagtgggacacggtcgctatggacaagtgggttgcggaaaacatcggtctttcacgatgccagggagaggctgagctctttgatacaaagtggtttgactatcgcgacatgcacccgctgatggcaacctgtctgttcaccgaagcctataagcgcgcatactcacagatcatgctgtctcatggccgcgagcatttcgagacggcgccattcagtactggtctgaaacgcctgccttaccaagagctttcggcggtgaacaaaacctctctctggaaagctcgccagtttgcagatcggtattgctgttcttatgactattttatatcaactgttctatctgcagctgcacgccggctctgggacaaattacctcgccctcagcatctttggcagccagaactgattgagatcttcgaaagcaaactcgccaatcgtgcgggaacgcgtctggatgactctgtcgtgagttttaagcacttgggagacatgcagcatgacccaattcaggaacgttactttgaatgggttctggagcgtttgaagcacatcacccgtgataagcgtatccgcaccatcttctctgctgtctggttgatggagctggtgcctgagcgcgttatatatgcccattacccggaagaactggaagaagcacggcgactgtgttgattgcctgctccatatttttacgattagaaaacaacttgtttaagcaccaaaggataacaaacacatgaccgaactttgccacacgggacgagggttgtctgaagagttcgacgacgacttccagaatcgtctggcggcgtatttttgccgcgatcatgagtttctgactcgtgccggcgatctggttgcccccaaccaattctccaatgcggcgaacgccatactggtgaacatggtatcgggctatttcagaatgtataagagcgcgccttcatcggcggccatcctcgatatgttgaagcgtgctaaacgcgataagacgatcagagaagagatgttcccggatgttgtggcggcgtttaagcgagtgctctcggaaaaactctctgatacggcttacatggtcgaccaggtcgcgacgttcgctaaaagtgtagcgttcgacgatgcgttgattaaagcggccgagatgaaggagaagggcgacttccagggagcgatggccatcatggccaaagtgcagcagatcggttctaacgaagcgacgggcatttatgactattacgcctctgcagcggaacgttacaaggcccgtgaatatgaagcctctgatgattacgtgccgaacagcatcaccaccggtcttccgctgctggatcgtatgctctatcaaaaaggttgggcgaaacgtgagatggtgctcttcatggggtttgcgaaatcaggtaaatcgacagcgatgggggagttctccattaacgcaacgctggccggctacaacgttttgtatctttctctcgaagtgcatacctcgattctctccgatcgcttcgatgcacggctgtctgaaacggagatgtcaaagctggtggagcagcgtgacgacgttcaccggaagctcgcggagcttggtgcgacgaaaggggtggggaatctgtgggtggtcgagcgcccgtcaggaagcatgtcgcctgcagatttggatcgtatgctcaatagcatgaaagcgaatggcatgatcccggatatggtggtggtcgactatgcggatttgatgcgtgccagttacgacctccgtgacgaccgggcgaacatccgttctatctacaccgatctgcgtgctctctacgataagcacaacgttgcaggaatcacggcatcccagaccaatcgtgaaggtggctcatccgaagtggccaccatgatgcacgccgcggacaatatcgaaaaagtccgtatcgccgacttagtcatcactatcaacaagactgaagaggaagaagccaaaggcgaagcacgtctctattttgctggttctcgtaaccagaagggcggggtgagtattcgcgttaagcagaacctcgaacagatgcgcttcatcgagcggatcatggaggttctttaaaaaaataggcgtggggcaaagacggataacagccccacgcccttaaaaattaccttttggttaatcacaaaaggaaaaacacatgagcctttatggtattcaaaaaacgcggcttatcaagatattgccgtttaaaaactgcggtaaatgacaatgagtgacctcaaagagttactgtccgagctggatttcgaacaatggctggatatggaaggcatcatctatcgtcgcggcggtgtaagcgcccgcggccgcgaagtgaatatcaaagaatgtccggtatgtggaagcacaaactggaaggtctatttcaacctgaccaacaacgtcgggaaatgcttcgccggcgatcacccagaagaaattcaatttaacaagctggttttcctcaaacactacagcggtaagtctcgtcgtgccttcgaggaatacgtacataacgcactcctgtctcaaggttgggcgccaaaaaaagaagaggttgtgctggccagtgctgtggaacttgaaggcccgatggctttaccgcggcattatgagcttccaattgacggtcggctgccggactatcttgttgagcggaacattaccccggagctggccaaatactttgacctgcgttactgcgtcgagggaaaacatgcttatgtcgacccatataccgatcaggttaaagggcaggcattcgatatgcgcatcctgataccgatttacgatctgaatggggtgatgaagacattccaggggcgtgacatcaccggcgcagcagaacgccgatatctctttccaatgcagctgccggcatccgggaggtttctctataacggacataacgcagttggaaagcaaacagtcgtcgtctgtgagggggctttcgatgtcatgggggttaagcgcgccatattcgacgaagagacgctccgggactacgtagagcccattggcacgttcgggatgcatctgtccggaaacacgactgtagacgcagaagaccagctgggcgcgtttctgtcgttaaaggcagatggtttgcgaaacgtcatcatgatgtgggatagcgagaagcaagcgatccgaaacacaatggcggccgccagacgattaaccagtatagggttaaatgtgaaaatagcctgtcttggagaagaagggctagatcccggggaggccacccaggaacaaattctcaaagcctactatcgtgcaaaaccctactctaagcagctggagctgcagagcaaggttctcggtattagtgcatttaaatagttcgactcatggctgtagttccatatccgtgtcggaaataccataatttgtttatgtatgtaggtatctacttaaatattttaatgtaataaataacactttggttatggaggacatcacatgaaaaaaggtatcgaacaggcagttttagagatgatcaagaagtcaggcgtagagcttggcgtgggcgagctggagagcatcatcgatgcctcattcaacacggcatcagagcatatatcgaatgcgctatcctgcattcctctcaaagaaggggcgacacatacctcggtgttagtgtggtacgcaaagacgcctgaaatgcctggtactgttcaaaagcgcgtagctctggttgcgttcatcgtcccgtcgcttgagaccggcattgggccagtcgcgcattttggcgcttggtatgacgacaaaatcatcttctcaaactgctaccagatggaaagcagggaaatgcttgagcatagcgtggacgtgactctcatagccgtagaaagcaaatgcgagacagtaggagaggctttcgttagcgtcatgacttctcccgatgttgaaaagcgccatgtagatctggtggcaccaccaggcttgttggaaatgattgtctctggagattacaccaaggctatagcgcgtgttcgtgagctggactatgggcgtatctgcgacctgtgtcgtagtgatctggacttaatcaacgtgatcgttgaggctggccgcgtctgtgatggggtgttggcacaatacgcaagtaagatcagtcgtttggccaatgaaatgcctatgctgattcaggaagccaaatcccacgccgttcatgccgcaaacgacctgctaaccccttatcgatacgaagccgcaagtgacaagatgaccggctgggccacctggtaagccgtgactatgtactgtgtccccgtacagagttatttaaactgattagtaagtaagtacaagattatcgtttagagaaatggctaccaaaactgacttatcaaaaatcccttcgatctctggactcaacggctactcgctgcgttgcccggaagtgaagcttaacggacatgactcgtactgcagctacaccgtctgtcagcacacgatccttgccttcaaagagaagcgactgccggcgtcatcgttcacctcctgtgcgaacgccatttcggccggaaaatgccaggcgctgaaaatgatggtagaggaaatccggcaaggtgagtcgctgtatttcgtcgatatgccggcgctcattgaagaggtggaggaacgaaaccgaacagcgagaaccctgcagccgaagagaggcagtgcatctatctacagtggaattaaagggaagcgccaatcttcgaccgtggctaaaactggcagactgccggatgccagcgagatttattcagaacttatcaaagaaaccttaaaggagaagaccgactaatggagaagctgatcgcgcttaaacataagctggacgccattaaaacaatgggaacgaacgccaagaaagaggcgctggccagtatggatgacttcgaacaaagaatggtgtcactcatgctgaacccgtttgttcgtttcggggtgaagaaatacaacgtggccgatccacttagcaagtccgtacccagtgatcagaaagcgatagagctgctggagcaactgattgaagcaggagaatactcatgattccatacatcatattgactttttctggaggcgtcgcccttggcttcatcatctgtcatgacttgatcaagcaggaactgaagaccaaaacacttcgtattggtaagcgggtatatcgcgtcgttcacgagacaggggtatcaaaatgagcaatctaacctcgtttgactggtggataggcttgtactttgtggcttctggtgtcgcagtagcttttacgattggccagtccctggtaaagctactgcttttaagattcgccaatcgcaagcgtatcgatgacacgctttggtgccttggaactctacttgaacagcgttacggcgagctgaaggaaggtgcaaccctttgcataaaggcaaaacgtttcacggccacaattcagcggacgcaggatgataagtcaaagctgatcaaaaaatgagcaaaagaatgcatgaaataataggtaattatttacttattattttgatacaaatatgattgacttgttttcgttgagacgcgactgtttgaacgtttaaagataactgcaaacgacaatcagtatctggcagtagcctaaaaagccaaacaccagcgaggtcagtttccagcctcgtcaccgaaatgggacacactaagcgagtgtgattgcaaaacgcaggtagggcatctggttaaccagtgcccttaccgatgaggtaacagaatgggcggttgggttttatgtccaacacatcccggctcccaaagacccgaccgtctatcctgttacgtcatttctgttacttatgtcgtttagttttgggttaaaaatggcgacgtaacccggctggttaggtgagccagcacgcaacgttgagaccactggtttttgcatcacagaggcagaaccggcagacatgtagggccaagtacattaatccgttcagtggtttcaacgttgtggtcacggtttcattatccttctggttatagccattgttgtcactgccccgtggccacaacgattaaatgattccatacatctaattagatctgaatgaaaactctcctcaaccctcggagagtatttgaagatcttggcttgtaagcgtttggtgaacacgtaaagcacaagtggcaggaaacggtaggactgctgcgaacgacaccggtgaatcggtgatacagccccacaagtccgtgaatcgacagaggctgacggtgtcaaccttagatggtgtagctcagtggtagagcggttgactgttaatcaactggtcggtggttcgaatccacccaccatcgccaacacagcgctgaacggtttggagttcgccaccaccatccgaacggaaagactccgcaaatgtcgccagaccgttcagcgctgtgatagacacggcagacgttcttaaccattgcttcttagcatcgtagcaacacttttttcagcgcaaataattaaaggggcttcggccccttttgtaagattagcaaaaaagaacaatattacttgaaaaaaaagacaaagttagtcaatttcatttaataacaccaatgtcataatcgaggaccttgctcctctgcttaattaaaccattacctgttaagtttaatttgaatagccaattctatcttttctctgaatttttttgcatttccctgtaagtaagggtccattcgtttgaatatcgatagaagcttcctacgatatgttaaacttgtagagttaaattcccccgttgttgtgtgtattaataatgcctcacctatatcattaatctgcctttcttcgagcctggtgtaacaggtgacaaccatctgtaatatggatacttttgagtaccccttcaatttcgggctaggaataacatgctctaacatagagcctaatactttcgtcgcttccttagggatatacctactatcctccttagaattattaactgtttttatatatgaactttgttctgcccaatctatagcaataccgaataggcgacatagaagatagtgatatggtgtttgatgttctgcgattgagtcaatactctgaactttcatttgatataatattttttcagcaaagtgtttgaaataatgcagccaaagatgatcttgcaatctttgatgaataccttgatgcaccataatttcgaacattgttattccagaattaataggacaactaaatctactttgctcacggtaagagccaaggggcttgtttagtatttctgataacttactgtcttcatctaaacgccagcaaacagattcacctatagctctatatatgccacttttacttgcatacactgagtcggcaaagaaaaagtgaagcaagcggttggtttcaggtatcgcaagacgtcctccagtacatgtattttggttatttttaagttctacataaagacgactaccaggtgagtcaagcagcgaattaataaatctatcaatgaaatcagaacgaacgacctcatcagcaccaataagcctcaaacaaaaatgaggatatgcaagtgaaagatgccttgtaagatcaggagaagttagtatattcagcaaaacctctcgggctttatcactggcttcataatttgatgatagcttttcacgcaaaggacttagtagggaatatagacctttcaccaagacatttcggtctttgggttcttctccattcaataacgcatttcgatcggagccgccatatagcttatcaatccattgaacaataaggttcggttttccattagcaagggatattatttcgtctaactgaggctcaactaacaatactaactcatcatattttttggtaagatgtaaactctcaattagctcaagaaatagttttattttacctcgatttaatgttggcgattttagccgaatgaaaagatatgaggcagccaagagaaacaatagatatactgcactcgaactatccaatccccatatccacggtccgaaactgtaatacagtccaacttgtcttaatgcaggtgcaaaaaccaaataattagctagtataaaaatcagcccaatgattagtaggtcccaccgagtcatacaaaaacgaaatcgcagtctgctggtaggagtaattattgcccatacggcagcgatcactccaagtatagtgagtaaattagtggtatctattttggctggtatcgtcataatattttcagtattcctttagtagacgcactggcaagcttaaactgtatcacatgaccgcttcatagtagtcatgattgaagcaaagcgcctatcctataataactaaaaaaactttattatccccctttaataccgtaaaaaactttgttgaagtcattatgataggtaggtacatacttatcttttttgtgtttctaatgtatagtactttcagttactcacttgaaaggactcaatatgggaaacaaacgtaaacagacgcgtcgcgcagctcgtcaggctctgaagtcaaaaccacgtatccacggctacgaaattgacacaatcattgttgacgaactggctgccgcccctgctctgcctccgaaaccgaagcgcgacaactctcctctcgaagcgcgaaacgaggcccaggcccactatctcatctccctcgataccaaaacgctaacgttcgccacaggcgaagctggctgcggcaaaacgtacctggccgcggccgttgcagcgcagcgtctacttaataaggaagtagacaagatcatcgtgactcgtccggtattgcaagcagacgaagatctgggcttccttccgggcgacatgagcgagaagttcgctccgttcttccggccagtctatgacgtgctacagaagcgtctgggtggctcgtttctcgaatactgcttaaagccagaggtggccaaagtagagattgccccattcgcttacatgcgtgggcgcacgttcgagaacgctgtagtcattctcgatgaggcgcaaaacgttacagcgtcacaaatgaaaatgttcctgacccgtatgggcgagaacgtaaccgtcattgtgaacggagatgtgacgcaatgcgacctgccaagcaatgttaagtctggtctggaagatgcactggagcgatttaaaccttcctcccatgttggccttattgagtttgcgaccgaagattgcgtgcgttctgagctatgcaaagtcgcactggaagcctatcagtaagggaaagccaatgaccaaagagtacctgccacaccagaaacgtgtcatggatgaacacgaagaactgtgtggccgcatcaaagaactggaggcgtacattgcaggcgacgagtttgctcgcctgctgtatgtcgaccgcatcatcctcatttagcagctggacacgatgaaggcgtatgacctgattcttcgtgcccggatcgctcgtttttaacgtaaggaaaccaaaatgaccgatatggatatcgaaaaagagattgtggccaaaggcaaaacggccgcgcgtgttaccccggaacgcattgaagctgttatctcaggcgagttttactttaccggcgcggacggatatcgcagctcaccgttgtggctgaagcaggaagagcctgaaccggccctgcaatcactcgaactgctgaccttctgcgttcttgtgctggagaacggctacaccgtaaccggcgagtctgcgtgcgccagcccggagaactttgatccggagatcgggcgtaaaattgcacgccagaacgcgattgccaaaatctggccactggaaggctatcttctcaagcagcagctgcacgaggtgaaatgatgaaggtcgttatctacggacgtgataattgctcatactgcaaacgtgcggtcgagctggcgaagcagctgaacggccacggctttggtgattacgaatacatcgatattgtgtctgctgggatcgacaaagagaagttaagcgacctggtgggcaagccggtggaaaccataccgcaggtgttcgtaaatggtgaacctatcggcggctatacagaatttgctgcttttgcgagcgctctgtaatacaatacggctccttttggggccgtttattatttgtcgctttcatcaacacagcgtacacttaggtacgagccatttagctgtaaagaggttttatgcatttagaaaattgcctggaagatatgaatgtcattagcaatgctcttgctaccgtgacttctaacgcttcacgcttttcgaatgcaaatagcactccgaaagcattcccgaagcgtgtacacacaaaatttaagatgcgtccccgtttcggcggcatcacaaggtcgacgaggcccggttttgcagattcccatgagttcagactgccgcaaacggaaggcattccggttgctgagagtgacaccgcagctcaacttgcggatattgaacaaaggctcgcagagctgacggcgaaacacgttaagttgacccatagcatttcaggttacagtgcggaacaaatccgcgaatctttcggtgaaggccgttacgaggacttgaagaacgttgacctgtccatacgtggtttagagggctttgttaacaagttcgtccgtgatgcagaacagccgcatccgtacctgaaacgcttgagtgatgctatcactgagtaccgtctggcagtttctgacctcctgatgattttaaatcagtgctttaacgaggtagaggttatcgaatcgcagacaggcctcattgatgaggacgtcttcgcaaacttctccttacattaaggctgaacgatgaaagtcacatggaacagtgatagttacgcccaatttttggagccggtcttcagagtaatgccagatctgaagacctccttacttgctgactttgtgagttttaagaacggcttttatccggccgtttttggcaaagatggcccctataccgaacctggttctgtagtttcctctcgtgtttaccacgttcatctcttattcaccaagcaagaacgaaatagtcaccgaaacaggttcaactgcacaagcgaccgcgccctcgtttatacccagcacgccaagtttcaggacgtgtatagtctgctggccatcttcccgaaagaggcgcacaaaacagccagtgatccagtcaaaatgagcgacatcgccaaatacgcggcagccttccagaaattaacaaacccgtagttacctgcagctccatgcctttctcattcgtagcgtggttctattgcgataattttcatattttttaggcaattaatctagtctttgcgcgtatgcataaatatacgagaaataacggtacagaaagcggcaggcaaaataaccacaaaataatgaacatgccatacacaccgctattcacgccaatgtgacgatcccaaaagggtttggtcattatcttaagggctagtttctccgaagtataatatgagaatgggtacaggacggcgcttaaaacaagatatgtaaccacaaatggcatataaggaacataggcaggaaaaatgagtccgtcattcatatcgcgcactataaaatagatcagatagccataaccacaccatccccataagcagtgccgtaaataatattttaaggtcatcatctatgattccttcatagctataccattaaagctatcataacatgaattgacgaagtcccccttcgagaccaagcggcatcgagacagccatagacgcaaacatgactaaactggcaccggacaacgatgggacataacgcaaagactagggtgatgtcgcaaacaaacaggcgggaaatggcacggccctgatgactaattttcaaaaaaaggcctttctatgattccatactttgtaggtatggaatcattagacaaaagagggtattttaggttgatctcaataaaaacaatgcctaatatactgtatataaaaacagtataaaaagcgtcatacagtggccagattatgaaaaacacgtttgacagagcacgcgcagcggaaaacacgtcacaggaagcgatcacctatctggatcgggcaacgcagatggatgccaggtcggtctcgatgcagggtgccgatctgactttcgccgacgcattcatgttattcactcgcttatcattattgataactcgccgccggccagagatagctgtccattgtgttttgatacatgttctcccgcatatcgctcaggaaaaagtaagtaacctgaatagaataatggtgaatcagctggtcaacccgctgatccttgaagggaagatcgtgatgggtcgccgtgttttttccatcatgaagcagttcctgggatggtgtgccttccaggggattatcgaaacatcgcccctgaatgatatgtcactgaacaaagttgccggcggcgcgaagacggccccgcgggaacgatgcctgacggacgcagaggtttgggtattctggaatgtctgggactatttcgacgtatgtccgggcacgaaatgggcggcaaggctttgcctcgtagctgccagacgtccagatgaagtgctgcgggccagagtaagcgagttcgaccttaagctaaatgtatggaatcaaggatctcgcaacaaatcggcccggtcgcacacccttccgatgagctcactgatgcggaagtgcgtagaagaattgattgattatggcgccggcagccagtggctcgtcccgtcgaacaaaaaaaaagctgatacgccaatgtcgaaggtggcaatagcccaagcgttgaggcggattctggagcggccggagctgggggaagtggagtcgtttaccccacgcgatctgcgtagaacggcacgcagctactttcctgcccttaatatttcacaggaagtatcacgtaagatcatgaatcatagtctggaaggtatcgaccgtgtatacgaccgatatgactacatggatcagatgcgagaagcccttgagagcttctcatcgtacatttcgtcgattgttgagcaaccagatttagaagaaattgaccacaaaatgaagggagatcgcctatccaccgagctgatcagagtaaacttctcatagctttttaattgcttcgacaacctgctcaacaccatcagtttgagccggaaagcggttgcggaaagctgcgagaacctcacgttcttccggagtcagcggcgctatgccctggtctcgtaaaaaatctgccagctcaggctgacggtcttcaagaaccatcatcatgagacgtactgggtccgcattcagtgcttctgccagtggtagcactttctctaccggcagcggaattcttcccttttttatcagggacaaaatgttgggattcttgtaaccaatctcacgggagatcgccgactgacttttcggcgaaacagtgattaaagaatcgatgtaggcgacgtaacgagcggtcttctcatcggccattgtcattgtagttactatcctcgcgtgatctttttgtatggtaagtacttaccgatattacagcaacggttattattgtaaagtcttacatccggctatttgtaggcaattatcgcacataaatcacgcgaaataagggataaatcagcaaaatccggtacttctgttgatttttttgattatttttgtttaagaaattacgatacatttttattaacttttatattaataggtagtaccatcacctccaaatgaaacctgttgattaggatgctattaatggaaaaattgtcatctaatttacttgctctgaatgtaggcaatgttttcgtgctgacacacctggaggctgcagaagtactatctgagttaccaaatcaccaggtaaacgttagagcgcgcgacgctactgttttccggttctccctggaaaatggctctttcacgctgatcaatactggcgacctctctttcgcggttcgaatcaactaaaatttataacccgcctataactcattgatcccctgcgcgaattgcttcctcccctgttcgcgcagtgttattttcttatatctgaaaacaatttgtttactcgataaggaaagcacatggcaaccaaacccagcaaaactgtactcaaagaggtacaggacttccgcgattccgtaaaacgcgtcgttggtcttctttcgggcaagaacattcctgtagctgaatgcggagatacagcatacgttcgctacaataaaaagggggagccagtcatggttaacatcccatccataccagatgacgcaagccctgcgcttatgaatgccatacgtggattccttgatcacgaggttggccatctccttttcacagacgaaaaagtcgtcaagaaaatgcgcaacacaaaggcattcggactctggaatgccctggaagacgtctacatcgaacgtcgcatgagtgaagtgttcaccggcagccggcgcaacctattgtccacacgtaacctcatgattgataaatattttaatccccacattaaaaaggcggtagcgatgtgccgcggggatcaacgcgagttgtttctaaagttcttcctctgtccggttctacgggcgtgggatggccaaccaacttttgctgatttcatggaggagcactggcgcctcatcgataaacctattgccgttctgaaagagtttggcgtcgatgaagctgtccgtcgtatggatagcactgaggattgcgtcaaggttgcagcagcaatggctaagatccttcgtgaaatgactgagatgccagaaggcccgttacctgaacgtgaatcctctttaaccaaaaagaccgaaccagaagaagacagttcagatgagccggctgctggagacgatactgaggtttgtgacgaagaggggctcgatagcactcctgatgagtttagctctgacgatgaagatgttgaaaaatcagacaaaacgataagtaagtacatacctagcagggatgaagtgataaatgatacagaaagtaaacctgaagatggcgatttaggccatgaaaatattgacgacttgcctgacagcgaagaaacgacagctgatgatcctgttacatctctgggctcggatgtaggggaagaagtagatgatgaaggagattacagtccctccacggatgatggctcagaggacaggcatggcagctcctctgatgacagtgaagctgtcgaagacggtgaaggtaaggcagataaagacggtggcaaggagaaggatgaaggggatcgggacacctcggatgaaagcgatgccgggtttgccccacacgctgacgatatgtctcttgatgatgctctcaaggcattagaaaacgtcgatgaagagataggttcttccaccgaagatgcgctggcgtcggcgatcaagtcggagctggccagcgcatcattatctgattaccggccatacaatcgctcctacgacttcctcgggccaattgacgaggcagaagagcatattaagcgcgccagaaaagcttttggcgcaatccctatgtattcgcccgtagatcgctaccgcattgttccagagggcagaaaactgtttgagatgaaggtggagagacatctgtcttcctcggtgtcatctaccttggccaaagacctggagcgcgcgatcgccagtcgcaaccgtgttcagttcatccctggccagcgtcgtggacgcgtacatggggcgagtctttaccgactgtcgatgaatgacgatcgggtattccggagaaaagaagaccacaaggccgtgaacgcgtgcgttcaacaggtcatcgatttgtcaggttcaatgggcggccgaaaaatcgagctcgcgctggcatccgcatacacactggctgacgccctagatcgtatccacgttccgaacgtcattaccggcttcactacgtatggcaatccggatgtagcaactatgtcgaaacgtgggtttagccgctttgaagcgcttatgctgccgattattaaaaactggcatgagaaagcgaactccccagagatacgtgctcgtatgggctgtgtggcggagactttccccctgctaaacaacgtggatggcgagagcatcgcacagctggcttctctgtttgcagggcgtatggaagacaagaagatcatgattgtgcagagcgacggcgccccatgcgctgcgggggatggctttagtaaccatctgcgctctgtaacgaatgacatcgaaaacacaagtgacatcaacctgttggccattggcattcttacggacgcgccgcgccggtattacaaaaactatgcgctagtgaataaggtcgaagagttgggtacgtcagttgtcagcgagttatctcgtatcattttagggtaaatcttgcgccctataaaataagtaactagttactataaagcctgatacattcgtatagaatagagcccagaaacgacaacaagtaaggaaaaacacatgaccgcgactgcgctaccacaagacgcccactctgatgccgtcacctgcaaatggtgcggaaaatccttccatcacctcaaatcccacatttcgatgggacgttgtgaaggcattccggaagaagccaaagggcttggtgtggatgacgtagtgaaaatgtacaccacagcattccctggggaaccaacgctgtctccaaaggccattgaagcgttaaagacgaaacgctctgagaaggctggcgcagacggcaaaatcgcggatatcagttcccaccctggctatgcagggacagtcgaatacaaaacagagcttgtcgccgcgcacgagctgcttggcctgactatcaaggaacttggcacgccccgaggcaaaccccttcaggtaacggtcaacatcaacacgccatatccggagttcgtgccagaagtgaaagccggctatatatacggcgacttcgatctgattaaagacatcttcatgatgctggagatcggcattcctggttatctgtggggtcatgctggtacggggaaaacctccctgccaacccagctttgcgcgctcctgaatcgcccggtgatccgctcacagcatacggcatcaactgaggaagcccatattacgggccagattctggcacgagaaggcacaacctactttgaaccagggcttctgtcgctggcgatgaagaacggttgggtctatctggcagacgaatacgattttgcattcccgcagattctggggatctaccagccagttctggaaggcgaaccactcgtaatcaaagaagcgacaccagactggcgtcgcgtggctccgcataagcgcttcgccttcatcggtacaggcaacactaatggttcaggggatgaaacggggctttatcaaggaacgaacatccagaacgcggctaacttctctcgctttggcatcgtatctcacgtcaagtacatgaagcctggtgctgaggtaaacatgctggtcgaagcgggaatcatccgtgaatacgccgaaaaaatggttaagttcgccaatctggtacgagacgggtatgagcaacacctgatcagccaaccaatcggcccgcgtgagctgcttctgtccgcaaaaatcggaatgatgcgaggtgatttcgcagccggcatcgagaagtcattcatcaataaactcccctccacctctgcgcaagcggcgcgtgaagtggttcagaaaatcttcggttaatcgtgcgtaaaggttgttttggatctcttatcgcagcttctgaaactggcgcggcctgtttgtcatgtgctcacaggccagactgccaccaggcagccaaaggagttgcgatttcgatatacgggaagttcgtcggcttccccaacgacaaaattaagaaaaaacagaaggtaaaaacacatgaaagcactgatggtcaggactgatttttccctgggagaatcagcactgaaagcagagcacgcagtaaaggtagcaaaggaggctggctataccgcggttatctctgctgacacgatgaatatcgccagcgttatccccctgcaacgagcagctggcgatgagatggcggtgatctgtggtgttaagctgaatgttgtcgacgatccaacatacgagtaccgggctaaactggccaaagagtctaatggatgtatggaatcattggagcgtggacgtaactactgcttcaccgcactgattaaaaacgagcaaggttatcgcgacatttgcgaactaatgactttagccaatacccgcgagcagttttacttcgtaccacgtctggcgctcgaacagctggcggctacttacgctaaaggcaatatactgttgctgacttcggatatcggcagcgtattccagcgcccggacttcgctaaaattattagcgcgctgattgctgccggcggacgcgagaatttctacagcgtagtttatccgcaccctacgccattctatgaccagatcaacgtgcgagccatgaaagtggcaagcgcactgaaaatcgagcccgttgcgttttacccagcttattacgaaggggttgatgacgctgacatcaaagacatcgcccacatggtgatgaacaatatcaaagtcgatcagccacaccggctgcgtatcccccaccagcgcgacaatgcaataaatggtcgccgtcatctgctgcaggctctgaaagagttttctgtccggatgggcgtatctgtatctgccgccatggcttctacaacgcaggacgccatcgttaaggcgtgcgaatggcgctggcacgagatggcgccgacactgccaaaaatggcagacgatgagcctgcaacgttgatgaagctggctgtcgcagggcttcgaaaacgtctcagcaacaaagaatttggctacacgccaccagcttccgagcaccgcgtttacgtcgatcgcctcaagtatgaaattgagacgctcactcgcctgggattctgcggttatttcctgatggttcgcgatctgatgaatcatagtcgcgagactggtattcctgtcgggccaggtcgtggttcatccgccggctctctggtggcatggtgcatcggcattactaacgttgacccaatccgtcatggtcttctgttcgaacgtttcattaaccctgaacgtctcgacttgccggatgctgatctggactttagccaggcgcggcgccatgaggtgatcgagtatctgaatgcccgatatggcgaagagtatgttgcaggcattccgaacttcacttatctgggcgccgcttccgcactgcgcgacacagcgcgtatttatggagttgatgcggcggatatggctgtttccaaggagctaaagaccctggaggatgacagtttatctctgtcggagctgcgcgagcagctggccagcctggacaagtacgccaccaaacatccggacgcatttaaggcggcgagcaagttgcaaaacctgatgcgtggcttcggccggcatgctgcagggatgattgtcgctggcgtacctctgacggaacgtacccctgtagagcgacgtggagacgcgcgttgcatcgcattcgataaacgatactgcgaggccatggggctgatcaaactggacgttctgggcctggccactctcgatctgctggatagcgcaaaacgttacatcaaagagagcaccggcaaggacatcaacctcgatgccatcccactggatgatcgcaaagtacttgatggattcgccgcggggtatacgcaaggtgtgttccagcttgagtccggccccatgaggaagctactcaaagatctgggtggtggtatcgagccaatgagcttcaaaaccattgtggccacaactgcgcttttcagaccaggtccaattcagtcaggcatgttggacgactatgtctccgtggcaaaaggttttatggctccacattcaattcatccgcgtcttgaggaagctactaaagaaaccaacggcgttttactctatcaagagcagatcatgaaaagctctcgcgtactcgctggattctctatggctgaggctgacgctctgcgttccgctatcggtaaaaagaacatggataagatgaaagcgatcggcagcgattttgtagaacgagcgcaagcaggttgggtgacactgtcacttgaaaacggaagcacagtagaagtccacaaaaaggccaagctgatgtgctctgacggcaaacgcagaacctatgacgaagcgattggtgataacgctgatattgttgattttggagtttgacggtggaagaaatttggaaatccattcctgagtttgaaggttattacgaagcatccagtttaggtcgcattcgctctttagatgttatacgaacagcccccaatgggggcgaatgggtgaagaaggggcaaatcctcaaacctcgcgtaatcaatgattttggacatctgggcgtgaaactaagcgtcaacggcgtcaaatgcgaccgcacagttcattatctggtagcaactgcattccacggagaacgaccagaaggcttacttattcgtcatcttgacggaagaccatcaaacaatgcgccctccaatctcgcgtatggcactcaagtcgacaacatggctgacgccattgcacacgataccgttgagtttggtgagaggcgctacaacgccaagctaaccaacgaagtcgtcattgctattcgcattaaaaagtcagaaggcgctctgaacaaagacctcgcggccgaatatggtttaactgagctttacattcaccatatcgtcaccgggaagaaatgggcacgagctggtgggccgatcgttgtctcaagagcatccaaaaaactggatgctgaagcaagagctgaggtggtcgccttgcgcaaggctggcgcaacctatgaaaagttgcgagaaaaattcggcatctctaacactcaaatcgcaaatatctttaaaaaagctagcgtttgaagctaatgacgggaaaaacacatgaaaattgccaaagttatttccgagcaggaaggtcttagccctgagaaagcccaagaagtatgggacgcctttgagaagttcggtggatatgccttcaacaaatcacactccgttgcctactcgctgatcagctatcagtctatgtggttaaagacacattaccctgctgagttcttcgctgctgctctcaccattctgggcgaggataagcaccaggggctggttaaggatgcgctgacctatggcattcgcgtattgccaccagacgttaacgtgtcatctaaccgaattgagatccgcacgctggaagacggcagccaggttctgtatgcgccattctctgctgtgaaaggctgctctgagaatggttgccaggccatcatgagagcgcgtgagaaagttggcggcaaattcgagtcacttgagcaatttgaggaagcggtcgagaagcgagcctgtaacagccgagtacgtgagtctctacaaaaggttggtgcattcgcctctattgaacctggcagtatgccggcgaccgatccggaacgtctgcgcgatcaggcagagctgatgggcaatctggtgatcgatgcggtgaaagcttcacgcccatttgaaatgaacccaaaacgctctgcagaggtcaatgtgctgatgactcgcatggccgcagaaatgggtctgggcgatgagttgatacgaccaagcatcggcattaagccaaaaattatggtcatactcgacaacgccaatggcaatgatgcacgtaccggctacttcatggagaacggctacgatgacttcaaagccaagttgctggtttctggtgacctgcgtatgggtgatttgtatgtcacaggcgtgtgtaaaaaggtaaaggataaggaaaaagactacaccaaagatgagatcggccagtttatcgactttatgcgggaagagataaatctggttcgtccaacttacgtgctgacgtgcggcagccgggcgacatcgctgtttaataacaagagcaagccatccgatcttgttgggcgcaaagaatatctgccagacctggacgtgaccgtgttctatggatttaacccgaatattttgtacttccgtccagaggaaggagaaaagctggaagccattctggcagaggttgcggagactattaacaaatgagtaaaggaaaacacatgagcgcagcggataaaattgcacaagagctcacagcaataccacaggagtttcaggataaggcgattgaagccactctgcgatcccagttctgggaaattattgactgccctgtcacgctcgatctggcattggcgtttgcaaagcaggatggcgccgaccctatttgtcgattacggaaatgcgcgcgtgcgctggcattaaaaacgcaagatccaaaggcgtgccaatatctgctggagatttatgaatctgacaaaccagaagaagagctggcttcatttaaagcgttccgtgcccgtcttgtcctgaaggtggccaaggagttcatggaggtgagtaagataggcgacgtcagaagataccggcttaagaggcagaccagagtcactctatcaaacattttcggtagaaaagtagcataaagaaacccgccatatggcgggttttctcatggagttagtagagaagccgtccagatctaacgacctttaactccttccaataatccttccaaactgactactcaggctcaggccgtcatcgttatcgcagcggatagattaccgaaatgaaattagctcaacgtaactacgtttgaagcagcagggcctttagccccgttctcaatagagaactcaactttttggccttcttccagggtacggaagttgttgctctggatggcagagaaatgtacgaacacgtctttgctgccgtctgctggggtaataaaaccgaagcctttatcagcgttaaaccattttactaaaccagtcattttgttagacatagagattaccttcattatttgagagccacacaacgcggcgaaattggtctgagagattggtacttacttgggcacttaggaggagactcacggagaagggtaatctttggataacacctgaacttcggactgctttactaaaactgctttcataaggtctgtcttgcaaaccgacgcaatcattaacgcatggcctttctgtttgtgcaacatttattttccttttcacagcgtcgccacataaacgtctctacccaacctaccccctctcatcttcacgacacatgctccatcagctgatttcttcatggtactattgatataaattagtaagtggatacataacaaaatgagcaccgaaatttacgaaaaaatcatgaccgatctggagttcgatcgcgacaatcttgaagaggtctggcggcagcaaccgaggctgttgatggagtacggcgcaaaactagcgcgcgcagaacgagaggttgcagatgctaaactatccctcgatgccatagaggcaaaaatttacgacattgaacgtaagaatctgagtatgaacggaataaagttcaatgaatcggtactggaagctaaggttcgcacaagcccacaataccttgcgaagcgccaaaaactggatgacgcacgtctgatcgctgacatctataagcacgctgtcaccgccttctctcaccgtagagacatgatcgtgcaggcctcgaaaatggctatcgtagagattgaacgactgggcgccgaacgcttcaccgccacccgataatttttgatagatagtaagtaagtagtgatctattattatgtacgattttaagagccacgaacaagcgaatgccccaagcgcaaagcgcccatggccataatcacaacaaggagaaatacatgtctaagtcattacttgatctgcttaacaagacccgcggcgatattgcttccaaacgaggcaacaacgtcgacctaacccgcctgaaagacggtaataactatctgcgcatcttccccaacaaggacgatcagaacggtgtgttcttccagactttcggtatgcactacgttaagcatcagaatgaggagggcaaagaagttaccactgcctatatctgcgaacagcacacccacaatcgtgcgtgccagctgtgtgagatggtgatggaaggtcgcgctcgctacaaaggcaacaaggcaatggaagagcgtatcggtcaaatgcgcgctactccacgctacctggtcaatggcgtactttcagctcgtgaagactttggcgacgcagaaaaatgtcagctgattgagctcccgtccactgtgttcgacgatatctgcaaagtgatgtctgaggatatcgcagatgatatcggcaacccgttaagcaaagaagaaggctatgcgttcctgatcaaacgcaccggctccggtcgcgataccaagtacgacgtatccccaaaacgtaaagtctacaagggcgatatccctgaaaaactgtggtcgacccagcatgacctgatcgcttacgccaatcaggctgatgaaactcgtctgctgtctaccgttcgcaccatggggcgtctcattggtattgcagcacctgccgccgccaccgctgctatttccgcaccagctgctgcaagcgcagcaacgctgcctggttttggcaccatcactggccatacggaaggtgcagctgctgttgccacgacctctaccccggaaccagcaaaaacatctctggtagacgaagagatcttacgtgccgcagaagctgagttcgtaccagagccggaagaagttaaagcatcagctgctgccgccactaccactgcagccgcgaccagcacttctaatgacgatgagggtcttgacgatctgctggcggaattagaatcgctttaatcacaggccatgactgttaaggcgtctacggacgccttactttttggaaggagttttccggtgaattatctctttgtggacggtaacagcctgggctattaccaccagcaatctgacaaattacataacggcgaaatggaagttcaggcggtgtttggcttcgtcaaaaacgttcgtcgctatgcgtccattcttcacgcacgccccatgatcctgtgggacggctttagcgacaagcgtcgcgactattacccggattacaaagcaaatcgcgatgaagatccggaaatgaagaagatgaaagaaggctttgcagtccagaagccttacatcctgaaaatgatggcagcccttggcatcaaccagctgatcgccaaagacgccgaggccgatgacctggcggggatgctggttggtcgtcttgcgccacaaccaacggtcgatcatatctacctgctcaccggcgacggcgactggctgcagctggttcgagaaaaagtcagctgggtgagccttcgtgaagacgccaaacacaagcaggtgaactttgagcagttcccaaagctgatcggcctgcctactcctcgtgctttcctcgaagccaaagctctgcagggggatacctccgacaacatcaaaggtgtaggcggaattggtgacggtggcgccaaggagctgctgcacgaatggggaagcgtcgccgctatggtgcgcggcattaacgacggctcgatcgtcatcaataaaggccgatacaaaacggcattcaacaaactggccaaaaatgccttcaacgagaagaccggctgccggatgctggaagccttcaaacgcaacatgacgctgatgaacctcatcgataccaagttcccacccagcgaaatcgaaaagataaaaggcgcacgtgatttgaaagccttcgaactgctctgccatgagctgaacttccggtcattcctggaagatctggacgtgttcgttttgccttttgagaggtactgctgatgttgaaatcactcatcaacggcaatacgaccacgcctacgatgctggctaaggagattgtcttcttccatggagaacatgccgttgttgcgctaccgcgcattctaggcgcggccggcatgagcgtgacagagcgagagtacgggctgattagcgaacaggtcgtcaagatcctctcccgcatggccaaacacctcaaccacggcgcaataaagtttgatgaagccgccgcttccaaacgcatcaacgagacaaaaggagcctaagaatggcaaaaggaaaatcagcactggcaatggcgttaaaaaagaaaatcggcagcaatgatgagatccaaaaggtttcacactggattgattccggcttccctccgctgaataaagccatctccgggcgctatgacggcggtttcccaagcggacgtatcgttgagatctttgggccgccaagtgctggtaaaaccttcctggcgacggccgccatggtctccgctcagaaacaggagggtctggctgtattcctcgaccacgaaaacagctttgatgttggtctggcggtggcaaacggcctgaatgcggatgaggatgacggccagtgggtctataagcagccggacacgttcgaagaatcggttgagctgatcggcaccatcctgaaactggtgcgagacgaagagctgatccccgcagacgcccctatttgcatcgtagccgactctcttgcgtcaatggtgccaaactccaaagccgagaagttcgacaaaatggcggaaggtacagcgaaggataaagatcagctaaacatgaacgacaatacggccctggctcgtgctacgagcgccaactttccgacgctggcgctctgggcgcgcaagtacaatgcctgcattattttccttaaccaggttcgtacaaaaatcggcgtgatgtttggcgatccaaccacctcccctggtggtgattctccgaagttctacgcctcagtacgtattcgtcttggcgcttctgttatgaaggatggcaaagataagatcggtcaggacgttggcgccgagtgcatcaaaaacaaagtggcaccgccattcggcaaatgctcatggaaattctacttcgacccgacccgcggtctggacgttatcgagtcactggttgagcacatgctcgaagaaggatacctgccaaagaatgccagcggccgcgtagagattggcgacaagaagtacaccaaatcgcagatcgtcgatatgtatcgtgataagccccttccggagatcattgcggcgctacagaccatcgacgaacgtcgagctaaagagtctgcttcagccgaaacagaagaagcgtaatcacagggcgtccattggacgcctttatattttgtttattatcaccaataagaaaacaacttggttactaatatgaaattaatcccaattccaacgtcaaatgtgacagtgccacgcagttaccgggtagccatcctagacgcctggtggttggtgaaggaagaatcaaagtgaagagactctgggatgcggccaatgccgcgctcgatgttatcgacgcagaaatcgcacaaggcttacctgagcctgaatgggctgctcagctgcgcgaggtcattggtctaatagatgagccatcacctgaacaggacgattgctccccttctctcgaacagaataataagtaagtacatacaccacaaaggagaaacacatgagaatattagtttggatatcagccagtactgacagtgatgtttagccactgcttataatgtatggctctggactctccatccttagggatctctaggccttagcgctcttccgtagccatttacacctcaaaatatataagttagtatttacctattatgaagatatacatagatatcttgttactcatcttttcaatactgtttatgttggactgcctgatgatcgggacactcaagaaagctctgtctcctgtcaacggaaccactgtgaacatgctcgcactggtgctggtcatcacctctacagcacaggtctacacagggatagtggtatgagaaaaataacgctactgctggccgccctctccttctctctgctggcggataccagaatttaccaatgcgatatgaccgtatcgcaggtgaaaaatgatcaaatcagcagacctactaaagctgacttcggcgcgctagtcgttgatagcggagagcagttctatgtcgtccgcggcgatgaggttctctcatctccatatctggctaaacgcaacggtaaactggttggcgttggcgaggacaagcttatctacaacaaatcccacgacgtctacggcgttcatagcaaagaccaaagtttctttttcgacggatgtaaggaggttggttaatggctctcacaatgactggtctggagattgagaaaacaagcggctactggagagcgaaaggcttccgaaaaccggacatgttggagcgtctggaacgcgaagacggttacatcatccaccagcgtcgggaatggcgcatgtttgatcctgaaaccgggaaactcacatcgaaagcacaaacgctttggggtctgctcaagcagatccactaaccgaagtttctacagagcgttttaagtgtggtggaataacaattgttagtaaccaccaacctagcattcatgcgggttaacaggttagtgaccactggggaagccatattgttatctacacgggcctggcgcaaatcaacgactgcgtcgcccgttttcaggatatctaattcagtgctgtattaccgctcacggcatacgttgccagtgaattaccgctggcagcataccttgtaccgctcacagcatacgttttaccgctgacagcatacattcatagggcagcagttgctcttagacgttagccatgtcgatttataaagaccgcagatagtggaaatgtaccgctgacagcatacgttttaccgctgacagcatacattgagacaaaagaaccgctgacagcatatgttgaaccgctgacagcgtatcaaagcaacttgaggctattggtgagtatctcgatcagcttgatattctctggcgtcaggttctgcgacagctcagaaattttgtttttgaggttctgtttcgcatcaatttcacccttcgcttcttctgcctgcttaggcgcctctggcttctcgggtttgctcgatgtgactttcagttttgggttacgactgtggatctggatgtagacagaacggccacgcttaacctcgctatattcgagatagcccagctcttgcagtgacttcaatccgttcctgatagtctggttttgcgagctgacgttgcgcgtgctcagattgagcctggcgcgcagtcgggcaagagataccggtgccggcttaggaggaagactttcgatgaaagtatacagcgcctgggccgtctctttgcgcgggagcttgttgatgaccttcaactgcagcagaactttatggtcaaagcgatagagctcagacagcttaggttcagcataaaagacaatggagtctttcttctcgttgtaatcaacgctgtttatgaggtgaaccatcaacagggatatcttgttggtgtcgtcgacgttcttctcttcatgagtgcgctggaacgacaacgtcgtgcgcatgatcttgagcaggctgtttgtcaggcggtctcgcagggtcttgcggatctgcgaggacgggtagccgcagaacttggcgaacttcgtgatgctcagctctacgcgccctgttggctcgccgtattcagccagagagcgaacaacaccaacccaggttttgaagtcatgatccatatccagccgcggaccggtgattttaatgtttgaataaccctctgaccgcgcgacttcaagctggacaagctccctggatgcgtcgatcatgttggacttgttgcgagagctattcttcgttcccttgagcgttggaacaaagaggccaaggcgcattaaagcgattggctgcaccgtattgttgctgttaggaactaagtcacctgtgtacaaattgagagcatcttcctcaagaatttcgttatcttcaggtatttttttgatttcactatcttttttcttttttgtggacatgtggataccttttggttctaaccgctgacagcatacgtcaattaccgctgatagcatacacaaaaccgttggcagcatataccgtaccgctgacagcatatcgtttaccgctgacagcatacacggatcagtccttagcccaggcgtggcgcggcctgcggcgatcggggatctctttggatctatatggggatctgtatagggatcttattattgggatctaaccagtggataagtggataagtaaaacaggcttttgcgattacaggtgtgcctagtaagctatcgtggttccggtcaacaatcactaaaacgagaacatggacttaaaacgcacacgttgggtacgccgtctggaagacggaacctacaccatagaatcaaactccacactgagcaacgagaaggttctctgcagcctgtgtggcatagcctcgaagtgcaacatcaacgagacccgactcaagttgcgtgacgcaggcgttaacttccacctgaacagctgtgccagatacgtaccgctgctggcatttcgaaaaccgatcatcggtctggataccccctacttcaacactatgcgttcaggcgttacctggcgtgacagattgaccgaggggaagattatctgcctggttgaagctgatactgcaaagatccttcgattcggtgtcgtggataaggtttactctgggccagttgatgagatgctgagaaagcacagtcgattcaatcacctctgtatgggcggagagaagatcgaaaaagtgggtgaagtgatccgccgatcctatggccacttcctgaaagaagacagcctgctcacagcgatttacataagacacatcaaacgggactttgatatcgagtatcacagcgaagaagaactcgatttagtcgaccctcggccaaaagcagaagtgtttagcatcgcaaatgcgcgtcagaagctctctgacgaaccctaaacgaacaaaggggtctttacgcgaatacaaaattgcgtagcttagaatgcatctgagaagccaagggggtgatatatggacgatttttactcaagagagattactctggctgatatgccctttctgatgcatgaattcgaggaaggcgttcttcttgctcactttgcagtatgctccatgcaataagccagctaatgcattgaaaataaaatatagctctcattatgaagatttaaatccattactctgtacgttattttgaacgcaagttgtatactacttattgggttttgatgaagaccttgacta

SEQ ID NO: 69 - DNA, 109484 bp, Unknown
  source: /note="Description of Unknown: KP2-Mcoc1 Bacteria Sequence"
atatgccgcggtccggcgtaggcctcgagggtcgccagcgatccggcggccccgctggcgtcaatggcgatggggtctccctcaggcggcacgatcagccagaagccatcgccgccgaggccattcatatggggatagacgacggcgatggccgccgcggcagccaccatcgcttcaatggcgctgccgccctcgcgcaggatcgccagcgcgctctgactggcgaggtggtggggggccaccgccatgccgtgggtcgaaacgttgctactgtgcataaattatcctttctgaacgaatcacccgcagaacactgcaaaagctgttccatctctgaacgtttcgtttcattgataaaaacgatgaccagaattttcccactggcacgctatgtgtaaggcatagcagatacagtatgatgaggaatggatgatgaaacgaaagttacagggggcgctatgcaacaactcgatgaacgactgaaagggcaatacgcctcgctgtcgccgcaggagcagcgggtggcggatttcatctttgaccactttgacgacctgataagctacaacagcgccgagctggcgcagctgagcggcgtgtcgaaagccaccgtcagccggctgtttaagcgcctcggttacgacaaatataaggatatgcgcgatgaactgcgcactctgcgtcagagcgggatgccgctcaccgaccagcgcgacgcggtgcagggtaacacgctgctggcgcgccattataagcaggagatggcaaacctcacccagtgggtcaacgccctcgacgcccgccagttcgctgaggcgctgacggcgatggtggccgcccgccgcattgtggtgattggcatgcgcaacgcctatccggcggcgctgcatctgcgccagcagctgctgcaggcccgcggccaggtgctggtgctgccccagccgggtcagagtctcagcgaagagctggtcgatctgaccgccgatgatctggtggtaatgatggcgtttcgccgccggccgcgaatagtacgcccgctgctgcagcagctgcagcgcgacggggtgccggtcctgttaatgtgcgagccgcaggcccacagcctgtttccgctctcccgctggcagctctgcgcgccgctggacagcgtctccgcctacgatagctatgcctcggtcaacagcctgattaatctgctggccaatgcctttctccatgaaacgctcgacagcggtcgtccgcgcatccacgatatcgcctcgctttaccagcagctggatgagctggaacaacgctgatggggcgccagcgtggtgctgtgcattattatggtgcaataaaaaccacgtgatggcgccgccgctctctgaacccttttccgttaacgcttgtcctttctcactttttgttttaattcctcgccaaccctcgcctcgtctgtatctggcacattagttgcaaaaacagattcaaagaatcttttgtttcatgctaacgtaacgggtaaacatcatgaagaaactgttgatcgcgctggccggggccgcttgtctcctatcgtctgtttctgccgcgcaggctgaccagctccaggatattgaaaaacgcggagtcattcgtattgccgtgcctcaggattttccgccgttcggctcggtgggcaccgacctgcagccgcaggggtatgacatcgatatggcgcgctatctggcgaaatcgatgaagctcaagctgcagctggtcccggtgaccagcgccaaccgcgtgccgtatctgcagaccgataaggtggacctggtgatctccagcctcggcaagaacgccgagcgcgagaaggtgatcgacttcagccgcgcctacgccccgttcttcctcggcgtgtttggctcgaaaggggcggaactgaaggacgcggccgcgctgagcggcaaaagcatcggggtgacccgcggggcggtggaagatatggtactgaccagcgtggcgccgcaggcggcgcagattaagcgctacgaggataataacactacgctgtcggcttacctgtccggtcaggtgcagtatgtcgccaccggcaatctggtggtggcggccatctcccggcagaacgccgacaaagcgccggtgccgagctttatgctgaaggactcgccgtgctttatcggtctgaaaaagaacgaaccggcgctgaaggcgaaagtggataccctcattgagcagggcattaaggacggcaccctcaacggtctgtctgagaagtggctgaaagcgccactgcctgccagcctcggcgcgtaaggtctggggatgacggagcaacttcatttctctgagctctggccgcactggccggagctgctggccggcctgtgggtgacggtgcagttgacggtgctggcgacgatcggcggactggcgatcggcatcctcggggcggcgatccgcagcggtcgcccgggaatgctcagccgggtatggggcggatatgtggaaatcatccgtaatacgccgtttgtggtgcagctcttttttatcgtctttggtttaccgaacctcggactgaagatgaccgccggtgaagcggcgctgctggcgatggtggtcaacctcggcgcatatagcaccgagatcgtccgcgccggcatccaggtgacgccgaagggccagtgggaagccggtcgcgtgctcgggctcagccggacgcaaaccttcgttcgcgtcgtactgcccccggcgctgcagaggatttatccggcgctggtcagccagtgcatcattgtgatgctcggctcgtcagtggtgtcccaggtctcctatgaggagctgaccttcgccgccaacctgatccagtcgcggacatttttgagctttgaggtctatctggtaaccaccgggatctacttagcgttatcgatagcgatgcgccagctgctgatggcggcggggcgtaaatggctgggggtacaggcctgatgaccacttttaccgactgggacattatccgcaacctgctgctggccggtcgctggacggtgctgctgtcgctggtcgcgtttaccggcggggcgctggtgaccttaccgttactgctgctgcgcctcaccggcggacgccaggtgaaacggctgatccgcgggtatattgagctgttccagggcacgccgctgctgatgcagctgtttctggcattctttggcgtggcgctgttcggcgtcgacgtctcggcgtggaccgccgcctcggtcgccctgacgctctacaccagcgcctttctgctggatatctggttcggcagcattcgcgcgctgccgaaaggccagtgggaagcctcgcgctgtctcgggctgagcttcggccagaccctgtaccgggtggtggcgccgcaggcgctgcgcattgccatcgcgccgaccgtcgggttcgccgtacaggtgatcaaaggcacggcgctggcatcgattatcggctttgtggagctgaccaaggccgggacgatgctgaccaacgtcacttatcagccgtttaaagtgtttgcccttgtggcgctgggctatttcattctgtgctatccgctgtcccgctacagccgctatctggagaacaaattcaatgcctctcatcaccattaatcagatgcagaagtactacggcgacaaccatgtgttgaagggcgtcgatctggatatcgacatgggggaagtgatctcgatcatcggccgcagcggctcgggtaaaagcaccctgctgcgctgtatcaatggtctggagggctaccaggagggaagcatcaagctcgggggcatgaccatcaccaaccgcgattcacaggcccgggagatcagccgctccatcggcatggtgttccagaactttaacctgttcccgcacatgacggcgctggagaacgtcatgctggctccgcggcgggtactgaagaagtcccaggccgaatgccgggagctggcgcagcggatgctggagaaggtcgggctcggcgaccgtctggattactacccggccaacctctccggcggccaacagcagcgcgtggccattgcccgggcgctggccatgtcgccgaaagttttactctgtgacgaaatcacctcggcgctcgacccggaactggtgggtgaagtgctgaaggtgctggagcaactggcggcggaaggtatgacgctgatcctcgtcacccatgaaatgaattttgcccgcgaagtgggcgaccgcgtggtgtttatgcatcagggacgcgtctgggagcagggcgacagcaaaacgctgttcgccagcccgcagaccagcgaactgaaacagtttatctcctcggtgcgcggtcttaactaacgtaaggaatggcagatggatatcactcagttttcgcaaattaacccgccgcagcgcctgctgatggggccggggccgatcaatgccgacccgcgcgtgctgcgcgccatgtcgagccagctggttggccagtacgatccggcgatgacccactacatgaatgaagtcatggcgctgtaccgcggcgtgtttcgcaccgaaaatcgctggacgatgctggtcgacggcacctcgcgcgccgggatcgaagcgattctgctgtcggcgatccgtcccggtgacaaggtgctggtgccggtgttcggccggtttggtcatctgctgtgcgagatcgcgcgtcgctgccgggcagaagtgcacaccatcgaggtgccgtggggcgaggtctttaaaccggatcaggttgaggatgcgatcaagcgcgtgcggccgcgcctgctgctcaccgtgcagggcgatacctccaccaccatgctgcagccgctggcggagctgggagagatttgccgtcgtcacgatgtgctgttctataccgacgccaccgcgtcgctcggcggtaacccgctggaaaccgacgcctggcagctggacgccgtgtccgccgggatgcagaagtgtctgggcggtccttccggcacctcgcccatcaccctcagcccgcggatggaagaggtcatccgccgccgccgctgcattgagcaggggatccgcaccgatgcccatcacgatggcgtcgacgagatgatctactccaactatttcgatctcggcatggtgatggattactgggggccggagcgccttaaccaccataccgaagcgacctcggcgctgttcgccgcccgggagtgcgcgcgcctgatcctccaggagggactcgacaacggcatcgcccgccacaaactgcacggcgatgcgctgctgaagggcatccaggcgatggggctcgagacctttggcgatctgcggcacaaaatgaataacgtgctgggggtggtgatccccaacggggtcaacggcgatcaggtccgcaaactgatgctggaagatttcggcattgaaattggcacctcgtttggtccgctgcacggtaaagtctggcgcattggcaccatgggctataacgcgcgtaaagactgcgtgatgcagacgctcagcgcgctggaagcggtcctgaactacctcaggttcaccaccactcagggcgcggcgatgcaggcggcctgggatcactaccgcaccgaggccaccctatgagtgacaccgtccgccagcaggcggagagagaggcggccgccagccgggtgatggcgcgcgccgaccagctggccgccctcagcgaaaccgccgacgccctgacccgggtctatctgtcgccggaacatctgcaggccaaccagctggtgggccagtggatgcaggccgccggcatgatggtatggcaggacagcgtcggcaacatctgcggtcgctatgaaggcgtgcaggagggcgcgccggcggtgctgctgggctctcatctcgacaccgtgcgcaacgccgggcgctacgacggcatgctcggcgtactggcggcgattgaggtggtccagcgtctgcaccagcaggggcgacggctggcgaaggcaatcgagatcgtcggctttggcgatgaagagggcacccgctttggcatcaccctgctcggcagtcgcggcgtcaccggcacctggcctgaaagctggctgtcacagtgcgataccgacggggtgagcgtcgcccaggcgctggtgaatgccggactcgatccggcgcggatcgcccacgcggcccgtcacccgcgggatatcgccgcctatctggaactgcatatcgagcaggggccgtgcctggagcaggcggggctggcgctcggcgtggtggaggcgattaacggcgccagacggctgaactgccgttttaccggcgaagctggccatgccggcacggtgccgatgcttcatcgcaaggacgctctcgccgcggcggcggaatggatggggcaggtggaaaacctgacccgccagcgcggcggtaacctggtggcgacggtcggcaccctgcgctgtgcgccgggcgcggtaaacgtgataccgggcgaggtgcagttgacgctggatattcgcggcccgcaggatgcgccgctgacggcgctgctggaggaactgctggggcaggcgcaggcgattgccgggcgccgccagctgagtttcgccgccgaggagtattatcgcatcgccgccaccgcctgcgacagtcacctgcaggcggtgctgagcgaggcggtggcggcggtgcaggggcgttccctgacgctgccgagcggcgcagggcatgacgccatcgccatcgccgagcgctggccatcggccatgctgtttgtgcgttgcctggggggcgtcagccatcacccggcggagtcggtcaccgccgccgacgtcgggctggctatcgacgcgttctcccgggcggtagagaaggtggctgacgcctgatcgcgccggtcaccgtgccccggctggcggctttacaccgccagctggttgaccacctcggcgacggaggtgatggcatggatgttgccgatccccgcgcccaccgagatatatccctcatcggtattcccctccagcatgcccagccgcatcccgcgcagcccgcccatcgcctgggccagctcggcttttgaggcgccggcacgatccatggccaccagtgtgtcgctcagtttgccgggcagcgcgcggtagtagtccggcagagtacggaacaggcgcagatccagaccgttggcggccacaattttcgctttcaccgagtcgggaacccggctttcgatggtgctgataaataccgaaccggcgaagacgccctccgcccccagggcatgaacggcgcgcgcgccccgggcgtcggtgatccctccggcggccatcaccggaacccgctgtaccgcgtcaacgatcagcgggacgatggtgaaggtcccgagggcggtacccggcagcgtgccgccttcgtcaaagccggtggcgacaataatatccgctccggcctgctccgcgcggcggctgttctccggcgtcgggttgatgtcacgatagataatggtgatcccggcggctttcagttcgtcgaacagcgccggttttaacgaaccgtcgccgtagccggtgtagaccaccaccttaaccccttcctctttgatcaccgggaggatcgccggcgtccagatgtcattttccgccgtcgggatcaggttgacgccaaagggtttctccgtcagctgtttggttttgcggatctcttcgcgcattttctcggcggtggcctccggggtggagacggcggttgccgccgtcagtccggcgttcgggcccagcacgccaagcccaccggcgttgccgacggccgccaccagacgagcatcggttagccaggagaggggcccctggaccaccggtttttcaatacccagaatgcgggcgacgcggttaggttgcatgctatttttccttgtatgttaataagttataaatttgttcgccccagcgatgcggcaatgagggcagtgtaggcgtctttattgttttaaaaaatgagcaaaaactttcatcactattattaaattagtaataatgtgaactgatgaagaagtgggaggcgggccatcatgcaaatgaatctgtttgaaaatattaaaatttttattgaaatcgtcgatgccggcagctttgcccaggcggcggaaaatttgcagatccaccgaccggcggtgaccaaagcactgcagcagctggagcaggagagcggggtccggctgctgcagcgcaccacccggcgtctgtatcttacgccggagggggaagagttttatcgtcgcagcaaaccgttgctctcccaggccgacgatctgctggagtcgttcgcgccggaccggccgatccgcggtcagctgcgcgttgatatgccgatcgcctttgcccggctgctggtgatcccgcatctgccggatttttatcaggcccatccggaggtggagattgtcctcagcagctccgacgtacgccgggatatgctgcgcgatggtctggattgcctgctgcgggtgggggatcttgaggatggcgactatgtggcgcgttcgctgggggaggtggcgttaaccacctgcgccagtccgggctatctggcgcgctatggggcgcccgcgacgctggaggacctgcagtcgcatctggcggtgaactgggtgaacagcagcagccgacagattatgccctggcgattccagaccccggagggcatcaggcagatcgccattcccggtaaactggtgctggacaactctgaagtctttactgctgccgggctggcggggctggggatgctgcaggggatgcgtttctttttgcaaccttatatcgacagcgggcaactggtggaagttttgccggactttccggcgccgcgtcgaccgttgtcgctgctctatccgcaccggcatctctcgcataaggttcgggtctttgccgactggctgcaggggctggtggcgaccctggactgacaatcggcgctgtcgccttgactctatcggctgagcgtttatatataaaatgtgaatgctattaatgcaacgaatcacaaagctggataacgacttaacctgtaagggaatgctgatgaaactctggaataaaacactactcgcttccgccctgtgcctgaccctgtttggctgcgacgatgcgtcgaaagttgataacaaactggataaggctaaagataatgcggagcagatgaaagatgccgcggcggataaagcgcaggcaattaaacaggatgcggataagcaaatcgatacgctgaaaagccaggctgacgccgaggccgatcgcctgaaggatcaggccagcgccatcaaggccgaggcggacaagaaggcggacgccatcgcccagcaggcgaaagcccaggccgatgcggtgaagcagaacgcaaagcaggaaagtgaccgcatagtcaaagaggcgggtcagattaaagacaacgccatcggtgacgccaatcagctctcggctgaagcggcgagcaaaaccaaagccatccaggacagtatcgcgaaggataaacagaacgccgcgccgcctgccgcacagcagtaactcgcggtgtttgtctgacccgccgcccggaaatatagggagcggagcctgatagattacccggcggcgctgcgcttgcgcgggcctacgcagggagcgggttggctgcgcaatgaccgggtatcacccttttgtaggccgggcaaggcgtcgtcgccgcccggcacatggaccgcaataacatcctgctcaggggtatcttacgataccccttttttatgcccgccgtgggttcaacggtttggcagcagggtgcctttcaggccgtgcggctccgagcgcaaatactgcgacggcacacggacctgggcgccaaggctggccgctgcgtgccacggccagtgcggatcgtagagtaccgcgcgggcgagggcgatcaggtcggcatcgccattctccagcgccgcttccgcctgctgcgggtcggtgatcagccccacgccaatcaccgggatggctacctgctggcgaatgtcgcgggcgaaaggcaactggtatcccggcccaacggtgatcgcctgctgcggcgacaaaccgccgctggagacgtgaatatagtcactgcccagcgtttccagctgctggctaaacttaatggactgctcgcagtcccagccgccttcgacccagtcggtagccgacagcctgacgcccaccgccatggtgttgcccactgcctcgcggatcgccttaaagacttccagcggatagcgcattcggttctccagcgaaccgccgtactcgtcgcggcgctggttgctgagcggcgagagaaactggtgcagcagatagccgtgggcggcgtgcagttcaatcagctcaaagcccagccgctgggcgcgcagcgcgctggcgacgaaggccgctttgatgcgcgccatatcggcatggctcagttcagcgggggcgcgatcgccatcgtgaaacgccacggcggaaggggcgacggtctgccagccaccatcgttgagcgccagctgatggcctcccagccacggggcggcgcaggatgccttgcgtccggcatgacccagctggatccccagacggatcggcgaccaggcccgaatatcttcgactacgccgcgcagggcgttttcggtttcatcatcccacagccccagatcccccggggagatacgccccgcaggctctaccgccgtggcttccagaattaacaggccggcgccggagaaagccagttggccaagatggatccggtgccaggaggtcgccttaccctcgtcggcggagtactgacacatcggggcgataacgatacggttatcaagggtgagttgaccaattcgcgtcgcgctaaaaagatgactcatgaatacctcgtaaatgttaaacgtggtcgtgcaggggacggacagttgctgtttatagcacgcctgttcacccccccagtattcggatattgcgcttaagcgctccgctattcgatataccagagacggcgccgtcggccggcggcctgctgcgacacggcgcgggccattgcgctgccaatctcggcgctggccgtcagcccctgcacaaaggggcgatcgtgcatcagccagggaagggcgccgaaggcgacccgaccgcgcactgtctccggcgcctgcagcgtgtagtcatcaccgacgtccggaatgtcgtcgccgcaggccagcagctgctggcgcagtgaagggaagggcagatcccgagttttcagcgctttttgtccgcgggcatcgataaagacatcgaattcgcagcgctgacgatgatgaacaatcagcgtccggtcaggctcccgctgcagctcataatcttcgcccagcgtcaggatccgcagaatgccggcccggtgcagggccagcagccgacgtatggactccggcggaatggcggcgtagttatcgataaatacccgggcgaggccctggcggaagcgacggctgtccgcgtcgttgaactgcggcaccacggtttcaatcgcctcatgcaggcgcagaatggcatagcgccagggcaccgtgtggtgttcgcgcttattgcgctccacctcctgcagattgcgctgcgcccactgaaaggggtcgtgggtgaggcggtcggcaaaccaggcgtcggcgatacagtcaggcgtcagctgacgaagcccgatcgcctcgctccagtcgggggcggcatattccagctctttaacgatcagctcaaaaatccgatctaacagagcgtcgctaccctccgcaatggccgcttcgagggcggcgggagtggcaatctccagcggctcccacgggatcgggcagtaaaaatcggcctccggcagcacgccgtggcgtgacatcagggtgatctccagcgcttcgctgcctggatggagggaaaaatgggtcgttttgtcgtcctcggtatggaaaacgccgtggcgggccactaccgccacggcggcatcaatcgcgcttaatgaagtcccaaggatccccacccggcagggggcaatgcgggcctccatcaggccggtccacgggctggggaagtactgtcggctggcgcgctcttcttcaggccacagatggccggtggcaatcgccaccaggtcgacgattaccgggtctgctgcactatcggtgtggatggcgatcccggtggactgaaccgcaatatccgtgacttcacaggattcacaaacgctaatcacaaagccgacgtcccgggcccgctcaacgaggtaaagaaaacggtcgcgatagtattcgccgaggataacccgcggcagaaactggcgctcatgcagggcgtgccgttcaagcccgcgcgccgccagccagttctcgctttgctgctgcagccattgcaggtaggtcaggtcgatgggggggatctcaatgctggcaatattggccagcatttgcgccgcggtattatcgtcactgtagggcatacccaccccggcctgcgcctctttttcaaacaaggtgatggccagcggctcaccgcgcttcaccagttcataaaaggtgtaaatccccgtcggccccacgccgacgatggcaattctcttcatgattctctcccttcctgtgggcagatgcggcattgatgacgcttcgcttaagcgaacctggttttaattctggtcgaaaattaccgaaccggtgaggggaacacgcaatttgaaacaaattagcatgctaataaacttgccgattgtcgtaaaaggggtgtaattaacaaaagagcaactttctatacaaacaatttacacaagcggtaaccccagctcgccctgctggacgccgcgcacactcccggcaatgccgtcgggatagggatgacaagatgcacggctggacctcacgacagcgtaatgcggcgatagccagttttttaagctggacgctcgatgctttcgactttttcctgttagtttttttactgagcgatatcgcccactcgtttcatgtcgaccttgaggaggtcaccctggcgattctgctgactctggccgtgcggcccgtcggcgcgctaattttcggcagggcggcggagaagtttggtcgcaaaccaatcctgatgctcaatattgtgttcttctcggcttttgagctgctctccgccgccgcgccgtcgttgatgctgtttttcctgctgcgggtgctgtacggcgtggcgatgggcgggatctggggcgtggcctcttcgctggcgatggagacgatccccgaccgctcgcgcggcctgatgtccggcctgttccaggcgggataccccttcggctatttgctggcggccgtcgcctatgggctgctttttgaacaactcggctggcgcgggatgtttgtcattggcgccgcgccggtgctgctgctgccgtttatctatttctgcgtcgaggagtctccggtttggcaggcggccaggcagaataaagagagtacggccctgctgccggtactgcgtagccactggaagctgtgcctgtacctggtggtgctgatggcggctttcaacttcttctctcacgggacgcaggatctttacccggtctttttgaaagttcagcacggcttcgagcctaaaacggtcagcatcatcgcggtctgctataacatcgcctcgatcattggtggagtgttcttcggttcgctgtcggagaagattggccgacgcaaagcgattatgatcgccgccctgctggcgctgccggtcattccactgtgggctttcgccagcggctcgctggcgctgggggcgggggcgttcctgatgcagtttatggtccagggggcctggggggtgatccccacctggctcaatgaactggtcccggccaacacccgggcggtgcttcccggcttcgtctaccagctgggtaatttgctggcttcggtgaatgccactctccaggcatcaatcgcccagcatcatgggcataactacggcctggcaatggccctggtggccgggacggtggcgattgtcattaccgtcctgaccttttttggtcgcgaaggccgggtgatccaatccgcaggagcgggacatcaccagccgctctccaccagccgttaacatttgtgaccgggcgtggccaggcgcccggtcgcatacattagtcacgcagacgaatagacgccgcctggcgtttctccagcgagcagatcccaatccccaccatgatgaacagcgcgctaaacagatgccaggcctgcggttgagtatgcaggaacaggatgctcaacaccccgccggagagggggatgatgtgggtgtaaatttcgccccgcgtggcgccaatggtggcgatacctttgttccagaacaaataggccagccacgatgggaaaattaccagatacgccaggccgctgaggaaaaacggctcgcgccaggctgcccagtcctgcgccgggtggcgcatcagccagaagatgacgattggcaccaggatcagggcgccgagcagcgagctgacggcgacaaagccattcgccgggatacggcggtccttcagacgtaacagcgaacagtagagcgcccagctcagcgccgaccccatcgcccacaggtcgccgacggcaaaggtgtgcagagaggcggcgtgcagcggatttccctgaaataagaggatcatcacgccgagggtgctaaaagccactccaagccagttacgccctgataccggatcgcggaaaaacagtcggttaatcaacagtaccatgctcggcgtggcggacatatagatggcggcgttgagcgcggaggtggtttgcaggccaatatagagcgtaagcgggaagctgacctggccacagagggtgagcaccaccaccgccggggcgtttgcccgcagcaggtggcgactgccggcgatttgccgtcggtagagcaggcccagcagcagcgccgtcagcgcccagcgcgcttcggtcatcaggatcggatccacgccctgcaccagcacgtgcccgacaacataattcccgccccagaacagagccgccagcgtcagtaacagataaggcatgatgattccttgtgtcgtttgtcactgtactgaatggtaatgttattgcttttataatatcaataatattttagtggtttttgttgtactcatttaaactttttaataaacaataaattgaaaatgcgtgtgaaatatacgttgccgcattatggacggtactataccgtatagtagccatgtatttcacagggataaatcatgcgtaacacagataatggggtgattggaagcgaccagaccgcggtgatggccaggctggcgctggatgagttaattgaccagcttctgcacagcaacgcgctgtcgctgaagctgacggccaacccgctggtggccgacagagcctggcatctcactgagaatacctgcatccgcgccttctccgctgacgatccacaggccaaaaagcgtgcgcaccacgcgctgttcattctttatcagtcctggcttgccgacccgctctcgccagcggctgccaatcagtttcatccgctgctttccgggatcagaaattacatcgagtctgagtggctgcgggcggaaagcaaacgcttccaccaccagagaccaatgcttaacgccggcaatatcgtcgacgaactgcgctccttatgccagcagcacccggcgtctcatcatccgctgttctatttccttgccagcgaggcctctgcggcgcaaatcgactatttcttcaaaagcgacagcgccctcaatctgcttttcttcgatctggtggcgatggggctggtgggctcgctgccggaaacccgcgctgagatggcgcaaaatctgtgggatgagataggccagggcagcaccgagatcacccacgttaatctgtataaggatttactgaagcggcggaatatcgcgttgccggacaatcattttgcccatttgtacgagtggcaggggctggccgggtataacgcctttatgctgggcggcgtaaaccgtcagcattattacaaatcgctgggggtcatggcgatgaccgagctgctcgacccgccgcagtatgaaaaactggtggcgggctgtcggcggattgggctttccgagcgcgacgtgcattactatgccgaacatatcacggtcgatatcggccatgcggacggctggctgaacaatgtgattgtgccgattggcaaaaaacatccggcggcgatggaggaggtctactttggcgccgcgctgcgtctgcaaacctgcaacgattactatgatggtctgctggcggccctgcagtcgctgggcggcagcttatcatctcacagcgtaccgccttctgagtagataagcgctttggccgcgctccaggcggtcacccctggcgggatctcccggcattcggcggactcggcctgctgggcggcgatggcgccatcgatgagcatcaccatcatcatggccacccgctcggcaggttccggttttaacacctgcaggaggatatcgcggaagaactgccagaggagcgacttaaatcgggagcattgctcccggatcgccggcgatgacgcaccatattcaaacagcgcgcgagtaaacatgcagccgtggaacgtttcgcaggtaaaccagcgatggtagtagtcgaacacggcgaacagcttttcccgtgcgctggctttatccgcggtgatctgcgccaaatcctgcataaattcgctctctttctgcttgaggatagccagaatgagcgcctctttatcggcgtaatagcggtagaaggtcattttggagatgccagcatgttcagcaatccgctcgatgctgggcgactgatatccttcgcgattaaacagcgtgctggcgtggcggagaatgtccgcttgttttggcttcatgcgttttcctgtcgaatggttcgctgtcacgattgccggtgacacggccgtcctgcgacagcggtgcattatgccggatcttgccgccagacgggcaaaaagtaaatcagccgcggtttatgcggcgtcggttccctcaataaaaacaagattgcgtagacatacacaagtcatgtccttatgtttctgaaccgacgtattattcggacctttatacacataagctgtgaatgatgtactttctacaagaagagaagagatgatgttacccctgaccacgccccggttgctgctgcgccggttcagaacggaagatctgccgtctttcagccattatcgcaatctgccggaggtggctcgctttcagagctggacccactacggcatgacagaggcgacagccttctatgaacaacagcgttcgcaggcctttgctgaggatgagagctggttccagcttgccgtagagattcaggccaacggtgcgctggcgggagatgtggggatccacttcttagatcacggcagacaagccgagctggggatgaccttttcccctgcgtatcagcatcaggggtatgcccgggaagccatgcgggcggtgatggccttactctttgaacagttagcccaccaccggctgacagcggtggtagacacccgcaataccggcgcgatcaaactcctggaagggctgggctttcgtcgcgaggcgcattaccggcagaatatcttttttaaaggcgagtggggcgatgagtacctgtacgcgctgttgcgtagcgaatatcagtgaagtgacgggcgagccgtcacttctgcccggcggacgattagctatgctggcggataaagcgcgcgcgccacggttttagcacccacagcgcgagggcggcggtgacaaaatcaaggccaatcgcgcagctgaagaccacatgccagccgtgagtgtgctgatagagcagtgccgccagcggaccgccaaagattgacccgatgccctgcgaaatatacagccagccatagttgctggcggcatgctcgctgccgaacgtatcggtgagcgtcgacgggaagagcgagaagatctccccccagccaaagaacaccaccccggagagcaggacaaacagcagcggatcttcccggcacgccagccagagcatcatcgctaccccctccagcgcaaaggcgataaacatggtttgctcgcggccgaagcggtcggaaataaacccaaacagcggccgggttaagccgttggtaaagcggtctatcgttaacgccagcggcagcgccgccatgccaaacaccaccgcctggctaatgccgaaatcctcggcgaacaccgccatctgcgaagtgaccatcagcccggaagtcgacatcatcgccatcatggcgaacatcagccagaacagcggctggcgcagcatttcccgggaagtaaacgatctgctgctctgcgccaccgtttgactgacgggcagggagacagcagggggcggcagcttcagcccctgactggcgaggaagccgacgagggcgaaaaggatcccgaaagtcgtcatcgtatgttcaaggccgttagtggtcagcgacagggagatggggaaggtggttatgatggcccccatcccgtagcccgccgccaccgcgccggcggcaaatccccgctgctgtgggaaccatttgaccatcaggccgacaacgccgatgtagacgatcccggtcccgaggccgcccatgcagccataaaccagccagagcgttgccaggccattcacctgcgcggaaagcacccagctcattcccgccatcaccgtgccaatagcgatcagccgccgtgggccaaatttttccactaaccgcccctgaaaaggggaaaagaaggtctgcaggatgatcagcagcgagaaggtgacctgcaattctggcagaccgacgccaagtttggcggccaggggttttgtcaacagcgtccagacatattgcggactggagatggcggccatacagatcaggcccagcaccagctggcgccatttgccaaatttcggggtaaccaacggttcgctgagtgtcgtcatgttgttctccgttttcagtaagcaggcttccgtgaaacgcatccaccctggatgcctcacagaaaggggaaggttgcgaccgcagactggcgacctgttgtggccatatggcatacgttcttgtccacattgcggtatacaagcgaagagcattaaacgtgccatataaaataattttttatattcaagtagttaatgtaatgagggcatgtctgacggggggcggcatgatgaatgtgcggcaccagggcggtgcaaatgaattatcgcggtgcgctttgcctgctaactggcgtaggagacatcgtatatcctggactggcgctagacggacttcagtgcaaagccgcccaggcgggtcgaggctacgaaatcaccgcctggggcggctggcaagataaacgggaaatgaggctggcggtctacccgcttagtagcgaaaaaacgctactgtcccgactattttttgctttatgagctgggcatttattgtatggactctcgcagagagacattcttcctggtagaaagcctggctactacacacgggaagccttaccgccccatattaagctcatgccgcggtactggcccggactttgagcactgacggaatttcaatgaacttttcaccaggcttatcgttaagcagttcgagaagagctttaccggctttcaccccaatgtcatgccagggaaactcaacggttgtcagggcaggggaacagactgtcgataacactcctccgcctaaactcgcaatggctacggtattgggcaccttaatgccggcactgtggcaggccatcatacatccacaggccatttcatccgacgtgcaaattaacgcatccagatcgccccaggtaatcatcatatccttgaatatattgacgcctgtggcgatggtggatggcaaatgcgtggttaccacccggtgcggggagcggttcagagcgagcatcgccgtattccatccgctcagcaactggcgaaacattgtgttattagccggggtacagagcagtgcgatgttttttaatgaggcgtcggccagatgagtcacgatctgttttacggccttaccgtaatccacgccgatgcacatacccacagggtgggtatttagcgcgccaatttccagaataggaacatccacgttggccagcaactgggtgcagctctcaatggtatcgatattgaactgaataatggccgccgggttataggcgagcattttttcaaacgtcttttgttcactttgaccgtcatgcccggattccataaacatcatggtatatccgcgttcggtcagcactttttgcagcgcttcagagaccggcaaaaaacccggcgaagagaaggtgggaacgacggcgagaataagatcggaatggaccgacgccagattacgtgcctgcagattagggacatagccgagttgactgacggccgcatcgatgcgatcgcgaagctcaggattcactttttcaggcattctcagcgctcgcgagacggtcatggcgctcacaccgacaaactcagccacctcggttagggttatcttacccgttcctttacgtcgtttttctttcgggctaccgtccgcgtctaaactcttcaccaaaatcaccaaccgtttgaaaaataaaatataacgaaagtatatctgcgaatcgcattataacttaccacagcgagggggaaagcacattatagctagtgttagcggtaacgcactttttaacatttttctttgttagcgctaactttgggaggtgtatcacagttgcattttatttagctgtttatagtgcagcacatagaccccctcgggagagcatatgatcagagactggttaaccccggataaaattaaagtcattaactcaatagatagctgggaaaatgccgttcgacttgcagcagaacccttgctgatgcaagggtatatagccgggtcgtatattgaggcgattttgcaaagccataaagaacttgggccctattacgtattagctcccggcttggcgatgcctcatgcccgtcctgaacagggggtgttaagaaatggattatcgcttcttcatattaaagaaggggtgtcgttcggctcggaagagaacgatccggtatacgtggtaatcatgctatgcgctcgttccgggaatgaacatatcacgatgatcggtgaactggctgaaatctttagcgatcagcaaaagttacaccgattgttaaatgccgatgatagcaaggcgattcaggccgttattgactgaaggaaaacagaatgaaaaaagtgcttatcgtgtgcggtaatggtttaggcagcagcttcatcgttgaaatgaatgtcaaaaagatccttgccgaaatgaataaagaagctgaagtcgcacataccgacctgacgtcggcaaaaagcgaaactgccgatcttattcttagcgccaaagacattgcagaacatcttagcagtcactctgcaaaggtcgttggattaagtaatttacttgataacaataaaattaaagaaattttagcagaaaacatttaagcaacggctatctgattcgtggagtttatcatgcttcattttcttatttatgatgtgctaggaacaccggcgatactggttggtttattttcactgatcggtctgctgttgcaaaaaaaaggaatttcagacgttatttcaggcacgctgaaaaccatcatgggttttgtcatattgaccgccggcgccggtattatagcctatacgttaaccatctttagccagttatttgagcattctttccatattcagggcgtggtgcccaacactgatgccatggccgctctggcgcagaagaattacggcacggaaaccgccaccattatggtattgggcatgctgatcaatatcgccctggcgcgtctaacgccattaaagtacatctttctgaccggacatcatacgctttatatggctgcgatgctggcggttatcctgtctgtagggggcttgtcagggggatgggtggtggccatcggggcggttattctcggtgcgatgatggtcatctccccggctatcttgcagccgtttacccgtaaaataaccaacaccgacgatctggcgctcgggcattttggatctattggctacctgctgtccgcgctggtgggcaaaattattggtaaaggtagtccctcgattgaagagatcaaagtacctaagtcgctcaatttccttcgcgactcatcggtggccatctctctcaccatgatgattctgtttctggtgctggtgctcgttgcgggcaaatcctttgtcgaggagaccctgagcgctggtcagaactttattatcttcgccattattcagtccctcacgtttgctgcaggagtttatatcatcctcgccggggttcggatggtgattgcggagatcgtcccggcgtttaaagggattgcggacaaactggttaaagacgcgaagccggcgctggactgtccgacggtgtttcccttcgctccgaatgccgtcatcgtcggcttcctcgcaagctttgtcgcaggactggtcagtatgttcctctgcccgctgttcggcttgagcgtcatcgtcccgggcctggttccccactttttctgcggggccacagcgggggtttacggcaacattaccggcggacgtcgcggggcggtggtaggggcttttgctcacggtctgctcatttcgttcctgcctgccattctcttgcccatgatgggggatatgggactgggctccacaacctttggagacgcagactttggcgttgtcggcatcgtgctgggtcatatcatcgcaatgtttaactaactatttatcggaggtggtttatgagcgctaaattttcaccgtcactgatgtgcatggatttaacgcagttcaaagagcagatcacggcaatgaataaaaaagcggatttttaccatgttgatataatggatggcaattacgtccgcaatatcacactgtctcccttttttattgagaatctgaaaaaaattactactgtgcccattgatgttcatctgatggtgaatcatccggaagatatcattcccatgtgtctcgaggccggcgccgatatcatcagctttcatcccgagacggcgaataacaaaatattccgcctgctgaatcagatcaaggatgcgggcaaaaagtgcggggtggtgctgaacccggcgacaccggcagaaagcattgccgaatatgcgcatctgctggataaagtgacggtcatgtcggttgaccctggctatgccggacaaaagtttattcctgagtcgctgaacaagattagaaagctcatcaacatgcgcaaaaataatggctataactatctgacggaaattgatggctcttgcaatgagaaaaccttcggtcagattgctgaatccggggtagatgtctttatcgtcggcacatcgggtctgttttcgctccatgaggatgtcagccaggcgtgggacagaatgatcgagatcttccagcgggaaactgtcgctgcataacgggttatttctcttcgaaccacagtgtgtatttgaataagccttaaaagatctgcatcacgccagcgatgctggtttgttatttaacgaccactctatatgaatgcgggtgaattatggatatttcgacagtgcttaatgttaaaaacatcaagttaaatatgaccgccagaaccaaagaagaggtgatagaagaactcaccgatttacttatccaggatggcgccgtcaccaataaggaagactttattcgtgatgtctggttacgcgaggagctaggctctaccggttttgaaaaccatatcgctattccacatggtaaatcttccggtgtttcccgtaccgcattagccatcggacgcacgcaacatgccattccctgggagaccatggatggcagcgatgtccgctgtgttattttatttgcggtttgcctggtggatcaaaatgccacccatattcgcctgttggcacaagtgtctgggtcactggcggatgaagacattatcgctaaattacttgttgaatctgatccacataaaatcattgcgcttttcaattcagaaactgaaaacgccgatgcttaataccaacttgctaatatcgatttgtaatttattaaattaattaacggagaaacattatgaatattgtcggcgttaccgcctgcacggtggggattgcacatacctatattgcgcaaaagaaaattgaaactgcggctaaaaaagccggacataacgttaaaatcgagacgcaaggaaccatcggcattgagaacccgttaaccgctgatgagattgccgcagcagatattgtcctgcttgctgccgatgtcaaagtaacgggcgaggagagatttgccggcaagaaagtcgttaaagtcgcgacggaaacggcagtcaaatcccccaataagttgattgaaaaaatcagtgaaatagtcaattcataattttatttcggcctggcgactctacattaaagggcgtgacttatgtctctaaaacaaatatggcaagcagcaaaccctaaaggacatctgctgaccgctatctcgtttctgatccccattgtctgtggttctgggtttattatcgccatcggcatggggcttggcggaacggtgcaggacacgttaactccgggacaatttgatgtatggcaggcgatggccaccctgggcgccaaggcgcttgggctgttgccggtggtgatcgccgtgggaatatctggctcgattgccggcaaaccaggcatcgcgccaggatttgtcgtcgggctggcggcgaataccataagcgcaggctttatcggtgggatgattggtggctatattgcggggtatattgcgctggcgatcattaaaaacgtcaaggtgcctgactgggctcgcggtttgatgccaacgttgatcgtgcccttttttgcctccattatcagctgcctgattatggtctatatcatcggtacgcctatcggtatctttacggaagcgctgacatctttcctgagaagtatgggcacgtcatcgaatcttgtgttgggcgcagtgataggcgctctgtgtattgttgactttggcggcccgcttaataagacatgctttgccttcgttctcacgctgcaggcgcagggaataaatgagccgattaccgcgcttcagttagttaacaccgcaacgcctattggtttcggcctggctttcttcattgctaagcttctgcgtaagaacatctataacagtgaagaagtggaaaccttaaaatcggcggttccaatggggattgttaatatcgttgaaggctctatcccgatcgtcatgaacgatatcgtccgcggtatcgccgccgcggccatcggtggcgcgtgcggcggggcggtcaccatggtctatggtgcggatgcgacggttccttttggcggagtactgatgatccccacgatgtcacatccgatggcaggcatcatggccctgctggtgaatatcgttgttaccgccacggtctatgccgtcatcaaaaaagatatccctcgcgacgtgattgttgataatgattacgaagaagaggatatcgacctggatgatattaaagtgagctaacgtatcccagggttattttaaatcaacattaagctcttcctgtaagaacatcagcccatgactaagcattacttagtcatgggctactctttgcatctgtcatccccgaagaaaaatggagcagggtaagcagaagatcaggggaaataatcttgttgcaaaaatgtgaacccttcagtagccttgtctctttcggagacaggaaatgctcgtcactgattcacttcttgcttacaccctcgctgctacactgcttaccctgacgccaggtcttgatactgctcttattctccgcacggcgactgctgaagggggacgcaaagccttgcatgccgcgttaggcatcgatctcgggtgctttatctggggcgcgctggtggcctttggtttaggtgcgctactggcggtttctgagttggcttataccttgttgaaatggtgcggagcgggctacctttgctggctgggcatccagttgcttctgcgcccgcgccagcaatttaacacccactcggccgaatcagattccacgagtaactggttcctgcgtgggatgctggggaatgtgcttaaccccaaaatgggcgtcttctacgtttcgtttttgccccagtttatccctgccgggcattcacccgtgagctggacctttctcctggtcaccatccatgtattgattgggacgctgtggtcattaacgctgattactgccactcgctatgccgccggcatcctgaaaaaaccagccgtggtgaaatggatggaccgaacgaccggctgcctgtttctgttgtttgccgcgaagctggccatgagtcggcggtaatctccggtttcgtcctcccggggggcaatgcccgctttcatccggtgtcgccttgccggaatacagactttcctgccataccatggcaaatttcctgcactttgacgctcattgattatactttgatggcagcttgtgctgcctcaagcagttgtcgcgatggtggatatcaaaaccaatatcccgaacattgggtcaacggggccgaggaacatgtgttcatgtaacagtcgtggaggtatggaaagatgggattattaaattttgtgaaagaagcgggcgagaaaatatgggatgccgtctccggcgacagtaaagaagatcgggccgataagctgaaaaaacatatcgatggacttaatctgcctggcgccgaaaaggtcaatattgatgttgcggaagatggcaccgcaacggtcactggtgatgtcgcttcgcaggaggataaggaaaaaattctggttgcggtcgggaatgtcactggcgtaggccaggtcagtgacggcgttaaggtgacgcaaagcggggcggaaagtcgtttttacacggtcaaatccggtgacactctgagcgcaatctcaaaagcgatgtatggctcggccaatgagtatcaacgcatttttgaagccaataaaccgatgctgacccatcccgacaaaatctatccgggtcaggtgctgattatcccggcgaagtaggccactcagcagcaacatcagtgatggcaggaaaacttgctttataccgctgtcggaagccgccgcggacatctattcctctatcaacgacaaaagagccagcaagctggctctttgttcccccgggttcaggcgcttactgtgcgtcagccagtgccagtcgggcctcttcctgctcggtgattttacgctgttgctcaagttccagcgcgccgcgatgagagaggtagcagaagagtatgcagcagacgatcccgcccatcagcagatagaacccgccgtgccagcccattttatcgaccattacgccgaacaggctggtgcctaacgatgcgccaaagatatagctcataaatccgcgcagacccacggctgaaccgacggcaaagctggggacgatttccatggtctggaccgaggccagaaactgcgggacataaataaggcagcccacaatcgccgcgaataccgtgaccatcagtagcgattcgcttttccagtagccgatcagacagatgaagattagcgtcatacagattatggctaacggcatccggcgccctttaaacagcttgtcggagagccagccggccagcagagtagacggaatcgccgcccactcaaaaaacaggaatgcgacgctcatttgttctttggaaaaatgtttcaccgtcagcaggtaaattggcagccagctgatcatgccgaaacgcaccatatagacaaacacatccacaaaggagacataccaggcgtttttgttacgcagtacgtaggtacagaagatctgaaatgcgctcatgttctccggcgctttctggccgtgtttggtcttcagcaccactttctcttccggcatcatctctgccagcgaaggcagaccttcctcgcgcggcgaacccttacccagcaccagtacgctaatggcgaataccaccgccacgcaggccggtacaatgtagctggcgctctgccagtgctcggtgccgagaatggcgaatgcggcgccgacgatcggggcgacaattccgccgccgacgttatgggaaatgttccagaacgcccctacgcggccacgctcacggcgcgggaaccagttcgcaatagtaataaaagaggggccgacccccataccctgaaacaggccgttcaggacaaccagcgcagcgaagacccagaatgcggtactgaatcctaacccgacgttgacgatggcgcacagcaccaggccacaggccataaagactttcgggctggctttatccgcgaggctgctcattacgcctttactgatcccgtaggcgatgagcatacagctgctgagcaaaccgatctgcgtggcgctgaggtctaactgttctttcagatagggcgtggataaggtgaagttattgcgcacgatatagtacgccaggtatcccagaaatacgcttagcagcgcctgcatacggtatcgaccataggttgcctgaattttctcagcaggaactttattcgccgacgggcctttttttaataatgataacatgtcgtcacctgtatttatattgatatgaacatcaggagtaattaccccgaagggtgaaataagcggctaaaaaattcaaatcgtcgaaatgagtcaaaattgactcaaaataatgcagggacgggttgtttttgacccatctggcatgagcgagattttgcgtaattaattttgcgctgattttatgtccggcttgtgcggacactaacaaattgcctaatcattatctggtaatctttcccgatattcccggacgcccgtttgactatttttccgctcgcggcgattaattcaccagatgtcataaacgggtaagttttgtctcaacgcggtttttacggtatttcaatatttatgaacgggatcacaaacatatttcttcgtggggtcgggataatgagcaaaatgttcgcgctgctgctgctgagcgcatggctgagaccctgtgcggcgcaaggcaatgagctggtgatggcgacgacattttctcccagcgccaccgtgtggattatcgatcgctggcagaaagagccggggtcggtgatgataaggacgctcaaccgcaccagcgcctcgctggaacagttgcttgatacggcaaatgccgaaaatgtcgatctgatcctgacttcgtcgccgatgctgctgcagcatcttcaggagcatcaaaaactggcgccgttcagcggtgcgccggcagtcagccaacatctggtgccggaatccattcgctccacctccgtggccgtggcgatctccgggttcggtttgctgatgaatcgctcagcgctgatgacccggcatctgcctgcgccagcggactgggatgacctgaccgatccccgttatcagggggcgctgctgatgagcagtccgtcgcgttcggataccaaccatctgatggtggagtcgctgctgcaacaaaaaggctggattaaaggatgggaaacgctgttgacgacggcgggaaacctcgtgaccatttcatcccgtagctttggggtggcagataagattaaaagcggcctgggcgtgactggtccggtgattgataattacgccaatctgctactgaacgatccgcacctggcttttacctatttccctcagtcggcggtttcgccgacctatgtcgcagtgcttaaaaacagccagcacgccagcgaagcgcggcggtttattcgctatctgttaagtccggagggccagacgatcctcgccgacgctaataccgggaagtatccggtaacaccgctggcgccaggcaatccacgggcggcgcagcaggcgatgctgatgaatcaaccgccattaaactatcgattgatcctcaaacgtcagcgtttggttcagcggatgtttgatacggcgattagctttcgtcttgcccagctcaaagacgcctggcgagcgctgcatagcgcggaggtccgtcttaagcgtccgctgcccgagatacgggcgctgctcacccgtgtcccggtggatccggccagcagcgaggatgaagcctggctggctcagttcgacaacaaaagttttgcggaacagcagatgatggagtggcagctctggtttctcaacaaccagcggcaggcgattactaaactggaagaactgaaatgacggacaggtccatgctgcaacgcctgcggcaaatcagtatcagtagcagtctgcgcggggcatttctgacgggggcgctgcttacgctgattgtcagcagcgtaagcctctattcctggcatgaacaaagttcgcagatccgctattcgctggatgagtattttccgcgcatccatgcggcttttctgattgaagggaatctcaacctggtggtcgatcagctcaatgaatttctgctggcgccaaataccacggtacgactgcagctgcgcaaccagattatccagcatctggacaaaatagaacggctaagtcaggggttgtcgccggcagaacgccagcagttgggggtgatattgcaggacagccgcgcgctgctggcggaactggatcgcgtgctctacaacatgtttctggttcgtgaaaaggtgggagagcttgcggcgcggatcgactggctgcacgatgatttcaccaccgagctgaattcgctggtgcaggattttacctggcaacagggaacgctgctcgatcagattgaagcccgacagggggatgcgaggcagtatctgaaacgcgcccgggaagtgcagaatgaacagcagcaggtctataccctggctcgtattgaaaatcagatcgttgacgacctgcgcgacaggctcaatgaactgaaatccgggaatgatgacggcatgctggtggagacgcatatccgctatcttgaaaacctgaaaaaaacggcggatgaaaatatccgtgcgctggatgactggccgagcaccattaccctgcgacaaacgattgatgagctgctggaaattggcatggtgaaaaataatatgccggataccatgcgcgactatgttagcgcgcaaaaagcgctcgtggaagccagccggtccagagaagcgacgctggggcgcttcagaacgctgctggaagcccagcttggcagcagtcaccagcagatgcagatgtttaatcagcgtatggcgcagattgtccgggtcagcggcgggttaatcctggtggcgaccttgctggcgctgctgctggcatgggggctaaaccattattttattcgctcgcggctggtgaaacgctttaccgcgctgaatcaggcggtggtgcagattggtctgggccggaccgaggcgaccattccggtttacgggcgcgacgagctgggacgtattgccggtttgcttcgtcataccctgggtcagcttaatgcgcaaaaacagcagctggaacaggagattggcgagcgaaaagcgattgaggccgatctgcgcgccacgcaggacgagctgatccagaccgctaaactggcggtggtggggcagacgatgaccaccctggcgcatgagattaatcagccgctgaacgcgctgtcgatgtatctttttacggcgggaagggcgatcgaacagggacaggcggagcaggcgcggacgacgttaagcaaagcagaagggctgatcaaccgcattgacgcgattatccgctccctgcgccagtttacccgccgcgcagaactggaaacgccgctgcatccggtcgatttgcgtcagacgtttaccgtggcgtgggaactgctggcgatgcgtcataagcctcagcaggggacgctggtgataccggatgacactgtctggatcctgggggacgaagtgcgcgtccatcaggtgctggtgaacgtgctgtccaatgccctcgacgcctgcccgcacgccgcgcaaatcaccgtgagctggcaaatccagggcggaaggctgtgcgtgttgattgccgataacggccctggctggcctgcggccttactcccttcgctgttaaagccgttcactaccagtaaaaccgtggggctcggaatagggctttcgatatgtgtttcgctgatgacgcaaatggaaggggcgttgcgcctggcgtcgacgtttacacgcagtgcctgcgtggtgctggaattcaatttgacggatgtaaaagatgttgagtaataactgttcgattctgctgattgacgatgatgccgatgtgctggatgcctatacgcagctgcttgagcaagcggggtatcatgtcagtgcctgtaataatccgtttgatgcgcgggagcaggtgccgaaggactggcccggcatcgttttaagcgatgtctgcatgcccggctgctccggtatcgatttaatgacgttgtttcatcaggatgacgatctgctgccgattctgcttatcaccggtcacggcgatgtgccgatggcggtggaggcggtgaaaaaaggggcctgggatttcctgcaaaagccgatcgatccgggcaagctgctcacgctggtggacgccgcgcggcgtcagaggcaatcggttatcgcccgtcgccagtattgtcagcaaaaattacaggttgagcttattggccgcagccaatggacggttcggtatcgccagcgccttcagcagctggcagaaacggatattgcggtatggctttacggcgagccgggaaccggccgcatgaccggcgcgcgttacctgcaccagttaggacggcacgctgaaggtccgtttatcgcctgcgagctgactccggctaacacccatacgcttaatgaactgatcgcccacgcccagggcgggacgctggtcttaagtcaccccgagcatctgactcacgagcaacagcatcagctggtacagctgcagagtcatgagaagcggccttttcgcctgattggtatcggtagcgcttcgctggtggagttagccgccagcagccagatagtggcggaactctattactgcttcgcgatgacgcaaattggctgccagcctctgtcaaagcgacctgatgatatcgagccgctgtttcatcactatttgcaaaaaacctgtcaacggctgaatcatcccgtcccggaggtggatgctggtctgttgaaggggatgatgcgccgggtgtggccaaataacgttcgcgaactggcgaacgccgccgagctgtttgcagtaggggtattaccactcgcagaaacggttaatccgctgatgcacattggcgagccgacgccgctggatcagcgggttgaggacgtcgaacggcagatcatcaccgaagcgctgaatatccaccagggacgtattaatgaggtggcggagtatctgctgataccgcgtaaaaaactttatctcagaatgaagaagtatggtctgaataaagagcactacaaaggggtttagggcatcttgtcagacgatggttgaaaattatgaggacagatacagattataaatgccttcaagtcagcagaggcgatttatgttattgtgactgcttaaatttccttaaaaggtgtgactgttgaacatgcgaatattgactgtagttgattatgatgaaatgtggccgactttatttgagaacgaacgtactctgttgcagatgacgcttggtaaagtgatatcccggattcatcatattggtagcacctcggtgcctggattatcagctaagccagtaatagatatattaatcgaagttgctaatcttgaagaactggacagtttgaatcaggcaatggagggtgtaggatatactgtgcgtggtgaaaacggcattttaaatcgtaggtactttacaaaaggtggaagtcagcgtagtcatcatatccatgcgtttaccaccggggatgctcaaatcataaaacacctggcattccgtgattaccttattaaacacaatgacgtagccattcagtacgctttaatgaaaaaaagcgcgatgttattatgtgaaaatgacagccaccgatacagcatttataaagcggatttcattcagaaacatcttcgtatggcgcttattgatgcgggtcacctgggctagccttcaaataaactacaacccatgttttttttgtaatttttcacagcgttacctcttgtttctccattattagcaaacagcacgccttgcagactccctgcggcttcctgcaactgagcattctgaataagcgacggggcgataaagccgataacgcatcgttcagtatggaggcactatttcacaaccccagcggcctgacctcctgtatgaactcaatcagaaggcgaagcccggtcggcaattgccggcggcttgaataatagatatgaaaaccttcctctagtggggaccattccgtaagcaccagacggagccgtccatccttgacatagggtgcaacaagaggctccggaaaatacatcaggccagccccgcccaatacggccaccagacccgtttcggcatgattgaccgtcactgagcctggcactgtcatttggtatgtttcgccgtctcgcgcaagttcccagcgataaacccgatcgtcaccgagacgattgctgatgcagcgatggtgtaataaatcatccggatgttcaggcgttccgtagcgttccaggtaatcaggggaggctgcgataacccagcgaatatcggcagataaacgccgggcaaccatgtcctccgggacggtgccaccatagcggatgccggcatcgaagcccgcatcagtcacgtcaaccatacggttgctggccacaatatcgatttcaatatcgggatagcgatccataaaagcgggcatgaccggcgcaagcaaaagatttgccgcttcaacggctgcattgatgcggatacgtccggtaggggtattgcgataccggttaagcgattcaagcgcgccttctatggtgtcgaaaggctgaagaacagactgaaccagttcctcaccagctgccgtaggggtgacgctcttggtcgtgcgattaagcaggcgaactccgagccgggtttccagtcccttcagggcatgactcagcgctgatgcactgacgcctaattcaattgccgcacggctgaagctgcgatgacgtgcaatcgccatgaaataaataagatcggcaacatcagctctgcttatttgcatacagaatagttttccttatgcggcgttaaaacccgaatgcgttgatgaagaaatgatatacaccttagaccgattagggctaatccattgctgaatttttttcacaagtccattcatgcacgtccactcactgtacacgttgtgcttcgttattcttgaaaatcatgcgctctggctggtaggccagggcggaacactcatctaacggagccgtttatgaactatacgcatcttggccgcaccggcctgaaagtcagccgcctttgtctcggaaccatgaattttggtgacgtcaccgacgagaagaccagcgcccgcattctggatgaggcgcttgaggcgggtatcaatttcattgatacagcagacgtgtatggcactgaacaatctcccgatatccagcaaggctcggggctgtccgaggaaattattggtcgctggcttcagcagggtggccgccgtgaacgcatcgttctggcgacaaaagtctatcagcctataggaccgggcccgaacgatcgccggctttctgcgtatcatattcgcaaagcctgcgaggacagtttgcgacggcttaagaccgaccatattgacgtctatcagatgcatcacatcgatcgtcatacgccgtgggaagagatctggcaggccatggaactgcttgttcagcagggaaaggttctttatatcggtagcagcaatttcgcaggctgggacattgcgactgcgcagtcagtcgccacggcccgtcatttcctgggcctggtcgccgagcaaagtctttataatctgacagcccgcaccattgagctggaggtcattcccgcatgccgccattttggcctggggttgatcccctggagcccgcttgccggagggctgcttggcggcgtactgaaaaagatggcaagcgggcgccgtgccaggcccgcgtttgcccgtctaatcgaacagtatcgtccgcagctggaagcctatgaaggattatgtgaggacctcggcgaaaccccctccgatgtggccctggcgtggctcctgcagaatcctgtcgttaccgctccactgattgggcctcgtacggtcgaacaactccagcaggcgcttcacgcaacgacagtcacgctatcagacgacaccatgagctgtctcgacgaaatctggcccggccccgggggagaagcgccccaggcttatgcctggtaatgaccaattaatgaatcctttcttcgttatagggagttccagtttatgagcaagatgatgcatgaccagccttctgctgccgtacccgcttcccgggaccggcgcaattttctgatcgccggcgccggtctggcgttggccgcaaccacccttggcaggagcggcgccgtgatggcgaaaccggctggtcaggacacgccgaacgccccttcggatgctgctcccgtccggaaggaaaccttaaccacgcgtaaactcggctcgctggaggtgtccagcatgggactcgggtgcctgccgatggtgggttattacggcggaggtccgcgcgatcgtaaagccatggtttcgcttatccgggcagccttcgaacaaggtatcacgttctttgatactgccgaggtctacggcccccatctcagtgaagaatttgtcggggaagcactggcccctgttcgcgatcgtgtggtgattgccaccaagttcggtttcggcgtggaggaggggaagcccacttcccttaacagccatcctgaccatatccgccgcgccgtagaaggctcgctaaagcgtctgaaaacggaccacatcgatcttctctatcagcatcgccccgatccgaatgtgccgatcgaggatgtggcggaaaccgtgaaggcgttgatccaggagggtaaagtgaaacactggggactgtcggaagcgagtgccaggacaattcgccgcgcacatgcggtactccctgtgactgcggtgcagagtgagtatgccatgtggtggcgggaaccggagacgcggatatttccaacgctcgaagagctgggtatcggtttcgtaccttactgcccgactgcccgcagcttccttgccggagcagtcaatccaagccagcggttcgacagcaccgatcggcggcataacctgccacgcttccagcccgatgccctggccaaaaacatggtgctgcttgaatttgcgcagtcgtgggcccgtcgcaaaaacaccactccggttcagttcgcgctggcctgggtgatggcgcagcggccctggattgtccctatcccgggtacgacgcaatatccgcacctgatagaaaacagcggcgcaccgcaagtccggttgacggacagtgagctacgcgaaatcgatgcggcgcttgccaaaatcccattgcagggcggccgcgccgatccgtttaccgaaagtcagtttgataaaagttaatacctgctgtcacagggagactgcaggtgaagtctccctctgtattattgccggggataaaccacatgaatggactaaatcataacgcgcttacatgcagtgccgtccccataccgccctgggagcgttctcttcagaccgtggaggcccagccgtacttcaacgtttcacaggcgtcgctcgtgctcgaagggatcgtgttcgatcggaacaataacctgctgtttgttgatgtggcgacggggcgcgtgtttaagctaaccccggagcggcagctttccattgtccttaaggagaattcattcggtgcttccggcctggcggtacacaaagatggacggatctttatcgcctcggtgggcgatatgcagcgaggttctgttcgggttatcgaacccaacggcacccgtgagcagatgattgttgcccctgatactggatttcttgtcaacgatctggtctttgataatcagggcggattttatttcactgacagccggggaaattcagccgatccacagggtggggtgttctacgttagtcccaatgtcgggtcaattcatgccatcctgcctggactcgcggtcgggaacggcatagcgattgaccccgccggctctcagatatgggccacagaacacgctaaaaacaggcttcatcgcgtaagactgtcagacgccaccacggtcgccccgtttggttcagttgttacctatcagttcaccgggccggcgccagacggggcccgtgtcgacagcgaaggcaatgtatatgtggccatctcaggccagggccgcgtcatggtcttcaaccacaacggactgcctattgggcaaattgtgctgcctgaccgcgacaaaggccgtaaccttaaatcgacaagcctggcgatccgccccgggcatcgcgagttgtttattgtcgctaacagcgggaccgaacctggtggagcgatgatttttcgatcgggcgcattcgcgccggcaccgtttcccttttcacatcagtgaccgggaatgagtggtctgggagacccggcaacgccgggccaggacagggtgttaatagttctggatcgctgaaggcggcgtgagggaaggcggcgtatccggaagcgggggaatgatcccgtcaacggggtgcggcagatagcgagcttccagttccgtgatttcggcatcgctaagtgaaaagtccagcacgctgatagccgtggaaagatgttctggtttcgttgcgccaatgatcggtgctgtgatgacggattttgataacagccaggcaattgcaacatgagctcttggcaccgcgtgcttttcggcaatgctggcaacaacatcaatcacgggcttatccagaagggctgcgttctcatacatttttaacgcaaaggcatcgttttgcgttcgtcgggacgtgacactccagtcgcgcgtgagcctgccgcgtgccatcggactccaggggatcaccccaacgccctggtcttcacacaggggcagcatctcgcgctcttcttcccggtaaagcaggttgtattgcggttgcatcgtgataaatcgggtccaaccgttacgctcagcggtatgctgcatttttgcaaagcgccaggcttccatagaagatgcgccgatataacgcgcttttcctgctttaacgacgtcatgcagagcctccatggtctcttcaacaggcgtggagtagtcaaagcgatgaatctgaaagagatccacataatccatgcctaagcgcatcaggctatcgtcaatagactgaaaaatggccttgcgggaaagaaacccggtattgggtgagttgcgccacggaaagaaggtctttgtcgctacaacgatctcgtcgcgtctggccatctctctcagcgcttttcctgtaatttcttctgaactaccgcccgagtagatattcgcggtgtcaaaaaaattaatgccggcttcaagcgcctgacgaatgagcggtcgtgacgccttttcatccagggaccagggttgaggcaaacgttcaggttcgccataactcatacaaccgagacaaagacgggagactttcaacccgctacgacccagattcacatacttcattcggtgttccttcttttattgccagcaattatgtatgtgacagggtattgcactggtatgaagggaaccagcatgcgccattgaatggtgttatgagttttttcacaagtagacaacattctcatacgccagcctaggcccaaagtcggtatagcgttcgcggataatattgagtgcgtaccgggcaagaccatcaggcagctggttattgctgggttatccacgacggcggttaggcatactcagtgggcctgattgattgtaacgctagagaaggcgtcggcactggcgatcgggaatacccaggcgctgcgcggccatctgagtggtcagacgctggtcgacaacgtcatgaatgatttagagtcggttaacttcatccaaagtaaaaatgccggtgcatgatccgtcatcagaatcctttgattgggaaactatctttgaaagcagtgatcgctgtggtgagactgtagcgcggacatgtctatttggtcagagacggacatctcaagttagctactacaacatgtgtcaaagctcagtgaaaatgtctaatcactggctcattagaaatgtccatatgttgaaaaggccgctgcgaaaatccctcccgcagcggcctctttagcataacgtcattatgcgaaccaattatggtttgagtttatacttctgaccattaatgatttttttgattaactcgaatgcagcgggggaatatttatgaacaccttccttccccgttttcactagcacatgatagttattatctgaggatttaatattaaaaccagtttccttgtgtattctttctaatactttatggacgtaatgccaagatcccatatcaagtaattttgcaagttcagatatggtgtagggatagcttgcgttaagtgcttgcccattatttaactctgcaattccataaagtttcgctaacacgttatcttgctcagcaatgttcttaagcatttcaaaatcatatggaagctcttgttttacaagagattgagaggcaaatgtataggttctggctaatagcgccctgactaattttgggttaacactgatttctggcgtatttgacgatagggcatcataaatccaaccgaaatcattggcatagatcactttgattcggatgcttttattttcaccaacaccaatcaaaatctctttctggtgtgaacctgtaccttcacattctggactaaaggaaaccaaataaatattcggaatcaaagcgttattcggcgcaattatctcatcaatatcagacaggatggctttaatattctcatcattaatactatagccaatgaagaacaacggatgctcgacgaaatatgttaaaagttttgcactgatatactttttacgcttataaaactcaacataatcttcatttgttataatgatgctttctggttctttactactgccgtgaatcttcatgatttcaccgtatgtagtatagttaacagtcacaacattatggccaactatcggttggtagttatcaaatatcttttcaagcagatcgtcatagtttgttgtaataatggcatggggccttactttttttaacttttcaatttcttcagtgtacttcattgctgaaaaatcaaccgagtctgaaaggttattcaacaatgttgcaatctcatgcttgatataaatatctttagagctttttccattgaaatactgttcaggataacgagatgtccccacatcccaagcccactcagcgtatgactcagaaaaatcacttgctatcaatggtttattgtcatttcttgtttgactgtagtaaccatacgggcgagtgattaatgggcaagtttcagcgagatactttaacaggttttcccaatcaggagctttcaagtagcgttgagatacccctgcacccataaagagaattggctgtacctgtaaaccttcaagacatgatttgatatcttcaattatttctgtctgatattcagagaagtccatactttagcctttaggatgtgagatgctggagtagtaaatcgccgcggagcggttcggggttcggggttctgtgacactcgaattttacctcggttatataatatcattgaagttatttgcatttctcagaaatcttctctggctttgattgctatagccgaaagatagcgcacacatcgccgttggtcagttagtacgaggtttccgccaagttcaccttttaccaaagatggcttcagagcttccctgaagctttatcatggcttcaagtaggtcatcttcgttcagtgagcgctgagatttgttgatgctaggggcgtgccgtctgcgggaaggctcatcaccagaacaaggtaacgattgtgagcgattattttcccgttttctctggatctgacgggcaacatccaacacatggccaagtctcttgttatctacaatggcgacggtctcaacctcagaaagctggtcataggtggagtagggcagcagcacgccatttagtcgcagctccttatgtccgtcaggataatgccagacatcaatgtacttgccgatggctcttcgactgtattcgctgtcctcaatcagatagaggattttatcgtattgtacagtcagactttttgatacacgccggggctctcgccaagtaaattccgcatcaaggtcatcgtctagtgccagtggccggtgcgcgttaaaatcatgcaagggcgctttggcaaagcgtcggttgtaatccgcaatgtattcttctgcaaatccattggccgcttctatagtacagattcccctaagcctgagttccttaaccagccggtcctgaagggttagatgagcacgttccacacggccttttgcctgactggtttctgcgcacagcggtgtgatattgagggagcgcatggccctggcaaactgatacagggtcgaccccggttttcaaaccagtggtggtcacagccatcaatttgtatcagctcgccagtacaaggccgccggtaacgaggctgatgaattttaggtgcgcgctgtctgcgtgggatccagagtccggcttttatcatgagacgtcggatgctttctttgccaaggaccagaccgtgaacttcctccagtttttcccgcgccagcgtggggccaaaatcacggtattgctccctgattatactgagagcctgatctgtcagtgacgctggcaacagacggttaccagtgcggccacgactctggttgttcatgccaagcggtccgagttgacgatagcgtttcagcagtcggctgcaatgacgtggtgtaatgccgagcatctccgcagcttggccaggacgcagattgcgatcgatgacatcctgaaggattttgaggcggttgatttctttcacgttgaacatcccggcgtcatgtatagccatagaaaactcctcatcaggaaaagtgagtcgttgtctagacatacaggtctgagaactatagcctggacattcctatgagccacaaatagacattagcattgagcctctacaacatgagtgcgcataatgtatattatgttaaattgccgaatgagggaatctacgtcacatatcgcatccactcctctgtatcgctcctcttcacgtgactcggtaaaacgcgccttacatccccgtccatctgggcggggttttacggcccacctgatatttgataccgcctgaacttcgcgctagagaagattctcttcatccagagaaatcacctgaatgccggcattacgatacgcctgaacatcatcaggcagacgatccaccaccaccgtgtcaattcgatctgcggcggtaaattgggcaagcgaggtgttattcagcttgctgtagtcacagacaataattacctgactggcgtgttccaccatgcctcgtttcgtttctgccagcatgatatcggccacgcaggcgccgtgtttcagcgacagcgaattggtgcccataaatgctttatcgacgtttagcgtgtcgagaatggaacgtccgttgatcgccaccacgcagtggtatcccttcttaacgatccccccgagcagaatcgtttgaatcgagggactggcctcaagctcccgggcgatttggtaatcattggtaaccaccgtgacgttctgtctgtcacgaatattgcgcgcgatatgtagcgtcgtggtaccggtatccagcacgattatatcgccatcctcaaccagcgccgccgcgcgctggccgatccgctctttcgcgctgagattgacaatttcgcgatcgtccgacgcctgttcaaagcttgcccgggtacgaagaacggctccgccgtgggttcgggtcagcagcccctcctcttccagctggcggagatcggcacgaatggtggcgcccgatacattaaagacgtcacacatctcagaaacagcaactttgcgtttttccctgagaataccgagtaacttctcctgtctttcttctgcaaacattctgcctctctcttttttacggcacgttacggcttacctttgcgtatcagtcgggccccacgctgagcgcatccagcctgtcgtataaggcggcggattgccggtacagcgtatcaaaaagctcgctgcaggcgtggtaataatcccgcagacggggatccggtgagatcactttgtcgaactgcaccgtttgccgcacgccgctggcaaaatcggcgtacaaccctacgccaaccccggcgataataccgcatccggtgacgccattctcctgattacgcgtagataatatcggcagattgtacgccgcggctttgatttcaagccacagcgagctgcgcgcgccgccgccggaagcgatcatttgttgcggatactgcccgcacttctgcagctgccgaagattgcgccaggatgcaaaggccaccccttccagaactgcgcggaataaatgaccgcggcgatgcttgcgctgcaggccaaaaaactgtgcccgcgagttcgtgtgttcggccagacgttctcccgtcagatagggaagaaacagcagcccttctgcccccgccggcaccgccgccgcttcctgtaaaagctgtggatgcgtaatctggttatcggcaagtgccagccgcgcccagcgaacggcatcgccgccggcgtcgaggatcgtaaatccgccccaggccgcgttggcaagatgaagattattaaccagcggatggtgtaacggccgcggcgacaccaccgtcatcagcgtcgacgtgccggttgaatcagacgccatccccggttcatacacacccgagcccagcagagaggccgccatatccgacgtcccggcaaccaccgggatacccgccggcaggcccgtcaggtcggctgcgcgctgcgtcacctggccgattatgtcgctggaaagtttaagctccgggagctgatcgacccgcagaccaaacgtttcgcaggcttgcgaagaccagctacgggtttcgctgtccatcaggaaatagcacgacgcttcgctataatcggtcgccatggcaccggtcagcatgaaattaatatagtccttcggcattaatactttggcgagctgcgaccagcgatccggatgattttcgcgccaccaggctaacttgaaagcgggccatgctgccgcaggcggattattcaaatgcgccagccacttttcccaaccttcgcgcgcgttaaaggcgtcaacttgcggctggctgcgcttatcattccacagcaacgccctatcctccaccagctcgccacggtcgtccagaaggacggtgccatgcatctgtccgcaagcaccaataaccgcaatttgcgctgccgtttcaggatagcggtaaagcacctcgcgtatacagtcgcaggcggcctgccaccataaagacggggcctgttctgaccaacctgcacgcggcgtggtttgctcatactctctttgcgcaaagccgatcatcgcgccgtcaatgcgcacaatagcggcgcgggtactgccagtgccaacatcaatcgtgagtattttatctttcatcactaactccggtgacgtcttaaggcgggccaccaggcccgcggtctctcagtttaatcggcgttcagctcgggaaaacgttccgggtgctgctccagttcagccagcaccttggttaccgcgccatggctcatgccaaagcggcgcacgccaagctggtacagcgcacgcaccgtggccagatcgcgaatgcccccggcgcctttgatatcgattcggcctttaagctggtcggcgatgatgctgactttttccaccgtggcgccggtgggcgcccagccggtagaggttttgacccacttcatccccacctctacggcaatttcgcacacgcgacgaatctgctcctcattaagatagtgcgtttcaaggatcactttggccggtaccggggcggcggcttccaccacgcggcgcaaatcttcgcgcacatagtcataatcgccggagagcactttgccgatattcacgaccatatccacttcccgagcgccgtcggcaatcagctgccgcacttcctgaaccttggtatcggtggtatgcccaccgccgggaaagccgaccggaccgccaatcatcacctctcccgtaccctgctgcggcagcaacgtactgagaaagcgcgtccagcaaggcagtacgtggacggaaataatgttgtatctggcagccagctcggcgcaggcgcgaacatccgcttcggtactggtggcctgaactgcgctcagatcaactaaacgtgcaaaacgacgggttgtttcattcatggtcttatcctgtcctttgtttttaattgctttcatttaatgctgatatttggcttaaatacatttaaaaacgcattaaatgaaaataacgtgatcaaattagcatttttttattttcatttgtttttaattagcagcaggaaataagcgttaaccttgcagagcaggcgtaatcgggcataaatgggcgcaaaagcaatcttgcatttatttttgtttgtttttgtttatgcctgaatcacgggcgaaatagcgcaaaccgctgacggaagtgaagcgaaatgcgtgcgctatcacagtgttcggctgcggatagcttgccttcgtgggacattcccgaggtctcaacgctctgcgcaagggaaaggtaatctgattatgtacttcaggagagagctatgttgccgctggaacgtcatcatttgattgttgaactgctgggccaacacggcgtcatgcgggtgaatgagattgcgcaagcgactcgggtctccagggaaacgattcgccgcgatctgagcgagctggaacgcaaagggatcttaacccgaagccacggtggagcgctggcggcggaaaatccgctgccggcgacccgggcggcggcatccgccctgccagttgaagatagccagggaagctttcagcacagaacgctgctgcacagcgaaggcaaaatgcgcgtggcccgtaaagcactgcagtttctccaaccgggacagaccattgtcctggacgggagtagcaccagctggtttttggcccggcagatgccggagatggcgttgacggtgattacgccctccattcgcatcttacaaactctgatgagccgacgctcgttgcatctcgtcgggctggggggcgatttctccccgaccgaagagtcgttcttcggggaaaccgcctcacgaacgctacgcgaatatgccattgatacgctctttttctcctgccaggggctggagcgcgatagcggcttgtatgcgggtacgcaagcccacgccgccctgctgaaacagatgctgctggccgcccgtcagactgtggctttggtcgacggcagcaagctggggcgaacaggcgtcgcgcgtatcggcggactgggcgagctggactgtctggtgactgaaaggtttgtcgatccgctgctggaaaaagagatgacctggcataacgtcagcctgcaaatcgcctgagtacgccgtcatgacgtgacggttaatacgcgcaatgtcgaaacgctgcttaccgcggcagggccagactttgcctgaattcagccaccaccggaataaatgaggccttatgcgttattacctttctccctcgctgatgtgtatggacatgatgaagctgacggaacagctgcgctttctaaacagcaaagccgacaggctgcatgtcgacatcatggacggccactatgtcaaaaatctggcgttgtcggccagctttgtggcgcagatccgtccctacacctcgcttcctatcgatgtccatctgatggtcgaagcgcccgcttcgtttataccggcgctgttagacgccggcgcagacgccttctcactgcatccggagaccatctgccgcgaagcgttccgggttatcaatatgcttcgtcaggcggggaaagaggtgggaatggtgctcaatcccgccacaccggttgagagcatccagcactatctgcatctgctcgataaggtgacggtgatgaccgtcgacccaggctatgccggtcagccgtttattcctgaaatgctcgccaaaattacgcagcttcatcagctcaaagagaccggcagcctccgcttcttgctggaagtcgatggctcctgtaaccgcaacacctaccgcgcgctgctgggcgccggcgcacagatattagtgatgggcagcagcggtttattccgcgctgatatgccgctcgagctggcctgggaaaccatgtcccgcgaactgtccgccgcgctgcactcccccgagctggtatagaggagcgaatgatgtcaggaaaagtctgtgtttttggttcattcaatttcgacatgatcgccagggtggatcgctttccggtaccaggtgagtcgttagtggcctgcggaagtatgaccagcgccggaggtaaaggggcgaaccaggccaccgccgcgctaaaagcgggagcaaatgtccactatatcggcaagattggcaatgacaccttcggccattttgcccgccgtcatctgaaaggcgtgggcttcaatgctgtgacgctgctggtcgccgaagagatccccaccggcaatgcgctgatttatgtcgccggtaacgatgccgaaaacatgattgccgtcgatcccggcgcgaatatgacggtgaccgatgatgaaatcgccggctgcattcccgctatcggctgcgcggatgtggttctggttcagctggagaacaatctttccgccattgaacaggtcgtagacgccggcaaacaagccggggccctggtgatgctcaatcccgcgccctggcagcccgttgagcgcgcccttcttagcaaagtggatttacttacaccgaacgccacggaggccgggttaatgaccggacgccgggttgacagtctggcggccgcggctgaggccgccgacgtgttgcatgctcagggcgcgcgcaacgtcattatcactctcggcgccagcggcgccctgctgagcgagcatggggtgaaatcccctattccctgctttccttctcacccccgcgacaccaccggtgcgggcgatgccttcaacggcgcgctggcggcgcggctggcctgcggggaaccgctacaggccgcagcccgattcgcggcggcctatgccgccgtcagtgtcgaaaaacaaggcgcctcatctttacctgagtacctggaggcacaggaacggcttctccgtgccgccgctgattatgaaatggcataaaccctactgtataaaaaacattaagaggatagctcaatgagtacgctaatcacggataaggtcgataacgcagcggtccaaaaagaaaaactggacaccagtgcgtatttaccccataccccctggctgcaatttttacttgtctgttgcctgtttgcgctatgggggatggcgggcaacctgaatgatattttgatcgcccagtttaaaaagggcttcgatttaacggatacccagacagcgctggtgcagtcgatttttttcctcggctacttttttgtcgccctgcccgcggcggcgctgattaagcgtttttcctataaagcggcgattattattgggctgtgcctgtacgccctcggctgcttcctgttcgttccggccgcacagatcatgacctacggcgcattcctcgcctgcctcggagtgatcgcctgcggactctcttttctggaaacgtcggcaaacacctactccagcctgctgggtccgattcaatcctccacccagcgtattaacttttcgcagatcttcaactcgctgggcgtgatctccggcgtattaattggccagctgatggtctttggcgaaaacgatccgagtcatgaacaactgctggcgatgcccgccgccgctgcagacgttgcacgccatcagatggttggtcaggtggtcgggccctatctgattatcggctccgtactggtggtgctggcgctggtgttcgtgtttattaaattcccgtcgtgcaagggcgcgcccgctcaacaacagcaactcccgacggaaagcatggggccaacgctgaaacgcctgtttgctatcccgcgctttcgcctcgggatcctgtcgcagtttttgtacgtcggcgcccaggttggcgtatggagcttcacgattcgctttgtgcagctcgtgcagcaaggcaccagcgagcactccgcgacttactggctgctggcttctctggtgatttacgccgtgggaaaaaccgtggccacctggttgatgaaccgtctgaatccggcgatgctgctcggaacgtttgccctggccgccaccgccctgttactgattgccgttttcagcggttcaatgctggcggtctatgcgctcattctggtcagcttctgtatggcgccatgctggccgacgaactttggtctggtgatcaaagggatggggaaagatacccagaccgcaggctcgatcgtggtgatgtcgattatcggcggggccgtaattcctctggtgatgggcattatctcggatatgaacggcggcaatatgcaaatcgcctttatcgctccgctcctgtgctttgtgtatgtcgctttctacggcttctggtgcgtgcgtaagggggtataacatgcgcgaacttatcaacacgattgctcatattggctatcaggtcagtgacttaacgcgttcgcttgccttctatgaaccgctgggctttcagcgccagcagcggtttagcaagccatcgccacagggcactattgaagttgcgttcctggaaatggcgggcgccgtcctcgagctgtatcagcttcccgctggaacgccctttgacgccccccgctgcggtatcgatcatctggcgctggaagtcagcgacctggatgcggggcagcagcggctggcggcgctcggttatccgctcgatgaagggccgatagaagaagacaacgtgcgcttcctgcttattcgcggccccgatggcgaacggctcgagttcgatgcctgtaaacgctaagcggcagggctgaccccttcactcttttaggcccggttaacacgggtctaaaagatagcgtcctctggcattattcacgtcggtttgattcgcggatatctctcccccacccggtctctcctgcccattgtgcaatgttacaaaattgcttctgttttgttgattttctattgtgagccattcggcaatttcctctcctgaatttcccctgactactcctactcaatacgcgatatcaggagagacacatgaacagcacctccgccgacttccagaatctgtaccaggccctgagccacagcgccgcccgcagcccggatgccctggcgctggcgtttgaggatcggcgctatctgtaccgcgattttcatctgcgggtacagcgggcgatggcgcagcttgatcgcggctggtcgctgcgcaaaggcgaccgtattctgctggcctggggcaatcaccccgctttttgcgaagtcctttttgccgcgctgggtttgggcatcgaagtggtgccgttcagcaccaagcttaagcaggccgaaagcgaggcgctggtaggccatatcgctccccgggttgtcctgttcgatgcgaccgtgcaggactggctgaaaaacacccccgacgcgcgtgcggtttcactcagcgaatggcaggcgctctgccttcccgaaccgctgacccgcccgccggtcccggttaaccgcgacgatacggcggtgatgatgttcacctccggcaccaccggagagcctaaaggggcgattatcacccacaataacctgctctgcgcgattgacgcctatacgcaaaaactgaatctcaccgccgcggatagcaccattctggcggtgcctatctatcacatcaccggcctgtcggcgctgctggcgctgtttattagcctcggcgcgagcatctggctgcagcatcggttcaatgccccgcaggtgatcaccaccctgcgcgagcagaacattacctttctgcacggctcgcccaccatttttatccttctttgtcaggctgcgcgtgagcagagcgccagccatcccggcgattttccggcattgcgcacgattgcctgcggcgcgggccacctgagcgatggactgatcaaggagttaaaaaccctgttcccgcataccgcgattcagccgatctacggcctcaccgaaacgacctcgcctgcgacgatttttccgggcgacgtctggggcagcgataaatgtggcagttcaggtcaggcgatcccgggtctcgccattaccatccgcaacgatcgccagcagcccctccccgccgggcaaatcggccatatctggctaaaaggcgatgtggtgatccgcgaatactggcagcacagcgagcgacgcccgagctgcgatgcgcagggctggttttgtaccggcgatctgggctatctcgacgacgaaggctggctgtacatcaaagaccgcagcaaggacatgatcaatcgcggcggcgagaaaatttactcactggagctggaaaacattctctctacctatcggggagtacgggaagttgccgtcatcccgacccccagcccggtctacggcgaagagcccgtggcgtttatcgtgccggatggccagcatcacctgaccagcgaagagatcctcgactggctcaaggtcaaaatcgcccgctttaagctaccggcgcgcattattttcacccgtgctttaccgcgtacccacaacggcaaagtgagtaaacagcagctcaaaacgcgtctcgcagaatccatcatcacgctatcaacggaggataaaaagtgagcagcaaatttatcgacgcccatgaggcggcgcggtgggttgccagcggcgacaccgtctgcaccgtcgggatgacgcttatcggcgcggcggagtccattttaagcgccatcgaagcgcgctttctgaccgcgggcgaaccgcgtgacctgacgctactgcatgccgcggggcaaagcgatcgccagcgcggtatccagcactttgcccatccgggtatggtgacccgccttatcggttcgcactggggcctggcgccgcgctggatggcgatgatcaacaacaacgaagtggaagcctggtgcctgccgcaggggcagatcgttcatctctatagcgcgatggccgccggactgccggggcggctttctcccgtcggtctcggtacctttgtcgatccgcgcatagagggcggaaggatgaacgcccgcacccgcgaacgacccaatctgatcgagcacgtcacgtttcgcggcgacgaatatctgttttatccggctcttcctctggacgtggtcattgtgcgcggcacccatgctgatgaagacggcaacctcacgaccgatgaagaggtgatgaagctggaagtcctgcacgccgttctcgccgccagacgctacggggcgaaggtgctggcgcaggtgaaatatcgcgtagcgaaaggctcgctgcatccgaaaagcatcaccgttcccggcaacctgatcgacgccattgtggtatgcgaagagccgcagacggatcaccgccagacttcaagctgggccttcgacccagcgctgtgcggcgatatccagctgcccgccgcgcaaaatgcgccgctgccgctggacctgcgcaagcttatcgggcggattgcctgccgctatctgacccccggctgcgtcatcaatctcggcaccggtattcccaatgacgtgattggcgccatcattcacgaggaacagctcggcgagcaggtcaccatcaccgtcgagtcagggatctacggtgggcagcaggcgggtggcgtggattttggtatcggccgtaatctgagcgcgatgattagccaccaggatcaaatgctctactacaacggcgcaggggtcgacatcacctttatgggcgccggcgagatggacccgcacgggcacgtcaatgccacacggctcggcgcatcctgccccggcgcgggcggttttatcgatatcacccagaatgcccgccacgtcgtgttctgctcctcttttaccgccaaagggctggagatcgcctgtgaacacggggcgctgcatatctgccgcgaaggcgaggtgcgtaaattcgtcgccggggtaaaccagatttcttacaacggcgaactggcccgcaccaaaggacaaaccatgcattacgtcaccgaacgggcggttttcgaactgcgcccggaaggaccggtgctgacggaaatcgcccccggcatcgatcttgagcgcgacatcctggcgcatatggattttcatccggcgatcgccgcggatcttcaggttatggacagccgtttgttcaccccgccgccctgcggtctcgcggaacatctgtcccggaattcatcctctgactcataaggaacgttgctatgaaacttgccagtaaaaccgccattgtcaccggcgccgcacgcggtatcggctttggcattgctcaggtgcttgcgcgggaaggcgcgcgagtgattatcgccgatcgtgatgcacacggcgaagccgccgccgcttccctgcgcgaatcgggcgcacaggcgctgtttatcagctgcaatatcgctgaaaaaacgcaggtcgaagccctgttttcccaggccgaagaggcgtttggcccggtagacattctggtgaataacgccggaatcaaccgcgacgccatgctgcacaaattaacggaagcggactgggacacggttatcgacgttaacctgaaaggcactttcctctgtatgcagcaggccgctatccgcatgcgcgagcgcggtgcgggccgcattatcaatatcgcttccgccagttggcttggcaacgtcgggcaaaccaactattcggcgtcaaaagccggcgtggtgggaatgaccaaaaccgcctgccgcgaactggcgaaaaaaggtgtcacggtgaatgccatctgcccgggctttatcgataccgacatgacgcgcggcgtaccggaaaacgtctggcaaatcatgatcagcaaaatccccgcgggttacgccggcgaggcgaaagacgtcggcgagtgtgtgacgtttctggcgtccgatggcgcgcgctatatcaatggtgaagtgattaacgtcggcggcggcatggtgctgtaaggagaaaaacaatgacccaggctaatgatattgtgattgtcagcggcgtccgtaccgctattggcacgtttaacggcagtcttaaacatacccatcagcatgaccttggggccgccgtcattcgcgaagcgatcgcccgcgccgggattgcgccgcaggatatcgacgaaacgatcgtcggcaacgtcgggcaaatcgccgaaagcggttttatcgcccgcatctgccaactgcgcgcggggatcccgcaggagagcaccgcctattccgttaaccgccagtgtggttccggacttcaggccctggcggacggcatgatgcagctgcaaagcggccaggtcgaggtggtcgtcgcctgcggcactgaaaatatgacccagctgccctactacctgcgtaaagcgcgcgatggctatcgcatgggccatggcgagctggaagatggcctgatctccattctcacctggccggaaggcccttatcacaacggcatcaccgcggaaaacgtcgcgcaacgcttcggtattacccgcgaagcgatggacgattttgcctggtcgagccagcagaaggcgctgaaggcgatcgcggagggtcgctttcgcgagcagatcctggcccttgaggtgccggacggcaaaaaagcgacccgcctgtttgcgaccgatgaacacccgcgcgacaccccgcgtgaaaagctcgccacgctgcgtccggcgtttaaagccgacggcgtggtgacggcggccaactcatcgggcattaacgacggcgcggcggcgctggtgatgatgacccgccagcaggcggaaaaacgcggcttaaccccgcgcatgcgcattcgcggctgggcggtcgccggctgcggggcggagattatggggtttggtccctctcccgccacccgacgcctgatggaccgtctcaatatagatgtgcagtccattgatttaattgaactcaatgaggctttcgccgctcaggcgctggcggtgatgaacgatctgcgtctcgacccggcccgcgttaacgtcaacggcggcgcgatcgctctcggccacccggtaggcgccagcggtgcgatcctgccggtcaaactgatgtatgaaatggcgcgcagcggtgcacgcactggtctggtcaccatgtgcatcggcggcggccaggggatttctatgctgttcgagcgcgaaggcgcttagcaaaagacggcccgaagtggggcttcgggccgggcgtcgttcgggtcagcacccggcgacaacctgtgagctgacgaacgggatcgtctcgatcccggcaaggcttctgaccacgaatacggggaaataataaccatgtccgcaataaatgaaaaggcggtaaacgggacgcagctgcaacgcacccataaaaaaatctaccgccatttgatgccgctgcttatcgtggcgtacatcatcagctttattgatcgtaccaatattggcatggcgaaagcgaccatgtcggtggatatcggcctttccgcaaccgcattcggcctcggggccgggttgttttttctcacctacgcagtgctggagatccccagtaacctgtttctcacccggattggcgcacggcgctggatagctcgcatcatgattacctggggcatcctctcctgcggtatggcgtttgtcaccgggcctacgtccttttacgtgatgcgccttctgctcggcgccgccgaagcgggactctatccgggcattatttactacctcaccctctggtttggccgcgaagagcgcgcaaaagccaccggcctgttcctgctgggggtctgtctggccaatattatcggcgcgccgctgggcggattgttattaagccttgatggcatgtccggctggcacggctggcagtggatgttctttatcgaagggctgcctgcgatagcgctggcgttcgtcgtctggcgcagactgccggataaaccagccgacgcccgctggctggacagcgacgatgtgcaagccattaacgcggtactggcgaaagaagccgaggaaacgcgccatacgccgagccgtttctccctgaaaaacgcgctgtccacccgagtctttttgttgctggtgctgatttactttacccatcagttttcggtttacggcctgagttatttcctgccggggatcatcggtagctggggccagcttactccgctgcaggttggtctgctgaccgccatcccgtggattgccgccgccgcgggtgggatcctgctgccgcgattcgcccgcacggaacagcgttcccgcagcatgctgatggccggatatctggtcatggcgaccggcatggcgattggcgccattgccggccacggtgtggcgctgcttggcttctcgctggccgctttcatgttcttcgctatgcaatccatcatctttaactggctcccgtccatcatgagcgggcatatgctggcgggcagcttcggcctgctcaactgcctcgggctgtgcgggggctttctcgggccgtttattctcggcgcgtttgaggaccgcaccggtgcggcaacgtccggcttatggttcgctgtcgcgctactgattatcggcgcgctggtgtccctgtttctcaaaagttcctcatccccaggctccgtatcggcgaaacaggcccacggcgaaaaagtgtaatcaggaggccattatgcgcattgaagtgttactggatttaaaaacccgactcggcgaaagcccgctctgggatgtcgaacagcagcgtctttggtgggtggacagcctcgacgggcgcctgttcgcctgcaacgcgcagggcggcgcgatcaagagctgggacgtgcgacagaaaattggctctttcgccctgcgccagaacggcgaaggcgcggtggtggcgctgcagaatggcgttcatctgctcgacttcgccagcggcgagctgacgctgttgcaccatccggaagcggaccgaccctttaaccggctcaacgacggcaaagtcgatcgtcagggacgctttctgttcgggtcaatggatatgcgcgaagaggaaccgagcggcgcgctatatcgcctggaccccgatctgtccctgcacgtgctgaagaaagacattatcgtctctaacgccccctgctggagcccctccggcgagaccttctattttgccgatacctggacgggcgaaatctgcgcctgggactacaacaccgcgaccggcgatctttccggcgaacgggtcttttgccatgtcgatcgcagcgaaggcggcgcggcggacggcgccaccgtggacagcgaaggctatctgtggaacgcgctggtctacgcgggcaagctggtgcgctataccccggagggcaaggtcgatcgcatcattgagatgccggtgaaaaaagtgaccagcgtgatgttcggcggcgaaaaccttgatgtgctgtacgtcacctccatggcgcagccgcccctgccgcgcttcccggaagataatcagctgcgcggcagcctgttcgccatttacgacctgggcgtgaccggcgtagcggaacggcgcttcgccggctaaacgaaccaccggctcgccgcgataacaataatacccggcgaactgactctgaccctgacaccaggcggcgcgcatcatgctgtcgcgacgccgcggagtaaacacgactatgacaacaatcaatcacacacctgccggcgaacaacgtggcaaaaagcggctgatacatcgcttctcctgggtttcgctactggtttgctggctaatctgggtgcttaacgcctacgatcgcgagatgatcctgcgccttggcccggtcatctctaaggagttctcgctctcgccggaacagtggggcaatatcgtcgccctgatcatggtagcccttgcggtgctggatattcccggctccatctggagcgatcgctacgggtctggctggaaacgagcgcgctttcaggtaccgctggtgctgggctataccgcgctgtcttttatttccgggattaaagcgatcagccacgggctgacggcctttgtgctgctgcgcgtgggcgtcaaccttggggccggctggggcgaacccgtcggcgtcagcaacaccgcggagtggtggccgaaagagaagcgtggttttgcgctgggggtgcatcataccggctatccgattggcgcgctgctgagcggcgtggtggcaagcctggtgcttgccacgtttggcgaaggcagctggcgctactgcttcctgctggcgctgctcgtcgccatcccgctaatgatcttctgggcaaaatattctaccgccgaccgcatcaacacgctttatcagcatatcgacagccaggggttgacgcgcccggcgacgcaggaaagcagccatgtcgccaaaggcgaagggatgaagacctttttacgcaccctgcgcaaccgcaatatttcgctgacggcgggcaataccctgctgacgcaaatcgtctatatgggcattaacgttgtactgcccccgtatctttatcacgtctccggcctgtcgctggcggcgtccgccgggctgagtattatcttcacgcttaccggtaccctgggtcaggtaatctggccctggctgtcggatagctttggccgtaaacgaaccctgatcgtctgcggtctgtggatgagtatcggcattgcgctgttctatttcgccaccaatatgccgcgccttatcgccattcagctattttttggcctggtggccaacgccgtgtggcctatctactacgccatggcgtcggactccgccgaagaacgcgccacctctaccgctaacggaattataaccacggcgatgtttatcggcggcggcatttcgccattgcttatgggctggcttattcagtttggcggcggctgggaaaatccagcgggttatatctacgccttctttaccatggcgggatgtgcgctgctggggatgttattacagctcatgaccaccgataaaacgccgcgcaaagcgcattaacgcaggagaacgtatgaagattgttatcgcgctggattcgtttaaaggtagctgtagcgcgcaggccgcttgcgcagcggtagcccagggattgcgccgggttgaccagacgctggagctggtcgaaatgcccgtgtccgacggcggagagggactgctgtcgactctggcggatagtccgttgcttgagggggcgctgtggcaacagcagcgctgtacctcgccttatggcctctccctgcaggcggatttcctgatcctgcccggcgagcgggccattatcgagatggcgcaaagctgtgggctcgaactcacgccgccagcgcagcgggatgtgcgtcaggccagcagctacgggctgggcgaacaggtaaaggcggcgctggacgccgggtgtcggcatttgattatcggcctgggcggcagcgcgaccaacgatggcggcatcggttttgcccaggcgctcggcgcacgattctggcgtaaggacggcaccctgctgccggctcccgcggcaggtcaggacctggcgcatattcagcgcatcgatttgagcggtctggacccgcgtctacagcaaagcgaaatacaggcctcctgcgatgtcactaaccctctgcttggcgagcatggcgccacctgggtgtatggggcgcagaaaggcgcggacgaggcggcgctctgcgagctggaggcgggaatggcgcattatagccagctgcttacgcaaaccctcggattcgacgtcagcggacggcccggcgccggggccgcgggcggtatgggggctgcgcttatcgcctataccggcgccacgctgcgtccgggcattgacctggtgctggagctgcttaacgccgacgaccatcttcgcgatgccgcgctgacgatcgtgggtgaaggctggctcgatcggcagagcgcctttggtaaggccccggtgggcgtggcaggcaaagccgcacgccatggcgtgccggttgtggccctttgcggcgggcgtgatgagagcagccggcaattatatcaacaccatattgacgcaatgtggtctatttgccagcgccctatggcgctggcagagtcgatgaacacatgcgaaccgctcctcgccgacgccgcggagaatgttctacgaacctttctgagcgggtggcgcggagaggcacataagcggataactgtatgattattacaacagcgctggctaatgaaattgtcgcccgggcaatggcgataattcatcataacgtgaatgtcattgaccatcatggacagatcattgcctcaggtgaacggcatcgtatcggcgaacagcatgaagtcgcccgggaggtaatacgcaccgggaaacgcatttgtattaacaacgccgcggaagccgcgcgttttcacaacgtgcatcctggtattaatcatcccattatctatgacgatcgcgtggtgatggtggtaggcatcagcggcgatcccgcggcgataagccgctatgctgaactggcggtgctcaccgccgaactgctggtccgccaggccatagagatgcgggaaaccaactggcggcaacgtctgcgtgacaccttgttttgtcagtatcttgaacaaggggctacacccgccgggcaagaagcgcttcatcgcctgctggaacttggtttcgattttgatacaccgcgggttccgatcgtagtgaccgtgcaggtcgaacagcatcagttaagcgacatactgagtacgctgttgcgggaattctcgcagctctccggcgtaagtgacgttattttgctgggcagccatgaaatattgatcctcaacgcgctaagcgaagcccaggaaaccctgctgcggggcattgagtttgtactgagtaatcagataagccattaccatatcgggattggcgtgcaggcggacagcgccccggacattcgcgaggccattcggttcgcccgctcggtgatcgaagtgggtagcaaagtgcagccgcagcggcagatctactactttcgcgaaatggcaatgctctgcctgttcagggtgctggaagacagctatatggtcaatttttttatcaataacgtacgccagctgcttgagcatgattccggcgaagtgctgctggataccctgagcagctttattgccaataatgccgaaccgggcaaaacgtcgctgctgttggggattcatcgtaatacgctcacctatcggctgcagcaaattaaaaagcatatacagctcgatccgatggtcttcaccgacctgacgcagctggcggtgtcggtacactgttatcgccggctgaatccgcgccagagtgaatggattgatagcttaagctaacgtacgatagattcgaattgatgccccatccgccaggataagtggccaccatggccacttctttcctggcgtgggtaggaaactacgcttttgacgacggcgacagccactgatataccgcagacaaatcctctccggcatatcccgcgtccgccgcctgctgccacagttcggcgatgtattccagccccggcatggtgtgcggctcggccagggaaagcgccagccgggcatctttcagggcatgcgccagctgcatctgcggggtaaactgctcgctggcgatggcgtccagtttcactttgacatagggcgccgccagcgggccgccttccagggcgctccacagctggtcgggggtgaagcccagcgtcttcgccagctgggcgctctccgcgatgccctgcatcatcgaaatcagccaggcattgaggaccagcttcattttctggctgttgcccgcctcgccaaaccactgcgtcccgcgggagatagccgcaaacaccggttcggcagcggcgcccttttccctatctccgctggcaagcaccaggatctgtgccttctccgctggggctttggtccccgacaccggggcatcgatataggtcatcgctggctgaagttcccgcaacaacgcgatggcctgccgggtctccggcaggccaatggtgcccatctggcaatagatcgcctgcggctgacaggcgggcgcgatttgcgccagtacctcgagggtggcctcgccgtcggcgagcatactgatgatcacctcggcatcggccaccgcctgctgcggcgtggcgtgtagagataacccatgcgcctgtaaatcttcgccgcgggctggcgaacggttccagccggcaacggtaaagccgtttttcagcaggttactggcaaaagcgtgtcccatggcgccgagtcccagcaccgcgacctttggtaatgtactcatcttgtctgtcctgattcgcgtcttaataaaagcggacctctactatcgcatctctggcacggatgtcagtagcaataacgggcatgaaaagtgacactgtcactgatattctcaaggctgacgaagccattccagtaagcggcgcatcgctggcgacaggctggcgtcatcctggtagcacaggcacaaacggcgctgcgcccagcggtcctgtaacccgatgacggcaaacgaatagcgctgccggtaacgctcggcaataacgcgcggcaggatcgccccgccggcgccgtgcgccaccatctcgcaaagccctgcaaaatggctcatcctgacccgaacgtttagcacctggccgagttcagctgcgtgctgttcgatatgctgctgtagcgcactggtctgatagagggcgaccaacggctcgttgagcaccgccgcaaacgccacttcctctttttcggccagagggtgagctggcggcacgatcagcaccagcgggtcgtcagcgacgggatcgaggcgcagcggcccggggtcgaccgcatcggacaccactccggcctgcgccacgcccgccaggatacagctgacgatatccgcgctggtgcgttcttcggtttcgatctgcaccgccgggtgcgctgccatccaggcggcgagcttccccggcagaaaggccgacatcgccgaggtgttggcgaacaggcgcagcgtcccccgctgaccgcaggcgaaggcgtgcatcgcctggcgcagacgctgctgctgcgcaagaagcgggcgggcatggcgcgccagtacctccccggcctctgtcatcgtcaccccgcgggcatgacggtgcaacagcggcacgccgatctcggcctccatcttgcgcagcctctcactggcggacgccagggccagatgggcattcgccgctccgccggtgatactgccggtatccacgatggcgataaatagccgcagatcggccagatccagtcgcatcaggccctcctttcccttcggtttttccgtagtctatggccaacataccgcattgtggccctcacgaccagctgtttcaatgcccctttctaccctgaaaagtgagccataatgttcgatttacacacgatctctttcctgttgatctttattgccgccgggctggtcaaaggggtgaccggcatgggattgcccaccgtggcgatgggcctgcttggcctgctgatgccgccgcaggccgcagcggcgctgctggtgcttccctcgctgctcaccaatctctggcagttactggcaggcccggcgctggcgcagattgtacgccgtctctggcttatgatgaccgggattattattggcacgttggccgggtcctcactgctgatcggcctcaatcctcggtggtcggcgctggcgcttggcgccgcattgatagtttatgccgggtatgcgctctgcagtccggtgtttcaggtttccggccgcgtggagaagtggctgtcgccgctcatgggcgggctgaccggcgttatcaccggggcgaccggggtatttgttattccggccgttccctggctacaggcgctgggctttcgtcgcgacgagctggtgcaggccctggggttgtcgttcaccctttccactctggcgttggcggctggcctcgccctgcacgatggctggcatgatgatgcatggctattgtcggcgctggcgctgttgccggcgctgctcggcatgtggctgggacagcggatccgctcgcgtctcagcccgcagcgctttcgtcagggctttctgttgttcctgctggcgctggggatagagctgatcgcccggggatggctggtctgaatcctctagcggcgggtaatgtgcttcacattgtacttactggtgttctggtagatctctgagaaatcgacgatcgcccggttctgggcgtagctgatcgactgcacccgcagcaggaggctgtttggcgccacctgcagcagctccgcctgctcacgggtcgccagcaccggggtatagctgcggtggctctcgatgatggtgatatggcactcttttttgaaatagttgaacttagactgctcgaggttacccacgctgagccaggggaaggtggcgaatgggatatagctgttttccaccaggattgggacctcatcgatcagccgcagccgtctgacgtaatacactttctcccccggctggatctttaactgctgggcaatggctggcggggcatcaagcagggtaaattcaataactttgttacggtagttggtgacgcccaccacctgcatctggtagttaaagccctccagttccccgccatgatagttacttttacgcacaatgcaggttccgctgccgtgccgccgcgcgatcaacttttcttcctccagtagcgccagcgctttgcgcagcgtcatcaccgagaccttcagctccgcggcgagcgctttttcgctgggcagcatatcgccgacggcatagtcgtcgctgttgatgcgggccttcagttcagtggcaatctttttataaatcacttttagatgtctcgatggagtggcgccagtcaacggtagatatgaataacttcatgtaattaaatgattatttttatctttcggcgaaaaaatcaacaatgacacatctataaatcacgccatatttatatatctgtccagcaacaatatatatgactttcgtcacagatggcccttttcctgctcgggatcccgggggtctgctcctagtctgataagcctattcatcaggtgatgacagcggtctgcaaagacgagaggacaaccatgattggagtgaaaaagcttcaggacttttccaaggcgatgatcgggccggtgctgtatctgccagctatcggcctgttgatcgccctgttcagcatgacgaccaaccggctgtgggtggatgaaagcagcgggctctacctggtggggaaatttgtctccagtatgctctgggcgctgatgaaccatctagggtttctgttctgccttgggctggccagcggtctggcgaaaacccgcaaggccgaagcggccttcgtggcggccatgacctggctgatgtacctggcggcgaataatagctggctaaccctcacccatcgcctggcgaccggagccaccaacgcgcaactgtacggcagcggacaaacctttatcttcggttttcaggttatcgatatgggcgtattccttgggattatccttggctgcgctgtcgcctttgtccataatcgcgtggttgggattgagtttcgcggcgcgctgtcgatctacggcaacagtaagctggtgctgatcgtgatgctgccgctggttggcatgttcgccatcgccaccgtctatctctggccggtagtggagctgggcatatcggcgctgaccggctttatgaaatcctttggcgccatcggggtcttcctgtacggctttctcaaccggttcctgatccccaccgggctgcatcatctgatctggtcgccgttcgtttttacctctatcggcggtcagctgctgatcgatggtcagaccgtcattggcgctaagcctattttcctggccgaaatcgcccgccaccccgttgacgcgctcagtgattccgcccgtttcctcacctatgggatggtgaagatttttggcaccgccggcatggcgctcgccttctaccgtacggcgaaagcggagaataagcagcggttgaaagtcacgctgatccccttgattgttacctccgtcctggtggggatcaccgaaccttttgagtttctctttatcttcaccgccccattgctgtggcttatctactccctgctggacggttttttccagatgctggcctggctgcttcacgtcagggtctgcgccactaacggcctcatcgatttcgtcgtctataacctcccggcgggagtcagcgcgacgcgctggccggtgtttgtcgccctcggtctgctggaaaccgcgaccatgtacctggtcggcaccttctgtattacccgtctgcggctgctcaccccgggccgcgaaaccgcagccgaagatgagcattcgcaacaggctaatagcgagcatccggataaaggcgcgctggtgattgccgggctgggagggaaagagaatgtctgtgcggtgggcaactgttttacccgtctacgggttgatgtgcgggaccccgcccttatccagcagacgctgttgaaagagagcggcgggagcagcgtgctgattaaaggaaaccatgtccaggttatctatggcctgggagttaacaaaattcgaacggcggtcaacgccagtctgggtgttattgaataacgaggtggtaaatgaaagataattttgtggtcaccattgccggcggcggcagtacttatacccctgggattgtgatgatgttactggaaaatatgtcgcgctttcccctgcgggagatccgtctgtacgacaaccatcaccagcgtcagaagactatcggcgacgcctgcgccatcctggtggctgaacgcttcccacaggtgaagttcagctataccaccgatccgcaggcggcctttaccgacgtcgatttcgtgatggcgcatattcgcgttggcctgtatgagatgcgggaaaaggatgaaaagatcccgctgaaatatggcgtgccgggccaggagacctgtggtccgggtgggattgcctacggtatgcgctcgattgccggggtgctggagctggtcgattatatgcagcagtacgctccaggggcctggatgctcaactactccaacccggcggctatcgtcgcggaagcgacccgtcgcctgcggcccgacgcgcgcatcatcaacatctgcgatatgccggtggctatcgagggtctgttcgccgacatcctcggcctgccgtcgcgcaaagcgctgaacgttcgttactatggcctgaaccacttcggctggtggaccagcatcaccgataaagccggtaacgatttgatgccggcgctgaagcgtcacgtggcggagcagggatacagcagcccaaaagaagactttcagcataaggcgccgagttggatcgagacctttaaaaaggtgaaggatgtgtttgccctcgatccgacgacgctgcctaacacctatctgaaatactatctctacccggactatgaagtggcgcattccgacccggagtctacgcgggccaacgaggtgatggccggacgcgaaaaagaggtctttgatatggcccgggagatcacccgtcgcggcacggcggaaggcgcgcatttccatgccggggcccatgccacctttatcgtcgacctcgcctgcgccatcgcctttaacacccaggagcggatgctgttgatcgtcgagaacaacggagccatcgccaacttcgatgagacggcgatggtggaagtcccctgcctggtgggcgttaacggtccggaaccgctggcgatggggaaaatcccgtcattccagaaagggttgatggagcagcaggtggcagttgagaaactggtggttgacgcctggattgagggcagttaccagaaactgtggcaggccatcgccctgtcgaaaacggtgcccagcgcttcggtggcgaaagccatcctcgatgaactgatcgtcgccaacgaaggctactggcccgcactgcactgatctttttcgtgatgggtaagatgcagagaatccaccttctctgcatttttacccggtgtttcccccggtgatgcattcatccttaacctcctcccccgaaccgctcatttcccccttcagaccggaggtaaaaggcctctatcttcattttgccccgatcgtgacaatgaaatataaattctattcttcaatattatggcgtaaaaatgtgatctgcgtagtattcttcgatttacattaacccactgaaaacaacatcgttattacctcactgtaaatttaacctgcttttcatggggatatactccctttagcctttgtgattggcttcatgcatttaccattctgcaacactgatttgaaattaaattttcataatgtgatcttgttgcatgttcattccatttctttgtgccatattcttaccacggtaaatcgccggagcgacagcaacgtgccacaccagagcgctgttcatcggcaaatgtcgtcgcgactgacgcactaaagaccgctaacccgcaaaggagaacggatatcgactacatccatgtcaacaccaagccgtaaacctctttgaccgccattgcttagcgtaccctgccttgtgctgagcaattacacaaagaagaaaatcatttaattcagttagatacgacaacacaggcgtgataaatcctgactggggagatgtatttttatcttgtgtcgttcaacaaaataaagggactaccatgtcatttataacaaacctgaaccagcaacagagaaaacgacttcatcagatcaccttagtggccaccttcggcggcctgcttttcggttacgacaccggcgttatcaacggcgccttttcctcactgaagcagtacatggcgctgaccccaaccaccgaagggctggtaatgagcgttctgctggtcggcgccgcgctgggcagcgtgtttggcggcaaatttgccgattacttcggccggcgtaaatatttactctttctctcctttgtttttctcatcggcgcgttgctttccgccgcggcccccgatatcactaccctgctgattgcccgcgccctgctgggctatgccgtcggcggcgcttcggtcaccgcccccacgtttatttcagaagtggcgcctaccgagatgcgcggcaagctgaccggcctgaatgaagtcgccatcgtcattggccagctggcggcgtttgccatcaacgcgatcattggcatcatctggggccatctgccggacgtctggcgctatatgctgctggtacaagcgattccggccatctgcctgttcgttggcatgtggcgcgcgccggaaagcccgcgctggctgatcagcaaaaatcgtcatgatgaagcgctgcatatcctcaaacaaatccgcccggcggaacgcgcgcagaaggagtacgatgacatctctaccctgatcaaaattgaagctggtaataagtacagcgcccagagcacctttgcgacgatcgtcaaaacaccctggatcctcaaaattttgctggtcggcattacatgggccgcactgcagcaaaccaccggcgttaacgtcattatgtattacggtacggaaatcctgagtgccgccggtttctccgaacgaacctcgctgatctgcaacgtgctgaacggtgttttctccgtgggcggtatgctgatcggggtgctgttccttgtcgaccgcttcaaacgtaagacaatcatcatctacggtttcgccattatggcaaccctgcatctgattatcgccgctgtcgattacaccctggtgggtgacctgaaagctaccgccatctggctgctgggcgcgctgttcgtcggcgtgatgcagggctccatgggctttattacctgggtggtattagccgaactgttcccgctgaaattccgcggactgtcgatggggatctcggtatttttcatgtggatcatgaacgcggtggtcagctatctgttcccgctactgcaggcaaaactgggccttgggccagtcttctttatcttcgccgccattaactatttagccattcttttcgtggtctttgccctgcccgagacctccaataaatcgcttgagcagttagaagcagagctgtcagcaaaccatgaagataaaaaatccactcgtctcaccagggaggttggttatgatcgataacatcacgctggataatctgcatattggctgcaaagccagtaataaagcggaagtcatcgccatgatcggcgcggagtttaaagccaaaggctatgtcaatcaggaatgtgtccactttctgctggagcgtgaacatcaggtctcgacctttttaggcaatggcatcaccctgccgcatttgccgaaatccgcgacggatatcatccttaaaaccgggattgagatctatcagtttcctgatggcgtaatctgggatcggagcaatgtaatgtttattgccatcggcgtgatcgcgaaagagaaagagcatattgacgtactcaaggaaattgcctcgatatttagcgatgagctgatcgctaacgcactgtcattaatctccgacaaacatgatttcctgaaaattctgcagcataacgccttgccccattaagtatgacaccgaccggagctctggccccggtcggattttcacccctcgcccagcaaacatggcgaataatctgattctccccgttataacctcaatggtaataataaccagagaaaccaacgtattgctacttgcttgaagtacgcgcattagcgcaggcatctcataactaaaaaaccattaaaacaatgagttaaatattctccagggctactgaccctcaggtttattgcttgcgctgttagcaccgtacgccagtgattcctgcggtattccattagttttgatttatatcaatacctgttcgatcgttaaaatgcattttacagcgcgattattttagcagggtgaatacgacattggttttacgattgggatatttatttagccgacccgcaagtctgtggggatggctgatgtgtaatgcgtttaacggtattgcgattgtcctctgctttcgtggcataagcagcgtcaccggtttcagcgaggcgatctggcaggtcatcatcacgctggctattatcatatcgacctggtacagcgctaactattttgctgcgctggaagctcgacgcgataaacgacgctatctgctgctggcctgggtggtcatgaccattctgttgaattttattcaccttggcggtggttaacgccatttattaaaggatcataccatgacgctggcgatgctgttggtgcttatcagccaccataaagggctgacgctcttgctgatcgtaattattgcgctgctgtttattgcgctcactccgctggtcaaaaaactgttgagtcaccttcacgatcgttcctgaattttcttttatgaccgcctacagggggccttctcttcgtcatctccgtttatcccgccacccgctcccccagcatacagtttgtggcaacgccagaaaaagaaatgagaaccattatcataaaagctgtgctaacgtgtcagcccaacaataacgccagaagcaacaaaacagggggacagacgaggtgaagttgagttcagggagcatcacaacaggtcgtacgagcgggctgctgacgctggcgattggcgcactcttctacagcagcggcagtattgcccggccggatcttcagccgctggggccgaacattgcggataaagggtcggcgttttaccactttacgcaacgccagtatgactctgccgatggcgaacgtcactaccgggtatggaccgcagtgccggacaaagccccgcccgccgccggctatccggtactatatatgttggatggcaacgcggtgatggataaactcgacgacgcgtttctgcagcagctcttcgccggctccccgccggtgatcgtcgctatcggctaccagaccgcgctgccctttgataccgcagcccgcgcctgggattacaccccaccgctaaagacgcatgagcctcgcgccgggaaacccgcgctaccgccgcgtaaaaccggcggcaatgatgcttttcgccagctgctgaccgaaacgatggttccccagacggaagctaacctgaaaatagatccccaccagcgcgctatctggggccactcctacggcggattgtttgtgctcgacgcgtggaggaaggcttcgccgttcgggatctactattccgccagcccgtcgctaggtcaggccctgcaatcgcctttgcaggcaagccaaagtcttgatgccgtccgctttcgcgggaaatcgctgtacctactcgagggtgacggtaaagcccgtggagagccgtccgggcacgaggcctcgcttgaggtgttgcgtcaaacccaacagcagcttgccagtaaagggttgaccgtagccttctggcgctaccccggcctgacgcacggtcagatgttcgaggtctcgctgcgctcggcgctgctgcatctttccgggcaggcagcgcttgcgcatcaataacgcccttacgcccaccagcggagggtgggcgcatcagcgccggtcgggcaggtgtttgatatcgaccggctcgccgaacagaaatccctgcatctcgtcacatccctcctcttcgaggatctgcagttgtccagccgtttccaccccctcggcgataagcggcgtattgatcgaattgcccagcgaaataatggctcgcacgaatgagcgtacctgagggttgctctccacatctgtcataaagctgcggtcgagtttgatgacgtcgaaatgaaaatcgcgcagcatgctcagggaggagtaaccggtgccaaagtcatccagcgcaatactgatccccattttttgcagatgatgcagaacgctgaacgccagctgtttattgatcacaaacgccgtttcggtgacctcaaactccagcagactgaccgggtaggcggtacgcatcaggatctcgcggactttttcgataaagctacgatggcgcaactgcaccggagagatattgaccgaaacttttctgttcaaaccattttccagcgattcgttacacacctgctcgagcacccagtaacctaagggcacgatagcgccgctctcttcggcgatgggaataaacacgtccggcgggatcgtccccagctgcggatgctgccagcgcagcagcgcctcgtaaccggtgatgctacgatctttgatgttgcggatagcctgatagtggagcgaaaactccccggcgtgaataccgcgccggatatcggcggccatcatattgcgctgccgcgtcttgtcatccatttcacgttcataccagcaaatcttatggtcgaggctgctttttgcccgatacatagccagatcggaattgctcagtatcgtattaatatccgtgccgtcctccgggtagactgagatgccaatgctggcggagagcaccacttccgtcgcggcaaacgtctgcttaccgctgaagcagtgccacaggcgcgcagcaaaggcatccacttcaccctcatcggaaaaaggtttaacggccacaaactcatcgccgccgaagcgggcgaccatctcctccttctgcagcgttttgagcacggcgcccgccacgcgctgcagcagctggtcaccaatcagatggccctgcagatcgttaatctctttaaatttgtctaaatcgatcgtgaaaatggcaaagcggcgggcatcatttccagtgatcagcttctccacccgttcaaaaaactccacccgattgggtaaaccggttaacgcatcgtagcgcgccatccaggcgacgcggtcgttaatcgccttctgttcactaatgtcgcgggtaattttggcaaaacccagcagggtgttctgctcatcgcggatggtatcgatcatgacatgcgcccagaatcgggacccgtctttgcgataccgccagccttccccttcaaactgcccgctacgcagggcgatttccaggttttttgcgggtacaccggagagttgctcagcttcgctatagaagagaccgaagtagcgaccgatgatctcgtcgctcaggtacccttttgcccggcgggcgccctcattccagctaatgaccgtgccgtcggcgctcagcatatagatggcataatctttaacgctttcaataaagtggcgataggcaatatccgtcaggtgatcgttactcatggtacagcgctctctgtggctcggtcgtggcaaaacgcattagatatagcagaattacgcctattaagaatacaaggatatggccttttgttggcctctttctgacccggacaccgcagtaggcgcggcggacgctctcgttaagcgtagtggaccaggccgtccgaaggagtgatattccccgcgatttttgcacttaggtcgcccactaatagttacttttattgattaaaaagtttgattgaaagaataaataaaaggagtaatgttaataatactttctatggaggttaaatatgttgcgtgattatttaaaagtggaaaaagaagaccaacttgttgaacaacagagtcggcatgacaatagccagcattattcttcggtgaccgaatgggttattttaagtaaagatggccagcgcaaaggccgggtatccctgttcgaccgcttcaccacccgccgctcctggagcgacagtttccgcattacgcagttcgataatgcgggtaaagtggtggtggataaactcactgacgcgctgtaaatccttcggattcccggcctgacgggagaatattaatacgcaaaattaacacctgcataaaatatattgatgcgtcgccatcatgttattttctttctgcataccgataatctaatgggtaattttcgccatggtgcacagcgcgaatttttaacccgaaaaaatgctgaatataagcccgctggtcgggcttttttgcatggtgctcgccatctacgccacaaaatgccaaggacatcccgcgctggattgtatacgatgtatatacgaatcgttacggtatatatctatgggaatcgtcaaaatctccgatctgctgcacgatgatattcgtgatgccagcaaagccatgtcccgctccgtcaatgcccaggcggaatactggatccgtctgggcatgatgagcgaactctaccctgagcttaaccaccagcagatcaaactgctgatgctgaaatccggctctgaccgtctgctggaggtgatcaatgccatcaataatcattaaaaccgccgacgaactcgcccggcagcgccatgccggccagctgctggcgtcagtgtttgatatgctggatacttttatcgttcccggcgtaacgacgatggcgattaacgatcgagtggaagattttatcgttaaccagctgcacgcccgcccggccagcaaggggcaatacgattttccctatgtgttgaacacttccattaacgatgtggtgtgccacgggatccccaaagcgaccgaacatctgcgcgccgggatgattgttaacgtcgatatcaccctcgagaaagcgggcatgattgccgactccagtaagatgtacctgataggcgatgtctccccgctggcccgccggctggtaaagactacctatgaagcgatgtggaaaggcattgaggtggtgaagcctggcgcgacgctgggcgatattggccacgctattcagcgctgggtggaggaacatggctatagcgtggtcagagaatattgcggtcacggcgtcggtcaggaaatgcatgaggaaccgcaggtgctgcattacggccgccccggagaaggcgccgtgctgcaggaaggcatggtgttcaccattgagccgatggtcaaccagggcgacagccgtatcaaaaccaaaaaagatggctggacggtggttacccgcgataaaaaactctccgcgcaatgggagcacaccgtggccgtcaccgccaacggttttgaggtgctgacgttacgcgacgatgaacagtcggggatccgctgagttgcttccttttctctatgacggtgggccgctttccgatcccggagctcgcttgggcgccagacgacacctgattctgccgccgggcggcggcaataattgttttcatgaatgattttctgcgcgcgcgtctgcccgctggttatggctgatgcgcgcataaaccgcacaacggtttatcctttacctccttgcatcagcttactcttcattgcctttatcccgccttagcgatagcgaataatgacatccgcttcactatgctgcgcatttcgccagtgaatactgacctcaccacgattgtccggcatggcgtagcgaggacggttgtttgtcaaggcgacctgttccggtgaatggtgctggcacgagacatcgatacgatcgtgccggggggcgataacacaggccggattgatgacccgtcctgaaaaatgaacctggccggaaagcgcagcagacgacgccagcggcgccaggcacagacatagcagagcgagacggaatggagacatagcaatcttccttgataacgggtgacactgcgcggcacagcatcgtttctgtgccctacaacctgcggcttcctgccgtcactccacgctactgcaaaatagcggcagcgtaaatgattattccgggccacccggtcaactgccgggaataacagcaactttttcgtaaaatttgctcagaacagttatctcccggaaataatgcattatacgtatgggactctttttaatatttaatgagattatacttacaccaaaaaataaataatgttacagcttaacacatcttatcaatgggcctttacgatgttctccgtataatcccgcccccgacggtaatatacattagcgatgcttaccgtttttttgtgaacagaaataaaaaacatgctttaaaaatgttaaacgcttttgttaacttgtgattatttaataaggtttgagtatgaaagaaaaaggcaccctgctggttgttggttcactgctggccttaagtctggctactgtgaccaccgcccgcgcggcgggtacactgaatttcaccggtaaaattattaacgagtcctgccagatcaccaataacggtggcgatgttaatgtcgattttggcaacgtcgatatgtcggcgctgaaatcccatgaagcgaaaaccgcagaaacgccgttcactatcaacctcaccggttgcccactggcgcagaacatcagtatcagcctggaaggtactccggacaccaacgctaacggcaccagcgccgccgtgctggcgctctctgacgccgcggataccgccaaaggggtgggcattgaagtcttctcttcccctgacggctcaacggaaggcactcagctgacctttgacaagcagagcaaaacggcggtttcgcaagccgacgaaaacggtgatattgcatttaactttattgccgatctgaagagcgattcctcacaggatgtcaccgccggcaatattaatgccacggccaatattgatattgtgtacgaatagaatgtcctgattgccacttttccaagggcagcgtccccctgcccttattctcattcctcgtgaccggatcctcaattatgcagtgttataaagcggcttttatcctgagccttctcttttgcccgttcctggcgtctgccgccggggttgccattgccggcacacgtgtcatttataatgaacaaagccatgaggcagacatcacggtaaaaaacaccaatcctcacgatccggtgcttattcagagctgggtagacgatctggctgataataataaatcaccgtttatcgtcaccccaccattgttccgtctggatgccggagacagcaacgatctgcgcgtgttattaacctcggcgcaactgccaaacgatcgggaaagtttgttcaccctgaatatcaaagtgatccctgccaataccgcgccggctggcgagaacattctgcaatttgctattaagaatcaactgaagctcatttatcgcccggcagggctccctggctcggcgctcgacgcggcgcagcacctgcgctggcgggtcagcgacaaccacctgcaggcggagaatgcctccccctattatgtgactatcaccacgctcacctgcgcgggccagaaccagaaaacgccgcttgagcgcagcgtgattgctcctcacagccgtgaagagtattccctacccggcgaggcctgcgcccgcgaggtgagctggcgcattctggatgactttggcgctgtgcagacgtttagcgcccccgtttcggcgcactaagcgtctgatgtcgcgatgcgccacggcccggctcataccgttaccatcgtcagcctctccatcctgctgggcggacagagcgcgctcttgcacgcccaggcgacctttaatatggatctgctggagaaaaacgaccatttgccggcagtggatctgcaacgcttcaatcagcaggcgggccagccgccaggcgactatccggtgagctggcaggtcaacggcgtcacgctggacgcccgtaagaccgtcacgtttcgccagaacgatcgcggacagctcacgccctgccttaagccggaagatctgctgcaggccggagttaacccggccgtgctgtcccaggcgcccggcgcaacgtcccgctcatgtcccgaactcaacgcgctgctgccgggcagcacggtcaatttcgattttgctcatcagcggctggtaatgaccattcctcaggcgctgatgacgcaccgggcgagggataatgttccctctgcgctgtgggacgaaggtattagcgcctttcagagtaactatcgttattcaggcgccagccagcgtacccgcgagggcagcaccgagcgcgataactatctgatgttgaaaagcggcgtgaacgtcggcgcctggcgcctgcgcgccagcaatagcctgaccgccaacagcgatgataagccccagtggacgaccagcggcgcctggcttgagcgcgacctgacgcgctggcagagtgaactgaccctcggggataccttcacgtcgggcgatgtgtttgacgcggtacagtttcagggaatatccctcgcctccagcgatgcgatgctcccggactcgcagaaaggttttgccccgaccatccgcgggattgccagaaccaacgcccaggtcacggttcggcaaaatggctacgtgctgtatcaaacctacgtcacccccggcgcgttcgtgattgacgatctttatcccaccgccagcagcggcaatcttgaggttgccgtcaaagagtcggatggcgaaatccgccgcttcacccagccgtatgcttcggtgaccagcatgcagcgcgaaggcagcctgaaatacaacctggtcgccgggcgctaccatagcgacgatgccagccagcggccgttgatgatgcagctgtcgctgatgcgcgggttcgcccacaacctgacgctgtttggcggactgcagagcgcggcgcaataccataacctctcgctcggcgcaggacaggggttgggagaagccggggcgctctcgctgcagctgttaaacgcccgcgaccggcaccagcaggatccgatcgatggccgggcctggcagctccagtacagcaaaggttttgatcgtcttggcacgcagttgactttcaccggctggcgttattcgcatcagcgctatgccacgctgagcgaggcgttttccagcccgggtagcgacgacgacctgcaggatagcgacaacaaaaaagcaaccctgcaaatcaccgccagccagagcctgccgtacgatatcaccctctatctgagtctcgaccaggacagctactggtcagggggcgccacacagcgtaccgccaatatggggatcagcagccaggttcacggtatcgcgtggtcgctcagctacagcgactcccgcagcagccacggtgacgaggaggatgacgagccgcattccgacaaagtggtgacgttgtcactttccgtgccgttgagccacctgctgccggggagctatgccggctataccctgacctcctcccgccacagcgttggcagtcagatggtcagcctcaacggcacattgctggacaatcacgcgcttagctacgccgtcagccaaacccgcgatcggcaaaacgggtccagcggcagcctgacggccgggtacagcagtggaaggggcgatctgaatctcggctacagccacgattcgcaggccgctcgtctgaactacggcgccagcgggggcattctgattcaccgccacggggtagtctttacgccggaaatgaatggcgctgtcgtcctgattgacgccggtggcgccgggggtgtgaccctcgccaaccagaaaaccatcgccaccaatggtgacgggtacgccgtgctgcccttcgccaccgcctatcaccgcaacgacgtctctctcgacagccattcgctgccggagaatgtggatctggccaacagcaccgtgacgctggtccctaccaaagacgcggtggttctggcgcgctttcacacccacgttggctataaggcgctgtttacgctgcagtcgcggggacaaccgctgccctttggcagcgaagtacgcgccaaagacaccaacagcatcgttgccagcgagggtcaggtgtacctggccggcctggcgccaaaaggcaccctttatgcgcaatgggggccgggccctcagcagcgctgtagcgcccgctacgatctcaccccgacgctggcgcagaccccccatccactcattttacagcagacgttatcatgtcctttttaactctcctgcgtcgggtcgccctgacgctgttatttattctgttaccggccgccagcggatgggcctgtacgccagtgtttgtccgcggccaggcctccacccttcggctgaacgtggggcagctcacggttccggctgacgccagacccggcaccccgctgtatcataaaagtttcgcctggaaccgccttagcgacggcggcgaacagtggatccgctgcgcggacgatccgcacgggttgtcgccgctgctgctggacagtctgctgtccgggggagtgacgcgaccgacggtttatcaaactaacctcgccggcattggcgttcgcgtatcgctgcgcgctatcggcggctatggcggctttcctgaccggccgacgccctcgccgtttagccaacgggtggacaatcccgccgccttgcccgatgcggtgtggaaactgggctatttccgcctgacgattgagctcattaaaaccggtcccgcggcgacgccgggcgagcttgagtatcacagcgagcgctttttaatggcggagcataccccgctggccgcgttagacttaaccggcaggatcagcaccgcgggatgttcagtgaatgacgccacgccagccctgatcaagctccctgcggcgatgcttgaccacttcggcggcgtcggcaaaaccaccggcgacacccctttcgcgctgcagctggattgcaacagcgcggtcacgattttcctgcgagttgacggcgcggagcccctctccgcccgggggcatggcgttctgcgcaatgacgccaccgacgatcgggcgcagggtattggcgtgcagttgctttaccatcgcctgccggtttccctgaatcatgagatgacgctgggcagcgcgagcgcgggccggtttaccctgccgctcactgcccgctactaccagacacgttcccggatcaccgccggtcaggtgtcggccgtcgcgacctataccttgcattatgactaggcgatggcgaaccgacggatgaagcggatgaaggaattgctctgaccggcgaatcgtaagagaatagcgcctacacgcgacgatctgagtacacgggagttcatcatcagccattctcgtcgattccccttagccagcaaagtggcgctggcaggcgcggcgctcatcgccgctggcatgctgttcagctgcaccagtaaagcccctaaatcccttgtcacgccgccgaacgctgccgccgtcaaagccgggcaggcgcaccgggagccggtgcgcggcgtgtggctcaccaccgtttcgcgccttgactggccgccggtcgggtcgattatcgccagcacgccggagagtcgcatcacgcagcagaagctggcgctgatcgctaaactcgataacctgcagcgcctggggatcaacaccgtctttttccaggtgaaaccggacggtacggcgctctggcggtcggatattctgccgtggtccgatatgctgaccggcaaaatcggcgaataccctggctacgatccgctgcagtttatgctggatgaagcgcacaagcgcggcatgaaggttcacgcgtggtttaatccctaccgcgtctcggtcaacaccaaaccgtcgacgattgccgagctgaacaacacccttactcaggtaccggccagcgtgttcgtcctgcaccgtaactggatccgcaccgccagcgatcgctttgttctcgacccgggcattcccgaagcacgggactggatcaccagcatcgtcgctgaagtggtgcagaactacccgattgacggcgtgcagttcgacgactatttctataccgaaaccgcctcttccccgcttaacgacaacgagactttccgccgttacgggcagggctatgcctcgaagggcgactggcggcggcataacacccagcagctcatagcccaggtttccactactatcaaaaagctcaatccgaacgtcgagtttggcgtgagcccggcgggggtgtggcgcaaccgctcccacgatccggcggggtccgatacccgtggcgcggccgcctatgatgagtcctatgccgatacccgcagctgggtgcagcagggactgctcgactacatcgcgccgcagatctactggccgtttgcccgcgatgccgcgcgctatgatgtgctggccaactggtgggccgaggtggttaaaccgacgcatacccggctgtatatcggcgtggcgctgtacaaggtgggtgaaccgtccaaaaatgagcctgactggacggtggacggcggcgtgccggagctgaaaaagcagctcgatctcaatgagactctgccgcagatccagggcaccatcctgttccgcgaaaacaacctcaatcagccgcaaacccggcaggcggttaactatttgcgcagccgctgggggcagccgcagagctagccgccagccggctctgctatagcgcctgcagcccttgctgcaggcgggcgtgcagcttcagcatgttctctgtaatggcctgccagacgtggctggaaaagtccgccggcagcgtccggcgagcgctttcgattgcctgcggcacatgcccggcaaactcctggaggatcgccagcatctgctcccggggaaagttcaccgctttggccgtcgccagaaaatgacgcggatagatggcgttaatctctgttttacgcccttttgtggcattgagccccatcgacagcttcagatcgcgcagatgcagtcccgtgccgcccagcaccggaaacgccgaaataatgtcgtagaacggtgttaagcggtagctgccgccgggcaacaggtaaattgagaagttttttgcgtgaccgtccgtcgcccccgtcagccactggaagaccatgaacttcataaagtcatagcgatctttcagcgcttcactcgagcccagcagaaaggtcatgatcgcggcgatacccggcccgccgtcagactcatatttcatcgctgaaggaagaccaaaagcctgacacagatcctcctgcggcagacgcagcagcacccgtccctcctgcgcccagcgccggtcgaagcgggttaccgccagggcgcggatccgcggggtggtgatgatctccgcttccggcaccgccaggcccagttctctggccagcgccaggcacagaaactcattatccacgctttcacgcagatccagcgtcgcattgggctgcttgatctcgccgatgggcagcttaatgatatgcgtggtcggcgtggcgccctgcggaatacaccactgctcgcccatccgcagcagcgccgttttctcctgggcgccggccaccgagatacggaaatcgtcctggctggtaatcatcccgagggggatatccgactggtaagcggtcagcaaagcggtgagctgcgcctcgtccagcgtctgccagcgtaatccttccaggtgcgcctcttcccccggcggcaggagggtcaccgcccctacgctatcccgcccgacttcggccagcagatcgaacggctgcttcgagcgcgcctgatagcgcctgacgatccggtcgcggacctgcgggctgtcgggcagcaggttatcaaaatagtgatacaccgcgtcggcagtgatattgccatactgcagcggcagtgagagggagagcggtctggcgcgcgggctgcgcagccactcttcgtcatagcgaaaactgtgcgccccgttagcctggcgggttaaggttcccacgcgcacattgttcatccaggtggtaagcgtcgccattaccagtcaaggtccgtgttgttatcgggagccggcgccgtctcagcagctttggcgttcagcgtcatcaccacccccagcgactggaggatcttaaacagcgtggttaaggtggttttgtcggggtgattttcaaaattggacagcgtggcctgcttaatgccgatccgcctggccagcgcatcctgggtccagtggttctgctggcgcagcagcttcaggtaattggccagctgcacgggactgtatatctgcggggaattcatcgccttgttcctcaccatcatttatccccctgtcgggataaaattggttttataccctataggggataatgtcaaggatatcccctggtggggataggagaataattatccttgtgtggggataaaacaggaaggatgatcgccggagccacctgtacatgcccggtggcggctgcgccttaccgggcctacgggctgtctctacccgctccgttacgatccaggccgggcaagcgcagcgccgcccggcagcgggcagccggcttagctgccgcggtaggtcgaccacccgcccggggcgatgagaaacggcagatggaaatggtcctctgccgcctcgccgataacaaaatcaatctgagcccgggtaaagacgctctcgcgcccggcgcgggcaaaccacgccccggtttccgctgttaagcaatagcgccccgccggcagcggcgcggcgctaaaggtggcgatacgcccctgggcgttggtcaccaggttcgccagcgtctcgccctcccggctcaggctgaccgttacgccttctgccggcgtaccggtggaaatatccagaatatgggtgctcagggtgctcattcgccaatcactccttccagtcttaacatcgtaatctctcgcagctgggcaagcgcctcggccacttcttcgtcggcggtatgctgcagccggcgcgtcagcgcctgcagaatctcttcgccgctgcgccctttggcgcggattaaaaacacccggccaaagcgggcttcgtagcgggcattgccctcccgcagggcctgcgcgagccgctcattctcgctgtccaccgacgactgctcctggcgcgacagcgccgcgtgcgcctggctgccggtcggcttctcaccgatccgcggatgggcgctgagcgccgcgttcagctcgtcctctccccagttagccatcgccttacgggcgacctgcagcagcgcatggcggctggcgaaaggtcgcaagcttaccagcatctcgctccaggccgggatcgccacgcagggagccaacagcctcgccgcctcatcttcacataggctgttaaactgattcagcgcgagcatcctgactccttaacgatttcgtcgccgcctgctcctgcggcagaataaggttcagcgctatcgctaccagcccaccgctggtggccgccgaaccgaacagatcgccgaccatcggcggaaaatggctgagaaacgccggcaccgactccacgccaagacccgcgccaaacgccagccccacgatcagcacatcgcgacggctcagcggggtctgggtaataatccggatcccggccgccaccacgcagccaaacatcaccatcgtggcgccccccagcaccggcgccgggatctgccgcagcagttcgcccaccgggggaaacagcccgagcaggatcagaatcacgccaatgtagcgtccgacatagcggctggccaccccggtcatctggatcacgccgttgttctgcgcgaaggtggtgttcggaaaagcacagagcatggccgccaccatacagctgacgccatccgccaggataccgcccttcagccggttacggaaagcgcgatcgtcaacagactgttgcgaaatcagcgagttggccgtcagatcgcccaccgcctccagaatacagaccagcgacaccagggcgaccggcagaaatatcgcgctgttaaactgaaagccgaacggaaacagcgtcggcaggcgaaacagggtgtcgcccaggctgtgaagatggaactgaccgctcagccccgctgcgatgcagcccacggcaatgcccaccaccaccgaggagagccgcagccagcggtttttggcgcagctcagcaggacgataaccccgagggtgcccgccccgagcgcgatattgctcatgctggcgaaatcctcggccttttccccaccgcaccagttgatgacgctgaccttgatcaggctgatgccgatcagcgcaatcacgctgccggtaatgatgggagtaaagattttcttcagcggttcgataaagcggctgacaatcaccggcaccagagcggcgacaaagttaacgccaaacagcatcgccatcatatcctgcggcccgccgccctgggcttttacccacatccctccggccaccgtcacgccgagaaaggcaaaactggtgccctgcatgcagatcatcccggcgccgatgccccatacccgattggactgcagaaaagtgccgatgcccgaggccagcagcgacatactgatgagatacggcagccagtcgccaagcccgagggtagcgccgatgatcagcggcggcgtgatgatccccaccaggcccgccagcacatgctggagagcgctgaaaaaggccggaagcggtgggatccgctgttcaaggccgtaaagcaggccactgtgatgttcgtcagacatagtgatatcccgtagcaaagagaagtgcatgggctagtgcacaaagcaggccagagacgacaaaagggcaccaataaatttattatcactccaaaatcatcaacttagattacgctcgtgatgcatcacccctctccgctgctgaaccaggcgcctgaaacgatagattcttaatgcaacatacagaaacttttgattcataaaaaggcaaccaatacctcacattgcaccgatgcggtgcgtcatgagccatcgctgtgcctcaggcaggcggttttcctccctccggcgaattggtacgcaaattgctgtagtcagtcacaacatcgggagaaggagaaaaaaatgaaagcaatcgtgattggcgccggcatcggcggtttaagcgcggcagtggcgctcaaacagtcggggatcgactgcgacgtctatgaagcggtgaaagagatcaaaccggtcggcgcagcgatttccgtgtggcccaacggcgtgaagtgcatggcccacctcggcatgggcgacatcatggagaccttcggcgggccgctgcgccggatggcgtatcgtgatttccgcagcggcgagaacatgacccagttcagtctcgccccgctgatcgaacgcaccggcagccgcccctgcccggtctcccgggcagaactgcagcgggaaatgctggattactggggacgggacagcgtgcagttcggcaaacgcgtcacccgcggtgaagaagacgccgacggcgtgacggtatggtttaccgacggcagcagcgccagcggcgatctgctgattgccgccgacggcagccattccgcactgcgtccgtgggtgctgggctttaccccgcagcgccgctacgccggctacgtcaactggaacggtctggtggagatagatgaagcgctggcccccggcgatcagtggaccacctttgtcggcgaaggcaagcgcgtctcgctgatgccggtctccgccggccggttctactttttctttgatgtgccgcttccggcgggtctggcggaggatcgtgacaccctgcgcgctgacctcagccgctactttgccggctgggcgccgccggtgcagaagctgatcgccgccctcgacccgcagactaccaaccgcattgaaatccatgatatcgaacctttcagccgcctggtgcgcggccgcgtcgcgctgctcggcgatgccggacacagcaccaccccggatattggccagggaggctgcgcggcgatggaagatgcagtggtgctgggcgccgttttccgccagacccgagatattgcggccgccctgcgcgagtatgaagcccagcgctgcgaccgggttcgtgacctggtgctgaaggcgcgcaagcggtgcgatattacccatgggaaggatatgcagctcaccgaagcctggtaccaggagctgcgtgaggagaccggggagcgcattatcaacggcatgtgcgacaccatcctcagcgggccgctgggctgaccgtcgccatggattcgatcaccgcactcagcgtctgaatggccatttgcgcgggccgcgaaagctgacgcgagggcgcagtacacagcgccagggtcagcggtcgcaacagcgtactgcgcagcgggacaaaggccagctgtccacgctggacctcgtccagcacgtcgagcaggctaaggagcgtcacgccgctgccgcgtagcaccaacgacttgataagccggatatcattgcagctgatggtattctccggcgcaaagtcatggtggcgatagaggagcgccacccgctcatggacgatcagcggcgcgccgggcacgatatgccgctccaggctgagctcgcccaaagacagcgccttcgcccccgccaggggatggtccggacgcatcacaatccccacctccagttcggcaaaggccagcacgctgagtccagcctgcccctgcggatcgaggatcaggccgacgtccaggtccgcctgacgcactttctggctgacggtgtggctgtcagccacctgcagatccagctccagccacggccagctggcgatgatctccgccagcgcggcggcgaaacccccttccgccagcgcctgcaccatgccaacgctaacgcttccgcgcttcatcccctgcagctcatcgaatttctgccgcgtctggcgaaactccttttgccagcgcagcaggttgtcatacagcaactcaccggcggtggtcatccgcagtccctccggcaggcgctcgaacagcggggtgccgaaggcctcctcagcctgcaggatctggcggttaatcgccgaggcggaaatatgcaactgctcggcggcccggcgcaggctgccgcagcgggccacggcgatgaaatagtgcgcgaaacgggaaaatggactcatggcgcccctgtactcttttttgcaacagcagagtgaattaatggtgatggatgtgaacaccctaatatgacaacaataatctcacaacaataaaacaatcaccgatgtgagcaggaagagaaatcatgaagacaaccacccccacgccccccgcccattgcacctttgatccagaggactggctgcggctggcccgctgctggcacccggtggcccgcgcctgcgatattgccggcgccccggtgaaagccaccctgctggacgaacagctggttatctatcgtattaaaggccaggtggtggtcgcccgcgacgtctgcccgcaccgcggggtgccgctgaccctgggatttcatgaagaggaaggcatcgtctgcccctatcatggcctgcgctttggcgaggatggccgctgcaaccgcatcccctccagtccggggcaacccattccggccaaactgcatctcaccagcttcgccgtggaggagcgctacgggctgatctggacctgcctggcctgcgatccggacaatccgccgccgttaccgaccatgccgcactgggacgacgcgggatttcagcaaatcaactgcccggccttcgaggtgaagggatttgccggccgccaggtcgaaggctttctcgatgtcgcccacttcgcgtggatccacaccgacaccttcgccgatccggacaaccagcaggtgccggactataccccgcaggagacgccgttcggctttgttgccgactactggagctcggtgggcaattacccggccagctccgatttccgcgcgccggaagggttccagtggctgcgtcactttgaaatgcatctgccgttcaccgctacgctgaccatccattttcccgccgacgccaggctggtgatcatgaacgccgcctcgccggtgtcgtcccgggtgacgcggatgtttgcccctattgcccgcaacttcgatctgcacgtgccggtggaagacgtacatgcgttcaacctgcgggtatttgaagaggaccgcctgatggtcgagacccagcgtccggaacggttgccgctggatctgaccctggaggcgcatattccggcggaccgcagctctatcgcctaccggcgcgggctgaagaagatgggctttggcgatttctttctggtatgggtggaggtcatatgcgcgacatactcccggtggtggtcgatggcctgtggcgccagggcgcgaaaaatctggccgttcgtctggtgagcgccgaggggcaaccgctgccggcgtggacgcccggcgcccatatcgatctccatcttccctgcgggctgatccgtcagtactccctgaccggcaacccggccgaacgggatcgctatctgctctgcatcgcccgcgagtcgcagtctcgcggtggctcccgttatattcatgacaccctgcgcccgggacagccattgatgatctctgccccgcgcaaccactttccgctgcacgagggcggccatgtggtgcttctcgccgcagggatcggcattacgccgctgctggcgatggcccacgcccgggcggcgtccggcgccagctttacgctgcactattacgttagccgtgcgcaggaggccgccttcgccaccgagatcgcccgccagctagcgggtggaatctgccagatccactgctcagacgaggggcagagtccgcgccagcggctggcgcaggatctgggggctccggacgccgacacccgggtctacttctgcggtccgcccggatttatggcccgggttcgcgataccgcgcgggcggccggatgggaggaggcgcaattgcacagcgaagcgttccagccgcccgccccgacggcggcgtcggcggcggacggaaccttcaccatcaccctcgcctccaccggggagcgctggccggtgccgggggacaaaaccatcgcccaggtgctgcaggaacatggcgtcgcggtgccgctctcctgcgagatggggatctgcggcgcctgcctgacgccggtacgcgagggaaccgtcgaccaccgggataccgtgcagtcggaggcggaaaaacaggccgcagagcagcatattgcgctgtgctgctcccgcggcctgtcggccaatttagttatcgatctcgcgggataagcggcccgtcaccggctggtcggcgcgggcgaccggtttcacccgtacggcggcgaaaacaatcaccatcgcgcccaacagcagcagaccgctgccggtgaagacgccgctggcgccgtgcaaatcaaacaccgccccgccgccggcggccccggcgctgatggccagctgaatagaggcgaccagcagaccgcccgcgctttctgcttcatccggcacggtggtagcaagccaggtggaccaggccaccggcaccaggccgaaggcaaatccccacagggcgaccagcagcccggccagcacggtcagatggccaaacgtcaccatcagcagcgccagaacgctcatcatcaacggcaccagcgccagggtgagacgcaggctacggctcagcagatagctcgccaccgaagtgccgataaagttagcgataccgaagccgagcaatatcagcgaaaccccttcgacactggcctgcgcgacggtctcaaggaacggccgcaggtaggtaaagaaggcgaaatggccgctgaaaatcaggatcgtcgccagcatgccgcccagcataccgggacggcgcagcactctgaacagcgtggagaaggtcccgacgctctccgggcgcatggagggcagcacccacagctgccagagcagcgccagcaggctgggtatcgcacagagaataaacacgttgcgccagccgatcagctccccgaggtagctgccgagcggcgcggccaccaccgtggcgacagacaccgcggaaaagatgatcgccagcgcctttggcacatgggccgccggcaccagacgcatcgccgtggcggtggacatcgcccagaagccgccgatggcgatccccaacagcagacggcccagcaggagaaacgccagcgaatcggcaaaagcgaccatcaggctggagactatctgcagtacggaaaagaacatcagcacccagcggcgatcgatattgcgggtggcggtggcgatcagcaggccggtaactaacgccaccagcgccgtcgcggtgaccgcctgtccggccatcccttcactgacgccgaggctgctggccatcggcgttaacaggctggcgggcagaaactcggccacgatcaggccgaacaccccgagggccagggcatagacggcgcgccaggcaggtttggcgggagacaggctctcgtcagcagctatgcaggaactcatatacaactctccaggtttattaacatcctggtcatcttagggacttactttcggacgatatatgatgcatactcttcagttattgattattcgtccggaattgccatgagccagcctgccatcgacctgaccagcgaactgttgcgcggtatgcgcctctccggcgttaactaccggcgcatcgaaaccgcacgcccgttcggcgtcggctttagcgccgtggcgggtaaagcccagttccatttcatcagccgcgggccggtgctgctgcgcatggccagcggagaacagttcaccctcgagagcggcgatgcgctgtttattcccaacggcgacgggcatgccctgctctcggatccgcaggccacggtggtcaatgtggcgcagctgcccagcgaaacggtgtgcagcacggtaagttgtatcaacgctggcgaccagcctgactgcccggagcgcgccgttattttcagcggttgtatggactttgagctcggcggcatgcagccgctggtcaaggccatgcccgaggtgatgcgggtcagcagcctgcttaatacctggccggagatccagccgctgctggcggcgatggagcgggaatccctcacccgccaggcaggctatgccgggatcctcgcccggctggcggacgtggtggccgcgctgattgtccgcggctgggtagcgtgcgggtgcggcaacgccaccggctgggtacaggtcctgcgcgatccccggctggcgaaagcgatctacgccatgcatcagcgcccgggagtcaactggaaagtggaagatctggcgcgggaggcgggtctttcacgctcgctgttcgcggaacgttttctcgccgccaccggcaccacccccgcccgctatctcaccgagctgcgtatgcggctagcggtgcagtacatcacccatgaaggccaggcgctggaaaaagtcgccttcagcctcgggtatcaatcgctggcggccttcagccgggctttcaaacgcatcaccggccagccgccgggggccctgcgcgccacggcacgctagagtcagcctttatgtaaagcgatacacgccgttgccgacacgaaagcgctgccccttaagcgccgggttggcgacgcggaacaccagttcggtcagctggttggcagccccttcacggaagataaattgctggccgcccacgtccagtccctgctcccccaggggcggaaagcccagcagcgcctgccagcgatcgcgcaccgcctgcggattgaccacctcgaacaccgcctgctcaagcgtaatgtcgcccagcggatgcggcgcgtccagcctctgggcgcgcagccgcgtcagccgggtggcgtcgtcttctccccactgcagcacaaagggatagaccagcccggcagtgtcgccatcgatggtgaagatccgccagcggatgatattgccctgcggatcgttgcgctggccatcgacaatcggtgacactgtcacccctgtgcgacgcaactggtcatgggtggcgtcgatgtcgtcgctgcgcagcgccacccgaaacagcgcctcattctccggcagcagccgtgcggcgtcgcgcgaaaggaggaatttgtccgtcgcggcgcgcagttcgtccgggtcggcaatggcgaggaattcgatatacgtcaggccaaaatagctcagcgcattacgggttccccaccccggatggcgcccaccggccaccgcccgcagctgctgcccggcaaagatttcaatcgccgcttccggctgattcacaaactgtactgcgtggtcccactgcaaggttgccatgatctctcccgcgattgtgcctggtcaggcgcctgcggcaaaagatagtgctggggtgaagggaatggcaaacaagaattaaatatatcgaaagcaggataagtgatttatatcaacgcggtatgtcgcatctgacaggcgatgaaacggcgggcaaagaaccgcccgccgcggggtcagaccgacccttctttctcaatcaccagaatacgcgccgccccctgcgggtgagcgacatgctcgcatcccaccccggcgtagaagatatcgccggcgtttagcatgatgatctgctcctcgccgtcgactttcacatgcatcgccacctgaccatccatcacggcaaacacctcctgaccatcattgatgtgccagatatagggttggtcggtccagtgtagacgcacggtggtgccggaaaaattggcaatatccagcgcgccccacgcgcggtcggcggtgaaatctttactgctccagctctgcatgatggtgtcctgtggtaagggttattttttctgccagtttgcccagggatccgctttctccaccggcgcgtcatcatcaagggaggcgagatacatagcctccacctctttgcgcgcccacggcgtccggcggagaaatttgaggctggacttaatgctgggatcgcttttaaagcagttaatgttgacctggcgggccatttccgcccaaccatagcgcgccaccagggaattgagcagcgcttccagcgtcacgccgtgcaggggatctttcgagctgtgcattacgatacgtccgttccgcattaaaaagtgcgcctaccttactggctctcaccgacgggcgcaacagacttcattacgcgcttcgcgcctatatctatttaacgcaaaagcactgaaccccgcgcggtcataaattagaaaataacgttattggttgcttatttggccttgaggcaagctgtgttcagccccggacagaggaaatcaccatgcgctgctgttgtgcccgaacccagaacctgaatctacccataacttattaccccgttttcggagaacacaatgaacgcgaccaccctgccgattctcgacctggcccgctacgcggaccccgcggataaagcggccttcctggccgacctgcgtcatgccgcccgcgacatcggcttcttctatttgatcaaccacggtgtcgacgacgcgcttcaatatgaagttcagcgccagtcccagcgcttttttgctctcgatgaggcgcaaaaacagcaggtggcgatgatccactccccccattttcgcggctataaccgcgcggcctctgagctgacgcgcggccagcctgactggcgagaacagtttgatatcggcgccgaacgtccggcgctgaccctcagcgacgacgccccgcgctggcagcggctgcagggtccgaatctgtggcctgccgccctgccgtcgcttaaaccggtattacttcactggcaacagcaaatgacccaggtgggcatccgcctgctgcgcgcctttgccgaagccctgcagctcccggagaatgctttcgatcagctctacggcgagaaacccaacgagcatatcaaactgatccgctatcccggccagcaggagacccaaagcagccagggcgtcggcgcccataaagattccggtttcctcagcttcctgctgcaggacgagcagaaaggactgcaggttgaggtcgcgcctggagaatggatcgacgccgtgccgctggccggcagctttgtggtcaatattggcgaactgctggagctggcgaccaacgggtatttgcgcgctaccgtccatcgcgtggtgtcgccgccggcgcagcagcagcgcctctccatcgccttcttcctcggcgcccagcttgacgcggtggtgccggtttacaccctgccgcccgagctggcgcgtgaagcgcgagggccggacagcgacccgcacaatccgctgctgcgcgatgtcggctggaattatctcaagggccgtctgcgttcccatccggacgtggcggaacgctactatcaggacgtgtttcgcgaacgcgccgagcaattgatcgtttaaccataactaaaaaggaacacaccatgaaatatgccgcttttaaactggcaggggtcgcactgtctctttctctggcatggacgtctgcccaggctgccgcgctgcgcgtcgccgcggacccggttccccacgcggagatcctcaactacatcaaaaaaatcgatcccagcctcgatctgaaggtggtggagctgaccagcggggtcaacgccaatgaactgctggccagtggcgatgtggatgccaactacttccagcatgttccctatctgaaggatcaggaaaaagcgctgggtaaaacctttgccgtcgcggccaccgtgcatattgagccgctgggaatttactcgcataagcataaagatttctcatcactgccggaaaacgccaccgtggcggtgccgaataacaccaccaacctgagccgggcgctgttcctgctgcaggcgcagaagcttatcaagctggaccctaaatttaccgacccggccaccaccctggcgacgccgaaggatattgtcgagaacccgaaacacctgaagattctggagattgaatcgccgcagatcccgcgctccctcgacgatgtcgacctggcggtgattaacggtaactacgcgctggaagccggcctggtgccagcgaaagatgccctggggctggaaagcgccgagcataacccgtacgccaatattctggtgaccaccccagccctggcgaatgacccgcgcattaaggcgctggcgaaagatctgacgtcaccgcaggtggcggagtttatccgtaaaacctacaacggctcggtgatcccggtggcccctcagtcatgataaccatcgaagggctgagcaaaacctacgccggaaccggccgaccggcgctgaacgatatcgcgttgcagataccgaaaggggcaatatacggcattctcgggcgcagtggcgccggcaaaagtacgctcatccgctgtctcaatttactggagcggcccacctcgggccgcattctggtgaacggacaggatattacccagttgaacaaggcggcgctgcgggattatcgcctgcgcactgggatgattttccagcacttcaatctgctgcatgcccgcaccgtcgctgacaacgtcgcggtgccgctggggattgccggagtgccgagggccgctcgcgaggcccgggtgcgcgaactgctggcgctggtggatctcagcgaaaaggccgccgccttcccgtcgcagctttccggtgggcaaaaacagcgcgtcggcatcgcccgggcgctggccgcccggccggaagtgctgctgtgcgatgaggcgaccagtgcgctggatcccgagaccaccgcctcggtgctggccctgctggcggatattaaccagcgcctcaatctgaccattgtgctgattacgcaccagctggaggtggtgaaaaccatctgtgaccacgcggcgctgctggaacagggcgcgattgtcgaaagcggtaaactcgccgacctgctggtgaccccatggtcgcggctgcgccagtcgctgctgcacgacccgcaggctgaacaggaatttcttacccgccacggcgttcaggggaggccattatgcggagtagcatgagctgggaagatttgtggccgttattactcgacggcacgctggatacgctttatatggtgggcctggcggccctgtttaccgtgctgatcgggttgcccaccggcgtgctgttatttatttcccgcgccaacgggctggcgccgatgccgaaactgaacgcgctgttaggcgcggtgatcaacatcggcaggtcgctgccgtttatcgtgctgctgatcgccctgatcccctttacccgcctgatcgtcggcaccacgctgggcagcaccgccgccatcgtgccggtgaccatcggcgcctttccgttctttgcccgtctgacggaaaacgcgctcgacgaggtggactacgggagaattgaagccattctgtcgatgggcggcaacgtctggcacgtgatttttaaatccctgctgccggaagccctgccaacgctgctggccgggatcacgctgaccatcgtgatgctgattggtttctcctccatggccggtgtgatcggcggcggtggactcggcgacctcgccatccgctacggctatcagcggtttaataatgaagtcatgtttggcacagtgctgatcctggtggcgatggtccagggggtgcaaatggccggcgatcggctggtgcgtagcctggcccaccgccgctagccgtcagtcattagttccagccgctctctgccgccagctggcggaccagagtggcggcgtcacactcgcggatcaaccccaccccctgcccggcccagtgggcgccatactcatggacaccctgggctttcgcggcggcggccagtgctttgccgatatcatacgccagcggataatccggcacggcgctcgccggatagccttcccccagcgcacagaaggcattcgccagacagcgtgccggacgcccggatatcgcggaggtcagcaccgtacgcccgtcaaggctgttgtggatcgccgcgcgatagccggcgtcggcggccgattccggacacagtaaaaacgccgtaccgagctgtacgccctgcgcccccaactgcatcacgctggcgatccccgctccgtccatgatgcccccggcggccaccaccgggatggttagtcgacgccgcagaagttgcaccagggtgaaggtgctcagctgcgcgtcaggcgcctgcggagcaaagatcccccggtgcccacccgcctcatagccctgagcgaccaccacgtcgatcccctgctgttcaatcagcagcgcctcctggagcgaggttgccgtcgccagggtaacgatcccctgccgccgcagacgttggatcgtctcaccttcaggaaggccaaaatgaaagctcaccaccgccggcgagatgtcgagaaggagctccagcatcggcgcatgaccgataaatgtctggtagatctcgcttaacgaatccggtggcgtactgccatagcgggcaaaatggggacgtaatgttgttgcccagtcggcttcccgccgggcgtcgcgccggggcggcgcatggcagaacagattgacattgaacggacggtccgtcagctggcgggtggcgactatcatcgcttccgcctgggcaacggttgaagcgcccagccccagcgagcccagcgcaccggcattacttaccgcggcagccagcgcgggggtggagacgcccgccatcggggcctgaatcaggggataatcaatatcaagaagcgaaagcagcgggttgctcatggtttcctcatgcattaacgatgccggaggcttaccatctcctttaaagatggtaagatcaacattattatcgtattgagaagaaaaatatgaaccacagcacactcgagatcttcattcaggtggcagacacgcagagcgtcacccaggcagcaaaacggctgggccgcgcacagtccaatatcacgacccgcattcagcagctggaagaggagcttgccgttgagctcttcgttcgcggcaacaaaaaaatggtgttgtccccggcaggcgtgcagtttctcagctatgcccggcggatcctgagcctggcggaagaggcaaagcaggctctgcatccgacaaccccaggcggcagtctgcgtctgggcgcgatggaggcgaccgccgccagccggctgccgccgctgcttacccgcttccaacagccgtgcccacaggtggatatcaccctcatcacccaaccgacccgccagttaaccgagggggtgttaaccgccgcccttgatgccgcgctggtctgcctgccaccaggggccgatgggcaacctgcttgtcccgccgagctggcattcaccccggtgttttatgaaaccctgatgctggtccgtccgcagaccccgggtccgctgcggttcgcggcatttgccagcggctgcagctaccgcgcgctgggagaacgctggctggcggaacagcaggcggccgtggaggtgcatgaggtcaattcctatcacagcatgcttgcctgcgtggcgtccgggcgctacgcctgcctgctgccgcagagcgtgctgtcgctgatgacgcttcccgaaaactgccttagcgaaccgctgtgcgaggcgaccacccagcttatctggcgcagcggcttgagcgcccccgccctgagcgagtggcgcaagctgctgcaaagcgtggcgattggctaagcctggcgttcggtaaagaccagccctgcggcaatcagcagcgccagcgccgcggcacagagcgccgggttaaatgaagccgcgatctgatacagcgcgccggcgataagcggcccggcaatctgtcccacaccgtacagtgcagtcatcgcggcaatcatattgaagctcacctgatggctgagacttttcgccttcggtagcgcaatggttacggtgcccataaaggtaaagcccaccaaaagcgcgcttagcacgcaaaacagcaatgaagcgctgcaggctggaaggatcacgccaagcgcctggacgagcaggttgcgggtcagcgcttgccggtatccccactttagcaccagcttatgccagatgaggcaggacggcgcggccgccagaccaaacagcgcccacagatggaccgggtcaacgctctgcagcgaaccggacagaaacaacggcagataagtggcggtgatgatatagccgaagcccgccagaccgtaaaccatcaagagtcgccacgccgcgcgacgggtatcgctcccggacgcaggcagggaggtttcaacatgggaaacccgcaccagtgcagccggcggagtcagcagccaacggatcgccagcgccagcagcagaccggcgcataatgcgctgagcagccagatctgctggctggtgaggctcagggcatgtccaagggcgatcccctccgctgagataaatatccccagccccaccccggcatacagcaacggagccccgtgatgatgccccatatgttccagcagccacagcgaacctgcaatcagcgttatcgcgctcagcgcgccggcgacggcgcgcagcgtaataatggtccacggcgagctcacccaggccagcagcgccaggctggcgatggtcaacccggcggagataatgctcagtcgggtggcggccccaggctgcacccgcgccagcagcaacgcaccgaccagatagccagcgtaattggccgacgcggcgagattgccctcgtgcagggttaacagaccttcattaagcataagcggcagcacgccggtgaaggcaaagcgcccgtagcccatgccgatcatcagtactatcgatccagccagtgccagccataaggcctggcgcgattggttattcatccaccaccccacagtgattctcaatttaagaataataatattgaatgattctttttttattatgataaagaggtattgttggcgcaaggcggatgttaatccgctatggtatttacagagagaaggtggcgcctgggcacggcttaacacacgccgggccgatttaccggtacagtatcaactcaacttatgctcacgggagtcattatgtcgttctgtcatatgcgcattgccaggccggtcagcgaactggacaccaccgccagcatgtattgcgccgggctgggactcgagctgctcggcagctttaccgatcatgaaggattcagcgggataatgctcggcgcgcccgaagcgggctggcatctggaattcacccagtgccgccaccatcccgtcaccccctcgccaggcgatgaagatctgctggtgctgtactatccgcagcaggcggcatgggaggcacagtgcgcagccatggacgccgccggatttctgcgcgttacggcgtttaacccttactgggaggtcaatggcgtcactttcgtcgaccgggacggctaccgcacggtattgcaaaaccgcgcctggggcatggtgtgtgattcgtcgggtatggcggcgagctgacgctgagcgaggcgggcgttaagcgctgtaaaagcagttatttacattcgtacaaatatcgttcccgtcggttaccgataaaacgctgtcgcgcctcgccagcgtcctcacggcgcgctatgctacacatcccgttgtattaacctcttatccctatgagcacttccgtcagcactacacaactcaatttgcgcattatttcgatcgttgtttttacctgtatctgctatctctccattggtctgccgctggccgtactgccgggctatattcactatcagctgggctacagcacctttgtggccggaattgtgatcagtctgcagtacatatcgacgctggtaagccggccgcacgccgggcgctataccgatatctgggggccgaaaaaagtggtcagccttgggatcgtctgctgcctgctcagtggcgccttcacgctactggcggtagtcctgcaggcaacgccgatgctggccattgccgcgctgctggcgggccgggtgtttctcggcgtcggcgagagctttaccgccaccggcgccaccctgtgggggatcaaaaccgtcggcgcgatccacacgtcacgggttatctcctggaacggcgtggcgacctatgtggcgatggcggtcggggcgccgctgggagttaccctcaatcactattttggcatcagcggctttgctacggtggtagtgctggtcgcggccatcggtctgctgttcgctcgtacccgccaggacgtcaaggtgaccgccggcgccagagcgccctttcacgcggtggtgcgaaaaatctggccttacggcctggggctggcctttggcaccgtcggtttcggcgttatcgccacctttatcaccctctacttcgccgcgcacagctggcagggcgccgcgtttaccctttcgctgttcagcgtcggctttatctgcgttcgcctggtgctgggaaataccattacccgctttggcggagtcccggtctccctggcctgcttcatcatcgaaagtctcggcctgctgcttatctggctggcgccatcagcatggatggccggcgtcggcgcctttctcaccggttcgggtttctcgctggtctttccggctttaggagttgaggcggtaaaacaggtggaagagcaaaatcagggaaccgccctcggcacctactcggcgtttcttgatctggcgctgggcctgaccgggccgctggccggctgggtcgccgggttctacgatctcgccacgctgtatctgctggcggcgatcgtggtggcgctcgcattcctgctgattttccgcgtacatcggcaacagcggcttgtcgccagagagtagtgtggcccggctcgcgggccgccgcggtccgatgacgccggcaaaaaatgaatcggcaattgacgacgattcggcttccgtgccaacatcccgtcagcgtctggcaacagatgcatggacggtactggtagacaacagagttcgcgcaacgatccagcccggtaccgtagtccaatccgaatcactgacccacacggtgaattcctgattctggcgggaaacacagacatgcaccaaagttttaatcagcgcgttcatttctattactgcgtcctggtcgcgctgaagatgcacggaaaatcgaaaaaagcaggtggtatcaggggaaagaataactttctgctgaaatggctgcgccgggcgcaggataacaacatttttcctcccgatatcaccagtgaaatcgaatggctgcgaggaaaaattattcaggctggctatgacaccgatctcgagccgatgctggattttgtctacgccaccgccagccgcgccgaggcgctcaaaaacgccgaataggctcctgcgcccgccacgggcgcagagacgttccctgccatgtctcaatcccaggttcggccaacagcgcaggcgcaatccagccacgttctattttgtgacactgtcacgcacaaaggtgaccgctgaggttcattaaccgctgacatgccgcctgacgcgttctatgctttaccctgtctccctcctcacacaggaactgcgcccgatggccgactggaatccttcgttgtatctgcaatttgacgctgaacgtacccgccccgcggccgacctgctctcgcgtattgcccatctgcaggtcgagcacgccgtcgacctcggctgcgggccgggaaacagcacccgcctgctacgcgccgcctggccgttggcgactatcgtcggtatcgataactccccggccatgctggtccaggcggcgcaggccttacccgactgcgaattcattgatgccgatattgcccgctggcggcctgcgcaaccgccagatgtgatctatgccaacgcctctctgcagtggctgacggatcatgagacgcttttcccccatctggtaaaccagctggcggacaacggaacgctggcagtgcagatgccggataactggcaggaaccttcccataccctgatgcgtcaggttgccagcgagatggggttgccggaccgtggacgccagccgttactcccgcccgccgcctggtacgatctgctcagccgccagggttgcgaagttgatatctggcgcaccacctattttcatccccttgcttctcatcaggcgattgtcgactggctgcagggcaccgggttacgcccctatctggcaggcctggacgagcaggccggaagcgcgtttctcacacgctatttcgcattgctggccgcacactatccgttacagtgtaacgggaaggtgctcctgcgtttcccacggctgtttatcgtggcgcgaaagatcgccgcctgaccgttggtataggtgggcagaaaagcggagtgatgaaaggtgtaaaggatcggctataccatcctgattttcaggattgataatcctgaacgttgcgatattcaatatcttagtcagcgtgtgacagtgatgactcctttaacctgcaaagagaatcactatgagtactcctcctgtcgatcgccgaacgctggctgctatcgcgccaaagctagccgagctgaccgaaacggtgctgtttggcgatatctgggcgcggagcgagctgtcgccccgcgaacgcagcctgatcaccctttccgccctgacggcgcagggcaaaactgaacagctgccgtggcacatcgcgctcggctatcagaatggcctgagccgggaagaaattgtcgaattgtttacccatctggcgttctatgccggttggccggcggcggccagcgccctgacctgcctgaacgcgcaggaggcgtcatgcccctgacccgaatttcgcttggcaccgcctggcgtcccgcggagtttgctcaattgtcggcgctctttcatgagtgtctggtggcggagttcgacgttccgtcagcagatagatttcagtttatcgaacgggccgccgatgagcagcgcattgacgacccgcactacctcagcgaaggacgcagcgcccgcttcgtgctgtttcatattttcgccggaaaaccgcgcagccgggcgcagaaagagggactctatcgtcggctctgcgcgcggttagacgacgagatggcggtcagcccgcaggacgtgatggtggttatccagtttaaccaactggaggactggagttttagcgcagggaagatggcggatgaatgagacaggcggcgccgcaagaggcgccgcgtttcagcactatatcatttgctaccatgcacaacagcgatcgttccatgaatcacgatacatgatgttcccttctgtgtatatccaggtgatcgtctcataacggaaatcaatgtcttcaaggtgagtacttgtcattccggccggatgtaaatttggtgtgattgtcgtaatcttaatattcgccatcgctatgttaaaatattcaacctccagtcccgcctcatttattctgtacatttttagcgttgccgatcttaatgttcgaccttcacaaagagccctaaataacaaaggtgttgttctgtcaaactctttttgaattttaaccggtgtatgaagacgggttcccgtcagctttcctgtattattatcggtaggtaaccaaacatgatgattcactgcgcgcaattcgatggaacccgtgcgtgtgggcatcaggcaagaacctataataggcgaatcattctcatcagttaaccataaatatgctggatttgacattacccctcctctttcatatcagtttttaactttaaaccaaacgacaacgtgaaacccaatgattaataaaacaaaaagtcctattaagttaatggcaatgtcaggaaaaagaaagactgcaatcatgctaaatataatgattaataatacaataccccatccccataaaaaaagaatgaattcttcttttaaccatcttttcaagaaatccatccattcacctcattaatttaataagtaattcagcaagttcatcatcagaaataatcatcggatttaaataaggaacgcctgtgatgacagattagatcattcattgttccggcacatatttcttatgatcatctggcctttcaatatacttataaaacgatggccttgatagtaatattgactctactcttttgtttatattccctcgccccctgcccggtttaaaatatctcggttagctattacttcgtattgtttcatattttcgctggaaaaccgcgcagccgggcgcagaaacagggactctatcgtcggctctgcgcgcggttagacgatgagatggcggtcagcccgcaggacgtgatggtggttatccagtttaaccaactggaggactggagttttagcgcagggaagatggcggatgaatgagacaggcggcgccgcaagaggcgccgcgtttcag

SEQ ID NO: 70 - DNA, 101153 bp, Unknown
  source: /note="Description of Unknown: KP2-Mcoc1 Bacteria Sequence"
aggccgggccgatcgacgtcgaggtgtacgccaactacggctttgactcaaaggcggtggacagcgacgcgcgtctcgaagcctggcagggcgggctggtgctgagccacaccaacgacagcggggtgaacaaggtgatcctgcgctattccgacaactcggataacagcgtctataacaaaaccgacgacctgaccacggtctacgccagctttgagggcagccataagttcacccagcaggcgcagatcgaatacctgctggccttccacgactacgacaacggcaaggacaacaccgacaaccgcaaaaactacggcgccatcgtccggccgatgtacttctggaacgacgtgcactccacctggctggaagcgggctaccagcgcgtggattacgaccagggcggggataaccacggctggaagctgacgctgtcgcagaacatcgccatcggcatggggccggagttccgtccgatgctgcgcttctacgtgaccggcggccaggtggacaatgagcataccgcgaaggtgaacggcacccaggaccagcagctggattcgctgaacgtcggtgggatgtttgaggcgtggttctgatgcgatagcgttgccgaaggagcgttcccggctggcgctacgcttagccgggctacaactggtgcgctccatttatgccggatggcggcatacatgccttatccggcctacgttccttcctgcgggctccccccccaggaccggcaagcgcagcgccgccgggcagtcagacccgtgccctggtggcgtcatcaattctttatctctggcttaatcggcgggcgatgcgctcaagcttcatcatcaacagcagcgtgacgcccaccagcacaatggtcagcgccgagccatcggcgatattgccgcgatcggtgaggctgaaaatggtcaccggcagcgtcgtccagcccggcggatagatcatcaccgtcgcgcccagttcccccatcgacagcgataagctcagcgccagcgccgagatcatccacggcgtcatcagcggcagtgtcacatggcgcaggcgataccacggcgaagcgcccaggctggaggcgacgttttcaatatcagcggaaatacgcgccagcccggtcgttacgttgctgaaggtaaaggcggagatcagcacgaagtgcgccgccagaacgataaagaaggtgccgttcatctgcagcggcccctggctgaacgccaccagaatgcccagcccgacggaaaccgaggggatggcgctgggcagataaaacgccaggccaagatatttctgtagcgtcgcgccatactggcgcagcgccagcgccgcccacatcccgcacagcagcgccagcaggctggcgcagaagcccaccatcaggctcgaaaacagcgaatcccacgccgcgccgcgaaaggcgttaacaaagtgggcaaaggtaaagccggtgggcagcaggccgttccattgtttactcaggctggagagtaaaatcaccgccagcggcagcaggaaaacgccggcaaaaagcgtcaccgccagcgcgcccgccgccgcgcggcctttacacgaccaaatcaacatcgttaactccttacgccagtgcgcgccgccgccagccgatagagcataaacagccccagcgacagcagaatattgatcagcgcaatcatgcaggccacgctgtaatccgactccagaatcgccttgctgtagaccatcatcggcagggtattgacccctttggcgccaataaacagcacgatcccgaactcgttagtggtcaatagcaggcacaggctgccgcccgccatcagcgccgggagcgccgccgggaagataacctgggtaatcacccgtaacggatgagcgccgagaatactcgccgcttccagctggctcttatctatctgccgcagtcccgccatcagcgggcgcatcaccagcggcgtaaagacggtaatctccgccagaatcacgccgttaatcgaatagaggaagtctaccggcggcagttcaaaagcaaacagcgccatcagggtgccgttgagcagccccgccgagccgtaaataaaggtgaatgcgagagtgataagaaaggtcggcagcgcaataaaagtatcaatgacccggcccaccagttggctgccggggaacggaataaacaccagaatcagcgccaggacgctgccgagcaccagacagccaagggtagcgaacactgcaatctgtaaggtattgagcagcgcgccaataaagcgttttgagtcaatcacctgccagaaagtctcgaggctcaggttgccgctggcgtcacgtaatgcctgttcggcgatcaacagtagcggatagaaaaacagcgtcgccagcaccagcagcggcaatgccagccacaggtaagggcgtaggtttcgcgccggacgcgcaagcgtgagggtttgcgccatcattgcacctcgatcagaaccgcatcgccaggttcgaagtagagcgccagcttgtcccccgcgcgcggcagcgggttcacgtgggtcatcacaatccgcaccgcttcgccggcaacatcgcacagcagatgcgtcagatcgccctgccaatgtaccgaggtcagggtagcattgagacgattactggttgccgatcgcggcgccaggctcatgtgctgcgggcgaatgcataacagcttgttgttgccatgcaggccgccccggctgaaggcgttaatcaggccgccgccacagctcacgctaaccagccccggctcggggctgtctttcagcgccgtcgcctgcaggatattggcgcggccgaggaattcggcgctaaagcggttcggcggatagtgatagagctcgtgcgtttcgccgtgggcgattagcgagccatctttcatgatgccgattttgtccgccagggtcagcgcttcggtctgatcgtgggtgacgtagagaatggtcagttccggcagttcgcgatgcagacgggcaatctcttccaccatgttatggcgaatttgcgcatccagcgccgacagcggttcatcaagcaacagcacccgaggacgcacggcaatcgcgcgggctatcgccacgcgctgctgctggccgccggaaagctgatgcgggtagcgggtggcgtaatccgccataccgacgatttttaaggcttcagtcacccgctcggcgataagccccctgggctgcttttgcgcccgcaggccgaaggcgacgttatcttccaccttcatatgcgggaacagcgcgtagttctgcaccaccatcgccagcccgcgtttgtacggcggcagttgggtgacgtccgtatcgccgatcaggatccgcccgccagccggttgcacaaaaccggcaatcgcccgcagcaccgtggttttcccggaaccggaagggccaatcagcgccagcacctcaccgggctcaatggtcaatgacagcggttttaagaccacgttgccgtggtatgaaacgcgcagcgagtccagggtgatcccggacgtccccgccagcgacggggaagaagtgacggtggttttcatcaacatcaggcttactcgctatcggtcactttatgccagcgggcaatgtcagccgacagcgataccgcgacatcatcccagttcggctcccagctcttcacgccgtcgagcgccgctttcgccgccttaaagttagcatcatccggcgctacatcgctgcgtaccggcaggccccaggagcgcgcgctgacgctggattgcgccggtttatccagcaggaaattgatcagctttttgccgttttcgctgttcggtccgttctgcaccagcccgatggtgtagggcagcgccagcgcgctgcgctcgcctttgtcatccgccggccagaaaattttaacgttcgggttacgcgccatctgcgacaggttcatctgcagatcgccgttggcgacgtacagctcgcctttgttgaccagcgccgtcagcttaccggtcgaggccgatgggccaacgttattggcctgcagcttacccagatacgcaaaaccggcgtctttaccgccgaggctatggaacgcctgcagcatcaccgcggtaccgtcgcccgcctgacccggcgtggagtactgcaacttgttcttgtagcggctatccagcagatcctgccagctggccggcgcgcttttcagcaactggctgttatagatgaaggtcagatagttattcaccagcggcgcgtagcggtcgttagcgccggggatctgcgcgcttccctgcggggtaaaggttgccagcaattgctctttcgcggcgcgctggataaacggcggcaccgtgaccagcacatcagcctgcggattggtgcgctccttggccagacgttcgacgatcgcgccggagccgccttccacatactgcactttgatgcccgtcgctttggtgaaggcagcgaactggctctgataccagctgttatcgccgtcatgcaggccgtcggcggagtaaaccgtgacgacgccgtccgcccaaaccggagagctggtcagcgcgaacagggacagcagagcaagtcgggagagtttcatcgtgtaagcctcatcggatagtcagttattctggtgtagaccagatttagcttcacgctaccgggggtttatgacaaaacgatgaaagaagtgtgtcgaaggagttaaaacgagcgggatgcgtagccccggcacgcgctagcgccaccggggagatcaaaaaatttaactaataaaatcaatgggtatcgacttcgatccgcaggctgtcatgccgccagtattcaatatcgtaatcgagaatacgcccgtgctgatcgtaattcagcctgcgcaacagcagcgccgggcgcccctccatcacccccagcgcctcggcggcctgcggcggcattgaggtgggataaaacgacagatgcatactggtatagatcaggtcgtagtgagtttgataaatctcggtcagactgccgttgagatcgtggcgcagcagctcaggcacccgcgcgggcagacagtggttttcgcagtagcacaccggccggccgtcggcatagcgcagccgggtcagcaggtagacctgatcgaagggctgcagcgccagcggcgccattacgtccagcggcacggcagccaggcggccatcaagcagcaccgttttcggttcgcgcccctgttcgagacacagcttgtggaagttggtattttgcgtcggatccagccacagacgctccggcgtcacaaaccagccgcggcggtcggcgcggtaaatcacgccgctggcctccagctgcgccaggctctcacgcaccgtaatccgcgtcgtgttgaacagcgcgcacagctcgcgctcggaaggcagcttgtcgccgcttttgagggcgccgttttgaatacgcgcctgcagctgcgccttaatcatcaggtattgcggcatctcgccagagggtgatttcatgtttactcactgccacttttcgtgcgctcattatacatagccagatgaattttttgttgcagcgccacatttcctttgaccctgccccggctttgtctccatgataactataaatctggtatagaccaaatggtgagacaaatgacttcacgaaattacctgctgctgacccccggcccgttaaccacctcccgtacggtgaaagaggcgatgttgttcgatagctgtacctgggatgatgattacaatctcggcgtggtacagaccattcgccagcagctggtgcagttggctaccccggccgacggttataccgcggtgctgctgcagggtagcggcagctacgcggtcgaagcggtgctcggcagcgtcatcggcgaacagggcaaagtgctgatcgtcagcaatggcgcctatggcgcgcgtatgattgagatggcgcagctgatgggcatcgcctgccacccttacgactgcggcgaagtctcccgtccggacgcggccgcgatcgaacagatcctgcagaacgacccggcgatcacccatatcgcgatggtacacagcgaaaccaccaccggtatgctgaatccgatcgcagaggtggccgaactggcgaaacggtacgataaacgctatatcgtcgatgcgatgagcagctttggcggcattccgttggatatcgccgcgctgaatattgattacctgataagctccgccaacaaatgcattcagggcgtgccgggctttgccttcgtgattgcccgtgaagcggagctggccgcctgcaaaggccgttcgcgctcgctgtcgctggatctgtacgcccagtggcgctgcatggaggacaaccacggcaagtggcgcttcacctcgccgacgcataccgtgctggccttcgcccaggcgctgaaagagctggcgcaggagggcggcgtcagcgctcgccatcagcgctaccgcaacaatcagcgccggctggtcgccgggatgcgcgcgctcggcttccggccgctgctcgacgatagcctgcactcgccgatcattaccgccttttattcaccggatgcgccgcagtatcgctttcacaccttctaccagaagctgaaagatcagggcttcgttatctatccgggcaaagtatcgcaaagcgactgcttccgcatcggcaacattggcgaagtctacgacgccgatatcaccgccctgctggcggctatcgacaacgccatgtactggaaacaataaggaaccgccatgaaccgtattagcgcactgatccttgactgggcaggcaccaccgtagacttcggctctttcgccccgacgcaaatcttcgtcgaggccttccgccaggccttcgatattgagatcacccttgaagaggcccgcgtgccgatggggcttggcaaatggcagcacattgaggcgctgggcaaactccccgctgtcgatagccgctggcaggccaaattcggccgcgcgatgactgccgccgatatcgatgcgatctacgccgcgtttatgccgctgcaaatcgctaaggttgtcgatttttccgcaccgattgccggcgttgtcgacactatcgccgcgctgcgcgccgagggcctgaagatcggctcctgctcgggttatccgcgcccggtaatggaaaagctggtaccggccgccgccgcccagggctacgccccggaccactgggtcgccaccgatgaccttgccgccggcggtcgtccgggcccgtggatggcgctgcagaacgtgattaccctgggcatagacgatgtggcccactgcgtgaaggtcgatgatgccgcgccgggcatcagcgaagggttacatgccgggatgtggagcgtcgggctggcggtgtccggtaacgaattcggcgctacctgggaggagtaccaggcgatgtcgaaagaggaaatcgccacccgccgcgagcgggcggcaggcaaactgtatgccgccggggcgcattatgtggttgataccctggcggacctgccggaagtgattaccgacatcaatgcccggctggcaaaaggcgagcggccttaagcgggtgaattcaccttcactttggccgccaccagcaggccggtaaacagcatcaatatccctgacaacaccagcggcgacagcagccctaagtggtcaagcgcaatgccgccgaccgcggcgccgcaggtgttggccagctggatcaccgccacctgaatcgacccggctttttccgcctgatcggagagggaacgggtgatccacgttgaccaccccaccgggatcagcgcaaacgcgaagccccagataatcgccaccgtcgaggcgacgattttgctctctccccacagcaccagcgccaccgcgcaggcggtcagcaccagcggcgcaatcgccagcgccgctttcaccgaacgcttgagcagcaccgaggagagcgaggtgccgataaagctggcgataccaaagctcagcagcaccagcgtcaggccgtcgacatcaaacccggcgagggtcatgtacaccgggcgaatataggtaaagaaggcgaactgtccggcaaaggccatgaaaatggcgcacattccggccatcacccccggacgcttcagcagaccaaacatattttgctgctgagaagccgattcaccgggcagcgacggcagcgctttcagcacccagagcgtacacagcacgcccatcaccgccgcgccgttaaagacgttgcgccagccgataagcccgccaaggaaactgcccaacggggcggcgatcaccagcgcgattgataccgcgccgaagataatcgatagcgctttcggcaccacgcgcatcggcaccagacgcatggtcagcgatgcggacatcgcccagaaaccgccgagcgccaggcccagacaggcgcgccccagcagtagcagggtgaagctatcagcgaaagataccagcaggcaagaaagggtcagcagcagtgaaaacaggataaccacgtagcggcgatcggttttacctatcaccgtggtgataaacaggctggaaaacatcgcgacgaatgccgtcgtcgtcaccgactgcccggccatcccttcggagatgcctaaatccagcgccatcggcgtcagcaggctgaccggcaaaaactcaacggtaatcaggcaggcgacgcagaaagcaaccgcgaaaaccgccgaccagtttggccgcgcgagatcgcgtgcatggggtttggtttcatttgaatgactcatgagtgacctgcgaagaaagtggcggaaagctgcgcagtgtaacattttgtatgtgacgtacttaacgttttcgcaactcttctcgcttttcataagaggttgcgtagctgctcgcatgtttaaaaaaacgatgcttgctatcgctttaacaaatctcaggagaatttaatatagcaccatgtgctatacttttaacgacaggatgtcagcaatgcgtatcttcaaaaccaaatggttcgccagagaggctagctctcatggcatttccgacgacgagctctatcaggcaattcaatctgcgcttcagggcaaagtggttgatttaggaggaggggtttataaaaagcgactcaacaagaatcgcgatcgcgcaatcatacttaccaaaagcgcagagtattggttttatacctttctatatgccaaacaggatatggccaatatcaaccatcgcgaattaatggggtttcgtgagttagcaaaacactatgccaatctttctgaagagagaacgacggccttagttaaaagtaaagaattagtggagatttgcgatgacagcaaaaaataaatacaaaagcccggctttcgaagcgatccatagcgctgcgtcggggctattcagcgttggcgcaatcccacaggaaacaatgcgccattttgatgaatcatgtctcggtagcgtagccgcacttcaacccattgaaattaaagcgctacgtgaacaactcaatgttagccaacccgtgttcgctcgttatctgaataccagcgtgtctaccgtgcaaaaatgggagactggcgctaaacgaccgagcggaatgtcattaaaattgcttagcgtcgtacaaaaacacggcctgaaaatcctactgtagttattctgccggatggcgcttacgcttatccggcctacaagtgacgagtgcggaaaccgtaggccggataaggcgcagccgccatccggcacacaaaagcgatgaaccacaggccggataacaatgagatcagtgcagccagtgcacgccgtcttccgggagaaacaggtcgttgtagcgctgctgtaggttatgcaaatcgctcatatccggatccagctcgcgcagaaacccttgcgccaggcggatctgcgcctcggtgatcggcgccgctaaacgcgctttttgcatcaggcgataccagtaatgcaggtttttttcgctggcgtcgacaatcgcgacctgccagatcagcagcacctgggcggcgttctgcagatgtgcttcattcggccgctccaggtaacgcaaatactcattaccggcggtttttcccagctgatcgatcatcgattccagcgggacaggcgtgatgccgaggcgttcgctcaggcggcggatcgcgcggcgtgaatcagaggtaagcacccgaaatcccacaacaaacaccactaccagggtggccagtcctatccagatcatgcatcctctcatccaatcgcagcctgactatcataatgggaatttgcctgctgtcgactgtcgggcctggcataatgcgcaagaaataaaaaagcccggcgcgaaggccgggcaaggttaccaaatacctggtgaatcaggcggtctgcaaaatacggttctttttctcgcggcgaattttacgctcttcaaagatagccacgatggccatcaggcagatacagccgacggcggcggcgtccagcgccgcaaaggtgccggcccagccggtcaggccgaagaccggggtgccgtcggcgatcatcccgagacccagtttggcgaagctatcgccgatcagataggcgaaggtgcccttgatcccatcggcggcgccgatcgcttttttcggtacgaaaccgacggcggcgacgccgatcaacagctgcggaccaaacaccaggaagcccagcgcaaataacgaggccagatagacgtactggttgctggcgtgttggtaaaccccgagggtggcgataatcagcgccagcgcgatgcaggccaccagcgcgcggcggccgttggccagatccgacaaccagccccacagcagcgtgccgaccagcgcgccgacctcaaacagggtaaagccctgaatcgccacctctttcgacagcttcagctcctggaaggcgtacacggtggaccactgatcgataccgatacgcaccacgtagaggaagatgttggagaagcacagcagccagatcactttgtttttcagcacgtactcaacaaagatctgccacttggtcatcgcattttcttcggtctctttgtcctcttcgctgatcgcttcgccaaacagctcttccgccgtgccgaggccgtaggattccggagagtcgctaccgtagcgcaggccgataaagccaacgatcagcgcaataatcgacgggaagataaacatgccgatcacatggccgtcgaacagatagttggcgccaaacagcgccacgcccgccgcgcccgcgccgccgaggttgtgggagatattccagaagccgaggaaagtgccgcgtttgcgtctgggcgtccacttggtgatggtggaatagctgcacgagccgccggtgctctggaagaaaccgctcagcgcatagaaggcgatcatcaggaacaggctggtagaacccgcccccatgctggcgctaaagcccagcatacagatggcggagaggatcagcataaacggcaggaactgcttggtgtttttgccgtcggcataataagagaccagcgtcttgcccacgccgtaggtgatggagaagcccaggccaatcatccccagctgggtcatgctcagcccgtaggtggagatcatgtcgttctgcgcgatgttaaagttcttgcggatcaggtacatggtcaggtagccgatgaagaccaccagataggactgcatgaaaggtttgaaccacattttgcgccgcacatcgagcggcagatccagggtcggcttgcgcacctgattcagaaaggccagcatgggtatctcctgagctgattttttatgcctgcgtaataaccaggcattgtaaaaaccagcgcgccgtctggcctgagacggcgtccaggtaaaaccgggaaaatttcttagttttgtcccgttcgcggcgaaagggtgagctacatcacgcttcgctggcggtacgcggcgcctgcgcgtttaaaaacggcagcagcagcagcgcggaaatgccggcggcaatcgcaatcaccacgaagaatccggtccagtgccagatatccatcacctgcgccagcggccagccggaaagcgaggcgccaagataagcgaacaggccgacaaacccggttgccgccccggcggcttctttatgcgaacattccgccgccgccatgccgatcagcatctgcgggccgaaaacgaagaaaccggtagtgaagaagcaggccgcctgcatgacatagctggcgaacggcatcagccacaggccgccaaccgacagcaaaattccggcggcgaaaatcaggttcatcggcccacggttgccgttaaacagcttatccgagccccaccccgccaccagcgcgccgataaaaccgcccagctcaaacatggtcaccgccgagttagcggtcaccagatcgacgccgagcgtctccgacatatacagattgccccagtcgttaatcgccgcccgcaccacgtacaccagcacatagcacaacgacagcagccagatgtagggattggccagcacgtagcgggtcaggatcgctttacgagacatcccagcgccttcctgctgctgggcgatttccagcgcatcgtgacgccagtcacccacggcgggtaaccccaccgcctgcgggcgatcgcgcagccgccagcacagatacagtccggcgaggatcgccagacagccggcaatggtcatcccggcacgccagccgtagtgcaacgccgccgctcccaccaccatcgggatcagcgcgccgccgacgttatgcgccgtattccatagcgcccaccagccgccgcgctcggtccgcgaataccaggccgtcagcagtcgggcgcagaccggcgagccccagccctggaagaaggcattcagcgcccacagcagcgcgaaagcccatagtgaggaagaaaaaccgaacagaatattcaccaccccggtggcgataagccccagccccataaaatagcgggcgtcggagcggtcgctgacgataccggagaaaaatttcgacagcccgtaggtgatatagaacagcgtggccagcaggccaatatcgctgcgggtcaggacgttgctggcgagaatttccgggaccgcggcgttaaagcttttgcgggtgaaatagaacagcgcgtagcccagccagatggtcaacaggatatggcgacgccagtagcgataacgcgcatcaagctcgcgtttatcgctaatcggcgcagcgtccggcggggcttttaaaaaggcgaacatcggcgatcctctcaggcgtaacgcagcggtagattgacgcacacccgggtaccatgggtgcaggagatcgtcagtgtgccgcccagggcggtcacgcgctcgcgcatgccggtcaggccgaacccctgcagattcgaccccggcggcaggccgcaaccgtcatcttccagcaccagcattagtcgctcatcctgctgccagccctgcagagtgacagcgctggcgctggcgtgcttgacgatattattcagcccctcctggcaaacgcgaaacagcgtcacgcgctggttctcgctcagtcccgcctcgttaatccgccagtcgagatggctgacaatgccgcggtcctccagctccatctcgcgcatcaacgaacgtaccgcctgctccagcggcaggtcgtcgagctgacgcggacgcagacggcctagcagtctacgcaccgagtcgtaaactcccagcgacagctgttctatcagctgaccgctctggcgcacgctggcattgtccggcgccagccgctgtacgatcccggcctgggtgcggatcgcggtgatggtctggccgatatcatcatggagctcgcgggcgacgtctcgccgcacgctctcttcggtctccagcaggcgttcagccagccgacgattacgcgccagctcgctttgtaatgactggttcagctcgcgtaaccgctggatccccgcccccaacagcagcccggtgaggctctgtgccagcagggaaagcaataaatcgaccgggtgatcgtgccaggtctggctggcaatcaaggcgatagcgttcatcagggtggcgatcagcgcgccctgccagccgtagtgccaggcgagggcgataatcggcagcgccagacaaaacggggtaaagcgggagagctcggcgggcaggccaagctgcagccacaggctaatggtgaataacagcagataccagatcagatgccgcccgcgccagttaaccggctgcgccaccagcgccggccccagcggccgccagacggtgctggtaagatagtgccagaaaaccaggcaggtcggcgccagcgtcaggccgccggtcagcgtcaacagcagggcgttaagcccctcgtccccctccgccagccacggcagcgattgcagcagcgcggcggccattaacgccccgccctggcgcagcagcgtcagccagtcgcgctgctgccggtagcgcgagatcaacgccaccggcagcagagtcagcaggcttccggtcatcaaaattatcgggtgcgccagcgccacctcctgcgccagccagaagataagcagccactcggttcccagcagcactggccagtagccgcgggggcattgcagcattaaccccagccgcaggccaaagggaaacagcagcaccgctaaatccgcgcgttccaccagatgcagactgatgctccacaggcagaaccaggcggccgcgaagataaaggcgcagccgatgaccgacagcaatcgtgagacgacggccttcattgccagctatcgaacatgcggcgcgccagctcaacgtcgttgctgacgcccagcttttccagcaggttggcgcggtgtacgtggacggttttcggcgacagaccgagctcggcggcaatctctttcaccgccatgccctgcgccagcttttccgccacctgacgctcgcgtttggtgagcggatcctggcgcccggcggccagcttcatggcgatatccggcgtgagatagcaaccgcccgccgccaccgtgcgtaccgcggcgataagttcatcggggctgcagcgtttcgacaggaagccgcgcgcgccggcattcaacgcttgctcgatcagcgccgggctatcgtgtaccgacagcatgatggtcgccatccccttcggcagctggctgagcagctccagcccggaaatatccggcattgagatatcgcagatacagacctgcacgccgcgccccggtagccccgtcagcgcctcgcggccgctaccaaattcggcgacaacctgaaaatcagcttccagccccagcagctgagcaaagccggagcggacaatcaaatgatcgtcaataagggcgatggtggtcatggtgtgtcctggtgcctgaaaacgccggatggcggcgtaaacgccttatccggcctacggattcactgcctgtaggccggataagcgcagcgtcatccggtaaaggcgcttaccttagcgataagcgcgtggctgttcaagccttgagcgctattcgaagaacaccgcaattttgttaaacatggtgggatcggactggttacgcgccactttggtgacatcttccagcttttcaatctggctaatcatctgccccagtcgctggtcatcatttaccagcagccagatgcggctgtgttcgctgccctgaattggcagacagagaatgccttcgacgttaaacgcgcgacgggcaaaaagcccgcacacgtgggtcatgacgccgggatggttgcggacggtgagttccagaatgacgttgtcacattgtttttgcatggcttattcccccaccatttcagtattggccgcacccggcggtaccatcggatacactttctgctgtgcgtcgatgcgcacgtggatcagcgccggccccggacggtcgatgatcgcctgcagcgccgcctgcggatcgacttcattatttaaatcacaggtttgcaggccaaaaccggcggcaatctgcataaagttaatcatccccggataggtggcggcaaaaacgccctgctgatagaacaggctctgctgctgatgcaccagccccagcgcttcgttgttcagcaggataatttttacatccagctgattttcggcggcggtggccatctcctgaatattcatcatcaggctgccgtcgccggagaagcagataaccttgcgctgcggattcgccagcgccgcgccgatcgccgccggcaggccgaagcccatggtgccgaggccgccggaggtcagccactggcgcggacgattgagcgggtaggcctgcgccgtccacatctggtgctggccaacgtcggtagtgatgatcgcttcatcatccacgcaggcggccacggcgttaatcaggccgtaatgggagagcgggtcgctttcctgcgggatggcgcaggggaattcgcgctgcaagtcggccaccagctggcgccattcctcgcgcggctgcgcctcaatctgcgggttcagctgggctaagacttccgccacatcgccctgaatcgccacgtgcggttgcttgattttgcccagttcggcgcggtcgatatcgacgtggataatcttcgcgttcgggcagaactgctcggtcttgccaatcgcccggtcatcaaaacgggcgcctaaaacaatcagtaaatccgcctcctgcagaatgaagttggtgctgcgcgcgccgtgcatccccagcatccccagcgacaaaggatgcgccttcggcagcatgcccagcgccattaaggtcatggtggtcggcaggttggctttttccgccagctcacggatcgcctgcggcgcgttaatcaccccgccgcccagatacagtaccgggcgtttcgccgcgttgatcattgccgccgcttcacgcacgctttcaggcgcgaatgccggtgccggggcgcgctcgccaggctcaggcagcgcttccagctcaatggtcgccgactgcacgtccttaggaatgtctatccacaccggcccgggacgcccggactgggcaatacggaaggcgtcgctgatcacctgcggcagctcggcaatgtcgcgcaccagatagttatgtttggtgatggggatagagatgccgtaggtgtccacttcctggaaggcgtcggtaccgatcatcgaggccggtacctggccggtgatgcagaccagcggaatcgaatccaggcgggcatcggcgatcgccgtcaccaggttcgtcgcccccgggccgctgcaggccatacagaccgccggcttgccttcggtacgcgccatcccctgggcgataaagcccgcgccctgctcgtggcgcgccaggatgtggcggatctgcgtgctctggcttaaggcatcgtagataggcaggatggagccgcccggaatgccgctgaccatagtgataccctggcgctccagtaaatgaacaaccagctgcgcgccggtaaagcgcattgtgtttgatgtggtgcccgaacttgccatgctccagtccttttcttctgggccgactttaccggggggctcgccaacaaaaaaccccgctcggtttgcgccggcggggtttggaattcgtgttgttccggaccctacggcgcattgccgacgacgaccaccacagacacgacgaccaccgcggctggcgcggtttttagtagggtcgaagcgatcagggttgcgttcattagggacctgttgtgtcgaaaaataagctgaatttatacaaacacaggttttacgttttcacaatggatttattttcatccacgaaaatttgcgcgaaagatcacagttcggcgcaaaagggcagaaaacaaaaaaccccgccggagcgaggtttttatcagcatggttacaggtggtagccgcaagcacactgtattacgtcaacgccaaaagtatacgcgatcgctgcagttcgcgcaatttaaggtcggtttttctctgtcatagagtatggatgagaggggcggatttgtccaaaaaatactgttcatccatacagtatttatctatactgggtgtgttcactttgtgccattcgggggccgcaagtttgaccggcgcaacgaagtcctggctgaaacgggtggtgccgtcagtgccttaaccccgggagagcacactgtgttacgtcaacaacgtgcagtcactggcccgcgcggcaacgcgtggctcagcgctgcgcacccctgtcgttgcaggcggcgggccgggaagccgttcatggaaaggacgaactatcggccagggcagacgccgccggcgacaggcagggataagctggcaacgggcagcggaaaggtacgtcagcttattgtgctccttaaccacaggagacgcgcgtatgggcggaatggatattattattttgatcctgaaactcatggttgctgtgttgcaactacttgatgcagtcctgaaacagttccgctgattcaggttcaagtcgcacctgaggggggcgggaaaccgcccccctgcaggcgcccgccgggcgtcccgggatgacttgatggaggaagctatgccacccctgttaattgccgccacgacgccggatgccccggggttcgcggcgctacgaattgaaagccttgaacagcatttcaatatgctgcgccgcctggcggaaaactggcagagcggcaaaaaccgctttaacgcgccgggcgaaacgctgctgggcgccttcgtcaaccaccagctggtaggggtatgcggcatcaatagcgatcccttcagtccgcagccgcgggccgggcgcattcgccacctctacatcagcgaacgctatcgtcgccggggcatcggccagcagctgctggtctcggttatcacccactccagcgcctggttcgactttctcaacacccatgccccggcgcaggcctggcccttttatgaaaggcttggttttcgcccggtgtacgatgaaccgcgggtgacgcatcgcctgttttgttcgctttaacccccgctggcaggcagcgcgggcgcgtgttacattccggtgaccttcactgttgaacctgtctgcgatgaccctcaccgtattctgcattttgctgttcgccgccctgctgcacgccagctggaacgctatcgtcaaagccagcgccgataaaatgtacgcggcgatcggcgtcagcggctcggccgcgctgatcgccctggtgatgctcccctttgccccgcagcccgcgctggtcagcgccccctatctgctggcgtcgtgcgcgttacaggtggtgtatacggtgctggtggcgaagacctaccaggtatcggatatgagccagacctatccgctgatgcgcggcactgcgccgctgctggtggcggcgataagcgtgctgttcctcggcgatcgtctgtcgccgctggcctggctgggtatcggcgtcatctgcctggcgattctggcgatggcctttaacggccgcgccagctcgcgcaaaggcatcgtgctggcgctgatcaacgcctgctttatcgccggttatacgctggtggacggcaccggcgtccggctggcgggctcggcgctgggctacaccctgtggaccttttttatgaacggcttctgcctgctgtgctgggcgatggtggcgcgacggcgtgaggccagtcgttatttacgtcagcactggaaaaaaggcatcctcggcgggatcggcaccatgggctcctacggcctggcgctatgggcgatgacccaggccccgctggcggtggtcgccgcgctgcgtgaaacctccattctcttcggcgcgctgatcgcctttatcgtcctgaaagagcaactgatgccgctgcgcatcgtggccgcctgcgggattgccgccggggcgatcctcctgcgcctggcgtagcctgagatggcaacattagttgccgttcctgtttacataatctgcctggaattccctcaacaatcggcactttgcagttgttctgtcattttaatatggtagattcctccatcgtttacgggatgtgccagtcacatattcttcatttctctttactcacaaagtattcatcgacatgaaacggcataagaacttcaatttgttgttgatgctggtactgctggtggccgtcggccagatggcgcagaccatttatattccggccatcgccgacatggcggtcgcgctgaacgtccgcgaaggggcggtacaaagcgtgatggcggcctatctgctgacctacggtatttcacagctgttctacggcccgctctctgaccgcgtcggtcgccgaccggtgatcctcgtcgggatgtcgatttttatgctggcgacgctggtagctattaccacccatagcctgccagtgctgatcgccgccagcgccatgcaggggatgggcaccggggtcggcggcgtgatggcgcgtaccctgccccgcgacctgtacgaaggcgctcagctgcgtcatgccaatagcctgttaaatatgggtattctggtcagcccgctgattgccccgctgctcggcggcatcctcgacaccctgtggagctggcgcgcctgctacgctttcctgctggtcctgtgcgccggggtgaccttcagcatggcgaagtggatgccggaaacgcgcccggaaggggcgccgcgcaccaaacttctggccagctacaaaacgctgttcggcaccggcgcctttaactgctatctgctgatgctgatcggcggcctggcggggattgcggtattcgaagcctgctccggggtgctgatgggcgcggtgctcggcctgagcagcatggcggtgagtattctgtttattctgccgatcccggcggcgttcttcggggcgtggtttgccggccggccgaacaagcgtttcccgaccctgatgtggcagtcggtgatctgctgcctgctggcaggtctgatgatgtggatcccagggctgctgggcatcatgaccgtctggaccctgctggtgcctgcggcgctgttcttcttcggcgccgggatgttgttcccgctggccaccagcggcgcgatggagccgttcccgttcctcgccggaaccgccggggcgctggtgggcggcttgcagaatatcggctccggcgtgctggcctggctgtcggcgatgatgccgcaaaccggtcagggcagcctcggcctgctgatgatgctgatgggcctgttgattctgctgtgctggctgccgctggcctcgcgcttcacccaccatcagcagccggtataagcgcggcagtggttcaccggatggcggctgacgccttatccgggctaccggactggtcgtctgccggcccgcgcaagcgcagtgccgtcattttgccgggtggcggctcacgccctacccggcctccctaacaacaccgagggatagcccggctcattttcaggtcaggctatgcagccactcgataaaggcgtcgattttcggccactgacggcccggcagggtgctcacgtaataatgctgatggcatttcagcgtcatatcgccgaacggggcgatcaactccccactctctaaccgcttctgcaccagccgtttacgccccatcgctaccccgacatgattcatcgccgcaatcaccgctaaatcagaacgatcgaagccaatgcccgacgattgcggcagttcaatcccaaattgttgtgcccaactgaaccattcatcggtgccggaatcattgctccatgcctggcgatcgtgaagcagcgtacagtggcgcagattggcaggatttgacgttaactgcagctggcgggcgtaatacggcgtacataccggcacgatcgcctcatccatcagaaaatggtggcttagctgcgacgacggcgcgtcatcaaaatagattgccagatcgatacccgcccgctgcaggttgacgttatcgttgccggtcagcacggtcagcgagatggccgggtagcggcgactgaaatcccccagcgccggcaccagccagcactgggcgatagagggccgcgagtagaccgtcagactgccggagagctcctggtttttgatgtccagaatctcctgattgaggccatccagcgacgacttcagcgcccagtaaacgcgtttcccttctcgcgtcagctccactttgcggtgcgagcggacaaagagctggatccccagctcctcttccagctgattaatccggtgactgacggcgcttggggtgagcgccagctcgtcggcggcaagggcgaacgactcgtgccgcgccgccacctcaaacgtcgacagcctggagagttgccagccgttcagcaaccgggtacctaaggtttttagcacatccattatgcgctcctggcgataatagggagtctggatgataaaaaaataatgccggaacttccgctaaaggatgagttaatttgacccatagcatatttagaggtcacttttagagctaaatcacctttttgatttaatttggctcatctgaaaggtcatttatatcgtttgtcagcccatgccgagtttctgttcaataaccacacgttacttacggcgaggtggggtatggaatcgcaaatttgggttgtgagcacattgctgattagcatcgtgttaattgtattaaccatcgtcaaactgaagtttcatccgtttctggcgctgctgctggcgagctttttcgtcggggcgatgatgggaatgggcccgctggagatggtcaacgccattgagagcgggatcggcggtacgctgggcttcctggcggcggtgatcggtctcggcaccattctcggcaagatgatggaggtctccggcgcggcggagcgcatcggcctgacgctccagcgctgccgctggctgtcggcggacgtgattatggtgctggtcggcctgatctgcggcattaccctgtttgtcgaagtcggggtggtgctgctgatcccgctggcattctccatcgccaaaaaaaccaatacttcgctgctgaagctggctattccgctgtgtaccgcgctgatggcggtgcactgcgtggtaccgccgcatccggccgcgctgttcgtggcgaataaactgggggctgatatcgggacggttatcgtctatggcctgctggtcggtctgatcgcctcgctggtcggcggcccgctgttcctcaggctgctcggcaaccgcctgccgtttaaaccagtgccagccgagttttccaacctcgacgttcgcgaagaatcgacgctgccgtcgctcggcgccacgctgtttaccgtgctgttaccgattggcctgatgctggtgaaaaccgtcgctgaactgaatatggcgaaaggcggcacgctgtatacagtgctggaatttatcggcaaccccatcaccgcgatgtttatcgccgtctttgtcgcctattacatgctcggcatccgtcggcaaatggggatgggcgttctgctgactcataccgaaaacggctttgggtccatcgccaacatcctgctgattatcggcgccggcggcgcattcaacgcgattttgaaatccagcggcctggccgatagcctcgcggtgatcctgtcgaaccttgatatgcacccgattttgctggcctggctggtggcgcttatcctgcacgccgccgttggctccgccaccgtggcgatgatgggcgctaccgccatcgttgccccgatgctgccgctttatcccggcgtaagcccggagatcatcgccattgccatcggttccggcgccattggctgcacgatcgtcaccgattccctgttctggctggtaaaacagtactgcggcgccagcctcagtgaaacgttcaagtactacacgacagcgacatttatcgcgtcgctacttgcactggccgccaccttcctgctttctttcattatctgagcgcaaagagacgtatgatgaaacacgctgacctgaccaccttaaccgcgaccttcccgcttgtgcaggatctgatcgccctgaaagaaaccacctggtttaacccggcaaccaccaccctggcgaaggggttgccttacgtcggtctgaccgccgacgatgtgcaagacgcccatgcccgccttcagcgcttcgcgccctatctggcggcagccttcccggaaaccgccgcgagcggcgggattatcgaatcagaagtggttgccattccggcaatgaaacgcagccttgagcaaaaattcggccagccaattagcggcgaactgctgctgaaaaaagacagccatctgccgatctccggatcaatcaaagcgcgcggtgggatttatgaagtgctgacccatgcggaaaagctggcgctggaagccgggctgctgacgaccgcagacgattatcgcaaattgctgacgccggagtttaaacagttctttagccagttcagcatcgccgtcggctccaccggcaaccttgggatgtcgatcggcatcatgagcgcgcgcattggttttcaagtcacggtgcatatgtccgccgatgccagggcgtggaaaaaagccaaactgcgcagccacggcgtaacggtggttgagtatgaagaggactatggcgtggcggtcgaacaggggcgcaaggcagcggaatccgacccgaactgcttttttatcgatgatgaaaactcgcgcacgctgttcctcggctatgccgtagccggcgagcgcctgaaagcgcagttcgcgcaagcaggacgcgtggtcgatgccgatcatccgctgttcgtctatctgccgtgcggcgtcggcggcggccccggcggcgtggcatttggcctgaagctggccttcggcgaccacgttcactgcctgttcgccgaaccgacccattcgccatgcatgctgctcggcgtctataccgggctccacgaccagatagcggtgcaggatttaggcattgataacctgaccgcggccgacggtctggcggtcggcagggcgtccgggttcgttggccgggcaatggagcgcctgctcgacgggttctatacccttgacgaccagacgatgtatgacatgctgggctggctggcggcagcggaaaatatccgccttgaaccctccgcgctggccgggatggccggagcgcagcgggtctgcgccagcaaagcgtaccatcagctgcaggggctgagtgagcaacagctgcagcaggccacccacctggtgtgggccaccggcggcggcatggtgccggaagaggaaatggcgcagtacctggcgaaggggcgctaatctttagcgcagcagcggcatcagcgcctctggcggccgctgctgtcgccgcaggtcccgcatcactcgcatatagggcccgctaaaatcgtagaactgccggtaacccgcgcacagcgggtcttcctgttcgccacagcggcacaggcgcagccacgggcagccgtagcaggtgctgttggccgccggcgcgcctggctgggtcagcgtctcgccgcaccaggcgctcagcgtctcgctaaacagtaaaatattgatgcgcccaatatcttcccgcacccagcggtgaaagactgcgcagagaaactctccccaaagcgcggcgtcgccggccgccagctgcggaataaaatggatagcggtgagcccctgttgacgaagctgcgcatagaacgcctgcggttgatggcaatgatgcgcctccaccacgacagcctgaaagggagtgtcatgttgctggccgggggcatgagtgagaggcaaattcgccggacatcctgtcatgacatatccctaatgaataaaacgatcggttgaaggtgagtaacagcaaacaggaatgccagagaaagtactgcgagtgcgatcaaaaatttgtcacgaaccgcccgcggctgtaaaaaatcgctatcgtcgacatccatcagatgacgacggcgggtatagccccagaggatcaccgccacaatcgccagtacgccgatcgacagccagaacggcaggccggcgcggtgccagctgtgcttaatcgccagcgccatcagcgcgccgtagcccaacagggtgcgaaaccaggccagcgaggtgcgctctggctgaagaccgggatcgctttcccgccgcgcccggcgtttatccgccatacaccaccagcagcatcaccgcggccaccaccgccagcagcagaatgctaatcaccagcagcgtgcgggtatagggaaggtcctgcttgaggcgcatcgccttctcgttattcagccagcgcagatagccatagatggccatgccgccggcaaagagacacagcagcagggcgagaatttcacggatcagcggcgtggcaaagtccggcgctaactggtcaaggccgacgccggcggcgagaaaaccgagcgccgtgcggatccatgccagaaaggtgcgttcgttagccagcgaaaagcggtaatccggcgcttcgccgaggcgggagattttcattacagttccttgttcatcgcgctgcaggcttcagcatagcgtaaatcaggaaccggggagaagaaccggcgccccgcagggcgccggtattacaacggggattaatgcagctcaggccagtaatctttgttggcggcaatgaggtcgtcgaggatcgctttcgccaccgaggcgctcggcacggttttcgacagggtaatcgcctgccacagcttgtggtacgagcgctgttcccaggcatcgaccaccagtttttccactgccacctgctggctcatcagccctttctggaaatgcgggatgtcgccgaccgtcagcggctccggtccgttgtggcctaccagacaagggatctccaccatcgcgtcggcgtcaaagttatggatcgcgccattgttcggcacaatcagcagcatcctttcctgcgtgttaaaggcgatagccgtcgccagatcgacgatataggaggcatgctcgtcaatctccagatcgccggcggtggatttcccggcggcgatgatcgcccggcaggcgctgaagacgtttttctcccgatgatccatcacctcattggcgcgggtgcgttccgggttggagtgggctaccacatagtccgggaacagataatatttcaggtaggtattcggcatggtctgcggatccagcgcctgcacatctttcgctttggcaaaggtgtcgttccagctggcctcggtgtgcggatcgttcgagggcggcacatagccgtatttcgccacatattcgcgcagtttcggcatcaaatcattgccgtcgaggtcctcaatcgaggtccaccagccgaaatggttgaggccgtagtagcgcacgcgcatctgtttacggtctttgaggccgacaatctgcgccatccgcccttcaatgccgatcggcatatcgcagatgttgaggattttggcgttcggccgcagacgacgagtggcttccgccacaatcgccgccgggttggagtagttaagcatccaggcgttcggcgaatatttttccatataatccaccagctccagcacgccgccgatagagcgcataccgtaggcgatcccgcccggtccgcaggtctcctggcccagcacgccgtggcgtagcgggattttctcatcctgttcacgcatcggatatttcccgacgcggatatgcgccatgacaaaatcaacatcggtaaacgccgcctgcggatcggtggtatagctgaattcaatctccggcgcctgctctttgaggatcactttgcacgcctcggcgatggtctcctggcgcgcgccgtcgttgtcgtaaaatttcagcgaccgcagcggaaaacgatcctggtttgccagcagcatcaggacaatgcccggggtgaaggtgctgccgccgcctgcgataacaactgagaattttttcatgatactgcctccgtcatggtggtatgttcggtcgaaagagaatctttcatcaggttttccagctggtcgcgcacctggggaacgtgcaggccgacgatgacctgaatcccgttgccgcggcgtactaccccgtgggcgcccagcgctttaaagacatcgtcactttgcgttttcgccatatcgaccagcgcgatgcgcagtcgggtggcgcagttgttgatgctttcaatgttgtcggcgccgccgagggcctgcaggaagccagcggcctgacccagccgggtctctggcgcggcggcggccgtggttttacctcgtgccgcctggtaatcggccttgctgtagagcttgatttcgctctcttccctgccaggcgtcttcaggttcagacgcaggatcagggtacggaagactacgaagtagagggcggtgaaacagaggccgatgcctatctgaatgaacatcatcgaagcgtggtgatggaacattgggatccagttttgcggcaagaattgatcgagcaggccgccgccgaagttgcctactaccccgcagatgtacatcaccgtcgccatagtcgccgccagcaccgcatgaacggcgaacagcagcggcgagatgaagaggaaggtgaactccagcggctcagtgatcccgaccagcatcgcggtcagggtggcggggatcagcagtccggcgaccttgacgcggttttccggcgcggcggtgaagtagagcgccagcgcaatccccaccgacccaaacactttcgagttaccgtgcagggcaaagccgccctccgggaacagcgtcttcagcggttccgtactctgactgaacgcctgcagatgctctgcccagtagacctgcagtccgccctccaccaccgcagggccaaagatgaacgggccatagacgaagtggtgcaggccggtggggatcaggatgcgctcaaggaagatgtaaacccacaccccaagcgccccggctgagcgcagaaaggcctgcagcgattcaatacccagctggacctttggccagccgagcagggtcagccaggcgcaagggatcatcgcgaggaaggcgacaatgaccacaaacgatgaaccctgaaagatgccgaggaataccggcaggggtttatcgaaatagcgattgtgcagggccgtcaccagaccggagatgacgatggcgccgataatgctggtgtcgagggttttaatcccggcaatcatcgtcaggccgctgccggccgtgggttcagcggaaaaatcgacgccgaagaagtggccccaggtcatccccatggcgttgataaagtagttccaggtgagaaagctcaccagcaccgccagacaggcccggccctgggcctgtttcgccaggccgatcggcagaccgacggcgaaaatcagcggcatattacgaaagacggtccagccgccctcctcaatgatgtgaacgatctgggcaaacaggctgtcgggtgcggtcagcgcttcgccgacgaacatcgggttgcgcagcatgatggcgataccgaccacaatcccggcaaaaggaaacaataaaaccggggtaaacatggcgccgccaaaacgttgtatttgactgagcattgggaaatcctcatgtaacaactcgtagggtgagtggccttctttttcttgattaccggcctgactggagaataaaaatttgcccgtccgacaacatgccgcgccgttgcgattcgtgatcccattcatggttttaatttggccaaagttgtctacttcgataacaaaagttagacatcgataagtcaggcagcgaaattaactaaatgaatgtgtcttaattgattgtaattaatctatttttttagaaaaaagagcacaaagcgacatccccttttcctgcacaagaggactactggtgatctacaaatccattgctgaccgcctgcggctgcggctgaattccgccgacttcgccatcggcagcccgctaccaggagagaaaaaactggccgaggagttcggggtggcgcgcatgactattcgcaaagccatcgatctgctggtggactggggattggttgtgcgtcgccacggctcgggaacttacgtggcgcgtaaagacgtccatcatgaaaccagcaatctgaccggcctggcggaagtgctgcgcaagcagggtaaagaggtggtgagtcaggtgctggccttcgaggtgatgcccgccccgccggccatcgccagtctgctgcggattaaaattgatgaacggatctacttctcgcggcgggtgcgctacgtcgacgacaagccgctgatgctggaggatagctatatgccggtgaagctgttccgcaacctgtcgctgagtcatctggaagggtcgaaatttgattatattgagaaggagtgcggaatcatcatcagcgggaactatgaaacgctgacgccggtgctggcggacaagcagctggcgcgctcaatgaacgtcccggagcagacgccgctgctgcgtattacctccctttcctacagcgacagcggcgagtttcttaactattcggtcatgttccgcaacgccagcgagtatcaggtggactatcacctgcgccgcgtccaggcgcaaagcccgctagctcagtccccagaacagcacggcgagtagctgcggggtgataatgcgcaggaacatcaccagcggatagacggtggcgtaagagagcgccgctgcgccgctggtggcgtgcaggttgttggcgaaggccagcgccggcgggtcagtcatggagccggccagcatgccgcacagcgtcagatagttcattttcgccagcatgcgcgcgaggatgcccaccgtcagcagcgggatggcggtgatgaaaatgccgtaagcgatccagctcagaccatcgccctgggtcagggtggcgacaaagtccccccccgattttagcccgaccaccgccagaaacagcactatccccagctcgcgcagcgccaggttggcgctcggcggcataaaccagtacagcttgccgatactgccgatacgcccaaggatcagcgccataatcagcggcccaccggccagtcccagcttcaatgctgcagggaagccgggaataaacaacgggatagatcccagcagtaccccgagtccgatgccgataaacaccggcagcatctggacctgctgcagcttctgctgagcgttacccagttcggcggccacggcgtcaattgcctccggacggccgaccaggttgaggatgtcaccaaactgcaggctggcgctgctgctggctaccagctcgacgcctgcccggttaagccgggagatcactacgtcatagcgctgtttgacgtgcagatcgcgtattttcttccccagcactttttcgttagtgaccaccacccgctccactttcagatcggtgccgcgcgtcgacagcgaggtggccacctcctggcctatcaccagctgcgcattgtgcaaatcctcaggtcgccccaccaggtgcagcaggtcgccagcctggataagggtgcccggcgcaggcaccatcaacagctcaccgcgtttcagccgcgaacagacgatgttgtcgttgttgagcatcggcacatcctgaatcgccatctggttgaggttggggttttccacccgcacgttgatggtgtgcaaatgagcgtggccgttaccgctgctctcctcaaaccgctgggcctctttctcgacattgatgcgaaagaacagacgcaccagccacatggtcagcagaatgccgcagatgccgaacggatacgccatcgcatagctcatccccatttgatcgaccacctcgaacggtacgccgagatcgcgcagaatttgctgcccggcccccagcgccggcgtgttggtcaccgcgccggagaagataccgagcaccaccgggagaggaatattgaacagcttatgcagcaccgcggtcaccaggccgccgaggataacgataaggatagcgaacagattgagccgcaggcctgagacccgcagcgaggcgaaaaagcccggccccacctgaataccgatggtgtagacaaacaggatcaagccgaattcctgaataaaatgcagcatcgggctgctgagggtgacccctgcctgatcgacaaagtggccgacaataatcccgccaaacaggacgccgccaatgccaaagccgacgccgcggattttgacattgccgatccacaaccccactaccgccaccagcgccagcacgctgaccgtcaatgctatctcactcatggtaccgtccctgtgaataacaccattaactacagggattatgaccgctgccaggtggattgtatgccgcctggcgcacaataatcatggagtaagatacgctactcaggcgcgttcttatttttcgctgcgatagtgagttgctgaatacttttctccggggaaggaagtgcttcaggcatagtgccacccaggtctttaatagtctggcgtactttttgccctacgtcataatgcgttttgttggcgagttgcttcgaatcaaccgcgtcccgacgtagtttttcttccgtttgggtagcacgaaacaggttggccgcgagctcagtcgatcccatatagtcgagtattttttggcttttctttaggcccttacgctcatggattgctttttggtcaagaccaccatagagacctttataaccatggttttgaaagacagcaaaatcaagagtcgtctcaacaccagcacgttgggccgtttcaaccagatgtttattatgctctttgagctcattgtgcaggaacagtcgcttttcatcctctcgtagagacttaaatatttgatcatcttgcaattcctggcgccgggtttgcaaggcaaagtacgtttgccccgcagcaatcaccggtttcgacggatcgccattttgcactaccagatagcaggcgtagcgtgagaggtggaaatcttcaagattcctgctggcgccagaacctaattcgaccattttgttggtttcaacaaaatggtctgccgagggatgaccactcgcctcacatgaaattatcgcttttgcaatgaccttataaaaattccgccactctttatagtcaagcaggggaccaaggttgcgggcagaccaatactcccgccccgcctcatcgctctttctaatcgcttcaaatggctgctgttcgttcataacgtatccttgtttgagtgagtcccaaagtatgattgttttttaaactgaaacacccgttgcagcaaggaagtttattgtgctctcgcacacaaaaaagccccgaaaatcggggccttataagttattcgcttaattaactatttaatgccggtcgttcgctgatggcgatacgctgcggggcgatctgctcaggctcattgcgggtcagatcgatatgcagcaggccattggtgaaggtcgcgccagagacctccatgttgtcggcgagggtgaagctcaggctgaaggcctggctcaccaacccctggtgcagccatgtggtctctttttccggctgctgcggcgtgcctttcaccaccagacgggtgccttccagttgaatatccagatcttcctgacggaaaccggccagcgcaagggtaatgcggtagtggttatcgtcgcttttttcgatgttatagggcgggaagctttggctttcaccggcggtttgcagggcgctggccagtttgtcaaaaccgatccattgacgcagcaggggggataaatcgtagttacgcatactgttttctccttctaagaagcgagtgaatacctgcgaattctgtaaattcgcatctgctccctgacggcgagcaggttgttacatcaggccgccacgcggcctgaaacggacaattagttgatttcgatgcggcgcggcttgttcgcttccgggatcacccgttccagatcgatatacagcaggccgttcaccaggttggcgccgcggacgtgaatgttttccgccagctggaatttgcgctcgaagttgcgctcggcgatcccctgatacaggtaggtccgctctttctgctcggcggcgtgggcgcctttgacgatcagcagattgtcctgggcagtgatctccagctcgctttcagcaaagccagccaccgcgatagcgatgcgatagtggttttcgtctaccagctcgacgttatacggagggtagccgccgttgctctggctttgattgttttccagcaggttgaacaggcggtcgaaaccaatggctgaacgatatagcggggaaagatcgaagttacgcatagtaaatagctcctgaaaatcagcgagaatcaaatgaccttccatcgtggacaggccgcggtaatccggaatacccctcaggcgtattctcagtgggttacacctataaaatgggtttctccccgtccttttcaagggattgagggcaattttttttgcagtttatcgatgattgcttagactgggtggaggagcacaaaaagcaaagtgcgatgcccgccacagtgcggcgcaataacactatgcattcacgggatggcccgatataaccgctgaaaggttatctcaacgcccgaaacgacaatggaagaacaatgaaaagcagacgactgttaaagctggtcctgttcagcgggataataagcctgagcggttgctccagcgtaatgtcacataccggtggcaaagagggaacctatccgggcacgcgatccagtgcgcaaacgctgggggacagcgataccaactggggtgtgaaatcgctggtggcgctggacatgccgttcaccgccgtcatggataccctgctgctgccgtgggatatgttccgcaccgacagctcaatcaaatctcgggtcgaaaagagcgagaaggctacgctggcgaccaactcggtgatcccgccagcgccgatgcctgcccagtaagttatcgtccggtctgcgtaacccacagctgacgataaccgtccacctcctccatccaggcaatctgtttaccgtctggcgaaaagacgatcgcgtccgccgagggcgcatgcgcatgcgtatcggttaaaaaggtgatatctcccgtaccggcatggcagcaggcaatccgatcctccagcgcaaaacccagccactctcccgacggatgccagttaaacgccgactggatacccgacgcgtgatgcgtcaactgccgcggctcgcccccctgcggggaaataagccacagctgcactacgccggcgtcgtcgcgcatcagaaaggctatcgccgtcgcctggggattggcgcgcacccagtggcgcgggacgttcaccagtcccgggtagcggcgatggtgggtgaaggtcaaacgacgctggctgacgcccgccggcggcgccggcattgtggttgcggtaccggccagcggcgccccgccaggctgcttccagccggcttcatcctgcggcagatcgacaataaacagctcaggcactttatcgccattttccgccagcgtatcgccaataaacgccagagtatggttcccgacccagccctcctcataggcgcgattaatctcatcgctgcccggcgcgggtgccggcgtcgtgcggcttaccagcacgcaccagtggctgccgccatattcgcgcggatgctgtccctgcggcgtcaccggtccatagggcgccgccacgccgacgttgcgcagatccagcgccggatcgcgctcgtgcagcacgtgatcgttgtaggtaaaactgacaaactgaccgttggggctatagacatggacgtggctgccgccgcgcagcgcgccgggcgtgtaggggggggtaatgtccatggcgtccagattctcgacagccccctgaaaggccaccaccccgcggcgatgatgaaaatcatactgccactgcgcatccggccgctcggggccatgaataaacacatagcgctcctgggttggatgcacggttaccacgcccacgtgcgcgccctgcgtggcacgataaatggtctccacagtaccgctgtttacgttcactcgctcaatggtttcgccggtaaacgatgcgccggacggacgaacgtcgaataccagccactggctgtcgggagtccaggtattaatattggtaagctggtgatgacggggagcaaaagtgacttgtttcatgacgataccctgatgcgagacttacgcatcagggtagcgtatcgcaaaaaattagcctacacgtttcacatcgccgaccagcaggatataagacagcgcgcctattaacgccaccacggagatataaaccagcgccgggccaaagccgtaatcctgcgccagatagccaatcaccagcgggacggtgatgccgcccaggccgccaacaaagttaaacaccccgccggtcaggccgatcaggcgcatcggcgccagggaggagaccagcgaccaggtgatagacgcaaaaccgttaccgaagaacgccagcgccatcagcgccatgatccagatggggtcgttggtgtagtttgcccccatgatgcaggtggagatcaacagtccacagatgatcggcgttttgcgcgccacgcccagcgagtagccttttttcaccagcttatccgccagccaaccagacagcaggacgccaaaaaacgcggcgaggaagggcaccgtggtcataaagccggccttcagcgcggtgatgcctttttcctgggttaagtagttcggaaaccaggtcaggaagaaccacagcgtcgaggttaccgcgaactgtccaaggtaaacgccaaccagcttgcggtgaaaaaccagcttccagtccgctttcgataacggttgacgcgcctctttcttcagcggcgcatcgccatccaccaggccgccgccgtcgcggatatagtcgagttcggctttactgatgcttttagtcaggcgtggcggttgataaaccttgaaccagatcagcgaccagataatgccgataccgccggtaacgataaacacccagtgccagctcaatagctcctggatccagatcagcagcggcgtgaggaaagccagacccacaaattgccccgaggtataaaacccgacggcggaagcgcgctcgtgctccgggaaccagctggtcaccatgcggttgttggtcgggaaggctggcgcttcgaagatgccggtaatggcgcgtaaaccgataagcgacattaaaccggtggcgaagccttgtagcaacgtcgccaccgaccagccaaatatagcgataaagtaggtaagcctggatcccacgcggtcaaggaaccaaccgccagggatctggcagagggtatacagccaggcaaaggcggaaaatacgtagcccatttccgctttgctaataccaaactcctcctgaatatgcgccgaggcgacggcgaggttggcacggtctacataacaaataaccacggtaataaagatcatgatgagcgtcagataacggcgacgcccggtttttacagcggtaactgaaatatccatcgcaatctgtctccagattttgggcatagcgaagccgctcaccatgcccggtaatttacagagggtgtttttgttttttattaataactatgttgcgatgcgctaaataattcgtgctggggaaaggcggcaaattttcgcatccctgggagcatacaatagtatgtgaccagggtaagaaaatgcagccaacgcatcaccagtgcgaagtatgacgcgcatttaccattcggcgacagatccatcctcataccgccacaacggatttcgccagtccggcgcgtttttacttaactcaatcacgcgggcctcatcaatttccacgcccagccccggcttcatcagaggtttaaagaagccgccttccatattgaaatcttctttgtttttcacaaaatcaagcagttcggcgcctttgttgtaatggatccccatgctctgctcctggaagaccgcgttatgcgaaacgaaatcaacgtgcagacaggctgccagcgcgatcggccccagcggacagtgcggcgccagcccaacgtcataggcttccgccatgccggcaattttatagcattcggtaataccgcctgcgtgcgacagatcgggttgtaaaatagccaccccgcccgcttccaggacccgtttaaattcaaagcgcgaaaacatacgttcgccggcggcaatgggaatatgggtttgcgccgccagccgcggataatattccgcctgctcggctaataccggctcctcaataaataatgggcgatatggctccagctctttaattaataccttagccatcggcgcgctaacgcggccgtgaaaatcgagaccaaactcaatttcattgccaaacgcttcgcggatttgcgccacggtattcaccgcggcatcaaccgcgcgggaattatcaatgatacccatctcttcgcagccgtttaatttaaaggtgtcaaaaccaatgccgcgcagcttcttaatcccgtcaatcacttcggcggggcggtcgccgcccacccagctgtaggctttaattttgtcgcgcaccagcccgcccatcagttgccacactggggcattcaggaccttacctttaatatcccatagcgcctgatcaataccggcgatggcgctcatcataatcgggccgccgcgataaaagccgccgcggtacattacctgccacaggtcattaatccgcgccggatcctgaccaatcaggtaatcgccaaattcatgaacggctgcctccaccgtacgggcgcgcccttcaatcaccggttcgccccagccgacgatgccttcatcggtttcaatcttcaggaacatccaacgcggaggtaaacggtacgtggtgatattggttattttcatttcactgcctctcgatacgcttttacgaatgcggctgcctgctgcgcggtacgttcaaccggctggccggcacgatagagatcgctacccaatcctgccccaacacagccggcattaatccactgcgccaggttttccggcgtcacgccgccaacggcaaagaccggaacctcgggcggaagcacggctttcaacgctttgatgtaatccgggccaaaagccgatgacgggaagattttcagagcctgcgcgccggcatcgagcgcgctaaaggcttcgctggcggtggcgcagcctggacacacggtcatgccgtaacccaccgctcgccggatcacttccggttgaatgtttggcgtcacaatcagccgacagcccatggccgccagcctgtcgacctgctccggttgcagcaccgtgcccgcgccgataagcgcctgctcgccgtaagcgtcgacgacctgcggaatacttttctcccactgcggcgagttcagcgggatttcgaccgcgtcgaaaccggcgtcgataacggcgccaacgtgagccagcgcctcgtctggcgtaataccgcgcaggatagcgataagtggaaggttagtttgccactgcataagcgatgctccttattcctgtctgaaatgccgtatcgcccgcaaccgcgctgacttcgcggccaatggcggcgaatgcctgctgatagcgggatgttaacgatgacccagcgacgagactgatcgcctgctgtccggcgaatgtgtcgctgagggtggcaacttcagcgccaatcagcaggccggaaagaaattcgctaacctgctcgcgaggcagcgcgcccagcacgtgcgaagcgcgaacttcaaacagctgcggcaggacggcggggttgttgataccgcgctgcagacctgccgcgaatgcggcagcggacgtttcctgcggcggtaagccggcgcccaccagcgagtgctgaagcaacagatgatgcaattcaccggtcaaaacggtacgaaaatcgtgaatttgccggcgatcggccagtacccacttgcagtgggttcccggcatcacgtagacagacgaaggggctaaggcgcgagcgcccagcagctgcgtttcttccccacgcatgacgttatggttatcgtcacgggaaacgcaaaggccgggaattatccagatattgtcgccaacggcagttaactgctggccaatatccgagaaagcggcaggaagcggcaaataaggggcgattttccagcccacgttgctgccgaccatccctgccatcaccaccggtgtggcgccatcgcgccagtgctgtgtgatttccgctaacaccgcagcgggagagcgaccattcaggcgcgttacgcctgcttcagattgcctgctttccaggcattcttcgccctgataaagccaggcgcgtaaattcgtcgatccccaatctattgcgatgtagcgagccgtcatgtgatttccttaagccttcgtgtcgagctggcgatcatcgtcaacgccgcctgctccgccgcgtcgctatcctgatgccgaatggcgtcaaatagcgctttatgttcctggagggttttcggcatgttgccttcatcgcccatccaggtccgttcaaataccgcccgctgcagcgaactgatcgccacgctaagctgctgcaaaaccgggttatgtactgactgcagcaccgcctcgtggtagcgaatatccgcttcgttaaaggcatcccggttttggttgttggcgatcatgtcattgagcgccgactcgatttccgccagatcgcttgaggtggcgcgttccgccgcccaacgggcaatggcgggttcaaccaggttgcgcacttcactcatcgcgctgataagacgcgggtcatagtcattttccagtacccactgcagcacctcggtgtcgaggtagttccactggtttctgggagcgacaaacgcgccgcgatagcgcttcatttcaatcagccgcttcgccatcagggaacgaaacacttcgcggatgatgttgcgcgaggtttcaaactcctcacagagttccgcttcggccggaagcgccgaacccgggacgtatttaccgctgacgatctgtttgcccagcgagatcacaatgcgatcggtcttattgagagtcatggagagtccttgtgctctatgtgtactgctctactttaccgtcgctgctgaatttcgcctcatgtttgtactactaacgtgatgctgtacgttatcaacatgagcgtaatgtagtacaacattattgtattgtactacaatttggatcacaaaaagaacaattcatgaaaattaaagcgcagcggccctggcaagaggcgataagagagaaaattaaggggaggaggcgttaaaacgcttcgccgacctggaagtaaaagccgctgctgcctttgccgataccgtagtcgaggcgaacattaacgcgaggtttgaattcaaagcggtagccaacgcccgccgaaggcagccagcggccattattcagcgacgacagtgagggccccatggttcccgccccggcccaggcgacaatcccgtgccgccaggtgagctgccggcgatattccagctgaccgctgacgacgtttttatcccggtagcgcccctggtagtagccgcgcatccgttcatcgctgccgagcagcggcatcatgctccacggtacctcgccctgggtgaaggcgccatcggcctcccaggcgagcacgcttttctcgctcagggcatgataatggctatagtgcagctgaaattcctcaaagcgggtatcgctacctaatccgggcgcatagtgggtatagcggaggttggcatactgaccccggcgcgggttagggacaaagtcgcgatcgtcccagttaatatcgatgctggcgccggagctgaataccgacggcccctgcggagtgttttctatcttcggccgatcgtcatggtccatctcatcggcattctgcgccgccagcgaccatcccgccccgagataaacatgatcgataagctgccgataaagggtgggtcgcagggtcagtacctgggcggtatacttctctttttcattgtctttatctccggcatgaaaaccctgcccccaataataagtgggcgtattggctatcgacccttcgacaaaaacgcgccacagatcacgatcgaaaaaggtgtagtttttcacgttgaggccaaaggcgccggtagagctggcgtagccgctgagcgtcagggtcgagttctggctggtggtatcctgcgggtcgggacgatacaggccgacgacagcggtgccaatgcccaaccctagttccggcgtatagaacggaccgggcatcacgccccagtcgatgcctttgctggcgtcgaacttatcgctggcgccgagatgctgcagccagccgtcgattttctcgcggctgagcgcctcggcctggctgcctgtcgggcaggccatcagcagcagaaaagtgataaacagtcggctcaaaagcgatactcgccggcaataaagaaactgttacgttcggcaaagccaaactcggtagtaatattaaaattctgcgtcagctcgtattgcgcgcccaccagaacgttccatggcgactgaagatgctgcttcacatcgaagcgaccgttattgtcctggttggccagattaaccatattctgcagcatcggcgacggcatcgagagatcgctgaggctgcctttaaactcctgctgcacatcctgatacatgctgccaacccacagatttagctttccggcggggagatgcagcgcatcgaccgatggcgtactgaaacgatagccaacgcgcggcgaaaaggtaagcgcatcgatgctgccgtcgaggatatcaaagcgcgtttgcgtgtagttggcgtccagcacggtaaaccaattgccgacgccgcccaccagggtggtgcccatcccgtaggtagtacctttaaaatcgagacgaaagtcgagatcctgcatccccggcaggggcaccactttaccgttcggtcccttcaggccgacagctatctgcgaaattgaatgcccttcggtgtgccccaccaggccataaacgttcataaacggcagcagccaggcatccagcttgagcgtctcggttttgctgctttcccgcgtatgaccaacgccaatctggaaagcgttatccagcgagaccggcccattagcgaaaatgttattcacggcgtgcttgcagacaggatccttaccgcaatcgatattgcggccatccagcgacagcccggtgaagtttatgctgtcgacattaatattctgccgcatatccatatagttaatgctgacgccaaacggcagcggcaggacgtagccgcgctttctggcctcatcgcctagcaaagggagtagcgaggacgatgctgccgccgcaggctggcgactttctggcgccggcagatccgcgggctctgcgccgtgataggcatacgccggttcgagcggcgccgttggttccgcggccgcgcaaatctgaacagaggcgaatggcagcgtaaccaacatcaaacggtggtatatattcatgaaaagtatgatgttagttctgagttgctaaaaagagggcgggtagcttatagaatcccctgcaaggattgagggatttaaatgcggattaacatctgttcatgaaaaaagagaagacagacccggcgaacgccgggccggaaagaagtttacgctaaaacgtatttttcaatggcgaaggcaacgccatcttcaaggttcgatttggtgatgaagttcgccgcttctttgaccgcaggaatggcgttatccattgccacgccgacgccggcaaattcaatcatcgcgatatcattttcctgatcgccaatcgccataatctcttccggcttgatgcccagcgcatcggccagcgacttcacgccagtgcctttattgacgcgtttatccagtatttcgaggaagtaaggcgcacttttcagcacggtgtacttctctttcacttccgccggaatacgggcgatggcctggtcgaggattgccggctcatcaatcatcatcactttcagcagctggatctcaggatccattttctccgcttcgcagaacaccagcggaatggttgccacataggattcgtggacggtgtagtagctgatatcgcggttcgcggtatacagcgtattgcgatccagcgcatggaagtgggagccgacctcgcgggagagctgctcaaggaagcgatagtcgtcatagctcagcgcggtttgcgcgacggtgcttccgtcaccagccttctgcaccagcgcgccattgtaggtaatgcagtaatcacccggctgctccatatgcagctctttcaaatagctgtggacgccagcgtaagggcgaccggtggtcagcaccacgttaacaccgcgctcgcgcgccgcggcgatggcggctttcaccgctggagagatggtatggtcgggcagcagcagcgtgccgtccatatcgattgcaatcagtttaatagccatagggtccccgggtaagatgagtctcccctcatgctaacgcgattccgctcaaaaaacagtaaaagtgtcggccagaaagggggatggaaccacagcagcggattcctcttttagcggcaaaagaaaagcccgatcgcgcgatgcgaccgggcttatacatcctgttgccccggtaaaactcgttaccgggaaacatgcggcttaaatatcgatattcgccgctttcagggcattctcttcgataaacgcgcgacgcggctcaacggcatcacccatcagggtggtgaacagctgatcggcagcgatggcatccttgacggtcacgcgcagcatgcgacggctgtccggatccatggtggtttcccacagctgatccgggttcatctcgcccagacctttatagcgctggatggagagaccgcgacgggactctttcaccagccagtccagggcctgctcgaagctggctaccggctgacgacgttcgccgcgctcgatgtaagcatcttcttccatcaggccgcgcagtttctcgcccagggcacaaatacgacgatattccggccccataatgaactcgttatccagcggatagtcggtatccacgccgtgggtacgtacgcgaataaccggctcaaaatgctgcagttctttgttctcgtggagatcgaatttccactggctgccgtgctgttctttctcgttcagctcggagaccagggtgttcacccagcgggtcaccttctgctcgtccgccaggtcggcctcggtcagggtcggctgatagataagctctttcagcagcgctttcgggaagcggcgctccatgcggccaatcattttctgggtggcattgaactcggcaaccagtttttccagcggttcgcccgccagcgccggcgcattggcgttggtgtgcagggtcgcaccgtcgagcgcgatggagatctgatactgatccatcgcttcgtcgtctttaatgtactgttcctgcttgcctttcttcactttgtacagcggcggctgggcaatgtagacgtggccgcgctcgacgatctccggcatctgacgatagaagaaggtcaacagcagggtacgaatgtgcgagccgtcgacgtccgcatcggtcatgatgatgatgctgtggtagcgcagtttatccggattgtactcatcgcgaccgataccgcagcccagcgcggtgatcagcgtcgccacttcctgggaagagagcattttatcgaagcgggctttctcaacgttaaggattttacccttcagcggtaggatcgcctggttcttgcggttacgaccctgtttagcagagccgcccgcggagtccccttccaccaggtacagttcggacagcgccgggtcgcgctcctggcaatccgccagtttgcccggcaggcctgccagatccagcgcgcctttacgacgagtcatctcacgagcgcgacgtgcggcctcacgggcgcgcgcggcgtcaataattttgccgaccacgattttcgcatcggatgggttttccagcaggtattcgctcagcagttcgttcatctgctgctccaccgccgatttcacctcggaggagaccagcttgtctttggtctgcgaggagaatttcggatccggcaccttcacggataccacggcaatcaggccttcacgcgcatcgtcgccggtggcgctgactttcgcttttttgctatagccctctttgtccatataggcgttaagagtacgggtcatcgccgcgcggaagccggcgaggtgagtaccgccgtcacgctgcggaatgttgttggtaaagcagtagatgttttcctggaagccgtcgttccactgcagggccacttccacgccgataccgtctttttcggtggagaaatagaaaatattcgggtggatcggcgttttgttcttgttgagatactcaacgaacgccttgatgccgccttcgtagtggaaatggtcttctttgccgtcgcgcttatcgcgcaggcggatagagacgccggagttcaggaacgacagctcgcgcaggcgtttcgccaggatgtcatattcaaattcggtgacattggtgaaggtttccaggcttggccagaaacgcaccatggtgccggttttgtcggtttcgccagtcacggccagcggtgcctgcggcacaccgtgttcgtacatctgcttgtgaactttgttatcgcgctggataaccagctccagcttctgcgacagggcgttaaccaccgagacgcctacgccgtgcagaccgccggaaactttataggagttatcatcgaatttaccgccagcgtgcaggacggtcatgataacttccgctgcggagacgccctcttccgggtgaatgccggtcgggatgccgcggccgtcatcctggacggagacggagttatcgctgtggatggtgacaacgatatctttgcagtaacccgcgagcgcttcgtcgatagcgttatccacaacctcgaataccatgtggtgcagaccggtgccgtcatccgtgtcgccgatatacatacccgggcgcttacgcaccgcatccagccctttcaggactttgatactggaggagtcataagaattcgacatcaacgtttctcgctcatttaatcttgggttaatccgttattttacctttttccacgcggaacatcttcgaatttttgtccgacatgtccataacgtgttcagcgctgatcgcgctgacgaaaacctgcgactgcgtcgctttcaggcggctggataacagaccgcggcgggcatcatcaagttccgaggcaaaatcatctatcaggtacaggcagcgccgcccgctgacgcgggtgaggaactctccttgcgccagacgcagggcgcacatcagcagcttaagctgcccgcgcgacaaggtatcttccaccggcgccccgtcggcgcgaatgcgaaaatccgctttatgcgggccgtgggcggtgtaggttaacattctgtcgcgctcgaaattccgctccaacacctccgcgtagtcggtctctttttcccagccgcgctggaaagagaaggtgagcgtgaattccggtaaaaattgctgacaggtatccgccatgtcttcgacgatagcggcgctgtattcggcacgccagcggctgatctgctccgccagcgggattaattccagatcccaaggccgcagctgggcatagcggctgacctgacgcagcgcggcgttgcgctgcttgaccaggcgcttcagattgctccaggcggtgaagaatccggcttcgttatgaaagcatccccagtcaaggaatgctcttctgtatttggggccgccgttgagtaaagtaaacccctccggcgtaatcagctgcatcggcatcaggtgcgccagctccgccactttgtggccgtcggtgccgtcgatacgcaccttgctgtcgccctgtttgtctttggtcaggccgatggcggtttcccgctcttcgccctgcagacggccatgcagaacaaacgcatcctgctcgtggcggatcacccggccaatttgcaaactgcgaaatgcccggccgtggccaagcgtatagatagcttccagcacgctggttttgccgctgccgttcgcgccaaccaggaagttaaagccgggagataaagcgagatccgcatgttcaatattgcggaagtctttgatgagcaagcgcgtcagtgacatatcagcgttctttgggccagggcgttatcggcgcagccagtttcaacgcggactgcgcgcagaccctggagcgtacacaaagtacgtgacaggggcgagcacagcccaggttgaaaatggcaagtaagatagcccgatattttccactacaatctcataggcatgacgacataggctgcggattgagaggccgcatcctcaatctgcacgctcgacaccgaatccgtcagcagaatgcgtacattctcgcacttcagcgcattcagcacatccagcacatagctaacgttgaagccaatctccatctccgttccggcgtaggtcacatccaaaatctcttccgcttcttcctgttccgggttattggcggtgattttcagctggttttcgctaacgtacagccgcacgccgcggaatttttcgttggagagaatcgccgcgcgcgcaaaagcctgcttcagaatatcgcagcccgcttcgaggtgtttatccggatttttcggcaatacgcggcgataatccgggaaacggccatcaaccagcttagaggtgaagataaaatcgccaacgtgggcgcggatattgttgctgccaatctgcacgcgcagcggggtatcgccgccgtcgagcatccgcatcagctcaatcacccctttacgcggcacgatcaccgaatggttcggcagcgacgcttccagaggcatcgaacagaccgccaggcggtgaccatcggtggccaccgtgcgcagttcgctgccttcggtttcaaacagcatgccgtttaagtagtaacgaacatcctggtgcgccatcgagaactgggtggcttcgatcagacgcttcatggtcgcctgcggcagggtaaactccacttcactctgccagtcatccagattcgggaaatcggcggcgggcagggtcgacagcgagaagcggctgcggccggaacgcaccagcatgcgatcgccttccaactgaaccgcgatctccgcgccttccggcaggccgcggcagatatcaaagaatttccgtgccggaacggtcgttgcgcccgcttcgtgcggctgaaccagcgccacgcgcgccaccatctccatttcaagatcggtaccggtcagcgacagcgcgccgtccgcgacctgaagcagcaggttaccgagaatgggcagcgtcggacgaccacctaacggaccgctcacctgttgcagcggttttaataaatgttcacgttctacggtaaatttcatagcgtcacgaggataatgttctgattaaattggaaaaatcttctttaatgtcgtggctttcttcacgcagctgctcaatcttgcggcaggcgtgcagcacggtggtatggtctcggccgccaaacgcatcgccgatttccggcaggctgtggttggtcagctctttggccagcgccatcgccatctggcgaggacgcgccaccgaacgggagcggcgtttggacagcaggtccgctaccttaatcttgtagtactccgccaccgtcttttgaatattgtcgatggtgaccagtttttcctgcagcgccagcagatcgcgcagcgcttcgcgcacgaaatcgatggtgatcgcccggccggtgaagttggcgttggcgataacgcggttcagcgccccctccagctcacgcacgttcgagcgcagacgcttggcaataaagaacgccacttcgcccggcaggcggatgtcgttctcgtcggcttttttcatcaggatcgcgacgcgggtttccagctccggcggctcgatcgccaccgtcagcccccagccgaagcgggattttagacgatcctcaacgccgttgatctcttttggataacgatccgacgtcaggatgatctgctgattaccttccagaagcgcattgaaggtgtggaaaaactcttcctgggatcgttctttattggcaaagaactgaatgtcatcgatcagcagggcgtcaacggagcggtagtaacgcttaaactcttcgatggcgttgttctgcagcgctttaaccatgtcctgaacgaaacgctcggagtgcatatagaccactttcgcgttcggcttacgcgccacaatgccgttccccaccgcgtgcagcaggtgagttttacccagacccgtcccgccatagaggaacagggggttgtaggcgccgcccgggttatccgccacctgacgcgccgccgcgcgggccagctggttagatttaccttcgacgaagttatcaaacgtgtgtttcacgttaacgttagagcggtaggtcggctccgccggcgccgggacattatcccagccagggcgcacgatcgtcggcgccgcgcgcgcggtctgcacctgcgccgccggaatggccgccgcagccgggcttaccgcccctttctgcagcgagctggcgggcttagcgcccacctcaaaacgcagctgcggggcgtccgcaccgcaaaaatcattgaggagtccattgatattattgaggtatttgtcccttacccagtcgagcacaaaacggtttggcgcatacagtgccagcgtgttatcgctcagttccgcctgcaatgggcggatccacatgctgaattctgtggctggtaactcatcctgcaatcgggcaagacactgctgccaaagcgaaagtgacacggcggactccactcgaacataaaatcgatatcaaagaaaaactgaaacaatcgtgattgttggcacacgtcgacaagaccctgcattagccgaaaagcccctgcacaaaaggggtgacgtgcgaaccgctatctgcggttattacccgctgcggatccggggatcgcgatcgggaccggggatcatagcctaaactgagaaagagatcttgtgtttctcaacagattcttcccgatttatccacaggaaggatcgaaaccgggtaagtgtaatcgatcctgcggggagtgaagcacgatttccgccgcatattggaaaaattaatgagctatgccgcttttgggcggaaacgatctaataaagatccttgcggatccttgcgctttactggccaggccgtataatcccccacccggcgcgtaatgcccgttttcgtcacgcgtctcagcttattttttgtgcgacgaggtgcgagaaataaggaaagagaattgactccggagtgtacaattattacaatccggcctctttaatcacccacgctgaggcgtaagtcgttcgaagttcgttcgggtctacgcaaaagtcagtgaatttattcaagtttaggtagaaatcgccatgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttccaagtaataaagctaaccctgcgtggttaagctcgcatttcccagggagttacgcttgttaactcccagtcatttcactttcgtcttccagcagccacaacgggctggcacgccgcaaatcaccatcctcggccgcctgaattcgctggggcatccccgcatcggtctcaccgtcgccaagaaaaacgtgaaacgcgcacatgaacgcaatcggattaaacgtctgacgcgtgaaagttttcgtttgcgtcaacatgaactcccgccaatggatttcgtggtggtggcgaaaagaggggttgccgacctcgataaccgtgctctctcggaagcgttggaaaaattatggcgccgccattgtcgcctggctcgcgggtcctgatcggcctgattcgagtttatcagcgcctgattagtccgctactcgggccgcattgtcgtttcaccccaacctgttctcaatacggaattgaggccttacgcaggtttggagtgataaaaggcagttggttgacgatgaaacgcgtattaaaatgccaccctttacaccctggtggtgacgatcccgtcccgcctggaccatttgataccagagaacactaacgatggattcgcaacgcaatcttcttatcatcgctttgttgttcgtgtctttcatgatctggcaagcctgggagcaggacaaaaatccgcagccccagcagcagaccacgcagactacgaccacagcagcgggtagcgccgccgaccagggcgtaccggccagtggccaggggaaactgattacggttaaaaccgacgtgcttgagctgactatcaacaccaacggtggcgatattgagcaggcgctgcttctggcgtatccaaaaacgctgaaatcgaccgaaccgttccagttactggaaaccacgccgcagtttgtctaccaggcgcagagcggcttaaccggccgtgacggcccggataacccggcaaacggcccgcgtccgctgtacaacgtcgataaagaggcgtttgtgctggccgatggccaggatgagctcgttatcccgctgacctacactgacaaagccggcaacgtcttcaccaaaaccttcaccctgaagcgcggtggctatgcggtgaacgtgggttacagcgtgcagaatgccagcgagaagcctctggaagtctcaaccttcggtcagctgaagcagaccgctgcgctgccgaccagtcgcgatacgcagaccggtggcctgtccacgatgcatactttccgtggcgccgcgttctccactgcggattcgaaatacgagaaatataaattcgataccattctggataacgaaaacctgaacgtcagcaccaaaaacggttgggttgccatgctgcagcagtacttcaccaccgcatgggtgccgcggaataacgggacgaataacttctacaccgccaacctcggcaacggcgttgtcgctattggctacaaatcgcagccggtactggtgcagccaggccagaccgacaaactgcagagcacgctgtgggtcggcccggctattcaggacaaaatggctgccgttgcgccgcatctggatctgaccgtcgactacggctggctgtggttcatctcccaaccgctgttcaagctgctgaaattcatccacagcttcctcggcaactggggcttctcgatcatcgttatcacctttatcgttcgtggcatcatgtacccgctgaccaaagcgcagtacacctccatggcgaagatgcgcatgctgcagccgaagattcaggccatgcgtgagcgtctgggcgacgataaacaacgtcaaagccaggagatgatggcgctgtataaagcggaaaaagtaaaccctctgggcggctgcttcccgctgattattcagatgccgatcttccttgcgctgtattacatgctgagcgcctcggttgaactgcgtcatgcgccgtttatcctgtggatccacgacctgtctgctcaggacccgtactacatcctgccgatcatcatgggcgcgaccatgttcttcatccagaagatgtcgccgaccaccgtgaccgacccgatgcagcagaagatcatgacctttatgccggtcatcttcacggtgttcttcctgtggttcccgtctggcctggtggtgtactacatcgtcagcaacctggtcaccattattcagcagcagctgatttaccgtggtctggagaaacgtggcctgcatagccgcgagaagaagaaatcctgatactcttcattcttcaagccaacgcatctgcgacttggataatttagagtagttacggtaacgttaatgccagagaaggcggtcaatggaccgccttttttacatctacatagagagtcaccatgagccataacgacactatcgtcgcccaggcaacccctccgggacgcgggggtgtgggcatcctgcgtatctccggtcttaaggcgcgcgacgtcgcgcaggcggtgctgggcaagctgccgaagccgcgctatgccgactacctgccgttcaacgacgttgacggtaccccgctggatcaggggattgcgctgtggttccccgggccgaactcctttaccggggaagatgtgcttgagctgcagggccacggcggcccggtcattctcgacctgctgcttaaacgtattctgaccctgccgggcctgcgcatcgccaggccgggtgagttttccgagcgcgcgttcctcaacgacaagctcgatctggcgcaggcagaggccatcgccgaccttatcgacgccagttcagagcaggcggcgcgctcggcgctgaattcgctgcagggggcgttctccgcgcgggtgaatcatcttgtggaagcgctcactcacctgcgcatctacgtggaagcggccattgacttcccggatgaagaaatcgatttcctttccgacggcaaaattgaagcccagctgaacgaggtgatggccgatctcgacgccgtccgcgcggaagctcgtcagggcagcctgctgcgcgaagggatgaaagtggtgatcgccgggcggccaaatgccggtaaatcaagcctgctgaacgccctggcgggccgcgaagcggcgatcgtcaccgatatcgccggtaccacccgcgacgtgctacgcgagcatatccatatcgacggcatgccgctgcatatcatcgataccgcaggcctgcgcgatgctaatgacgaagtggaacgtatcggcatcgagcgcgcctggcaggagattgcccaggccgatcgggtgctgtttatggtcgatggcaccaccaccggcgccgttgacccggcggagatctggccagactttatcgagcgcctgcccgctaaactgccgattaccgtggtgcgcaataaagccgatgtcaccggcgaagcgctgggtatcagtgaagtaaatggccactcacttattcgcctgtcggcacgtaccggcgaaggcgtggaggtgctacgtaaccacctcaagcagagcatgggcttcgataccaatatggaaggcggcttcctcgcccgccgccgtcacctgcaggccctggaagaggcggcgaaccatctgcagcagggcaaagcccagctgctgggcgcctgggccggcgagctgctggcggaagagctgcgcctcgcgcagcaggcgctgagcgagatcaccggggagttcacttccgacgatctgctgggccgcatcttctccagcttctgtatcggtaagtaaccgtcagtccgtaaacgttcactaacccgtattaacgccgcgttaatgcgggttttttcttgccctttgcaacgcaacgttctctacttttatctccccctctgccgcgagactaaaacatgaccgttgaatataccgtgatcgagaaggtgccctccgccgaagcgttttgccacctgcgggtagccgccggcatgtcgccgcgccccctggaaggcgccagagccggactgccgcatagctgttatggcgtacatatcctctggcaggagacgccgatcgcgatgggacgcatcgtcggcgacggcgcgattaatttcgatattgtcgacgtcgccgtcgatccggctcaccagggaaaaggccttggccggctggtgatggagaagctggtcgcctggctggacgctaacgcctttgatggcgcctacgttacgctggtggcggatgtgccggaactgtacgcgaagttcggcttcgaaagcgttcgcccggagagcgaggggatggcccgcgtctggcgaacccgcagtcgttagctcgcatttcctgccaggaaaagagcgttgtccaaatggcaactcgtcttacggcgcgttcctcactatgctgaacgccattcacatcgcgaggatcccatgacacgctttcttctctgcagctttgccctggttctgctctacccctccggcatcgatatgtatctggtcggcctgccgcgtattgctcaggacctgggggccagcgaggcgcaattacatatcgccttctcggtctatctggccggtatggcctccgcgatgctgtttgctggccgcatcgccgaccgctcggggcgtaagcctgtcgctattgtaggtgcagcgatctttgttatcgcctccctgctctgcgcccaggcgcataccagcagccacttcctcatcggacgctttatccaggggatcggcgccggcagctgctacgtggtggctttcgctatcctgcgcgatacgctggacgaccgtcgccgcgccaaggtgctgtcgttgctcaacggcatcacctgcattatccccgtcctggcgccggtgcttggccacctgattatgctgaaatatccgtggcagagcctgttctacacgatgaccggcatgggcgtcatgatcgctgtgctgtcggtctttatcctgcgtgaaacgcggccgacggcgcctccgcaggcagcgtcaccgcagcatgacgctggcgaatcgctgttgaaccgctttttcctcagccgcttactcattaccaccctcagcgtgacggtgatcctgacctacgttaacgtctcgccggtactaatgatggaagagatggggttcgaccggggaacttactcaatggcgatggctctgatggcgatgatcagcatggcggtctccttctcaacgccgttcgccctgtcgctgtttaatccccgcaccttaatgctgacctcacaggtgctgtttctggcggcaggcgtgacgctgagcctcgccactcgccaggccgtcaccctgatcgggctgggcatgatttgcgccggcttctccgttgggttcggcgtcgcgatgagccaggcgctggggccgttcacgctgcgcgcgggcgtcgccagctcggtcctcggcatcgcgcaggtgtgcggttcatcgctgtggatttggctcgccgccatcatcggactcagcgcaatgaatatgctgatcgggatactcattgcctgtagcatagtgagccttgttttgttactggtcgtcaccccgccgcgggttgcgcaatacgatgaagaagccgctgtcgagtcttgatcttaatttactcctctgcctgcagctcctgacccaggagctcagcgttacccgtacggcgaagcggatgaacgtttcgccgtcagcggtgagcaagtcgctggccaaactgcgcgcctggtttgacgatccgctgtttgtgaaaaccccgctgggcctggcgcccacgccgctggtcagcagcatggagcaggatctggcggactggatgcagatgggcaaccaaatcctcgataaaccgcaccataccatgcccagcggcctcaaattcgaactggcggcggaagcgccgctgctgatgatcctgtttaacaccctctctcagcgcatctatcagcgctatccgcaggcattgattcgtttgcgcaactgggactacgactccctggacgccatcatccgcggtgaggtggatatcggcttctgcggacgcgaaagccatccgcagtcgcgtgagctgctgagcctgctgccgtggtatatcgattttgatgtgctgttcaccgacctgccgcaggtctggctgcgcgccgatcatccggcgctcagggaagagtgggatctggcggcattcttacgctatccgcatatcactatctgctgggaacaacgcgatacctgggccctggacgacgtgctgcaggagctggggtataagcgtaacgtggcgctgaccgtgccggggtttgagcaatcactttttatggccgctcagccgcagcacaccatgctggccaccgcgccgcgctactgtcagcactataatcagcagcaccagctgccgctcgtctcccggccgctccccctggaggcgcagcatctggaaaagctgcgcgttcccttcaccctgctatggcataagcgcaacagctacaacccgaagcttgtctggcttagagatacgctgaaagcgctctattccggtacgctttaagccttgtttcgtgcccatagcaccttatttgcgcaagaatttgtaaaattcaaacaaattcccttttcaatgggggatttcggcattaaaacctgttaataccaggcgataatagcgcccgcagttttatccagaccattactcacggagcgacgtatggcaacgcattttgcaagagggatactcagtaccggggagccgctatcgacacgtttgtcagcggcctgtcatcaatccgcacgtcttctcccgacatatcgccaggctcgcttttgcgcgtcgcgctcgctgcttgccgagctgctgtttatgctttacggcatcagcgagctgcctgaaatcatcaacgaagccaatggccgaccggtttttagcgatcgccaactcccccgcttttcgatcgcttatactggcaatatcgttggtgttgccctcaccaccgagggggattgtggcctcgacatggaactgcagcgcactgtccgcagccacgacgccgaccggcacaatttcagtaacaatgagaatctgtggattaacatacagcatgatccggacgaagcgcgcagccagctggtagcgctgcgccgcagcgtgctaaagctgaccggcgaagcatcaacgcagctgcagctgctgcccggctctggccgcctgcgcaccgccggcagtcagccaatcgaagcggtatgtgacgccgaatcgctgctggtatggtccattgccgcaaccccgaacatcggctcgctgaaggtctgggaatatgatgctaagggaggtgactggcgcagcctggcggatgcgcagcagcgcgcacgcgaaccgtcagcccgcctgatgcgctttaccagcttacccatggaaaaaaccttatccctcaattgaccggtcttgccggcatcatgatccaaaggagcaatcatgtcagataccttgaaagtggttacgttactcggcagcctgcgtaaagggtcgtttaatggaatggtcgcgcgcaccctgcccggcatcgcgccagcgggcatggatatctccgcgctgccgtcgatcggtgatatcccgctgtacgatgctgatatgcaggaggaagaaggttttccgcagcgcgtgcaggagattgcgcaacagatccgcgaggcggatggggtagtgatagtcactccagaatataactattccgtgcctggcggcctgaaaaacgccatcgactggctgtcacgcctgcccgagcagccgctgtccggcaaaccggtactgatccagaccagctccatgggcgctatcggcggggctcgctgccagtatcatctgcgccagattctggtcttcctcgatgcgatggtcatgaacaagccggagtttatgggcggcgtcatccagaacaaagtcgatccgcaggcgggtgaagtggtcgatcagagcacgctggaccatctgcgcggccagctgaccgcctttggcgactatattcggcgggttaaagcataaaaaaagcccggcagcgatgccgggctttttcatcatgcgtgcggattaatgtgcatcgataaagacaattttcagcacgaacagcagcgaaacgataatcacacacgggctgagctcgcgcagccggccggtaccgatcttcatcacgcagtaagagataaagcccagggcgataccttcggtgatcgagaagctaaacggcatcatcactgcggtgatgaacgcaggcaccgcctcggtcaggtcgctccacttcacgcgcgcgaggctggaggtcatcagcacgccgacgtatatcagcgcgcccgcggcggcatagccaggaaccatccccgccagcggagagaggaaaataaccagcaggaacaggataccaacgacaacggcggtcaggccggtacgcccgcccacggaaacgccggaagaagattcgatataggccgtcaccgacgaggtaccgatgaaggagcccgccaccgacgagacgctatcgacaaacagcgcttgcttcatgcgcgggaatttaccgttggcatccgcgagacccgctttatccgtcacgccaatcagcgtcccggaggagtcaaacaggttgaccagcataaaggagaagatcacgccggccaggcccaggttcagggagcccgccagatcgacctgaccaatcaccgaagccacgctcggcggcgccgagacgatcccggtgtaatgcacgtcgcccagcatccagcccagcagggtggtcacaacgatagagaccagtaccgcggcgtgaatgttgcgcgacgccagaatcgcgatgataaagaagcccagcacgcccagcagtacgctgtgggaagtcaaatgaccaatgctgaccagcgtttccggattggcgacaatcaccccggcgtttttcaggcccatcatgccgataaacaggccgataccgctggtgatacctacacgcaggctaagcggaatattggcgatcatccagtaacgtacgcggaagatggtcagcagcagcaggcccacggcgccccagaagatggcgcccatgcccacctgccacggcagccccatcgcctgcaccaccacaaaggcgaaaaaggcgttcaggcccatcgccggcgccagggcgaccggcaggttcgcgaacagacccatcaggatactgccgaaagcggcaatcagacaggtggtcacaaacacggcgctggtatccatgcccgctacgccaagaatttgtgggttaacaaaaacgatatacaccatcgtcaggaacgtggtgaaaccggcgatggcttcggtgcgcaccgtggtgccgtgctcgcgcagcttaaatacgcgctccagcagaccctggccagaagactggctggtttgttgttgactcattatcggtttccgaacgtaaggagggaaaattcgaggctatcctataccaaattacggcaccaggcgcggttgtatggtaatttttttcatttattttgcttatacggcaacgattgcgtcgcggcattgagcattacgaaaacgttaaacttgttaatatggaaaggctatgactcaaccagaagcagtattttttgactgtgacggcacgctggtcgacagcgaggtgatttgctcccgcgcctacgttcacatgtttcaggaattcggcattacgctggacctcgccgagatttttaagcgcttcaaaggtgtgaagctgtacgaaattatcgacaccatcaacgctgagtatggcgttaatctgcaaaaggccaccctggagccgatttaccgggcggaggtcgctcgcctgttcgatagcgagctggaggtgattcccggagcccaggcgctgctggatgcggtaagcgtcccgatgtgcgtggtttccaatggcccagtcagtaagatgcagcactcgctcggacgcaccggcctgctgcgccatttcactgaccgcttgtacagcggctacgatattcagcgctggaagcccgacccggcgctgatgtttcatgcggcagaggccatgcaggtaaaagccgaaaactgtattctggtggatgactccagcgccggcgctcagtcggggattgccgccggcatggaagtgttttatttctgcgccgatccgcacaaccagccgatcgatcatcccaaagtgacgacctttaccgatctggcagagctgccggcattgtggcaggcgcgcggctgggatatcacgcgttaagggcctggtgagcggcacgttggcatcgatgaacccccgctatgcgtctgcgtaagcggggaatagaactagcggctttttattgctgcaactccgccgccgccgctttatcggcaataatcaccagtgaagggtgcaatttgagcactgaagccggcacctgcacgctgaccggaccttccaccacttgctttaacgcgtgcgcttttgccgcaccgctgacaattagcaataaatttttcgccgccatcacgcttctcggccccatggtgacatagctgtctggtactgccgagatatccccgcccatctcgctgttagcgataagagcaatcatttccccatgaatcggcacttcgaccgtctgatcatgaaagcgggtggtattcggcaggttgccgcaaaaatggccgtcggcccccagccccagcaccatcagatccagaccgccagcctcttccagctggcgatcgtgctgagcggcgttgtccagcgtcagcttgtgaatgttctcttctttgatctgcgccggggtaaaaaacagctggcgcaaattagatatcgtgacgccttctcgcgactggccgcgaaaagggatctcatcgaagttgtaatagtgcacccgatcatagaatgctttgcctttcacggcggcggtcaaatgctcatacatccgctttggcgtgctccccgccgtcaccgccagattcacccgccgcggcgccgtgatatagcccagaacatgatggctggcgaccaggctcatctcttcataatcttcggtcacaatcattttcatcttgtcgtccttcacaagcacaaaacgggggctgaaggccccctaaaggttatttaaacagtttttgcacaaactcggcgtaggccgggcgccagacgtccatttcatggttcaggccgggatactggtggtaatcaaatttaatctgctgtttttccagctcgcttttcagaccagcaatgtctttaccggtcacagaatctttttccccgacgaccacggtaaagttacgcagctgcttattgatcgcgtcaggctgcttcagctgcgcttccacgccggcattcggcaccgtggtagtcgtaacgccgctaaaggtggcgagccagccaaagctctccagatgattcattccggaaaccagcgcctgataaccgccctgcgagaggcccgccagcgcccgaccgtcggcatctttacgcacgttaaatcgggcatcgatcagcggaataatatcctgcatgagctctttatccgccgcctgcgcattaagtggatagaaggttttgcgccgctcctgcggcgggaagttttccgcgaccgcttccgggatatcggtttcggtatccgggaccaccactagcatcggcttaatcttgccctccgccagcaggttatccatgatttgcgggatccgcccctgatcgatggccgacaggccgctgtcgccaaagccatgatagaaatagagcaccggcagcggatcgccggttccgctatagcccggcggcgtccagacatagagacgacgttcggcgttcagagccttcgagtgataggtgagggtgcgcagatcgccatgcgcaacctcccgatcgtcaagaatactgcccggcaccagaatcaaactggtgttcacctggcgctgcggcttctgatagcggctgccggtatctaccgagcggaagccatccacatcgaaatagtattcatagagattgggcttcatcggctcgcttttccatgtccagactccgtccgctgctttggtcatgtcgtgcgagacaaaggagtccggcgtggcgccagtcactatcgagacccgccgggcatcaggggcaaacaagcggtaagtgatactcttatccgcgttaacctgggtgataaagtggctcaccggcaggcttgggtccgacatcgcgggtaatggcgccgcctggagggtaaacgccgcgccctccagcgccagggcgaaataaattgcatgtcgtttcatcgttgttcctctttcgttgtgtccgttcagttatcgtcttaccaccagatttccgcctgcgcccccacggcaaactgatcgttcttcccgtcttcaaaaatgctggtggtattattcgcggccttatccaggtcaatatccttcgctttaatataggtggcatagaaacgaatttccgggcgcgaggtcagcatactggtattgactttgaaggtatggaacagcgtggtcttgtagccggactcgttatatttcttgccggtaacatctttgttttgctgtttgaagtaccccagctcgacgccggtctggttatatttatcccagatataagccggtcgcagaaccgtacggatagattcaaaatcggagtgggctccggtttcgtagctatagacgtcgttaccaaaagagtagacgatggcattcgccataataacgtcatcgcgtaaataggtttccccctgcgtggttaagcgcacggcggtgccattggtatgatcgccataatagcggccattaaaggtggtataggggctggatccggcatagcgtgagaagctgctggcaatagagttattggccagtaagaaagagaattcgttaaagccgccgttagcaaatttctgcgttaacgaggtaccagccatccaggtatctttccacggataataaccttcattgccctctttatatttctcagaggaactttggttggcggcgacatagcgtccgctaaccatcaggctggctttatcccacagcggaatctctttgtaacgaacgtccagggtgttggtgttaatttgctgcttattgcttaaagaacggtcataatcatcgacatcttcgcgaatcaacgcgatatcgaatttcccggcgcccacctgccagttttccagccctacgccggccgccgcatcggttctctgcgttttccagtccagcatctggatttcaatttttggcgccccgtgtttgccgacccagaaatcggcttccggcgcaaacggcaggaaccctttggtgttaacatacatatccgagaattgaatgtagttttcgccgccggcattgtcaccaaaccagccagtggaatactgctggccgacgttcccgtcgagcatcacgatggcgtcgacgcgtttatcgccttcctgaaacacccgctgcttcagctgcagatcgaaccagccggaatattcattgcccaggcggccaagcgaaccgatcgcccatgattttggcgagccgtgcgaggcggtcccccagccggaacggaagtagccgttatagctaaagccaatttcatctttcacgaacttgctaaagtctttcagcgtcatcgcgctgtaggctggcgcgccatcggtgacaggttgttgatttttaaccagcaccgcatccggtttaaccgccgttttcggcccggcggtcgcccccccggtcttgcgcttctgaccttccgcaggaggagaccatgaggcccaaatctggtctctttttctttcctggtcctgatattttttgagctctttttgcgtgtctttgagcgctttttccagcagctcaagccgttgttccaccgtcaactggctcgctagcagattagttgaataacaaagtggcgccagcaagactatcgccgaagcgatcctgttttttctcatcataatattcccttatataatcattggcgtaaataaaacacgacaacaaccctattccgtgccggtgctaatagccgtatccataccgtttgacgtcgcggcggctgttatttttgcggttagacaaaaacaaaaaaacctgaagaagaccatctgccttggcagataatcctcttcaggttttgcccgcgcatcgcggtagcaaccctcattcagccattattggcccgcataaaacaaaaaacctgatatcgcccccaggagcaatatcaggttttgcctgctgtcgcagtcacaatccgtttaaaccatcctgagcgttaaaactcagtgagtggcagctgattgttacgcgataaaatgaataactcaaacgggcagattgttaattgtgacgataatctcagcaatctcgctgccgcggggtaaaacatatctaattctgataaatccatttaccagaattagacagaatgattattactctttcggatctttgccagcgagcagtttatccagctcatcgccgccaacgtgacggaaatcctgacctttgacgaagtagaaaatatattcgcagatattctggcagcggtcgccgatacgctcgatggagcgcgcgcagaacagcgcggtcaggacgctggggatagtgcgcgagtcttccatcatgtaggtcatcagctgacgcacgatgccttcatactcctggtcgactttcttatcttcgcgatagatacgtaccgcttcgtcgagatccatacgcgcaaacgcatccagtacgtcatgcagcatctgcaccgtgtggcggcccagcgattcgaggctcaccagcagcggctggtgctgctgggaaaacttctccagcgcggtgcggcagattttatccgccacgtcgccaatgcgttccagctcagcgatagtcttgatgatcgccatcaccaggcgcaggtcgctggcggtcggctggcgcttggcgatgatgcgcacgcacgcttcatcgatagccacttccatcatgttgacctgcttgtcgccgtcgatgacgcgtttcgccagatcgctgtcctggttatgcatggcggtgatggcatcagagagctgctgttccaccagcccacccatggtcatcacctgggtgcggatatactccagttcagcgttgaactggccggaaatatgtttgttaagatttaggttgtccatggtgtctcctgattgcccaactggtgagagcctgaaagcacaagggcaaatcaaccgtagcggccagtaatataatcttcagtttgtttcttcgcgggcttagtgaacaggtcatccgtgttgctgaactcaatcagctcgccaagatacataaatgccgtatggtcggagcaacgcgcagcctgctgcatgttgtgagtcacgataacgacggtgtagtcctgtttcagctcggtgatcagctcttcgatacgcccggtggagatcgggtccagcgcggagcacggctcatcaagcagcagcacttccgggcggatcgcgataccgcgggcaatgcacagacgctgctgctgaccaccggagagagaatacccgctctggtgcagtttatctttggtttcgttccataatgcggctttggtcagcgcccactgcacgcgctcgtccatatcggcacgggacagcttttcaaacaggcgcacgccgaaggcgatattgtcgtatatggacatcgggaacggcgttggtttctggaacaccatgccaaccttagcgcgcagcagggcgatatcctgggtgttagtcagaatgttgtcgccatccagcaggatctcaccttccgcgcgctgctccggatatagttcaaacatcttgttgaacgtgcgcagcagggtggatttaccacagcctgacggaccgataaacgccgtcacctggtttttggtgatatccaggttgatgttcttcagggcatggaatttgccgtagtagaagttcaggttacgaactgaaatcttacccggagctgtattcaccatactcatctcaatctcttcctcattcagcgcagcagttgctgcgccgcaaaaaattaaccgtgtttcttcttggcgaagataacgcgcgccaggatgttcagcagcaagacgcacagggtgataatcaacaccccggcccatgccagttgctgccactccgcaaacggactcatggcaaatttgaaaatggtcaccggcaggttagcaatcggctgcatcatgtcggtgctccagaactggttggacagcgcggtgaacagcagcggcgccgtttccccggcgatacgggcaatagccagcaggatcccggtcataatccctgagacggaggctttcagggtgatcgccgagatcatcttccacttcggcgtccccagcgcataggccgcttcacgcaggctatccggcaccagcttcagcatgttttcggtggtacgaataacgataggcacctgcagcagcgccagcgcgataacgcccgcccagcccgagaagtgctgcatctgcgccaccacaatggtgtagacgaacagacccaccacgatagacggcgcggaaagcagaatgtcgttgataaagcggatgatttccgccagcaccgacttgcggccatactccgccagataaattccggcgaggatacccagcggcgtaccaaatacggttgcccacaggatcagcaggccgctgccggcgagggcgttagccagtccaccgcccgccgtattcggcggcggcgtcatttcggtgaacagcgccagactcatgccgtcgaaaccgcgggttatcgtcgccatcaggatccagataagccagaacaaaccaaacgccatggtcgccatcgacagcgctagagcgatacggttcttcatgcggcgtttggcctgcatcttgcgacgggactccgccagttcggcggtagtttgcaattcaatggtcgccattagcgtgccccctcattcttcgcgaggcgcataatcataaacttcgacgcggccagaacgataaaggtgataacgaacaggatcaggcccagctccatcagcgccgccacgtgcaggccggtttccgcttcggcgaactcattagccagcgcggaggtaatactgttccccggcatatacaacgagatgctgtcgagctggtaggtgttgccgatgataaaggtgaccgccatggtttcacccagcgcgcggcccagaccgagcatcaccccgccgatcaccccgtttttagtgaacggtaaaacaatgcgccagataacttcccaggtggtgcagccgatgccataggccgactctttcatcatcaccggggtctgttcgaaaacatcgcgcatgaccgcggcgatgtaagggatgatcatgatggccagaatgacgccagcggcaagaataccgataccaaacgccgggccggcaaacagcgcgccgacgaacgggatggtcgacagaacgttgccgaccggctcctggaagtaagtcgcaaacagcggggcgaaaataaacaggccccacatgccgtacacgatgctcgggattgccgccagcagctcaatcgcaatgcccagcggacgcttgagccaggcgggggacaattctgtcagaaacagcgcgatgccgaagctcaccggaacggcgatcagcagcgcgataaaagaggtgaccagggttccgtaaatcgggaccagcgcgccgaagatctcgttaggcgcatcccactctttggtccacaaaaaggcaaagccaaacttttgaatgctcggccaggaagagatgatcagggaaacgatgatgccgcccagcatcaatagcacaatcagcgcagccagttttaccagcgcactgaaaatcatgtcaccctttttccccggaggggtaaatgcaggcttggttgcagccatagattactctttacgtattaaaacttgttcgaataaatgcccggtggcgttggctcccgggcctacagtctgaaccgtagggcgggcagcgcctgaacgcccccgccatcttcgtcaaaaatctactgttagtacagcgctttaccgctgctgtctttgacgttggttttccatgccgcgcgaacctgctctaccacgctttccggcagcgtcgcgtaatccagcgcattcgcttctttcccgccgtttttatacgcccagtcgaagaacttcagcacttcagcggtctgttccggcttgttggtcgccttatgcaccaggatgaaggtggttgaggtgatcggccatgcattttcgcctttctggttggtcaggtcctgagcgaaagacttgctccagtcaacgccttttgcggcgttagcgaagttgtcttcagtcgggctaaccggcttgccgtcggcagagaccagtttggtgtaggccaggttgttttgcttagcgtaagcgtattcgacgtaaccaatcgagccaggcagacgctgaacaaaggcggcgataccatcgttgcctttaccgcccagaccggttggccagtttacggtagagccggcgccgattttcgatttccactcttcattcactttggacaggtagctggtgaaaacgaaggaggtacctgaaccatcggcgcggcggaccacggcgatgttctgcgacggcagcttcaggcccgggttgagcttagcgatcgcttcgtcatcccattttttaattttacccaggtagatatcaccgagggttttgccatccagcaccagctcgccggatttcacgccaggcaggttaaccgccagtaccacgccgccaatcacggtggggaactggaacagaccttcctgggtcagtttgtcatcagccagcggagcatcagaagcaccgaaatcaacggtgttggcaataatctgcttaacgccaccagaggaaccaataccctggtagttcactttattgccggtttctttctgataggtatcagcccatttggcatacaccggcgcagggaaagttgcgcctgcgccagtcaggcttgctgctgcgaaggcagagaaagcgctcatcgataaggtcgcggcgacaactgttgcgacggtggtacgcataacgttcataatgtctcctgctgggattcgtaaatcattgtttcgaggctatggtgagcaaaataggtcaaagaggtgacagtaaaatgtacgaattatgacagttttatgacaggccgggagagtggattttacgccaaataatacgcttataactcagatggttatctttaatcatgaccgtggaatgacaaaataattttctttttatgacggcgaaatcggaccgtaaaacgatcgtttgtcatctaccgccagccaaaatattgcgcacgtaatcggtggaaaacagcaggtgcaaataaaaagggccgccgtcggcagccctttgcaggataggatgctttactcaaccgttaccgatttcgccaggttacgcggctggtcaacgtcagtgcctttgatcagcgcgacgtgataagccaacagctgcagcggaaccgtatagaagataggggcgatggtctcttccacatgcggcatctcaatgatgtgcatgttatcgctaccgttgaagccggcttcaccgtcggcgaagacgtatagttcaccgccgcgggcacgaacctcttcgatgttggatttcagtttttccagcagttcgttgttcggcgccaccacaatcaccggcatttccgcatcaatcagcgccagtgggccgtgcttaagctcgcccgccgcataggcttccgcgtgaatgtaggagatctctttcagcttcagcgccccttccatagcgatcggatactgatcgccacggccaaggaacagcgcatggtgcttatcagagaagcgctctgccagctgctcaatacgcttgtcctgggagagcatctgctcgatacggttcggcagagcctgaaggccgtgcacgatatcatgctcgatagacgcatcctgacctttcagtcgcgccagtttcgccaccagcatcaacagcacggttagctgagtggtaaaggctttggtcgaggccacgccgatttccgttccggctttggtcatcagcgccagatcggactcgcgcaccagcgacgagcccggcacgttgcagatggccagcgagccgagatagcccagctctttcgacagacgcagcgccgccagggtatcggcggtttcaccagactgggagagggtgatcatcaggctattgcgacgcactgcggacttgcgatagcggaattccgaggcgatttccacatcgcacgggacgccggctaacgcttcgaaccagtagcgggaaaccatcccggagttataggaagtcccgcaggcaactatctgaatatgttcaacctgagccagcatttcattggcgttgggccccagttcgctgagatccacttcgccatggctgatgcgcccggtcagggtgttcttaatcgcgttcggctgctcgaaaatctctttctgcatatagtggcggtagatacctttatcgccagcgtcatactgcagattggattcgatctcctggcgcttcacttccgcgccggatttatcgaaaatcaccaccgaacggcgagtcacttccgcgatatcgccttcttcaaggaagatgaagcggcgggtaaccggcagcaatgccagctggtcggaggcgataaagttttcacccatccccaggccaattaccagcgggctaccggagcgggccgccagcagagttcccgggtcacgggtatccatgatcaccgtaccgtaagcgccgcgcagctgcgggatagcgcgcaggacggcttcacgcaaggtaccgccttgttccagctcccagtgcaccagatgggcaataacttcggtatcggtctcggtgacgaagacatagccgcgagactgcagcagggcgcgcagcggctcatggttttcgatgatcccgttatggaccaccacaatgtgttcagaaacatgcggatgcgcattgctctcagacggttcgccgtgcgtcgcccaacgagtatgggcgatcccggtaccaccgtgtaacggttgctcttctaccgcctgagccagcatctgaactttacccaggcgacgcacgcgggtcatatgaccttcgctgtcgaccactgccagaccggcagagtcatagccacggtattccagacgacgtaaaccttcgagaaggatttcagcaatatcacgctgcgcgactgcgccaacaattccacacatagttaaatttcctgataatggcgatatgccatgcgttgtcgctgacctgtatttgcccgttttccgggcgccccgagccttgtagagagtggggttattgttatggtacttcctgcggacggggatctatgttgaccctctcatcctggttcgccgggaaaatttccccggcgataatccaaattatttcttcttcaccggacgctgccagccctgtttgtggacctgcggtacgcggctcaacactagttcgttatcagcgatattgcgcgtgacggtggtgccggcggcgatcgtgacgccgttgcctaccgtgaccggggccaccagctgggtatccgagccgacaaagacatcatcgccaataatcgttttatgcttgttcgcaccatcgtagttgcaggtgatggtgcccgcgccgatattgacgttatcgccaatctccgcatcgcccagataggtcagatgacccgccttggagcctttcccgagacgcgcttttttcatttccacgaagttaccaacgtgggcgccttccagcagttcggcgcccgggcgcagacgggcaaatggaccgatggtgcaggccgcctgcagctgggcatcttccaccacgctgtaggggctaatttcgcagtcatcgccgatggtgctgtttttgatcacgcagccggcgccgattttcactcgatcgcccagcaccacgttgccttccagaataacgttagtatcgatctctacatcgcgcccgtgctgcagcgtaccgcgcagatcgaaacgcgccggatcgcgcagcatcacgcccgccagcagcagcttttcggcctgctccgcctggtagacgcgctccaggcgcgcaagctgcaggcggttgttgacgccttcgacttcgctcaggcgctgcggatgcactgcgacgatctggtgtccttcctggtgcgccatggcgatgatatcggtgatgtagtattcgccctgagcgttgttattggtgagtttcgccagccagcgctttagatccgctccgccggcgatcaggatcccggtgttgatttcctggatctggcgctgggcctcgctggcatctttgtgctcaacgatgcccgtcacctggccattttcacgggtaatgcggccatagccggttgggtcatccagcttcaccgttaacagaccaatcccaccctgtggtttcgcggcgcgcaggcgctgtagcgtctcaacggagatcagcggcacgtcgccatagagcatcaggatgtcttcatcatcattgaagaatggcgccgcctgctgcatagcgtgcccggttccgagctgctcggcctgcagcacccagttcaggttgtcttcatgcagagtctgacgcagcagatcgccgccgtggccatataccaggtgtaccgcacatgcgcctaaatcgttagcggcatcaatgacatgctgcaccattggcttcccggccagggtatgcagcaccttaggaagatcggaatacatgcgggtccctttgcctgcagcaaggataaccacgctcatcgcactatttgacatactcatcctgacggtagttagaacgaaaagtaaaagcctttcacgttgaaatttctacatatttttcatcataaaacgagacgtggagaaaacgtccaggctcactgttttaccccattttatgacgctatttttaaccactgcaaatcagtttaacgctgaaaaaggagggcggggtggagaatcattaactatctcactgcttttgctgttttttcgccacctgaataaagccgcagcggcaggcgtttatcagcacccacagcgggaagaaccaggataaatattcgccagtcgctggcgggggagggcggtaaagtgattgatgctatccataaaaaacgaaaggccacctatcaggtgaccttcttttcccggtttcacatcgccagtgttgtcgttttgatgggcgatacgtcgtgtcagcgggcgagatagcgcggagcttagaagctcagaacgctaaatttagcgatgattttatggaacagtttcatgatgatttcctgacgcaggtgcagtttataacgctcttttttgtgatatacatcacataaaaagagtttacgcctcatcatttaactaatcaataacaattaagggtgaatgctgttttcacttcatccgctcgtcagcagcgggcaataaaaaaagccagcctggaacccagactggctttttacgttcaagccggtgttacatcgcttttttggtcaactcgataacgcgcagtttagcgatcgctttggccagttccgcagacgcctgagcgtaatccacatcgccgtgagagctcttaatgtgctcttccgctttgcgtttcgcttccagcgctcgcgcttcgtcgaggtcctgaccgcgaattgcggtatccgccaggacggtcacgctgccaggctgcacttcaagaatgccgccggacagatagataaactcttcatgaccgtgctgtttaacgatgcgaatcataccaggcttaatggcggtgagcagcggcgcgtggcccgggtaaatacccagttcaccttcgctacccgttacctggattttttcgaccagaccagagaacatttgttgctctgcgctgacgacgtccaggtggtaagtcattgccatatcaccctccgattaaggcgttaaagttttttggctttttccacggcttcgtcgatggaaccgaccatgtagaacgcctgctctggcaggtgatcgtattcgccttccatgatgcctttaaagccacggatggtgtctttcagcgccacgtatttgcccggagaaccggtaaagacttctgccacgaagaacggctgggacaggaagcgctggatcttacgcgcgcgagctaccaccagtttgtcttcttcagacagttcgtccataccgaggatggcgataatgtctttcagttcctgataacgctgcaggatggactgaacgccacgcgcggtgtcgtagtgttcctgaccaacaaccagcggatccagctgacggctggtggaatccagcgggtcaacggccgggtagatacccagggatgcgatctgacggctcagtactacggttgcatctaagtgagcaaaggtagtggctggggatgggtcagttaagtcatccgccggtacgtataccgcctgtacggaggtgatagaaccggttttggtggaggtgatacgttcctgcagaacgcccatctcttccgccagggtcggctgataacctaccgctgaaggcatacgacccagcagcgcggatacttcagtaccggccagggtgtaacgatagatgttatcgacgaacagcagtacgtcacgaccttcgtcacggaatttctcagccatggtcaggccggtcagcgcaacgcgcagacggtttcccggcggctcgttcatctggccgtacaccagggatactttatcgataacgttggagtcggtcatttcgtggtagaagtcgttaccctcacgagtacgctcacctacgcccgcaaacacagagtaaccggagtgctcgatcgcgatgttacggatcagctccatcatgtttacagttttacctacacccgcaccgccgaacagaccaactttaccgcccttggcgaacggacacatcaggtcgataactttaataccggtttccagcagttcctgagagctggacagctcttcataggacggtgccgcgcggtggatagcccaacgctcttcttcgccgatgtcgcctttcatgtcaaccggttgacccagtacgttcatgatacgacccagcgttgctttacctaccgggacttcgatcgggtgctcgaggtcttttacatccagaccgcggcgcagaccatcagaagaacccatggcgatggtacgtacgataccgccgcccagctgctgctgaacttccagcaccagaacttcattaccattctgtacctcaagggcttcgtacacgcgtggtacggcatcctgagggaactcgacgtcgaccacggcgccgattacctggacaatctttccagtagccatcttaaatcctctacgaaataacctggttaaaccgcggcggcccccgagacgatctcggtgagttcctgagtaatgctggcctgacgagctttgttgtataccaactgcagctctttaatcaggctgccgccattatcggtcgcggctttcatcgccaccatacgggcggcctgctcgctggccaggttttcaaccacgccctgataaacctgagattcgacgtagcggcgcaggagggtatccagcagcgctttcggatcgggctcatacaggtaatcccaggatttacgtttcagatcagcatcttctgatgccggtaacggcagcagctgagtgatcgtcggaacctgagacatggtgttaataaatttgttgctgacaacgtacagcttgtccagacggccttcatcataggcctgcaacatcacttttaccgggccgatcagttcggacagggatgggttatcccccataccggtcacctgtgcaaccacgttgccgcccacggagttaaagaaagaaacgcccttagagccgatcattgcgaggtcgcactgaacgcctttatcggaccatgctttcatttccgccagcagtttcttgaacaggttaatgttcaagccgccgcacagaccacggtcggtcgacaccaccaggtagcccacgcgcttaacgtcgcgttcttccaggtaagggtgcttatattccagattaccgttcgcaaggtgaccaatcactttgcgcatagtatctgcgtaaggacggctggccgccatgcgctcctgcgatttacgcattttggaagcggcgaccatctccatcgctttagtgatcttttgcgtgttctggacgcttgcgatcttactacgtatctcttttgcgccggccatgagcttctcctcaatgccttgcggcctgccctaagacagaccgccagacgttaccaggactgggttgctttgaaggaatcgaggatgcctttcagcttgccttcgatttcgtcgttatagccaccggactggttaatctcttgcatcagcggagcgtgatcacggtcgacgtaagccagcagagcggcttcgaagctaccgattttcgccagttctacatcagccaggtaaccacgttctgctgcgaacagaaccagagactgctgcgcgacggacatcggcgcatactgtttctgtttcagcagctcggtcactttctgaccgtggtccagctgtttgcgggttgcatcgtcaaggtcggatgcaaactgggagaacgccgccagttcacgatactgcgccagcgcggtacggataccaccggacagtttcttcatgatcttggtctgcgctgcaccaccaacacgggatacggagatacccgggttaaccgcaggacgaataccggcgttaaacaggttggtttccaggaagatctgaccatcggtaatagagattacgttggtcggaacgaatgcggaaacgtcacccgcctgcgtttcgataatcggcagcgcggtcagagaacctgttttccctttcacttcacctttggtgaaggcttcaacgtattcggcgttaacacgcgcagcacgctccagcagacgagagtggaggtagaatacgtcgcccgggaacgcttcacgtccaggcggacgacggagcagcagggagatctggcgataagcaacagcctgtttagacagatcatcgtaaacgatcagcgcatcttcaccgcggtcgcggaagtattcgcccattgcgcaaccagcgtatggcgccaggtattgcagtgcagcagattcagatgcagtcgctaccactacgatggtgttagccagcgcgccgtgctcttccagtttacgcaccacgttagagatggtggacgctttctgaccgatagcgacatagacgcacttgatgccggaatcacgctggttgatgatggcatcgatagccagcgcagttttaccggtctgacggtcgccgatgatcagttcacgctgaccacgaccgattgggatcatggcgtcaacggatttgtaaccggtctgtaccggctgatcgacggactgacgttcgattacgcccggcgcgatcgcttcaacggcggagaaaccgtcgttttccagcggacctttaccatcaattggcgcgcccagggtgttaaccacgcggcccagcaggccacggcctaccggaacttccaggatacggccagtacatttcaccttcatgccttcggcgaggtcagcgtacggacccattaccaccgcacctacggagtcgcgctccaggttcagtgcgatagcgtaacggttacccggcagggagatcatctcgccctgcatacattcggcaaggccgtggatgcggataacaccgtcacttacagaaacaatagtaccttcgttatgagcttcgctcacaacattgaactgagcaatgcgctgcttgatcagttcgctgatttcggtggaattcagttgcatgctccagtccccttaagactgcaagacgtctgcaaggcgctcaagacggccgcgtacgctgccatcaatgaccatatcacccgcacggatgataatacctgccataacagacttatcgattttgcaattcagcttaactttgcgtgacagacgtttttccatcgcgctgacgatcctggcaagctgttcatcactcagttggttggcagatattacttctacctctgcgatggcctcactggccgcgcgcaggtgaatgaattgctcaagaacgtccgggagcaccttcagacgattattttccgccatcaccttaatcaggttctggccattttcgtcgagttgctcgccgcagatagcgataaacgcttctgagagcgtttccggcgccaaagcaccggagagaagctctgccatttggtcgtttttggtcacttcggcggcaaacgccagcatatcctgccagcgttcaacactgttgtgttcgacggcaaagtcaaaagctgctttggcgtaggggcgagctaccgttacaaattcagacatcagcccctccctccttacagttcagcgacaagtttatccacgatgtcgctgttagcagcttcatccacggaacgttcgatgatcttctcggcgccagcaacagccaggatagcgacctgcttacgcagctcctcgcgtgcacgtttacgctcagcatcaatttcagcctgcgcttgtgcaacgattttggtgcgttcctgttctgcttcagctttagcttcgtccagaatctgagagcggcgcttgttcgcctgctcaatgattacctgggcttccgctttcgcttttttcagctggtcggtcgcgttggcctgtgcaaggtccaaatctttcttagcgcgttctgcagaagctaaaccgtcagaaatctctttctggcgtttttcgatggcagccattaaaggcggccatacgtatttcatgcagaaccatacgaagataacaaacgcgatggcctggccgaggattgttgcgttcatgttcacagcacaatacctctttaattaactctgtggcttaggtttctaacaacttactacgcgacggcgaacatcacgtacagacccagacctacagcgatcatcgggatagcatccaccagacccataacgataaagaactgagtacgcagcagagggatcagatccggctgacgcgctgcgccttccaggaatttacctccgaggatgccgataccgatcgcagcaccgattgccgccagacccatcatcacagcggcagccatgtacagcagatccatattcaggttttccatgacagtctccagtttgtttcagttaaaacgtagtagtgttggtaaaaaatcaatgctcttcagatgccatcgacagatagacaatcgtcagaaccatgaagatgaaggcttgcagcgtaataatcaggatgtggaaaatggcccaaggcacattcagaacccactgtgaccaccacggcaacagaccagcaatcagaatgaaaatcagctcaccggcatacatgttgccgaacagtcgcagaccgagagagaccggtttggacagcaggcttaccccttcaaggattaagttgacaggaatgaacgcccagtgattgaacggctgcatggtcagttctttaacgaacccaccaacgcctttcattttgatgctgtagaaaataatcaggatgaacacgccaagcgccatcgacagggtgatgttcacgtcggcagacggaaccacgcgcagtgctggcaggccgaaaatgtgttcgccgatataaggaagcaggtcgattggcagcaggtccatcaggttcatcaggaagacccagacgaacacggtcagcgccagcggcgcgataaccttgctcttgccatggtacatgtctttgacgctgccatggacgaagccgatgatcatttcgatgaaggtttggaatttccctggtacgccgctggtcgctttcttagcaacgctacggaacatggcaaggaacagcagaccgagaaccaccgagaagaacatggagtcaatgttgagcgtccagaaggtggctgtgtggttgtgcggatccaccagcgagaatgtacgcaggtccaactgaaggttgttcagatggtgtcctatgtaatcctgcggcgtcatattttctgaagccatgatgcctttaccctttgttgttaattacagctggcgccagaacttgtaccaccagcaccaaaacccacgtcacgatcagtggcaaaaataccacttttaaaacggccagcgccaccgccagaagggcgaaggtcagcaacaccttgaaggcttcaccgaaggcgaaggtccaggccacacggccttttgctggtgtatgcgcctgatgacgccaggcaaaaattataaacatcagatttggcaagaccactgccaaaccgccgcatacagcggaaatgccccagaaggggtctttgaggctgaacagcagtccacttgccattactgccagtaactgaataaacagaagcttgcgagcaacgtttcgactcaagagcgacactgacatcacgtttttactcctgctccctttgaggtatgtcgcgtgtcgtataaaacgtcctttaagacgaagagtcaagcatcaaaaagcggacaaattatacggtgacgccccgtgatttcaaacaataagtagcaaaatagtgaataaatgtttaattattttccaacggacaactttccgtgcatttcagcgttctgtgagcggtcatacaaaactgcaaataacgaggaaacacggcaattaaagcgtgcatcagatcacataataaacatttcaagcgccctttaatgaatcaaggacataaaacactatttttcatgcttttgatattcaagataaaaagtgaggacattatctaaaacaaccccacatacaataaaaaccttttattgacatttataataaaaatttaacatcactatgctgttcatcattgtcgatttttagcaccctgatattttcaaagttgactattttgtcagtgaatcacttacgctaagttaactgcaagaaaagccttagtaaaaacaaggttaaatgcggcccgttaatatcgggggacgtcctttatttttgtaacatgcgcgggccacattttttccacattttttgataaaaattaactcgattttggcttaatcaccaccaggtgccgctccccttccaaccgaggaacatgcagctcaatcacctcgacaatgtcatacccttccggcagactttccatttcttctttttgcgctaaccctttgagcgcatagaagtgaccattcgctgccggcagatgatggcaccagctcaccatatcattaagcgatgcgaaagcgcggcttatcacgccatcaaacggcggctcggccgggaaggcttccacgcgactctgcaccggggtgacgttatccagcttcagctcgtgctgcacctgacgcaggaagcgcacgcgcttgccaaggctgtccagcagggtgaaatgtgactccggacatacgatggccaacgggatccccggcaaccccgggcccgtaccaacatcgataaagcgcgagccctgcagataaggcgccacgatgatgctgtcgagaatatgacgcaccagcatctcattcggatcgcgaacggaggtcaggttataggctttgttccacttatcgagcagtccgacgtaagccaccagctgatttttctggtgatcggtgagcgaaatacccgcttcatccagcagacgagaaagtttgttgagcacggtaagtaccttcaaaaaataatgagcccggaggcgctaacgcttaccgggctatgaatgataaaggcgaacgctgattatgcaactgggaaatcagcgcggcaggcagccgcaatcaggcgctgcggcgcagcatcccctgctttttcagccaaaccagcaaaatagagatcgccgccggggtgatcccagagatacgtgacgcctgccctatcgacgacggtttatggtcgttcagtttggcaatcacctcgttagacagcccagtgacctggcggtagtcgagggtcgctggcagcaaggtattctcattgcgctgttgtttctcaatctcatcctgctggcgcgcgatatagccctcatacttcacctggatctctacctgttcagccgcctgacgatcttccagtcccggggtgaatggcgagagttgaaccagctgttcgtaggtcatttccggacgacgcagcagatcttcgccgctagcttcacgcgacaacggcgcggtcaggtgagcgttcacttcgttggcgctctctgcctgcggattcacccaggtggatttcagacgctggcgttcacgttcgatgctttccagcttctcgttgtagcgcgcccagcgttcgtcatccaccagacccagctcgcgcccctgttcggtcaaacgcaaatcggcgttgtcttcgcgcagcatcagacgatattcagcgcgggaagtaaacatgcggtacggctctttggtacccagggtgcagaggtcatctaccagcacgccgaggtaagcctgatcgcgacgcggcgcccagccctctttttccgcagagaagcgggcggcgttaagtccggccagcagcccctgagccgccgcctcttcataaccggtggtaccgttgatttggccggcgaagaacagaccctgaataaatttgctctcaagcgttggcttcagatcgcgcgggtcgaagaaatcgtactcaatagcgtagcctggacggacgatccgcgcattctccatcccctgcatcgagcggacgatttgcatttgcacatcaaacggtaggctggtggatataccgttcggataaatttcgtttgaggtcagtccttccggctcgaggaagatctgatgctggttgcgatcggcaaagcgcatgactttgtcttcgatcgacgggcaatagcgaggtccgatcccttcgatcactccggcgtacataggactgcgatcgaggttattgcggatcacatcgtgggttttctcgttagtgtgggtgatatagcacggtacctggcgcggatgctgatccgcggatcccatgaacgagaagaccggcatcgggttatcgccatgctgctgcgccagcacgctgaaatcgatggtgcgcgcgtcaatacgcggcggagtaccggttttcagacgacttacgcgcagaggcaattcacgcagacgacgagacagcgggatagacggcggatcgccggcgcggccgccgctgtagttgtccagaccaatatggattttgccgtcaaggaaggtcccgacggtcagcactaccgctttagcgcggaatttgaggcccatctgggtgacggcgcccacgacgcgatcgttttcgacaatcagatcttcaaccgcctgctggaagatcatcaggttcggctggttctccagcgcggtacgtactgcctgacgataaagcacgcggtcagcctgggcgcgggtggcgcgcactgccggtcctttgctggcgtttagtatcctaaactgaatacccgcctgatcgatcgctttggccatcaaaccgccgagcgcatccacttcttttaccaggtgtcctttcccaatgccgccaatcgccgggttgcaactcatttgccccagcgtgtcgatattgtgtgtcaaaagcagggtttgttgacccatacgcgctgcggccattgcggcctcagtgcctgcatgacccccgccaatgataatgacgtcaaaaggatcctgataaaacatggtggtctgcctcgcataaagcggtatgaaaatggattgaagcccgggccgtggattctactcaactttcgtctttcgagaaagactccgggatcctgagtattaaaaagaagatctttatatagagatctgttctattgtgatctcttattaggatcgactctctttgtggataagtcggatccgcgaagtaagatcaaaagcttaagaaggatcactatctgtgaatgatcggtgatcctggtccgtataagctgggatcagaatgaagggttatgcacagctcaaaaaccatactacggttattctttggataactaccggttgatccaagcttttaagcatggttatccacagaagatcgggcgatctttacaattctcagagcaaatttttccaggatcccagccagatttccgctggatcctccggaatttcgtgttcaaggacgttgatcttcagcgtctcaccgatctgttttgccccgcaggccttcagcgccgcttctaatttatcgatcgcgccgcaaaaggtgtcgtattcgcggctgccgatccctatagcgccaaagcgcacggcggaaagatcggcctgcttctcctgcagcgcgtcatagaagggaaccaggttgtcgggaatgtcgccggcgccatgggtggaagagataattaaccagatcccttgcgcctgcagatcgtccaccagcggaccgtgctggatttcagtgctatagccggcttcttccagcttttccgccagatgctctgctacatattccgcactgcccagggtgctgccgctgataagtgtaatgtctgccatagatcgccgatcgcccgctcaactgttcagagtggcgtattgtacgctgtgagcgagctgggatctacctgtggaaaaatgtgggattaaaaaaagcgatcagggcttgatggtgcgcatgatcgggttctgcagcacgatcagagtttcagtggactgaatttcatcgattgtttggatcttgttgataagtacctgctgcagagcatcgatggatttacacatcaccttaataaagatgctgtagtggccggtggtgtagtaagcctcggtgacctcctccagactttccaggcgggcgagggcggagggatagtctttggcgctttttaaaataatgccgatgaagcaaccgacgtcgtagcccagctgcttggggctgacgtcaatgcgcgcgccggtaatgatacccgcctgcttcatcttttcgacgcgcacgtgaatggtgcccgggctgacgctgaactgtttggccagttcggcataggcggtacgggcgttggccatcagcgcatcaagaatgccgcggtcaagattgtcgatctgataattttccatatctttttcttatgaagtttgagggttcttactattttagcgccatattttaatgaattaaaagttgatgcgcctttttattgattgattgttgtattgccgccctgttttgttgcttaatcaatggcaacaggacgcaggagtcataaaaatgaaaaccgcatatatcgcaaaacaacgccagatcagtttcgttaaatcccacttttcccgtcagctggaagagaagcttggcctgattgaagtccaggcgccaatcttaagccgcgtgggcgatgggacgcaggataacttgtccggctgcgagaaagcggttcaggtaaaagtgaaaacactgcccgacgcccagttcgaagtggttcattcgctggcgaagtggaagcgtcaaaccctgggacaacacgacttcagcgcgggcgaagggctgtacacgcacatgaaagcccttcgccccgatgaagaccgtctgacgcctatccattccgtctatgttgaccagtgggactgggagcgcgtgatgggggatgaagagcgtcacgtcggcaccctgaaggcaaccgtcgaggcgatctacgccgggatcaaagccaccgagctggcggtcagcctggagtttggcctgacgccgttcctgccggaacagatccattttgttcacagccaggagctgctgagccgctatccggagcttgatgccaaaggtcgtgagcgggctattgccaaagagctgggcgccgtcttcttaattggtatcggcggcaaactagctgatggcaagcgccacgacgtgcgtgcgccggattatgatgactggagtactgaggtttctgaaggttttgccggcctgaatggcgatatcctggtgtggaacccggtgctggaggatgcgttcgagatctcctcgatggggatccgcgttgacgccgaggcgctaaagcgccagctggcgctgaccggcgatgaagatcgcctgaaactggagtggcaccaggcgctgctgcgcggcgagatgccgcagactatcggcggcggcattggccagtctcgtttgacgatgctgttgctgcagcttgaccatatcggtcaggtgcagtgcggcgtatggccggcgcaggttcgcgaaagcgtttccgcgctgctgtaacgattagcgcagccagcgtcgcagcaggcggctacgcagcccggtgtcaaagcgccagatatgatcgaagatgcgcatgatgccgggtttgccgtgaaccgacatcgccaccgcgtgaaaacggtgctgatgcttacgctgtaactcccccacctgagcaatcacctcatccggcaaccgttgggcaataaagtcggagatcaccacggcatccgcatccacccactgcgggttttgcaaacgttcaataatggcgcgaaaacagctggccagatcggtgccgccgcgaaaacgctggctcaggaaacggatcgcctgctccagtccgctctcgctggtcaactcgtaatgcaccacttcgctggaaaacagcataatgaagcagcgacggttatcggccagcgcgatgcgcatcagggccagacaaaaggccttagcgcactgttcgttaaaaccgcccatcgatcctgacgtatcgacgcagacaatgaacggcccgcgcggttgctcatcaaaatcctgccgcgttaccgggcgttcggtaattttctcgcgccaggcatcgccgtgtagccggtaggtgagcagctgtttctccaccagcttgcgataaaattcaaactccagctccgtgatgccaagcgtcgccagctccggcggcagcaggcgtagaatgtcgtcactctgctggaggccgtcgacctgttcaggcaccgttgctggctcgcgtaccaggctgcggaaggtttccatcggcgcatctttcttcggcacggatttcgcttcccttgaacgccccagctgttccgccagctgcagcagctccggttgctggttaagaaaatcgccatagcgcacgatcagctggtagtcgcctcgtttgagttcgccggcgctcatatcccacaggcgtccggcggcggtatcattttccgccagcaccggatcgagctgaccgctgagcgtcattcgttcctggacctcactgagcaactggtcgcgctcatcgtccagcagctgctggttaaggctggtggcttgcaccaccaggctcaggcgccagcgctgtaaaaacagcgtatgcagcgccggggtaaaggtggcattgtcatccaccagcttctgcgcctgggcggcaaaaggggactggagctggtgcagtttgccgagaatttgcgggagctggacgataaactgcgaggtagagagcagctgagcctgctgataggtttgcacttcggcgtccagatccggcgggatgttaacttcttttaagcgggcgcgaacggcttcccgccagcgcggaatatccgccgcgatgatgtttttcaggcggggaaatttttcaaagaacaccgccagctgaggagaggccaacagcgccagcagcatctcctcgatcattccctcttcgctgactgccagcatgacattcagcatatcgagcgtcatggctgcttcgcctgtttaatctgcgcgccgacgtcctgcaggctggcttcgattcttcccagccattcgaccgggataaacaggcacttttgctgctcgctgaagcggttgtgttgctggtgccactcatcatccagcgcttccagctgctggcgaatttccgccggcatattctcctgcgctgcgctgccgggcagcgcgaggcgtgagccctgcaggctcacatcgcggacgaccagatgctggctggtgtcgacatccatattgagtagttgggcaaagccgatcccgttgagcttaccgcggatctcgccgcccttttccagccagttggctaacgcctcgcgttcaaaagtaatgtggatcacttccatatcgtgaagtttgagcggctgctgcagcagcagcgtcagggtggtcccctggatctccgccggcagttcatagtgcggtttgcggctaaacatcccgccaaggcgggtgaccttcagcgccgttttgtcgctttgctgttgttggatctgaatgcgtcgctgcacaatcgcccccaaccgcgtcagcatcgcctgctgttgccaggcgtgacaggtcatgagcgtttccagctgctgcgacatcaagttcatactttcgacgttgtgccacagacaatctttcagcaggataaggtcgattggcgcgatgctgtcgcggccgctgaagaaggcgctggcctgcagcaggcgaatagcctttttccagcggcgatccgagacgtagggggcatttggctgggcgtccagctgctggcggagctggaatatcagctcaaacaccgcgtccggcagtttaatattgccgatctgctgctgccattgggtaaattcctcgtcgctcacctgcagcgcgctgggcactggattgctgttttcatcctgctggctgaccagcatcgaacggaaattacctttatcctgcactttatcaagccatagacggatcagcattcggtcatacagcgcttccaggctgctgtcggcttccgggagttcgttcgacgcggccaccagcaggcgcattgggattttctcttcatgcgcgccattgcggaagtgacgttcgttaatcgccgtcagtagggtgttgaggatagccggacctgctttccatatttcatcgagaaacacgatttccgcttccggcaggtagccggcggttaaacgttcgtaacggccttcatctttcagcgcctgaatggacagtggcccaaatacctcttccggggtggagaagcgggtcatcaggtattcaaaagcgcgcgcctgctggaaggcgaatttgaggcggcgggcaatcaggcttttggcgatccccggtggaccaagcaaaaaaacgctctcgccgctgagcgccgccagcaggcagaggcgtatcgcgtggctgcgttcaaagagtcctttttcgagtgccgcgctgagccgggaaattctttcagccagtaaatgtgtttgagccataattgagttgcgtgctttgtcatgtatcgttattgggacgagtatagatgttagagccggggcggtaatagcctgaagaatcgatttattttttttgagccaggttaatatggtgtctgttaggggtacgatttcacaaataatcgtgcatactgtgcgctttttgtgggccaagggactaggcacacatttgttttataaacgaaaagactagtctatgagcactgataataaacaatcgttgccggcgttaacgctggcggccatcggcgtggtgtacggcgatatcggtaccagtccactgtataccctgcgcgaatgcctgtcaggtcagtttggctttggcgtagagcgcgatgccgtttttggctttttgtcgctgattttctggctgttaatctttaccgtatcgattaaatacatcaccttcgtgatgcgggcggataacgccggggaaggcgggatcttaacgctgatgtcgctggccggacgtaatacttcggccagaatgacctccgtgctggtgatcctcggccttatcggcggcagtttcttctatggcgaagtggtgattaccccggcgatttcggtaatgtcggcgatagaggggttagaaattatcgccccgcagctcgatacctggattgtccctatctccattatcgtgctcaccctgctgtttgtgatccagaagcacgggactggcatggtcggcaagctgtttgcgccgattatgctgatctggttcctgttgctggcggtgctgggcgcgcgaagcatttacgctaatccggaagttctgcaggcgctgaacccctactgggctgtgcacttcttcctgcaatacaagaccgtttcctttattgcgcttggcgcggtggtgctgtcgattaccggggtggaagcgctgtacgccgatatgggccacttcggcaaactgccgatccgcgtcgcctggttctccgtcgtgctgccctcgttggtgctgaactattttggccagggcgcgctgctgctgaagcacccggaagcgattaaaaacccgttcttcctgctggcgcctgagtgggcgctgatcccgatgctgattatcgccacgctggcgacggttatcgcctcccaggcagtgatttccggggtcttctccctgacccgtcaggcagtgcgtctgggctatctgtcgccgatgcgcattatccatacctcggaaatggagtccgggcagatttacattccgttcattaactggctgctgtacgtttctgtggtcatcgttatcgtcagctttgagcattcgtctaacctggcggcggcgtatggtatcgccgtaacgggcaccatggtgctgacctccattctgtcggcgaccgtggcgcgcaaaaactggcactggaacaagctgtttgtcggtctgatgctggtggccttcctgtgcattgatattccgctgttctcggcgaacctcgataagattgtctccggcggctggctaccgttgtccctggggatggtgatgtttacggtgatgacgacctggaagagcgagcgtttccgcctgctgcgccggatgcacgagcatggcaactcgctggaagcgatgatctcttcgctggagaagtcaccgccagtgcgtgtgccgggtactgcggtgtatatgtcccgcgccctgaacgtgatcccgtttgccctgctgcataacctgaagcacaacaaggtgctgcatgagcgagtgatcctcctgaccctgcgtaccgaagatgcgccttacgtgcataacgttcgccgggtgcagattgagcagctgtcaccgtccttctggcgggtggtggccagctacggctggcgggaaacgcctaacgttgaagaggtgttccaccgctgtggcctggaaggactcagctgccggatgatggagacctcgttctttatgtcgcatgagtcgctgattatcggtaaacggccatggtatctgcgcctgcgcggcaagctttatctgctgctgcagcgtaacgccctgcgggcgccggatcagtttgagatcccgccaaaccgggttatcgagctcggtacccaggtcgaaatctgatgtcaaaaaagcccttccattgcgaagggctttttgtttctcactccggttgttatgtcctgtcgctgcctcgcgaaacgtttcgatggcgatcacatttctctcttctggtgatggttttctgctcacacattgataataattattttagcgaaacgtttcgctagtggagcaaaagagaaaaaatgaaaaaaggcaccgtacttaacgctgatatttccgcggtcatttcccgcctgggccacaccgatacgctggtggtctgcgatgccggattaccggttccccgcagcagcacgcgcattgatatggcgctgactcagggcgtaccttcatttatgcaggtgctggaagtggtgacgacggaaatgcaggttgaagcggctgtcatcgcggaagagattaaaacccataatccgcagctccacgcgacgttgctcactcacctcgagcagctgcagcagcaccagggaaataccattgaaattcgttacaccagccatgagcagttcaaaaaacaaaccgcagacagtcaggcggtaattcgcagcggggagtgttccccgtttgcgaatatcattctctgtgccggcgtcacgttctgaggtcgccgtcatggaagccttattgcaactgaaagggatcgacaaagcgttccctggcgtcaaggcgctctccggcgcggcgctgaatgtctatgctggccgggtgatggcgctggtaggggaaaatggcgccggcaagtccactatgatgaaggtgttgaccgggatctacacccgtgatgccggctctttgctgtggttaggcaaagagacgacctttaacggcccaaaatcctcccaggaagctgggatcggcattatccatcaggaactgaacctgatccctcagttgacgatcgccgagaacatcttccttggccgcgagttcgttaaccgttttggcaaaatcgactggaagcagatgtatgccgaagccgacaagctgttggcaaagctgaatctccgctttaccagccagaaactggtgggcgatctatcgattggcgatcagcaaatggtggagatcgccaaagtgctgagcttcgaatcgaaagtcatcattatggatgaaccgaccgatgcgctgaccgataccgaaaccgaatcgctgttccgcgtcatccgcgaactgaagtcgcaggggcgcggtatcgtctatatctcccaccgtatgaaagagatcttcgagatttgcgacgacgtgacggtctttcgtgacgggcagtttatcgccgagcgcgaggtctcgtcgctggatgaggaccgacttatcgagatgatggtcggccgtaagctggaagaccaatatccacacctcgataaggcgcccggcgcggtgcgcctgaaggtcgacaacctctgcggcccgggggtggataacgtgacctttaccctgcgccagggggagatcctcggcgttgccgggctgatgggcgccgggcggaccgaactgatgaaagtgctgtacggcgcgctgccgcgcagcagcggttccgtgacgctcgatggccgcgaagtggtgacccgttcgccgcaggatggtctggcgaacggcattgtctatatctccgaagaccgtaagcgcgatggtctggttctcgggatgtcggtaaaagaaaacatgtccctgacggcgttgcgctatttcagccgggcgggcggtagtcttaagcataaagatgaacagcaggcggtgagtgatttcatccgcctgtttaacgtgaagacgccttcaatggagcaggcgatcggcctgctctccggcggcaaccagcaaaaggtcgccatcgcccgcgggctgatgacccggccgaaggtgctgatcctcgatgaaccgacccgcggcgtcgacgtcggggcgaagaaagagatctaccagctcatcaaccagttcaaagccgacggcctgagcatcattctggtctcctccgagatgccggaagtgttgggcatgagcgatcgcatcatagtgatgcatgaagggcatctcggcggtgaattcacacgcgagcaggccacccaggaagtattgatggctgccgctgtgggcaagcttaaccgtgtgaatcaggagtaagaaagatgacaacccaggctgtttctggtcgccgctatttcacaaaagcgtggctgatggagcaaaaatcgctgattgccctgctggtgctgatcgcggtggtatcgaccatgagccccaacttttttaccgtcaataacctgttcaatattctgcagcaaacctccgttaacgccattatggcggtagggatgacgctggtcatactgacctcggggatcgatctgtccgtcggctccctgctggcgctcaccggtgcggtggcagcgtcgatcgttggcattgaggttaatgcgctggtggcggtcgcggctgccctcgcattaggtgcggcgatcggcgcagtcaccggggtgattgtagcgagaggccgcgtgcaggccttcatcgccaccctggtgatgatgctgctgctgcgcggcgtaaccatggtgtacaccaacggcagcccgatcaataccggctttagcgataatgccgatctgtttggctggtttggcatcgggcgtccgctggggatcccgacgccggtatggatcatggcgattgtcttcctggcggcctggtacatgctgcaccatactcgcctgggccgttatatttatgccctgggcggtaatgaagcggcgacgcgtctgtccgggattagcgtcaataaagttaaaattatcgtttacgccttgtgcggaatgctggcttcgctggccgggatcatcgaagtggcgcgtctctcctccgcgcagccgacagcggggacgggctatgagctggacgccattgcggcggtggtgctcggcggcaccagcctcgctggtggcaaaggacgcattgtcggcacgctgattggtgcgctgatccttggcttcctgaataatggtcttaatcttttaggcgtttcttcctattaccagatgatcgttaaagcggtggtgattttgctggcggtactggtagataacaaaaagcagtaactgagaactctacaggacatcttaactatgaatatgaaaaaactggcgaccctggtctctgctgttgcgctaagtgcgaccgttagcgcgaacgcgatggccaaagacaccatcgctctggttatctctaccctcaacaacccgttcttcgtgtcgctgaaagacggcgcgcaaaaagaagctgacaagctgggctacaacctggtggtgctggattcccagaacaacccggcgaaagagctggcgaacgtccaggatttaacggtgcgcggcaccaagctgctgctgatcaaccccaccgactctgatgccgtcggcaacgccgtgaagatggcgaaccaggcgaaaatcccggtcatcactctcgaccgtcaggcgacaaaaggcgatgttgtgagccatatcgcctctgacaacgtgcagggtgggaaaatggctggcgattacatcgcgaaaaaagtgggtgaaagtgcaaaagtcattgagctgcagggcattgccggaacttctgcggctcgcgagcgtggcgaaggctttaaacaggccgtggcggcgcacaaattcaacgtcctggccagccagccggccgatttcgaccgcaccaaaggcctgaacgtgatgcagaacctgctgaccgcacatcctgacgtccaggcagtgttcgcgcaaaatgatgaaatggcgctgggcgccctgcgcgcgctgcagaccgcaggcaagtccgatgtgatggtggttggatttgacggcactccggatggcgaaaaagcagtaaacagtggcaaactggcggcgaccgtcgcacagttgccggagcagatcggcgcgaaaggcgttgagactgctgataaggtactgaagggcgaaaaagtggaagctaactacccggttgagctgaagctggtcgttaagcagtaatatgcgattcggactggcaacggtccgagggacaatataaaaaaagaaaagcagggcatgcgccaccggatcccggtggcgcgctttcccgggaacagaaatgatgaaaactgcaggcaaacttgtcgtccttggcagtatcaatgccgatcacattcttaaccttgacgctttcccgacgccgggcgaaaccgtcaccggccaccattatcaggtggcgttcggtggaaaaggggccaaccaggcggtggccgccgggcgcagcggagcggatatcgcgtttatcgcctgcaccggcgatgacgatatcggtgaacgcatccgtcgtcagctggcgagcgataaaatcgacgtggcgcccgtgcgcgcggttgccggggaagcgaccggggtggcgttaattttcgttaacgccgaaggtgagaatgtcatcggtattcatgccggcgccaatgcggcgctttccgtctcccaggttgaggcggaaaaagagcgtatcgccagcgcacaggcgttgttgatgcagctggagtcgccgctggagagcgtcatagcggcggcgaaaatcgcccatcaccatcacaccaccgtggtgctgaaccccgcgccagcgcgtgaactaccggatgaactgctggcgctggtggatattattacccctaacgaaaccgaagcggaaaagctgaccggtattcgcgttgagagtgacgaagatgcggcaaaagccgccgacgtgctgcatgccaaaggcattggtacggtgatgatcaccctcggcagccgcggcgtctggctcagtgccgaaggcgaaagccgccggatcccagggtttcgcgtacaggccattgatactatcgcggccggtgatacctttaacggcgcgctggtgaccgcgctgctggaagggaccgccctgccggaggcgattcgctttgcgcatgccgcagcggcgatcgccgtaacccgcaaaggcgctcagccgtccgtgccttggcgcacagagatcgatgaatttttagcgcaacaggggtaatgcttggctacgatgaaagatgtggcccgcatcgcgggcgtttccacatcgacggtgtcacacgtcatcaataaggaccgctttgtcagcgaggcgattaccgccaaagttgacgctgcgatcaaaagcctcaactacgccccctctgcgctggcgcgtagcctcaagctcaatcaaacccgtaccatcggcatgctgatcaccgccagtaccaatccgttttattcggagctggtgcggggcgtggagcgtagctgctttgagcggggttatagcctcgtgctctgcaataccgaaggtgatgagcagcgaatgaatcgtaatctggagacgctaatgcaaaaacgcgtcgatggattactcctgctgtgcacggagacccatcagccctccccggaaatcatgcagcgctatccgtcggtaccgacggttatgatggactgggccccctttgatggcgatagcgatctgattcaggataactcgctgctcggcggcgatatggcgacccagtatctgattgaccaggggcattcacgcattgcctgtattgccggcccgctggataaaaccccggcgcgcctgcgtcttgaaggctatcatgccgcgatggcgcgctgcggcctgccggttgccgaaggatacgtggtgaccagtgattttgagtttggcggcgggtttagcgcgatgcagcagctgctggcgttgccgcagcgtccgcaggcggtgtttgtcggtaacgatgcgatggcggttggcgcttatcaggcgttataccaggccgggctgcagattccgcaggatatggcgctggtgggctacgatgatattgagctggcacgttatatgacgccgccattgaccaccattcaccagccaaaggatgagctgggggaactggccatcgacgtactgatccatcgcatggccgatccgcagcaaaaacagcagcgcgttcagttaacgccggagctggtggttcgcggttccgcttagcgtttatgccgctcgctaatcaggttgcggccatccttcgctcttaacagcataaacatcagcgccgatataatggttatcacgcccatggttataaaggtgtagtgaaactgctgtaccgtgcttgcattatcaaaaccttcatagaagcgtagcaccgcagcgctgatggccaccccgagactaattgaaagctgctgggtgacggccagcaggctgttgccgctgctggcattatcatcggtcagatcggccagggtaatggtattcatggcggtaaactgcgtggacatcgccatccccagcacgaacagcggcagaagaagcatccacagcggcatctctggcgactgcagcgagaactgggcgatcataaggccaataaacacggtgatccccaccagggtcttacgatagccaaaccagcgcagcacctgggtaacggtggatttcgcaataatcgagccgatagcggtgggggcgatcatacagccggcgataatggccggatagccgaaaccaacctgtagcatcagcggcatcagaaacggtacgcagccggtacccaaccgcgtggcgaggttgccggcaatgccgaccgagaacgtatgggtcttaaataaagagagcgagataagcggcgtcggatggcgacgcgcgtgacgcacataggccacgagcagtaacagactgacggcaatcacggccagcgcctgccatgtcgccacgattttttccccaaacagttcaataccgctggaaaataacaccagacttaagccaaataacagaaaaccgcctatatcgaagcgtcggcgcggcgttgtgaaatttggcatgtatttacgggcgtacagaatgccaattacgccgatcggaatgtttatcaggaaaatccaatgccagctggcccaggtcacaaataccccgccgagtaccgggcccagaatcggccccaccaatcccggcatggtgacaaagttcaggaccggcaacagttcgctgcgggggtaggcacgcagcagggccagcctcgccaccggcatcatcatcgccccaccgatcccctgaattacgcgaaaaatgaccagttccgttaaggaactggagagggcgcaggcgagggaaccgagggtgaacaggctaacggcgatgataaagacccggcgcgtgccgaagcgatcggccagccagccgctgaccgggatcagcatcgccaccgtcagcgtatagctgataatggccgactgcatcgctaagggagaacgattaagactgtgggcgatagccgggagggcggtgttaagaatggtggcatccagcgcctgcataaagaaggccatcgccgcgatccacggcaggccagccatgctgcgccctttttttccgctcatgccaaatccttgttattgatttacgtggtgtggggcgttcaacaatgcctggcaggcgagcaacgcccccggcgcatcactgttaagaatggcatcgacaatcgcctggtggagatcgagcttcaccacttcattttgcgtaatcgacgtgaagtaggtgtggtagaccgaatgaaacagcgaggcgaaagagctgaggaaaggattaccgctcatttcatagatatgctcatgccaggccatatcgacttctatccagcgttcgcgctgaaaatggcgtttcagagcaatcatctcttccattaatgtattgagctgcgctttttgcccggcggtgccgttggcggcggcgagaaagcaggcctgtggctccaggctgctgcgcatgacgagaaagtggcttaccacctcttcgaagttatcttctgttagccaccaggagagcagttccttatcaaggaaattccagctgctgcgcggcatcacccgggtgccaatgcgagggcggggcagcagcatgccttttgcagtaagcgtcttcaccgcttcgcggacggcggtacggcttacgccgaactgctcccccaactccatttcgccgggaagaatgctttccggctgatattcgccagtcagtattttttgggcgagcttttcggccagtacccaggaaatgttcttttgtgccgccagttgctgtgcgcttaaagacataaatgccgttcctttctttcctctactctaacagtatgccaccaggcgccccgtttcgtcggttaaaacggcaaaacggcggttttttgcgacattcctcgccgcattgttgaaaaaagagacggttgaaaactttttttgcatttccccttgtcacctcagaattactccctataatgcgcctccactgacacggaacaacggcaaacaagccgccgggtcagcggggttccggtgagaacctcgcagagaaaagcaaaaataaatgcttgactctgcagcgggaaagcgtaatatgcacaccccgcgccgcagcgaaaacgaagcggcactgctctttaacaatttatcagacaatctgtgtgggcactcaaagtgacatggattcttaacgtcctcggacgaaaaatgaataccaagtctcaagagtgaacacgtaattcattacgaagtttaattctttgagcatcaaacttaaattgaagagtttgatcatggctcagattgaacgctggcggcaggccta

SEQ ID NO: 71 - DNA, 99448 bp, Unknown
  source: /note="Description of Unknown: KP2-Mcoc1 Bacteria Sequence"
ggccagcgtgccggcatgcctccccggtggcgctgcgcttaccggggctacggatccgacacggggctacgtccctgtggccggacaaggtgcgcagcaccgcctccgggaaaatccctcctatatcaccgtcgataaatgactattgcctctctaaccaactcacaataaatgtcgcgatctgtggtacattatttaaatccagcagcggaagtgaggtcgcgatcgatacatcgctggccacggcgatggtatgctcatcaattaccagctcttctacacgatggccgctgttttgccgaaaaagcaggatcttcggcacgggttcatgtttgaacccctccactaaaaccaggtccagtttgctggcatccattcgactgaccagccacgtgagatctaattccggcttctctggcgtctcggtcatcaatgcccaccgctgttcgctggcgacaatagtttgcgcagcgcccgccttacgcagttcatagctatctttgcccggcttatccacgtccatatcatgatgggtgtgctttatcagtcccgggcgtaatcctagagcgcaaagctcagggataagacgctttaataatgttgtttttccggtaccgctccatgcggcgatcgccagtaatgggatcatgatggctcctgcatctgctgcaaatcttcgagcgtatttacattaatgaaagcagttttcacatcgctgaaattcaccgggcgcccacccatttgtcgcataaaaaccatcaccctgcgctctccatgtgccagataagcctccagttccggaatgatttgacgatgaactaatgcaacggcaggatgatcccgttcgccgtcatgggcccaaacgaccggtgcgtcccctctctgctggataaagcgctccaccaaaaaggacggaatgaacggcgtgtcgcaggggcaaaaaacaaaccatgggctcgcgacctgctgcatcacagcaagcattccggccagcggcccctgataaccctcctgtatgtctcgaaagaccggatatccgctggcacgccactgttcaagatgacgattggcgctaatgactaactcatctacctgcggggctaatgcttccgcgacgtgtcgccagagagggcgaccatttagcgcctgtaatcctttatcaatgccgcccatccgcgtggccctgccgcccgccagcacgacgccggttatcgcctcgctttgcatatgaatatcgcctctttcattgtgggattgaccctgttaacttgtccctatcaagagtaaggagcatgaccatgaaatgtaaacgtctgaatgaagtaattgaactcctccagccagcctggcaaaaagagcctgaactgaacctgatgcaatttttgcagaagctggcgaaagaggccggctatgatggcgaactgagcgatctttccgacgatattctgatctatcacctgaagatgcgcgactcttccaaagatgctgtcatcccgggtattcagaaggattatgaagaggactttaaaaccgcgctgctgcgcgcccgcggggtaataaaagagtaaaaggttgtaagcgctaccgcgtaaagtgcaatgagatgatatcctgaactattcgtacgattatcggatgtcaggatgcacgataaggcttttacttttcagacgcttcgcccggataccattatcgatgggttattcgatctgggtatgcgggtggactccggtctcaccccgctaaacagctatgagaaccgcgtttatcagttccaggacgaagagcgccatcgctatgtggtaaagttctatcgtcctgagcgctggtccgcagaacagatccttgaagaacaccagtttgcgcttcagcttgtagaagatgaagtgcccgttgctgcgccgctcttatttaatgacagcacgcttcatcagcatcagggattctactttgccgttttcccaagccttggcggtcgtcagttcgaagcggataaccttgatcagatggaatgggttggccgctacctggggcgcctgcaccagactggccgcaaacagcgctttactgcccgcccggaaattggcgtgcaggagtacctgctggaaccgcgtcaggtgtttgagcaggcgacgctgatcccctctggcctgaaggccgatttcctgaaggcgaccgataaactcattgctgccgtcatggagcaatggcacggccgcgggaacacgttgcgcctgcacggtgactgccatgccggtaatatcctctggcgcgacggaccactgtttgtcgacttagacgatgcgcgtaccggcccggcgattcaggatctgtggatgctgctcaacggcgataaggctgaacagcgtatgcagctggagactattgtcgaggcctatgaggaattcagcccctttaacagcgatgaaatcgcgctgattgaacctttacgcgctatgcgactggtttattatctggcgtggttgctcagacgctgggacgatcccgctttcccggtcaatttcccctggttaaccggggaggattactggtgggggcagacgtcgacttttcttgagcaggtgaaggttctacaggaacccccgcttcagttaacgccaatgtattaatgtgatatatccaggagagagtaaatcatgaaaaaagtttggctggcgctggctggtatgattctggcttttagtgcatccgctgcccagatcaccgacggcaagcagtacatcacccttgataagccgattgctggcgagccgcaggtgctcgagttcttttcgttctactgcccgcactgctaccagtttgaagaagtgctgcatgtctctgacaatgtgcgccagaaactgccggaaggcactaaaatgaccaaataccacgttgagttcctgggtccgctgggcaaggatctgacgcaggcatgggcggtggccatcgcgctgggcgttgaagacaaaattactgcgccgatgttcgaagccgtgcagaaaaaccagactgtgcagagtgtggctgacattcgtaaagtgtttgtcgacgctggcgtgaaaggggaagactacgatgccgcatggaatagcttcgtggtgaaatctctggtcgctcagcaagagaaagcggcagccgatctgcagctgcagggcgtaccggctatgtatgttaatggtaaataccagctgaatccgcaggggatggacaccagcaatatggatgtcttcgtcgctcagtatgcggataccgtgaagcaactggtagagaagaaataaaaaaaacgccggtcactgaccggcgttactttatctgttttgcaatagctaccgttctttgtccctcatgatgtcagtcaactgacggtctttctcttcccataggccattcagccagcgctggaagccgcgcttaaagttcttatcgttaacgtaatcgccgtgcagctcttcgccaatagggaccagattgatacggaccacaatgcgcgtcaggcggccgcttaacatatcgtaaaatggtcttgtatgattatccgggtagcacagcgtgacgttcagcagtttatcgaactgcgaaccgagtacgttgagcgccatggcgataccagcggctttcggcggtaacaggttgtggtaaggagagcgcgtttcgcgctttttttcttcggtaaaacgtgagccttccacaaaattgacgatagtcgtcggatgcgcgcgaaatttttcacacgaacggcgggtggtttcgacatctttaccgcggcgctccgggtgacgaataagatagctgcgcgagtagcggcgcataaaaggcatatccagcgcccagcaggcgaggccaatgaagggtacccacgccagctgttgtttaaggaagtacttattcatcggaatatgcttgcggaacagcacgcacagcaccacgatgtctgcccagctgtggtggttgctgatcagcagataccagttctttttgttcaggccttccagaccctggacgtcccattttagccagggattgagatgcaacagcagcgccagcccttcgcaccagcagtacatcataaaattgcaaaaaacggatatagagcgccataccgctggaatggggaccagcagtttaatcagcccggcgacgatgatcggtacagagcagataatggtgactaagatggttaaggcgatactcagcggaagtgttatcgcagcgagtaatctcgacatagttagtttattcagaaagttaggctgacaaagagcgcctttaagctgcgcaagaggctgattttaccagaaaacgcggcaaatgacgggtcttaccagaacagaaaaaaacaaggatcttctatccacatggaagattaggtcatcaaattaatgccaggatcgttgatctgtttttaagtggttgataaatagtaaataatactatttattcatttattttcaggggcggataagctgacgttgtaaaactatgcacaaagttatccacaagctaagttgtcgcgcgatcgcgacgatcgttgaatcttttccgcgaattgcgggaaaaattcaggatttcatgcccgtctgtggcatcctttatccataatctgataaacaggcacggaaattatggttcagatcccagaaaaccctctcatcctcgttgacggctcctcctatctttatcgggcgtatcatgcgtttccgccgctgactaacagcgcaggggagcccaccggggctatgtacggcgtactgaatatgctgcgcagtttgatactgcagtatcaaccgactcatgccgtcgtggtctttgatgcgaaagggaaaaccttccgtgatgaattgttcgagcattacaaatctcaccgcccgccgatgccggacgatctgcgcgcgcagattgagccgttgcataagatggtgaaagcgatggggctgccgctgatggctgtcccgggcgtcgaagctgacgatgtgattggcaccctggcgcgggaagcggaaagggcaggtcgcccagtcctgatcagcaccggcgataaagacatggcccagctggtgacgccgggcatcaccctgatcaataccatgaccaacactatcctcggaccggatgaggtggttactaagtacggcgtcccgccggagctgattattgatttcctggcgctgatgggcgactcctcggataacattcccggcgtgccgggcgtgggcgaaaagaccgcccaggcgctgctgcaaggcctcggcggccttgatacgctgtatgcggaaccggagaagatcgctgaactgagcttccgcggcgcgaaaacgatggcggcgaagctcgagcagaacaaggacgtggcttatctctcttatcagctggcgaccatcaaaaccgacgtcgagctggagctcacctgcgaagagctggaggtgcagccgccggcggcagacgatctgctggcgctgttcagacagtatgaatttaagcgctggaccaccgacgttgaggccggaaaatggctgcaggctaaggggggcaaaccggctgcgaaacctgcagtgcctgcagcagcggcagaagcggaagaagaggttgaagccgctactgcactttcagcagagcattatgtcactatccttgatgaggctacgctgctcacctggatcgataagctgaagcaggcgccgctctttgcctttgatacggaaaccgacagcctggataacatctccgccaacatggttggtctttcattcgctgttgagccgggcgtggccgcctatgtcccggtagcgcatgattaccttgatgcgccggatcagatcccgcgcgagcgcgtgctgacgctgcttaaaccgctgctggaggatgagaaggtgctcaaggtcgggcaaaatctcaaatacgatcgcggcattttggctaattacgacattgagctgcgcgggattgcgttcgataccatgctcgagtcttacattctcgacagcgtggcgggccgccacgatatggacagtctttccgaccgctggctgaaacataaaaccattaccttcgaagagatcgctggcaagggtaagaatcagctcacctttaaccagattgcgctggaagaggctggtcgctacgcggcggaagatgccgacgttacgctccagctgcatctgaagatgtggccgaagctacagcagcatgaaggcccgctgaatatcttccagcacattgaaatgccgctggtgccggtgctgtctcgcgttgagcgcaacggcgttaaaatcgaccccgccgtgctgcatgcgcactcgcaggaaattgcccagcgtctggttgagctggagcagcgggcacatgagatcgccggggaagcgtttaatctctcctccaccaaacagctgcaaacgatcctgtttgaaaaacagggtatcaagccgctgaagaagacgccgggcggtgcgccgtccacctctgaagaggtgctggaagagctggcgctcgattatccgttgccgaaagtgattctggagtatcgtgggctggcgaagctgaagtcgacctataccgataagctgccgctgatgattaaccccaaaacgggccgcgtgcatacctcctatcatcaggcggtcaccgccaccggccgtttgtcgtctaccgatccaaacctgcaaaacattccggtgcgtaacgaagaagggcgccgtattcgccaggcgtttatcgcgccggaagattacgtcattgtctcggcggactactcgcaaatcgagctgcgcattatggcgcacctgtcgcgggataaaggcctgctgaccgccttcgcggaagggaaggatattcaccgggcgacggcggctgaagtatttggcttaccgctggacagcgtcagcagcgaacagcggcgcagtgcgaaagccatcaacttcggtctgatctacggcatgagcgcctttggcctggcccgccagctgaacatcccgcgtaaagaagcgcagaagtacatggatctttatttcgaacgttatccgggcgtcctggagtatatggagcgcacccgcgcacaggcgaaggagcaagggtatgttgaaacgctggatggccgtcgactctatttgccggatatcaagtccagcaatggcgctcgtcgtgccggcgcggagcgtgcggcgattaacgccccgatgcaggggacggctgcggatattatcaagcgggcgatgattgccgttgatgaatggctgcggagcgagaaacctcgcgtgcggatgatcatgcaggttcacgatgaactggtctttgaagtgcataaggatgagctcgatgccgtatcgaaaaagatccacgaactgatggagaacagcactacgctggcggtaccgttgctggtggaagtgggcagcggcgaaaactgggatcaagcgcactaagtatacaaagcgcaacgcgattttctgtaagtaagcaacataacttatagagttttgtgaggatcatttgaatttgctatgtaaatagtgaaaaaaaactacaaaaaatgctttatccgtgagcgaaagaagagtaaagttattcgcgtagggtacagaggtaagatgttctatctttcagaccttttacttcacgtaatcggatttggctgaatattttagccgccccggtcatttatgaccggggcgttttttattgcgcgaaagaaaagttttacgctgtgaaaacaacgtagtatgaacgtccggatagggcgctacgcgccgttatccggaaaaagcgggggttactcggcgtcttcgacggcttcttgcggcgggatttcgttaaaccagctatccagcttctgtcgcagcttatcgacgccagattttttcagcgaagagaagggttcaacctggacatcgccattgaaggccagtaccgcttcacgcaccatattcacttgcgctttacgcgcgccgctggcgagcttatcggctttggtgagcagtaccagcacctgaatatcgctctctaccgcccattcgatcatctgttgatcgagatctttaagcggatgacgtatgtccatcagcaccacgagacccttcaggcacagacgtttttccaggtattcccccagcgcgcgctgccacttgatcttcatctcttcgggtacttgcgcataaccatagccgggcaggtcgacaaggcgcttgccctcagcgacttcgaacaggttaatcagctgcgtacgccccggggttttggaggtacgcgccaggttcttctgattagtcagcgtattcagcgcgctggattttcccgcgttggagcggccggcgaacgccacttcaataccggtatcggcaggaagatggcggatatctggcgcgctagtgacaaagtgcgtcagttgataattccagttggtcaagacggtcgtctccgttaaaacaggctatggcagggattatacctgaacagcagaaaaaggctgtttttaccgcacgccgttcctgtaagtaaaaaccatatggtttgtgagacattgactattctttgtataggacatacctgaggaaaataagacaaaacatatttaaaatattgaaaattaatcaattatagaaatagagaattctgaaaatagatttttaactgccagactggttgtcgatttttgtcaacaaggtaaagtaatacacaacggcggggatgctgaaaggattaggactcaggacgaggagtcaggaagcgccaggaggcgaagaccacaggatagtcaggatgacgcgcgtcttggagacgttttacagggaaaaggaagaaacagggaccgttggacgctaagggaaagacagggtgagtcgttagcgaacagggaaagaagagcccgttaagggtggtcagtgaggaaaaaggcgacagagtaatctgtcgccttttttctttgcttgctttctgctagattccgcctcaattctatactgaatactactgtctgaagattacacatcatgaaaaaaccgacatccgccacccgtggcaaatccggccgcaagtcgcgtgaagagttaaatcaggaagctcgcgatcgcaaacggcagaagaaacatcgtggccacgcggcaggcagtcgcgcgaacggcggcgatgcggcttcagcgggtaaaaaacagcgtcaggcgcaagatccgcgcgtgggtagcaaaaaaccgatcccgctgggcgtgagcgaaagccgcgctccagcccccaagcagcataaaccaaagagcgagaaacctatgctttcaccgcaggctgagctggagttgctggagaatgatgagcgcctggacgcgctgctggaacgtctggaagagggcggcacccttaatgctgaagagcagagctgggtggacgccaaactggatcgcattgatgagctgatgcagcagctcggcctctcttacgatgatgaagatgaagaagaggaagagcgtcaggaagatatgatgcgtctgctgaagggtggaaactaacatttgcatcccatcggattcccggtactccttataacccttctggttatatgttatctgctgtggttattcgttaaactacgacggttgtcgcggcgtcagaaatggctgcgcaaccggctcatgacccgcggtgcggtggggccgggacggcgtacccgtcggcggcaccatcggaaggagtgagcatgtctgagcagataatcgactgggatctggccctgatccagaaatataactattccgggccgcgctatacctcgtatcccaccgcgctggagttttcaccgcaatttggcgcggcggaattcgatgccgctgtggcccgttacccacagcggcccctgtcgctgtacgtgcatatcccgttttgccataagctgtgttatttctgcggctgcaataagatagtcacccgccagcagcataaggccgatcaatatctcgatgtccttgaacaggagatcatccaccgcgcgccgctgtttgccactcgccaggtgaagcaactgcactgggggggcggcacgccaacttatctcaataaggcgcaaatcagtcgcctgatggatctattgcgcagccatttccatttcagcgcggaagccgagatctccatagaggtcgatccgcgtgagatcgaactggatgtcctcgatcatttacgcgctgagggtttcaaccgcctgagtatgggcgtacaggacttcaataaagaggttcagcgtctggttaaccgtgagcaggacgaagcgttcatctttgatttgctcaaccatgcgcgggagattggttttacctcgaccaatatcgacctcatttatggcctgccgaagcaaacgccggagagcttcgcctttaccctgcaaaaggtcgccgagctcaatcctgaccgcctgagcgtgtttaactatgcgcatctgcccacgctctttgccgctcagcggaagattaaagatgccgatctgccctccgctgagcagaagctggagatcctgcaggaaaccatcggctcgctgacgacggcaggctatcagtttatcggcatggaccatttcgcccgtcccgatgatgaattagcggtcgcgcaacgtcacggcgtactgcatcgtaatttccagggctacaccactcagggcgataccgatctgctggggatgggcgtttcggcgatcagcatgattggcgacagctacgcccagaaccaaaaagagctcaagcagtactaccagcaggtagcagagcaagggaacgccctgtggcgcgggatcgcgttaactcgcgatgactgtctgcgtcgcgacgtgattaaagcgttgatctgtaacttccagctggatatcgcggcggtcgaggcgcagtgggacgtggattttgcgtcttatttcgccgaggatctgaagctgctggcgccgctggcgcatgacgggctggtggctgtggatgataaggtcattcaggtgacggcgaaaggccgcctgctgatccgcaacatctgtatgtgctttgatgcctacctacggcaaaaggcccgaatgcagcagttctcacgggttatttaatgttttccccctctcccgcaggagagggggaacaattagctgaacagcccgaccagcgcagcgcacagcaaggcagcgactgccgtttgtggcgtgtgactcgcagcggcgccgctcgatatcatactcaccagtgattcaaacatgatgctctcccctaatgccggggacgatcatactcaactcatcggaacagtaaagtacaaaatagcagcactttgcgccgatcggctatttttcatcatgctgttgtaccctactccatacccaattcttttagcttacgcgtcagggtattacgtccccatcccagcaggcgcgcagcctcctgcttgtgcccctgagtatggcgcagggcggtcgttagaagcgtgcgctccatttcgggttgcgcttctgagagcaggttttgatgaccggatcgcaacgcccgatcggcccactgacccagcagcgtagcccagctgtcaggctgcatctgcgttgggctatcaggaatcgtggtctcaaacagttcgctcggcagatcctgcgtcagcacctcctggccggcggccatgacggtgagccagcgacaggtgttttccagctgacggacgttgcctggccacgccaggcgggtcagcgctgtctccgtttccggatgcagctgtttggcttcaacgccgagctcgcgggcggctatctgcaggaaatggcgggccaggcgtggaatatcttcccggcgctcgcgcagcggcggtaaatgcacccggatgacgttcaggcggtggaacaaatcttcacgaaatttcccctcctgcacgcgctgttccaggttctggtgggtagcggcgatgatccgcacatcgaccttgaccggcgcgtaaccgcccacgcgataaaactgaccatccgccagcacgcgcagcagacgagtctggacatcaagcggcatatcgccaatttcatccaggaacagcgtaccgccgtcagcctgttcaaagcgaccctgacggacggtattggcgccggtaaaggctcctttttcatggccgaacagctcggactcaatcaggtccttggggatcgccgccatattcagcgcgataaacggcgcttttgagcgtggactatggcgatgcagggcatgtgcgacaagttctttaccggtaccggattcgccattgatcagcacgctgatggatgagcgcgacaggcggccaataatgcgaaagacatcctgcatagctggcgcttcgccgatgatgtcggcggttgggctacttatcggcgcatttcgcggctgctgctgctcttgatagtggcttatcgcccggtcgacgagggcgacggcttcatcgatatcaaaaggtttgggcaaataatcaaacgcgccctgctgataagcgctgaccgcggcgtccagatcggaatgcgcggtcattatgatgaccggaagcattggatggcgctgcttaatctgtttgagcagcgccagaccatccattcccggcatacggatatctgacagcagtacatccggggttttggtggtgagggcatctagcacctcattgccgctttcgaacgttgtgcagctcaagccggctccggtgagcgcgcgttcaagcacccagcggatggagctatcgtcatcaacgatccaggctatccctcgttgcataaacacctctacttccgaataggcaggtataccgaaaattcggtatgacccggccagctggtgaattcaattttgccggagtgctgatcgataaggctacgggcgatagataagcccaggccggtaccgccttcgcggccgctgaccatcggatagaacagcgtatcctggagatggggcggaatacccgggccattatcttcaacgtcgatgcgggcggcgaggcgataacgcaccccgtgcagcgtcagctggaaagcggtgcgggtgcgaagaataatttcgcccccttccggccccagcgcctgcagcgcattacggacgatgttcagcaacacctgttcaatttgatccgggtcgtggggtagctctggtaggctggggtcgtaatcgcggatcaacttcacgttgtccggcaactccatggaaaccagtttaactacccgttcggcgactttgtggatgctttcggtaacgtgcatgcccggatgctgtggtccgagcaggcggtcgaccagatttcttagccggtcggcctgctcaatgatcactttggtatattccgttagcgccggatcgggcagcgctttgctgagcagctgggccgcgccgcgcaggccgcctaacgggttttttatctcatgcgccaggccgcggacgaggtcgcgagcggcgacctgctgcgcatgctgcagctgctcctggctcaggcggcgctgattatccatcggcgccatttccagcagaataaagccttccggcagccgctgggcggtcaacgacaggatgtgcgaacggccatcgataaccaacgtcacttcgttatcggtaaacccctggcccgcctgcagactctcctgcatcagcccgatattcaacgaaaaatagctcaacagttcaggtaatggggtgccaaacagtttgcgcgagctctgcgccagcagctgctgcgccgcagggttggcaaagtgcaccgccaggtcatcatcgaccagtaaaatactgttgataagggagttaaggatctgcccagcatcgggcagtgtgcctgttgccattcgacagtctcctgaaaatgagtgcaccaatttagtgcagtatagctttttatcggtaaaaagctcgcgagatcagcgtgttggtggagaaaaaagcccatcctgagatgggctgaaagtttccacggcaacaaaatatcccgggcatctcgcgccacaacacgacataccctggatttacagcaaaattagacgctgtagtacagttcgaactcaaccggatgcggagtcatgcgtacgcggtcgttctcttccatacgcagggcgatgtaggcatcgatagcgtcattggtgaacacgccgccagcggtcaggaactcgcgatcagcatccagggcctgcagggcttcttccagagaaccggcaacctgcgggatctctttcgcttcttccggcggcaggtcatacaggtttttatccattgcttcgcccggatggattttgttcttgataccatcaaggccagccatcagcagcgccgcaaagcacaggtacgggttggcagccgggtccgggaagcgcacttcgatacgacgcgctttcggagaggtcaccaccggaatacggatagaggcagagcggttacgggcagagtaagccagcataaccggcgcttcgtaacccgggaccagacgcttgtaggagttggtggtcgggttcgccagggcgttgatggctttagcgtgtttgattacgccgccgatgtagaacagcgcctgctcagacagacctgcgtatttgtcgccggagaacaggttggtaccgtttttcgccagagacatatggcagtgcatgccggagccgttgtcgccgaacatcggtttcggcataaaggtcgcggttttaccaaagcggtgagcgacgttgtgaacaacgtatttgtaaatctgaatttcatccgcttttttggtcatggtattgaagcgggttgccacttcgttctgacctgcggttgctacttcatggtgatgggcttcaacaaccagacccatctcttccatgatcatacacatggtggaacggatgtcctgagaagagtctactggcggaaccgggaagtaaccccctttcacgcccggacggtgacctttgttaccgccttcgtatttggtagaggagttccacgcaccttcaatgtcatcgatcgcgacatgggagccggagatagaggcgccaaagcggatgtcgtcgaacaggaagaattctggttctggcccgaacaggacggtatcagcgatgccggtggcgcgcaggtactcttcagcgcgtttcgcgatggagcgcgggtcacggtcatagccctgcagggtgcctggctcgaggatatcgcagcggatgatcagggtcggttcttcgtagaacgggtcaatgaccgcggtggacgcgtccggcatcaggaccatgtcagattcgttgatacctttccagccaccaatcgaggagccatcaaacattttgccttcttcgaagaattcggcatttacctgatgagacggaatcgtgacgtgctgttctttacctttggtatcggtgaagcgcagatcgacaaacttcacttcgtgctcgttcagcatcgtcaaaacgtgttcagcggacatacttaaactctcccggattggtcattgtcgtcgtggtaacgaaaacttcatactgcttaaaagtggcgttgttgccttaaaaaatataaagcgaaatctgtgccaacttttaaatgccccataaaacgctgtatcatgcgcaccatagtgcaaaaggactgcaccatgatggagataatgcaccaaaatagtgcttcagtgtgaacattgagcaccattttggtgcaatttttgttacggtgcccttttatcgctccgtgaaagcggtcacaaagaaactctgcaatacttgtttgcggaggatgtttgtgatcctgttcagtccttcgcttaatacgtgtacaataacgcgctatttctaatgcctgaggcaaagttgtgatcgaaaatctgcgtaatatcgccatcatcgcgcacgttgaccatggtaaaactaccctggttgacaagctgctacagcaatccggtacgttcgacgcacgtactgaagcacaagaacgtgtgatggactccaacgatttggagaaagagcgtgggattaccatcctcgcgaaaaacaccgcaatcaaatggaatgattaccgtatcaacatcgttgataccccagggcacgccgacttcggaggtgaagttgagcgtgttatgtccatggttgactctgtgctgctggtggtagatgcctttgatggcccgatgccgcaaacgcgcttcgtgaccaaaaaagcttttgcccacggtctgaagccgatcgtggtcatcaacaaagttgaccgcccgggcgcgcgtccggactgggttgtcgatcaggtgttcgacctgttcgttaacctcgatgcgaccgacgaacagctggacttcccgatcgtttacgcgtccgcgctgaacggtatcgcgggtctggatcacgaagacatggctgacgacatgaccccgctgtaccaggcgattgtcgatcgcgtgccggcgccggacgttgatcttgacggtccgctgcagatgcagatctcccagctggactacaacaactacgttggtgttatcggcatcggccgcatcaagcgcggtaaagtgaagccgaaccagcaggtcactatcatcgatagcgaaggcaaaacccgtaacggtaaagtcggtaaggtactgactcacttgggtctggagcgaattgagagcgacgtagctgaagctggcgacatcatcgcgatcaccggtctgggcgagctgaacatctccgacaccatctgcgacccgcagaatgtcgaagcgctgccggccctgtccgttgatgagccgaccgtttccatgttcttcaacgtcaacacctctccgttctgcggtaaagaaggtaagttcgttacctctcgccagatcctggaccgtctgaataaagagctggtgcacaacgtggcgctgcgcgttgaagaaaccgaagacgctgatgcgttccgcgtttccggccgtggtgaactgcacctgtccgttctgattgaaaacatgcgtcgtgaaggtttcgagatggcggtttcccgtccgaaagttatcttccgcgaaatcgacggccgtaaacaagagccgttcgagaacgtgacgctggacgtcgaagagcagcatcagggttctgtcatgcaggcgctgggcgagcgtaaaggcgacctgaaaaacatgaatccggacggtaaaggccgcgtacgtctcgactacgtaatcccaagccgcggtctgatcggcttccgttcagagttcatgaccatgacctccggtaccggtctgctgtactccaccttcagccactacgacgacgttcgtccgggcgaagtgggccagcgtaacaacggtgtactgatctccaacggtcagggtaaagcggtagcgttcgcgctgttcggtctgcaggatcgcggtaagctgttcctcggccacggcgctgaagtttacgaaggccagatcatcggtattcacagccgttccaacgacctgacggtaaactgcctgaccggtaagaaactgaccaacatgcgtgcgtctggtactgacgaagccacggttctggttccgccggttaagatgaccctggagcaggctctggagttcatcgatgacgacgaactggtagaagttactccgacctctatccgtatccgtaaacgtcacctgaccgagaacgaccgtaaacgcgcgatgcgcggtgcaaaagaagagtaattttttcttcttgttgttcgctaaaccccgcctctccggcggggtttctttttttcattcctgcatcacacgccaatagtcaaatccagcctttcccgctaaagttaattttccacggcgcggaaggagacaaaaatgctctatatctttgatttaggtaatgtgattgtcgacattgacttcaaccgggtattgggagcctggagcgatttaacccgcatcccgctggcgacgctgaagcagcatttcaccattggtgaggctttccatcagcatgagcgcggcgagctcagcgatgaagactttgccgccgccatgtgccatgaaatgaatatgcccctcagctatgaacagtttgctcacggctggcaggcggtgtttgtcgcgctgcgcccggaggtgattaccatcatgcataaacttcgtgcccaggggcatcgggtggtggtgctctccaataccaatcgtctgcacaccacgttctggcccgatgaatacccggaagtgcgcgcggccgccgatcgcatttatctgtcgcaggagatgggattgcgtaagcctgaagcgcaaatttatctgcgagtactggaagaagaggggttttccgccgcagatacggtcttttttgatgataacgtcgataatatagcaggggccaaccggttggggatcaccagtatcctggtgactggtaaggagaccatccctgactatttcgcgaaacagctatgctaaaaaccgttcatcaaaaattactccaccatacccggccgctgctggcgtggctaaagctgctgtggcggcgcattgatgaagaccatatgaccaccctggcggggaacctcgcctatgtgtcattactgtccctggtgccgctgattgccgtcgtgttcgcgctgtttgcggcctttcctatgttctccgaagtcagcgtgcagatccgtcattttatcttcgccaattttattccggcgaccggggatgtaatccagggatatatcgagcagttcgtggccaactccagccgcatgaccgccgtaggcgcctttggcctgatcgtcacctcgctgctgctgatgtactcgatcgacagcgcgctaaacaccatctggcgcagcacgcgcagccgccccaaagtttattcctttgccgtttactggatgatcctgaccctcggcccgctgctggcgggcgccagcctggcgatcagttcctatctgctgtcgctgcgctgggcaagcgacctggacggcgtaattgataatctgctccgcctatttccgctgatcctctcctgggcagcgttctggctgctctatagtattgtaccgactacccaggtacgtaaccgcgacgcggtgatcggggcgctggtggcggcgctgctgtttgaggcaggtaaaaaggcgtttgccctctatatcaccacctttccgtcctatcagctaatttatggcgtgatttcggtggtgccgattttgttcgtctgggtgtactggacctggtgtatcgtcttgcttggcgctgaaattactgtcactctcggtgaataccgcaaacttaaaacagaagaaacagaacaaccatgattgcattaattcaacgcgtatcccgtgcaagcgttaccgtggcggacgaggtgacgggcgaaattggcccggggcttctggtgctgctgggcgtcgagaaagacgatgatgaacaaaaggcgaatcgcctttgtgaacgcgtgctgggctaccgcatcttcagcgatgcggaagggaaaatgaacctgaatgtccagcaggcgggcggcagcgtgctggtggtttcgcaatttacgctggcggccgataccgagcgggggatgcgaccgagcttctcgaaaggcgctgcccctgaccgcgctgaggcgctgtatgagtatttcgtcgcccgctgtcgccagcaggaaatgcacacccagaccggaagattcgctgcggatatgcaggtttctttggtcaatgatggtcccgtgaccttttggttgcaggtatgacccagcttccgggcaggctgcgggtaacaaaagagagtacgactatgtatcaccttcgtgtaccgcaaacagcagaagagttagagagctactaccagttccgctgggagatgctgcgtaagccgctgcatcagcctaagggatcggaacgtgacgcctgggatgcgatggcgcatcatcagatggtagtggatgaagagggcaacctggttgccgtcggccggctatatatcaatgcggagaatgaagcctccatccgctttatggctgtgcatccctcggtgcaggataaagggctgggtacgctgatggcgatgaccctggagtccgtcgcgcgtcaggaaggggttaagcgggttacctgcagcgcgcgcgaagatgcggtggaatttttcgccaagctcggatttgtcaatcagggtgagatcaccaccccgaccaccacgccgatccgtcattttctgatgatcaaaccggtcgcgtcgctggacgatattttgcaccgcggcgactggtgcgcacagctccagcaggcgtggtatcagcatattccgctgagtgaaaaaatgggcgtacgtattcagcagtacaccgggcagaaatttattaccaccatgccggaggcggggaaccagaatccgcaccatacgctgttcgccggcagcctgttttcgctcgctaccttaaccggatgggggcttatctggctgatgctgcgcgagcggcacctgggaggcaccattattctggcggatgcgcatatccgctacagccagcctattagcggccgccccagcgccatcgccgacctcggttctctgagcggcgatctcgaccgactggcgcgcgggcgtaaagcccgcgtgcaaatgcaggtggagctttttggcgacgataaacagggcgccgttttcgaggggatctacatcgtgctgccggcgaagccctttggctcgtacgaagagggcggcaacgaggaagagtaagcgcctgcggcagttatcgtcctggcgatgccacacgccaggcgatatcccgcatggcatcacgcgcggcgttgctgacgcctcccagctgaaagaagccgtggatcacccccagatagcgctgacaggaactctccaccccttgctccgtcagccttcggtacagcacttcgccctcatcacgtaaaggatcgaactccgccgtcaggatgtggaccggtggcagaccgtgaaaatcttcgcgccacagcggactggcatccggatgggtagcgggtgtggccgctaaatacatttcgtagccgctaagcagcgtgtcccgggtaatgatgtaatcctcgccgttgctggcgtagcttgccatgctggcggtagcgtcgagcatcgggtaaatcaggataagctgtgcaggctgccatgttcccgccgctttcaggcgcagagccgtgaccagggcgagatgcccgccggcgctgtcgccggccagggtgatgcgcgaagcatccacgccaagctgttttgcgtgctggtgaataatcgtggcacctcgttctgcatcatcgtgcgccgccggaaaagggtactccggggccagacgatactgcacggcgatcacccggcacccactgaaccaggcaagctggcgcaattgattgtcatgggtggcaaagccgccgctgacaaaacagccgccgtggtagtagataagcgtgggtagcaggccgtcggcagtgggcggtgaaacgacgcggaagtgcataccctccagggtgatatcctccacccgcactcgcgtttccgtctccccggcgagtaccgcactggcgatatagccggccctccgatcatcaatatgctgatcgcgtgatgaaggacgacctgccgcaataaatgcctcaaccagcgaagcaatccctttttccagcgccatatgaagttccttatactgttttaatatccagtgttatagcctggattatggcgaaaagacaggcctgttgaggtcgcctgtgcattatggaaagcggctcgcaaaaaagagtttacctgacaaaatcctgtttgtttccgattccaaaagctctagattgctcataacttcatcactggtgatatacttgaggtatatatgagcatgatggctgaaagggatatgggcagaattcttctcgatttatcagacgatgtcattcaacgtctcgatgacctcaaagtgcagcgtaacattccgcgagcggaactgttacgtgaagcggttgaacaatatctggagaaacaagatcgagctaaagataccatctccagtgcgctgggtctgtggcaagactgcgaagaagacggcatggaatatcaacgtcagctacgcaaggagtggtaatgacctccggatctgcgctttttgataccaatattcttattgatttatttagcgggcgtcgcgaagccaaacaggcgctggaggcctggccaccgcagaatgcgatcagtctgattacctggatggaggtgatggttggcgctaaaaaatatcaccaggagcagcgcacgcgaatggcgctgagcacctttaatatcattaacatctcacaggatattgcagagcgaagcgttgcgctgcggcaggagtataagcttaagctgccggatgccatcattctggcgacggcgcaactccatcgtctggaactaattacgcggaatacgaaggattttgccggtattcctggcgtagccacgccgtacgaaatccaccctgaataattcgagtggcaggaggacgacaagtgagcgataaactcgtctgaaacgaatatctccagccaaaggttggcctctgataacggtcagtgacgcgtgtgaataatccctgcgcacgttcgtgtcacaagaaggaaaacgggcgacaagagccgcccgaaatcatactgcagaacttactccccttcgccggggaacatgaacgggttaattgagcttctggcgaagccctcctgttccatgcgggcgtcgagcaccagggaggccaaatcgtcggcgacggcttcgactttcggatccttctcctgatacataatcttcaggtaggttccgcagtcgccgcagctttcggctttcaccgccgcctgctcgttgtccagcgaccagtagtgcaggtcgcggctctgctcgcagttgctgcacttgacgcgtactacgtgccactcagtttcgcacaggttgcagtgcagatagcgcagcccctgagtggtgccgatttgcacgatgctggagaccggcatcgagccgcacaccgggcagaactggcgctgttcgccgtattcggcgcgcgcttttcctgggatcagactggccatctgcgcccagtagagcgacagcgcagcccagatgaacggcgctttgtcgctactgacggaggcgaaatcggaaacaaacagcgcgctggccatctgctccagctcctgctcagaggctttttccagattctcaatgaccgccagcgccgggccgctcatttccggcttcagctcggcaatcagcgagtgcaacagcttgtgccagtgcttgtcgcgcggcaggacgtggatatccagcggcggcttgccctgttcgctggccgctttaatgcgggcggtgagatccatctgcagcggatggtcgtacagcactacttcctgggcatgggcaatcagcgcggcaaagcgcaggtaatcgcctagcgggttattagcggccagctcgcgcaagcgttcagcgcggcggttatacagatttttcagcctggggaacagtaacggcggaattgcttccgccgtgcgtttctcgctcgaacccagctcgtcttgcgggattatgcgaatactcattcagatgacttttcctgtttctggcggacctctcggtaccagcgcgggtgatgtttcttcgcccacgttttggtaacccagccttccaccatcgcggtaatggtgcctttcacccagagggcggcgtagatatgcaccatgataaccacaattaacgccactgcggcaaatgaatgcagcatcagcgcaaatcggatcaccgggattgagaaagccggcgcaaaatacggacgccagatgatcacaccgctcaccagcagcagtaccaggaagataatcgccgcccagaatacgcatttctggccgaagttatagcgcccggtatcgcccacctcctcgttgacgacgatcttacgaatattcttcgcccaaaagatatcatcccgattgattaggttgtgatgccagtaacggaaaaacatgatgataaacgacgcgaacatcaccaccccgacgaacgggtggagaattcgcgccagctgcggcgtgccgaggatatgcatcagccagttaaaggacgggaagaaaaagcctaacccgctcaccgccgccaggacgaagcagaaggcggtgacccagtggttgatgcgttccggcgccgtgtagcgcacgatggtgtcacgtcttttcatttgcgcacctcgtctttctcttcatgcagattgtcctcttcctcttccgcgcggttcggaccgacgccgacgtagtggaagatactggctgcgaaggtcgcggcgaagccgacggccgccagcggtttccagatgcctttccagaacttgacggtctggctgatctccgggttttccggcaggccgtggtacagattcggcttgtcggcatggtgcagcacgtacatgacgtgggtgccaccgacgccggccggatcgtacaggcccgcattgtcataaccgcgggttttcagctcagccacgcgttcgccggccagcgttttcatatcctctttggagccaaagtggattgcgccggtcggacaggttttcacgcaggcaggctcctggccgacggtcacgcggtctacgcacagggtacatttgtagacgcggttgtcttccgggttcagacgcggtacatcgaacggacagccggcgatacagtagccgcagccgatgcactgctcggactggaagtcgacaatgccgttggcgtactgaatgatcgcgccttctgacgggcaggccttcaggcagcccgggtccgcgcagtgcatgcagccatccttgcggatgagccattccagcttgtcgttttgttccacctccgagaagcgcatgaccgtccatgacttggcggtcaggtccgccgggttgtcatacaccccgacattgtgaccgacttcatcacgaatatcgttccattcggagcaggccacctgacaggctttacagccgatacaggtggtgacgtcgataagcttcgccacctcctgctggtggtcccgcgcctgaggcgcgggggtgaaaccgttagtcgcggaacgacgaataatatcttgcgattggtaagccataagtcgtctccgttacaccttttccacgttcacaaggaaagctttgaactccggcgtctgcgtattcgcatcaccgacgaacggcgtcagggtattggcaataaagccttttttcgccacgccctcatagccccagtgaataggaatgccgatggtatcgatatccttaccgtcaactttcagcgtgcgaatacgtttggtcaccaccgccttggctttgatatagccgcggttggaggaaactttcacggtatcgccgtggccgatgccgagcttattcgccagtttttccccgatctccacgaactgttccggctgggcgatggcgttaagtagcgcatgcttggtccagtagtggaagtgctcggtcagacggtaagtggtgccgacgtacgggaacttctcggccttacccatctgctcgagatcgcctttgaagacgcgagcggccgggttagagaccacgttcgggtgcagcgggttggttccgagcggcgtttcaaacggctcgtagtgttccgggaacggtccttccgccatcttgtcgatagcgaacagacggcccatcccttccggctgcatgataaacggaccgacgtcgctgccaggcgcggcggcgctgtagtccggaatatccacgccgccccatttggcgccgtcccatttcagcaactgacgcttcggatcccacggtttaccctgcgggtccgcggaggcgcggttatacaggatgcggcggttgagcggccaggcccaggcccagcccagggtattgccgagaccggatggatcggcgttatcgcggcgcgccatctggttaccttccggcgtccagctcccggcgaagatccagcagccgctggaggtggtgccatcatctcgcagctgcgcaaaggagctcagctgttggcctttcttgacgatcaccgcgccggttgccgggtcggtgatatccgccagcgctttaccgttgctttccatcgccacttcttccgatgccggctcgtgtggcgtggagtagttccacgtcatgttgagcaccggctccggcgccgggccaccctcttcggcatacatcttacgcaggcgagtgaagataccggcgagaatttcaccatcggtgacggcgatcccgggggcgtccgcgcctttccagtgccactgcagccagcggccggagttgacgatagacccattctcttcggcgaagcaggtggagggcagacggaacacttcggtctggattttcgccggatcgacatcgttcgactcaccatggttttgccagaaggtggacgtttcggtattgagcgggtcgatagtcacgaggaacttcagcttcgacagggaagcgacgaccttgtttttgttcgggaacgaggcgaccgggttaaagccctggcaaatatagccattcactttgccctgattcatcatctcgaagtactgcagaacgtcgtagctcttatcccacttcggcagccagtcatagccccagctgttttccgcggtggctttgtcgccgaagaaggctttcatcatggagacgaagaacttcggatagttgccccagtagttgacctggtctttcagcagcggcttcggcgtgttagccgtcaggtaggtctgcaggtcggcctgtttttcgttcggcagcgacatgtagcctggcaggctggtggagagcaggccgaggtcggtcaggccctggatattggagtggccgcgcagggcgttgacgccgccgcccgccatccccatgttgccgagcagcagctggatcatcgccatggtgcggatattctgcgcaccgatggagtgctgggtccagccgagagcgtacaggaacgatgcggtcttatccggcgcgctggtttcagcaatgtattcacagactttgaggaagtcggccttcggcgtaccgcagatgttttcgaccacatccggggtataacgggaaacatgctgcttcagcaggttccagacgcagcgcggatgttgcagcgtagtatcgcgtttggcgaagccgttttcgtccagctcatagttccagctggttttgtcgtactgacgtttttctgcgttatagccgctgaacagcccgtcgtcgaagctatagtcctcacgcacgatcaggctggcgttggtgtaggcttcggtgtattcgcggttgaatttttcgttattcagcagatacaggatcacgcccgacaggaaggtaatgtcggtaccggaacgaatcggggtatagaaatcagccaccgacgccgtacgcgtaaagcgcggatcgataacgatgagcttggcgccgttatgaattttggcttccatcgcccagcggaaccccaccggatgcgcttctgcggcgttaccgcccatcactacgaccaggttggcgtttttaatatccacccagtggttggtcatagcaccgcgaccaaatgttggagcaagacttgctaccgttggtccgtgtcagacacgcgcctggttatccaccgccagcatcccgagggcgcgggtgaatttttgcgttaaatagccggtttcgttactggaggcggaggcgcacagcatcccggtagtcaaccagcggttgacggtggtgccggcgtcgttttgcgcgataaagttggcgtcgcggtcctctttcatcagcttggcgatgcgatcgaacgcttcgtcccaactgatttgctgccatttatcggagcctggcgcgcgatattccgggaatttcaggcggctttcagaatggataaagtccaccagaccagcccctttcggacagagcgcaccacggttgaccggatgatccggatcgccttcgatatggaaaatggatgctttggcgtttttcgcgccgtcgccgaggctatacatcaacagcccacagccgacagaacagtatgtgcaggtgttacgggtttcgcgcgtgcgcagcaatttgtactgccgtgtctccgcgagcgcagttgccggggcaaagcccagcgctgctgccgtggttcccgccataccgccagcgcagatcttaaagaactgccttctgctgacctgcatggttcgctccttgtttcgacattgtcacatgtagttatttgctttgcggtgaaggccgcaaaggttcagaattagggcaaatttccctcattcctgaagggataaaaacagaataccacattgtgtgtatgcctgttccaatacggttaaagcaaagtgaacaagaagcctctcgaacaaatcaaaaatgtgacgaatgtcacaggatatcgccaggtctccctctggaaacgcgaggatctgcaacaccctcagccagatgagttagcggaagaggtgcccgtcgcgctggtctacaacggtatctctcacgtggtgatgatggcctccccgaaagatctggagcaattcgccgtcggcttctccttatccgaagggattatcgagcaccggcgggagattttcggcatggacgtggtagcggtgtgcaacggccttgaggtgcagattgagctctccagccggcgttttatgggcctcaaagcccggcgtcgcgcgctggccgggcgcaccggctgcggcgtatgcggcgtcgagcagctcaatgatattggtaagccggtccagccgctgccgttcactcagtcgttcgatttagccaatctcgatcaggccctggcgcatcttaacgactttcaaccggttggccggctcaccggctgtactcacgcggccgcgtgggtccggttgacgggcgaactggcgggggggtttgaagacgttggccggcatgtcgccctggataaattgctgggccggcgggcggaagtcggcgaggggtggcagcatggcgccgcgctggtctccagccgcgccagttatgaaatggtgcagaaggcggcgatgtgcggcgtcgagatcctgttcgcggtctcggcggccaccaccttagcagtggaagttgccgagcgctgcaatctgacgctggtgggcttttgcaagccgggcagggcgacagtttacacccatccgcagcgtttaattgcgggttaaatattggtcaataaatttgaacaatgacagcaaatccttccgctttttgtttagcgatgtgcgggctactatttaacacatcaaggcacagcgccttatctaaacaactaaatgaaagggtttatatcatgaaaagcatcaaaacttttgtcgcagtaatcgctatggccgcctctttcgcttccttcgctgctgaaaccgtgaccgcaaccgcctccacaatggacggcgcggaagcgaaaatcgccgcacaggcgcaggctgccggcgcttcgtcttacaaaatcaccgaagcgtttaccggcaaccgcgtgcatatgactgccgaactgaacaaataagcgtatagcaactgtcgaaagagcgcctcagggcgctttttttgtttttgtttttcgcttcccgtctctgcgaaatttgccaatattttcctctgctacgaaaaaaatgtggcactaatcacgtttccgttcttttcttaaatcctcctttttatggcaaaggaaaggtcagcacgcctgaatatctcgattttttaacgccatgaaatttaaagaaataaaaaacagaaagcgatggagatcactctctttaaatgggatgcgtatcacaaaaataggtgtttcgccgtacctgtcaactattcactgcggtaatttaatacgcattatgtgatcttcattgcaaatagaaggcttgtactcagggaaaaatgttgtcaggcaaatgagcgaggatgcgtcatgaaaattggtatcgttattagcggcggggatgtttctggaatgaataattttatattccagatagccaggcaggctaatgctgatatcacgctgtttaatggcggtattccagggctactggagaaaagtcatcaggatatggcgtggcgcgatctggttgattattcaattaccgcggtgccgatcattacctcggggcgaaccagtcgcaaactgcagcgcagtgaatatgaaagcattgctaaaaaacttaaatctctgcgtattgatgtgctcattatggccgggggggatggcagcctgcagtttctgaatacccttagtgaatttgagattaattgctttggtgtgggaatgactatcgataatgatgtgtatggcagtgattatacgattggtttttccacggcctgtgagcaaattattaaagaagtctctcgtttaagaaataccggaagagcgctgcccggtcgggtttttatggttgagatattaggaggctattgtggagaactaacgttgcagtccgccattaaatgtaatgcggatattgccctgatcccggaggcacagatgccgttggccgtgctcgcggaacggattacccggaagctgagtacgcagaatagcgtcgttatcctctgctcagaaggctataccaaagagtactctcccggctttcagggggcgattgataccatgattaaacagctggaaccacaaataggtgtccgtatccgtaaaacgatcgtcggctatggtttacgcagcggtgatccaacctgcgaagagatttatcagggcactattatggccagtgaagtggttcgctgtattcagtcaggtatgaaaaataaagccataataattaattccagtaacaaacctattccgattgatttagtcagtatgaaaaaacgtctggtcgatactgaaggacatcattataaacttgccaagcaactcaatattatttgaggagaccctccatgctgaaaattttatgcgtatgtggctgcggcctcggttcaagctttgccattgaaatgacggcgaaggcagttttaaagaagctggaaattcccgctcatattgaacacaccaccgtttccgaagctggggcctttaaatcggatatgattctgacgcaaaaaacctttgccgacatcttaaccgccgatgccagtgaagaagaaattaaacgtgtcgtggtattgaataaacttactgataaagaggagattgaaactaagatcgtcgcattcttaaaagaacgtcatctgaaggtggctgattatgaatagcttcgtggcgtttatcgttaaggatttactcggccaggcatccattcttattgcttttattgccatgcttggcctgatcctgcaaaagaaatcgccaggcaaaaccgcggaagggacatttaaaacgctgctcggtttcttaattatgatggccgggataaacatcattgtcgccacgctgaccttcctgaatgatatcttcacccagggatttggcatgaaaggctatattaccgatgtggccgccatcgccgggttagcgaatcgggaattaggttcggaggtggcgctgacgctgctggtgatctttgccgtcaatattattatcgcccggctgacgccgctgaaatatatttttctgaccggccaggcgctgctgtggatggcgacgatcggcgccgtgattggctataagtccgggctcaccggcgtaccgctgattttaaccgggggcatcttcggcggcgtgatggcggtgttaatgccggccctggcgcagccggtggtcaggcgcattaccgggtctgacgatgtggccctggggcacttctgtactatcggctatctggtgcaggctgcggtcgctaaagttgtcggaaaaggctctcgctccacggaagatctcgaactgcctgataactttaagtttctgcaggatacctatctggccatggcggtggtgatggtgccgatgtatctcatcccggctatcgcggcggggcctcagtacatcgcgcagttctccggcggcattaattacctgatgtatgccttcatgcagtccattcagtttgtcgccggggtctttgtcctctatagcggcgtgcgtttattactcaatgagctggtgccggcttttcgcggtatcgcgatgcgtattgtcccggatgcaaagcccgctctcgattgcccggtgctatttccctatgcgccgaatgcggtgattgttggatttctggcaacgactatcggctcgattatcggcatgctggttttcccgatgttcggcctggcgatgattctccccgggctgttaaccaactttttcgccggcggtacggcaggggtatttggcaatgcgctgggcggacgtcgcggggcgatgatcggcggggtgattcacggcctgtttatcacatttctgccggccattctggtacccatgctggagagctacggctttacgggcgtcaccttcagcgattcagacgtcatcagctccggtctggtattaggccacgccttccagaataactggctctttgtcgccttgtttattgtgtttgtcgccgcactggcatggtttgtaaacggtaaatccgctaagccgaaaggggaaagtgttcatgagtctgtataattttaatgagattttaaaaatcgctcaggaaagagattttaaagcgattggctcgtttaacttgcactgtattgagatgttaccggcttttttcaaagccgcgcaaaacagccgcagcccattaatgatccaaatatcaaccggtaccgcagagtatctggggtatcggttactggtcgatgccgtgcgttcattagcagacagtgaaaatatcccgacctgcctgcatctcgatcactgctccgatattaaagccatcgagacggcaatgaatgcgggcttttcttcggtgatgtacgacgggtctcacttaagcctcgaggaaaatatcggtaacacgcggattgtggtggaaatggcccggccgtggaatattacggtagaaggtgagctgggggcgatcggcgggtcagaggatggaaaagcggtggctgccgaagatatctgtttcactaccgtcgaagacgcgacgcgttttgtgaaggagacacaggtcgatatgctggccgtctcggtgggcactgtgcatggcctgtacaccggtaaagcgcagatacagcatgcgcggctgaaggcgataagcgaagcgacgggcgtgccgctggtcctgcatggcggcacaggtgtcagcgatgaggatatgcggctggccgtcaccgaagggattaataaagtgaacgtcggaacggaaatgaacgtgcagtgggtcgatcgctgtaaatcaacgtttgagaaaggaaaagtaaatgacagcgtacggaaatttttaattcccgccaaccaggcagtgactgccgtattaatggaaaaaatggcgctatttaaatagcgtttttaccgacacatatcttttgttgccctgtcttccgccagggagggagcttgctatgtttgaatcattgaaaacgctgtggaaaaaagagcaaaacccgctgcaggattatgatcaacagtcccgtcagctggcggaagagatcgccagactggaaggcgaattacagcgccagcccgataatagcgacgtgcaaaaaacattgatgttgacttacaaccgggcattatcggtatatgccaaaagtaagagccaccggcaggatatcgatgcgctgtttctgcagattgataatttacgcaatattattcgccgcaatatctaggaacagagaatgaccataaaagaactgcttattgaggccgatgccattcaggttggcgttgtggagtccgactggcagcgggtaataaagctggctgcccgcccgctggaggcaaaaggctttatttcgacggaatatagccaggcggtgatcgacaatactttaaatcatggcgcttattacgtttttgatgaagggattgccatcccccatgcccgccccgaatgcggcgtcagacgcaactgctttagcctggtggtgctggaaaagcctattccctttgcggacagtgaaaaagcggacattgttattatgtttggcgcccgggacagcaatgcgcatatcgaggagggcatccgttccatcgtcgcgctgctggataataatgacaccatggccaaactgcggacggcccgcagccgggaggaggttgtcgcattactatgaacagacatctgaccccaggctgcaaaacggccattttaatcaacggcattccggcgtcggggaagagcaccattacccgtttgctggcggagacctttagcctgccggtattgacgatcgacggcatcaaagagccgtttatggcgcgcctggcccctgtcgaccggccgatgaatcgccagctgggctgcgcggcgtatgaggtgatctggtcgattgtcggcgcatcgcctgccagcatggtctggttgatcgacgcctggttcggctttcagccgcgggagaccttgcagagactgctacagcaggcgggcgtggagcaggtgattgaggtctggaaccatatctctccggagctggccgtcgcgcgctatgcctcgcggctggcgacgcggccgccgggccaccccggagaagagtatttgccggagctggcccagctggccgggcgggcgcagcccatgtcgttaggacctgtactgacgatagaccagcggcacccgctgcaaatcgaaccggttattcagtggcttgtaggcacgatcgccggacagcacagcggttttacagattacgcttactcgtcctagggcatacccgccaggcgcagcagcgcggtcaccacggcggcggcgataatcacgccgatcagcgggaccttgcgccaggcgaggaacacagcgaaagcaacgcccagaacgcgcgccataccggcgaaatgtgcgccctcatagaaagtggtggccagggcgacggaaaaaagcagcaccgtcgccgcatcggaaagcagcgcctgcgagcgctcggaaaatgccagccgattgccgagcttcgcgccgccgaggcgcatcagataggttcccagcgacaggatggcgataccggcgataaacagcgtcatattgcccattattttttcctcgacagtaaaccgaacagcgaaagcagcactggcagcccggtgggcacaaacggtacggcggcaagcgccagcgcggcgccgctggcggcgcggatcagcgtagtgcggtttttaaaggccgggatcaccagcgccagcaggatcgccgggaagaccgcatcaagcccgatggtttccggcgctggcagcagtttgccgacggccgcgccggttagcgtaccgaggggccagatcagcgcgacgccagcgccgcacagccagtaggccgctttgcgctgcgcgggggtgggctgcgacaagccaaagaccacgctctcgtcgttcataatgtggcacccgataaagcttaaggcgcgccgaccaaccagttcgcgtacggtcaccccgaacgggatatgacgcgcattgactaacaggccggcggcggcggcggccagcggactaccgccgctggcgacaatgccgataaacatgaattcagaagcgcctgccagcacggacaccgaaagcaagagcggcacccataaagggaagccgtaagccaccgccagcgacccataggacatgcccaccaccccgacggcaaggcagaccaaaacaatcgcttttatcgtgtctccgctgagactggagagagtttgtttcatatcacttagccatatcgaacgaatttccattataatgaacacataatgatcgtttttcaaggcgaacgaattgttcgatataaaaaacaaggggcgggtatgacacagccaatcagcgttatcgccaaaagtctggtgcgggagcgggcgcggaccgggctttcgctggcggaagtcgcgcgtcgggcgggtatcgcaaaatccacgctatcgcaactggagtccggcaacggcaacccgagtctggaaacgctgtggtcgctctgcgtagcgctggatattccatttgccaggctgcttgagccgcaggtgaacaaaacgcaggtgatccgccgcggcgaggggaccaaagtggtggcagagcaggcgaactatcaggccattttgctggccgcctgtccgcccggcgcgcgtcgggacatctatttgctgctcacccagcccggcgccgaccgcatttcgcatccgcatccgccaggctcggtggaacatattatcgtcacccaggggcgggcgcgggtagggctgacgtcggcgccggaagagctcggcgagggcgactatatctgctacccggcggatcaggagcatgtttttcaggcgctggagccggatacgcaggccctgctgatcgctgagcaaaactgacatcgcgtcggcgggggacgcgcgctcgctggacgtcatagccatattgcgggaaactagctttcctatgcgaaaacagggatttttatgtcgctgaaagccattgccaaacaacttgggatctccgtcacgaccgtcagccgggcgttgaacggctacgacgatgtgtcgcaggagacccgcgcccgggttgaggctgaagcgcagcgccggggctatcgccccaacactttcgcccgccgtctgaaaatgggcaccatcgatgccgttggtctcgtctttcctgtccgccccgcgccgctcaacaataacgtttttctcgagatggtcggggagatcagccatgagctggcgcgccatgacattgatttgttgctgatcgccgatgatgagcaggcggataaacatggctatatgcgcatggtgcagggccgtcgcgtcgatgcattaatcgtggcccatactctggatgacgatccgcggctggcgcagctgcaggcctccggctttccgtttctggcgctcggccgtagccgcctggcgcagccctacgcctggtttgatttcgataactatgccggcacctgccgcgccacccgccatctgattcaacagggccaccagcgtatcgctctgctgggcgagaacaacaatcaggcgtttattttgcaaaggcgtaacggctacctcgatgccctgcgcgaggcggggttatccgatgcatggctgcgtagcgtgccggcgacgcgccgcggcggctatcaggccacgctggagctgctgcgtctgcctgagccgcctaccgcgattatcaccgactgcaacacccatggcgatggcgccgcgatggcgctcgcccacctggggcgtttaaccggcgacaaccgcgtcgccctggtggtgtacgacgggctgccgcaggacagcatcattgagaccgatgtcgccgcggtgatccagtccacgcgccagggcgtgggaaggcagattgccgatatggtgcgtcgcttaatcgccggggaggatctcgccacgctgcaggtgctatgctatggcagccggaatttttcccgggtgaaaccgcctgatcttacccctttttaacccgtaattctgaagccgatcacggatccgaaacgttttggttggcatccgaaacgtttcggatcaacagtaagacattccttgtaatggagatgtctgatgtctgattcgctgattcacctgcaaagcgccggtgccgatgttgtgattaaaacccgccctttcgccgaaattgtctactggggaccgcatttaagccacttttcgccgcaggatgccgacagcctgacgcgcccggtcgccaacggcagactggatgtcgattcgccagtgaccttaatggcggagctgggccatggtctgtttggcgcgccgggcattgaaggccatcgtcaggggctggatgcctctccgctgttcaccaccagcgaagtgcggcacgagggccagacgctgaccctggtcagcgaagatccgcaggccggcctgcgcctgcagagcgagatcgcgttggatgccagcggcgtgctgagcgtgcgccatggcgtgaccaatctgcgcgccagcccatggcaggtggatcgcctggcggtcacgctgccggtcgccgaacgcgctcgcgaggtgatggctttccatggccgctggatccgcgagtttcagcctcatcgcctgacgctggagcacgacagctttgtgctggagaaccgccgcgggcgcacctctcacgaacatttcccggccctgatcaccggcagccgcgcctttagcgagatgcagggtgaagtctggggcgtgcatctggcctggagcggtaaccatcgcctgcgggcggaggtgaaaaccgatggccgtcgctatctgcaggccgaggcgctctatctgccgggtgaaatggcgctggcggaaggggaaaccttgtggacgccgtacctgtatgccagctactcggcgaatgggctgaacggcatgagccagcagttccatcgttatctgcgcgaacggattattcgtttcccgggcaacaaaccgcgcccggtgcatctcaacacctgggaggggatctatttcgaccacgacccggactacatcatgcgtatggccgacgaagcggcggccctgggcgtcgagcgctttattatcgatgacggctggtttaaagggcgcaacgacgactgggcggcgcttggcgactggtatctcgatgagaaaaaatacccctacggcctgacgccggttatcgatcacgtgaagtctctgggtatggaattcggtatctgggtggagccggaaatgattaacccggattccgatctgtaccgggcgcacccggactgggtgctggcgctgccgggctataccccgctgaccggccgccatcagtttgtcctgaacctcaacattcccgaagcgtttgattatctgctggagcggatgagctggctgctgggcgagcatgcggtggactacgtgaagtgggatatgaaccgcgagttggtgcagcctgggcatcagggacgcgccgctgcagacgcgcaaacgcgccagttttaccgcctgctggatacgctggtggcccgtttcccgcacattgaatttgaatcctgctcctccggcggcggacggatcgattatgaagtcctcaaacgcagccatcgcttctgggcgtctgacaacaatgacgcccttgagcgcaacaccatccagcgcggcatgagctacttctttccacccgaggtaatgggcgcgcatattggcaatcgccactgtcatgccaccttccgccagcatagtatcgccttccgcggcctgacggcgctgttcggtcatatgggccttgagctggatccggtgagcgccgatgaagaagagcgcgccggataccgaaaatatgcggccctgcataaacagtggcgcgacgtgatccatcacggcgtgcagtggcgaatagatatgccggacgccaccacccttgcccatggcgtcgtcagcccggataaagcgcaggcgatcttcctcgttagccagctggcgatgccggactacaccctgatggcgcccctgcgcctggcgggcctggaggcgagcgcccgctatcaggtgacgctcctcgatcatccgaacattcagatcaccggtgagggcggccacaccatgcggaagctgccggcatggatgacgacgccgcagacggtgagcggtgagtggctgcagcaggcggggctggcgctacccatcctcgacccggaaagcgccattctgattggtctgcaacgcgtgtgatggtatcgggctgcgctgcggcccttcttgaggaaaatataatgaacccgaccgtctgtacccacaaaaacaaccccaacttctggattttcgggctgttcttctttctctacttcttcatcatggccacctgctttccgtttctgccgatctggctgtcggacgtcatcggcctgaataaaaccgaaaccggcctcgttttctccagcctgtcgctgttcgccatctgtttccagccgatcctcggagtgatctctgacaagctggggctgaaaaaacacctgatgtggatcgtgaccgttctgctggtgctgattgctcccttcttcctttatgttttcgctccgctgctgaaaaccaatatctggctcggggcgctgagcggcggcgcctatatcggctttgcattctccgcaggcgccggcgcgatggaggcctatatcgaacgggtaagccgcaacagcgggtttgaatacggcaaggcgcgcacctttggctgcctgggatgggcgctgtgcgcgactaccgccggaatgctgttcagcattaatccagaatgggtgttctggatggggtcagccgccgcgctgctgctggtggtgctggtggccatcgccaaaccgcaggccagtcagtccgcgcaggtgatggattcgctcggcgccaatcgcccggcgatcgatttaaaaacggcggtgcgcatgttccgccagcgtaagatgtggatgtttattctgtatgttatcggcgtggcctgcgtgtatgacgttttcgatcagcagttcgccaccttcttcaaatcgttcttcgcgaccccggaagcgggcacccgcgcctttggtttcgccaccaccgcgggagaaatatgtaacgccatcattatgttcagctcgccgtggattattaaccgtatcggagcgaagaataccctgctgatcgccgggatggtgatggcggcaagaatgattggctcttccttcgccaccaccgccgcggaagtcgtagcgttgaaaatgctccatgcgctggaggtgccgttcctgctggtgggcgcctttaaatacatcaccggcgtgtttgacgtccggctgtcggcgaccatttacctggtgggcttccagttcgccaagcaggtggcagcgatcttcctctccgccttcgccggcaatatgtacgatcggatcggtttccaggagacctatatgatcctcggtggtattgctctgacggttaccttaatatccgcgtttacgttagcgggtaagacgaaaaccgagccgctgcgcgataatgcaatgaccgtttaatcgaccggcctcccgtctggagggaggccagttatttttacgccagataaaacacttctttgagctccgcgctcagcgggctgttgtccgggttgctgggcatcacctcgcgcatgtatttccaccaacgctggcatacttccgtgctggcgaccgcttcccagcgggcttccgattcaatctccaccgtcgcgaacaggagatggcgttctttatcgagataaatggcgtagtggtgcgcgccgtgatccttcaacactgcctccagctccggccagatggggttatggcggcgctggtactcctcgtgcgcgtcggggttcacctgcatgacgaaggctttacggatcataaggcctccagatagagctcgcgaacctcatcgcggctggcggggcgcgggttacacggcgcgcatgggtcggccagcgctttatccagccagccttcgatatcggctttgctgacgccaagctggctgaaaccctgggggatccctacgcgtttgctcagcgtgcggatggcattgatggcctccatgctggcagcttcatcactcatgccgcgagtatcgacgcccatcgcctgcgccacgcgggcaaagcgcgccaccgcgttcgggcggttaaagttttcgatgatcggcagcaggatggcgttgcataccccgtgcggcaggttgtgggtcgcgccaggctgatgggccagggcatgtaccagcccgagaccggcgctgttgaacgccatgcccgccagatactggccaaacgccatctgctcgcgggcctgcagatcgtgcccatcgtctaccgctttcggcagccacaggttaatcaggcggatggcttcgagggcgttggcgtcggtcagcggatgggcgccaacggagacaaaggcctcgatggcgtgggtcagggcatccatgccggtggcggcggtaacggctggcggaatgtcgagcatcacgctggcgtcgtcaacggcgatatccgggatcaggttcgggtcgataatcacctctttcacctgccgctcgctatcgataattaccgcgttgctggtcatctccgccgccgtgccggcggtggtgttgatggccaccagcggcacgccagcgtttttcactttgccgacgccggagtaggcggtggaggggcctgggttggcggtgaggatttttatcgctttggcggtatcaatcgggctaccgccgccgaaggcgatcaggtaatcgcagcgggccgcctggtaagccgcatagccttgctgcaccagcgcttcggtggggttggggaatacctcgtcaaatagctgataagccatctgctgttcatccagcgcggcgaacaggctgtccagcaggcccagcttcaccagctgaccgtcggtgacgatcagcgccttgccccattgtttgcccgctaccagcttgaccatatcaccgatcgcgcctgcgccgtggaggctgattttaggtagtgccaacataaaactcatgataattctccttaatgttgattttgggaaatccgtttcccctcaccccgaccttctcccgcagggagggggccagggtgagggggaaattaacatcgtcttcgctgcatcatccgccgggtaataatcggcagggagatcaccacgatcagcatggcgccgataatcaccgacatcacgatgccggggacgttcagcaggctcaggccgaaggtcaccagccccatcagaaaggcggcgatgatcaccccgggcatgctgccggagccgccgagaatattgacgccgccgagcaccgccatggtgacaaccgccagctcccagcccatcgccagggtggggcgggtactgccgagccgtgaggtcagcaggaccgccgccagcccggccatcagcccaaccagcgcgaacagcaccaggttatgacgcttaacgttgatcccagagaaccaggcgccggtcgggttattgccgatggcgtaggtccggcgaccaaagttggttttatgcagcaggaaggtgaaggcggccgcgaggaggataaacagcgcaaactcaaaagagagcgccccccacacgtacccttggccgaaccaggcaaagctctccggatagtgattgagtgcctgatcgcccagcaggatataggtgatgccgcgatacaggctcatggtgccgatggtgatcacaatggacgacaggttaaagcgggtcaccagcaagccgttgaacaggccgcacagcagacctacgcccaggccgatgaccaccagcagcggagtgtccatccccgctgccgcgcagaagcccatcaccgttgagctgagcgccatcgtcgaggctaccgacagatcgatttcccgggcgataatcagcatcgccatcggcaggacgacgatcgccttctcggtaaaggtaaaggtggcgtccgacaggttccagatattgaggaagtacggggaagccacggcgttgccgataaataccgccagggtgaccgccagtaaaaacccttcccagcacagcaggcggcgcagcggcgacggcgcggccggggcgtttttcatctcttcagataccatcattttgctcatgatttcaccgcctgtttctgtcgggctaacgccgcgttgcgcaggattaaccgcccgtgaccgcgattgccgcgctcgttgagcagcaccgccatgacgatcaccgccccggaaatcgccatctgccagaagggcgagatgccgatcaccggcagggcgttattaatgaccccgaggaacagcgcgccgcacaggcagcccagcacccgtccgcttccgcccatggtgctgataccgccgatcacgcaggcggcgaccacctggagttcaaaaccgttggcgacgtcgacataggcgacggcgaagcgcgagatccacagatagccgcagaagccggccagcgcgccggagagacagaagctgacgaactgcatttttccggcgttaatgccggtgtagtatgccgccgtcgcgttgccgcccgcggtgtataaggcccggccggtgcggctgtagtgcaggaaataacccaccagcagcagcgcggcgatggcgcaccagctcagtagcggcagcccaaggagggggctgcgcggcagactgagaaaatcagcactcatctgatgtgagttaacccagccgccgtcagtcagcaggaagataatgccgcgataaatgctcatggtgcccagggtcaccacaatggcgggaatgccgaggcgccagaccagcaggccgttaattactcccatcagcaggcccagcagagtcgccagcgccagcagcgctaccaccggaatacccggatagtgggcgttaagcagggcgacgatcatcccggtcagcgccaggttggcggccatcgacagatcaatgcctttggtgagcaacaccatcatctggccgagggcgaggatgataaggatggcggtatcgttaaacatctccaccagattgcccggtgaaacgaacgacggcgcccggctgccgatggcgccgatcatcaaaataatgaccaccgccagcagcgcttcgcgatgtttcagccatgcgtgtcccatcatgccgcctcctggccgatgccgctagcggcgctaacgatggtttccgccgtcgcttccccggcccggtactcggcgaccatcagcccttcgtgcattacgataatccggtcggccatgcccatcacttccggcagctctgacgacaccataatcaccgccagcccctggctgaccagctcggacataaactgatgcacggcggcctttgagccgatatcgatgcctttggtcggctcatcgagaatgatcacctcgggctgggtcgccagccatttgccaatcaccactttctgctggttgccgccggagagggtctccaccggctgccgccagctgaaggctttaacctgcaggcgcgaggcgtactcgtcggccagccgccattcccggccgtcgttcaggatgccgttaggattgagcttgctgagctgcggtaaactgatgttctgggcgataggcagggcgatgatcgctccctgtttctgccgctcttccggcacgcagacgatgcccgcgcggatggcgtcggcgggctggtgaaagcgcatggttctgccgttcaggcggatctcgccggaggaggggcgcgaaacaccggagagcgcctgcatcagctcggtgcgtccggcgcccaccaggccgtaaaagccgagaatttctcccttgcgcaggcggaagctgatatgggcaaactcggtaggatgacagagatcggtcacctccagcaccgtttctccgggggtgcagtcgactttcgggtaggtttggctgatcgcccggcccaccatcatcgacaccatccgctcttcggtgatgtcgcttatcgccccggagctgacgtacaccccatcgcgcaggatggtgtaataatcggccagctcgaagatttcatcgaacttatgcgagataaacaggatcgctttgccgtcctgcttcagacgctcaacgatgtgataaaactccaggatttcatgctgggaaagcgcggcggtcggctcatcgaggatcaccacctgggcgtcgaaagccagcgcccgggcaatcgccaccatgtgacgctgggcgatgctgagggttttcagcgtggctcgcgggtcgatctggacttccagccgggtgaggatctcgttggctctgcggtgcatcgtcggccagtcgagcgttttcagcagtcccttatacagatactggccgacgaaaatgttttcgctgaccgagagttcgtcaaacagcacggtttcctggtgaatggcggtgatccctaccttatgcgccgactccggcgttggcagatgaatggggatcgctttatagaggatctcgccctcttcgggctgataaataccggtcatcactttgaccagcgtggatttccccgcgccgttttcgccgattaaggcggtcactttgccgggccagagatcaagctgcacgttctcaagggcgcgcacaccgggaaaaattttggtgatccccttcagcgacagcagtggcgttgatgctgacatgatagttctccacaaaaatcacccctcaccctaaccctcccccacaggggcgagggaacggtccggcgtccgctggccgcatcgcgcagagggccagccgttccccctctccctccgggagagggccggggtgagggaacaaggattagaaaattttcgagaacttatcgatgttgctcgcatcgtagacaaacggcttggccatcgcgccattcccctcggcgtccagcttcactttgcccagcttgcccatactggcttcggttttggtcgccgtgcctttgactaaatcgtcggccagataggtggcggcgtagcccaggtcaatcgggttccagatggcgaagcttttgctggcgccggacttgatcgcgccggccatttccgacggcagccccagcccggtgacatacactttgccgattttgccctggtccttcaccgcctgcgcggcggcaacaatccccaccgacgacggcgagacaatgactttcaggtccggatatgatttcagcagacccaccgcttcgcggtagcttttatccgacagatcgtcaccgtaggcgacggtgaccagctgcaccgacggatactgcggtagcacctttttcatctcctcaatccagatgttctggttcgtggaggttggggtggcgcttaacacggccacctcgcctttctcaacgttcagcgcctgcagcgcatcggcggcaagcttgacgttggtttcgccaattaaggcgttatttgaggggttaagatggatctgacggcctgccggcgccacgccggagtcccatgagaccaccttgatgccgcgctgcatcgcttttttcagcaccggcaccaccgcgtccggatcgttggcggaaatggcgatcgcatccaccccctgggcgatcaacccgttcagcacgtcgatctgcgcctcggcggtggtagtggtcgggccggtgtagatcactttgacatcacctaactccttggctgcctgttgggcgccaacgttggcggcttcgaagaagccatttcccagcgatttcgccacaagggcgattttaacttcggctaaggcggaaccggacaacgccagggcggcaacggtgaggatcaagcttgtctttgttttcattgcttttactccacatgagttagttttgtagggtttgcaggtgatatttcgccccgtctcggtgagcggggcgcgatgttgttatggataaagatctaaagcggactgcagcggctgcacgttgaagcgtttgccaagggcgataagctcgtcgcgggtgatggtctgcttcatcccgcccatcgacaagactttcaccagcacttcggcggacttctcggcggtatcgatcaggccgaaggtctcatccagcgtggggccgctgccgaagacgccgtggaacggccacagcaccagcgagtgtttttgcatggtttcggcggtcgcctggccgatttcatcggtacccggcaccatccacggcagaatgccgacgccatccgggaagaccaccagacattcggtgctaccttcccacagcttacgggtgaaaagatcgctgtggttctccagaacataggtcagggcgatcaggttggtggcatggcagtgcatgatcacccggtctttgccgccggtcagtttgatgcgctcgctgtgcgacaggaagtgtgccggcagctcggaggtcgggacggcatcctccgtcaggccccacaggatatggtatcccgcgccgtcgctgtcgaccttcaccacgccgaggttagcggccgggtcgagctggacgttacggaagaatttgccggagccggtgacgataaacggctggttggccagggttggcatcggctggctgagggcgatatagcgcggtttggcgtggaaatccgccgcgtaaggttcgatatccgcttcatccagacgcagcgtcaggttgccgccgttgcgttcgtcccagcctttcagccaggcgtcggaggtggctttgatcatgccctggacgaaccaggcgtcgataatggtctgcatagtcttgtctttcctgttgattcggtgcggggttgaccccctcaccctaaataggtgcgtgcccccggattgcgccgtaaacggcttatccgggctaccggttcgtagcccgggtaaggcgtcagccgcgacccggggaagctcgtgcattacccgcgctggctcagaaccgcattctcataagcccgtacgctgtccagccactggctacccgccggcgtgtcgtgacgctgacagtacatctcccagatggcctgccaaggcagcgatttttgctcttcgagcagcgccaggcgggcggtgtaatcgccgtcgttctccagctggcgcagctgggcggtcggttccagcagggcgcgcagcagcgcttttttcatattgcgggtgccaatcacccaggccgcgatgcggttgatggaggcatcgaagaagtcgaggccgatgtgcacgcggtcaaacaggttatggcgaatgatttcgctggcgatggcctgggtttcatcatccagcagcaccacgtggtcgctgtcccagcgcaccggacggctgacgtgcagcagcaggcgcgggatgtagagcatggcggcggagatcttgtcggagatcacttccgtcggatggaagtggccggcatcgaggcacagcgccgtctgacggctggtggcgtaacccatatagaactcgttggagccgacggtgtagctttcggcgccgatgccgaacagcttgctctccacggcgtcgatatggtgcgccgggtcgagcttctcgctgatcacctcatccagggcgttcagcagccgctggcgcggggcgaagcggtcaacggtaatatccttcatgccgtccggcacccagatattcatcaccgacggcgtgcccagctgttcgccaaaataagcggatacgcggcggctggctttgcagtggtcgatccagaactggcggatctcatcgttggcgtgcgacagggtaaagccgtcggcgctcagcggatgcgagaagcaggaggggttgaaatccagccccagtttgttggctttcgcccacgtaacccagtttttaaagtgctccggcttaatctcattgcgggctaccggcgcgtcggattccaggtaaatagcgtgcagattgagacgctttggccccgggatcaggctcagcgcctgctcaaggtcggcgcggagttcttctgcattgcgcgctttgcccgggtagttgccggtcgcctggatgccaccggtcaggcttcccgccgggttttcgaaaccggcgacgtcgtcaccctgccagcagtgcatggagacgggcagacggtccagctggcgcagggcctcctcgacatccacgccgacggcggcgtagcgctgcttagcaatttcccaggcttgttcaagttgagtggtcatgcgcaaagctccttggtctgttgtggctgaaactgcgccacgaaacgggcaatttcactatcaggattgggggtaaaagtggtgagcgccgcgttgccgcgcactacctgacgaaactcatcgacattggccagctcgtcgagggtcattaactggatgccgatattgccgagggtggaggcctctatcgggccggccacgacggcgatcccgcaggcgtcagcgcacagctggttgagcagcgtgttctgacagccgccgccgacgatatgcagctggctgaaagggtggccgcgcagcgccgccagctcgttaagcacccgggcgtagaacagcgccaggctgtcgaaaatgcagcgcgccagttcggcatcgctttcaggaaccggctgcccggcgtcgcgacaggcggcctggatctcggcgctcatactggccgggttgataaagcggtcatcgttgcagtcaattatgaagcggcacgccggtagcgcggcggtgcgggcgatcagcccctgcaggtcgctgacgttttgctcttttagcacccgctgcagcagccacaggcccatgatatttttcagcacccgatagcggccttcggctccgccttcgttggtgatattggcctgcagcgccgcgtcgcaggtgtacggcgtcaggctttcaaaccccatcagcgaccaggtgccggaggagagataggcggcatggcggtcggccagcggggaggcgatcaccgcgctggcggtgtcgtggctggcgacagcgactaccggaattcggttaccctgcgggcagatccagtggcctatcacattgccggggtgggtcggctttccgaaccacgccaacggcgcgccggtccagttcagcagcgtctcatcccagctatcgctgttaatattgaccagctgggtggtggtggcgttggtatattcccagttcagattgccggtcaggcggaagctgaaatagtcggggatcagcagggcatgggcagcctgactgaccagctccggctgctgctccaccagcgcgcgcagctgataaagcgtgttaaacggcaaaaactgaatgccgctgcggcgatagatttccgccctgcccagctgcgcttcagcgtgacgcagcaggccctgggtgcggtcgtcacgataggaaatcggcagcccgacgcgctggccctgcttatccagcaggacataatctaccccccaggtatcgatgccgatactgtctatcagaatgccctgctcacacactttctccagcccgcggcggatctcgccttccaggctatctacatcccagcagtcgaagccgtctactttctgcagactattggtgaagcgatgaatttcgcgcagcgtcagggcgcgcggcccgggctgatagctggcgagcatcacccgcccgctggaggcgcctaaatcgacagcgacacaatgacgaatactcatgaaacgatccttcttaaaatcattgtccgcagtctaaaaaaggccgtttactgacaccttctcgctacggacagccaaaactggccgctggcaagaaagcaaaggtgaccgtgagggacatcacagtttgcggttttaggggatggcgagggggatgtgatggcctccgcagttccgcatctttccggctgattcttgaaaaagcggcaggatttacgaatttcgcggtcaaaaattgaaggccggatagccaacccttcattactatcagccggtgactgataatttttctcattacgagggtggcatcatgaccatattgcacagtacggatttctttaaggccgggatctcgacggtggctattgaaccccgcctccctcagtcggcctttccggaacatcaccatgatttccatgaaatagttatcgtggagcagggatcgggtattcacgtcttcaatggccagccctacaccattggcggcggttcggtctgttttatccgcgatcacgaccgccatctttacgagcacacggataatctgtgtctgaccaatgtgctctatcgcgcgccggatgcgtttcgctttctcgccggggtcagtcaactactgccccaggaacaggaaggaaactacccctcgcactggcgggtgaatcaaaccgtcctgcaacaggtgcggcatatcgtggcgcagatcgaggccgtggggagcgaaacggatactcatgccgtcgccagccgtgagatcctgtttatgcagctgctggtgctgttacgtaaaagcagccttgcggaagaggccaccaacaacgatgcgcggctgaatcagctgttggcctggctcgaagaccattttgcgcaggagatctgctgggaggaggtggcggcgcagttttcgctgtcgctgcgtacgctgcaccgccagctgaagcagcaaaccggtctgacgccacagcgctatcttaatcgggtgcgcctgatgaaagcccgccacctgctgcgccacagcgatgaaagcgtgactgatatcgcttatcgctgcggcttcggcgacagtaaccacttttcgacgctttttcgccgggagttcgactggtcgccgcgcgatatccgccaggggcgcgacgccattcttcagtaacgcgagaagagtcaacgtattgcagactaaaaacgcgaataatgcgccgttatccgcgtttggagtgtgagccgtggccggtctgattttacgtaaagaggagtttttcccttccgccacacaggcagtggcggtggcagaccgctacccgcaaaatgtctttgccgaacatacccatgagttcagcgagctggtgctggtgtggcgaggcaacgggctgcacgtccttaacgatcgtccctggcgcattacccgcggcgatctgttctacattcgcgccgaagataaacactcctatgcttccgttaacgatctggttctgcagaacatcatctattgcccggagcggctgcagctcaattttgactgggccggggcgatccctggcctcttcggtacgccgtggaagccccactggcgcatgggcagcacaggtatggcgcaggcgcgccaggtgattagccagcttgagcatgagtgcgcccggcgcgacgcgcagggaaatgcgatggccgaactgctttttgcccagctggcgctgacgttgcagcgccatcgctatgcgacggatgatcccgcggcgacgcagcgcgaagcgctgctggacaaactgctggccgcgctggcggccagccttagccgcccctttgttctggagcgtttctgcgagcaggagggcggcagcgagcgggcgcttcgccagcagtttcgccagcaaaccgggatgaccatcaatcactatttacgccagctgcggatctgccatgcgcagtatctgctgcagcataccgagcgcttaatcggcgatatcgccatgcagtgcggctttgaggacagtaactacttttcggtggtttttagccgggaaatcggcatgtcgccggggcagtggcggcagcgcagtcgcgccgccgcctgaagagcgtcgttgtcaggcagatgatccggtgattaactggccattcccagaccgacgatattggcggcgatgatgatcaccacgcagccgaggctcaggacgctcaccggacgacggccggcgttgttccactccttcagcaccagacccaccacaccgccgcacagcacgtagaaactcatgtgcagcatccagctcatataatcatactgcgccggaatgctggcgtggccccaggcatagaagaagaactggagataccacatcagaccgccgagggcagagagcagaaggttgctgatgataagcggtttggccagcgagaaatcggctttgactgacaggttcttcactttcgccagacgaataaagcagaagccaaggttaaccagcgccccgccgcccataatcaccacgtagcttggcagcgctgcgtacagcgggtcgacgccgagcgccgcggcggcatcatgcatcggtttggcggcgttcatcgcgaacgacatccctgcggagaagataccgcacattaccgccagcagaagccctttcttcagattgaactcttcggctttgatgcccattttgcgctctttcagctggcctgcgcgggtgacgatgccgacgccaatcaccgccaccagcacgccgagcagcgtcatttgaccgccctgggtgcgcatcagcactgcaaactgaccgttaataatcggcgtcatcagcgtgccgacaatcagcgtgatgccaatggcgatgccaatccccatcgacatgccaagatagcgcatggtcaggccatagttgatattaccaatgccccacatggcgccgaacagaaagaccggcagcagcgtggaggcgctaaaagagcggtagtaggcccagaagtcgggtaacagcgtggcgctgatggcccagggcagaatcagccaggagacgatccccccgaccgaccacatggtttcccacgaccagtgttttactttcttgaacggggcatagaaacaggcggcactggcggcccctatcaaatgccaaaaaatacccatcgtaatcgcgtggttcattgattttatcctcatctttttttatcggagacggcggcttccgatgggatgagtgtaaaaattggccgctttggccgccttcaggacgttgccacaggatggcgaaccctggcaaccatgggcttaattagttgttctacatcacaaaacgacgggtatttcttctggttatatccatatgaaaaatacggcattgataagcattttcaataccatttaattaactataatggacaaactgcttacgcggcgttaacacttgagccgctcgacaataatggagatgattatgagctataccctgccatccctgccttacgcttacgatgctctggaaccgcacttcgacaagcagacgatggagatccatcacactaaacaccaccagacctacgtgaacaatgccaacgccgcgctggaaagcctgccggagttcgctaacctgtccgctgaagagctgattaccaagctggatcagctgccggctgacaaaaaaaccgtactgcgtaacaacgccggcggccacgcgaaccacagcctgttctggaaaggcctgaaaaccggtaccaccctgcagggcgacctgaaagcggctatcgagcgcgatttcggttccgtggagaacttcaaagcggaattcgaaaaagccgctgctacccgtttcggctccggctgggcgtggctggtcctgaaaggtgacaaactggccgttgtctccaccgccaaccaggattccccgctgatgggcgaagccatttccggcgcttccggcttcccgattatcggcctggacgtctgggaacacgcttactacctgaaattccagaaccgccgcccggactacatcaaagccttctgggacgtagtgaactgggacgaagctgcagcgcgttttgccgccaaaaaataaggttgcattgcgctaaaagagaagcgagtctgatgactcgctttttttatatctgtagcaaggagagcagccatgcattatccggtgaatgtctttgtcggcaaaatcagggactacgcgggcagtcgccccagcgcgatcgacaaaatccaggtcgacggagaattgcagctcggcgatctcggtctcgatggggaccagcaggcggagaagaaaatccacggcgggccggaccgcgcgctgtgtcattatccgcgcgaacactatgccgactggatccgtgacttcccccagcaggccgagcggttctgcgcgccggcgttcggcgaaaacctctccaccaccgggcttaccgagcaaaacgtttatatcggcgatatctttcgctggggcgaggcgctgatccaggtcacccagccgcgatcgccgtgcttcaagctcaactttcattttgcgatcaatgatatggcgcagctgatgcaaaacagcggaaaaaccggctggctgtaccgggtgattgccggagggcaagtttccagcgatgcgccgctcgagctggtttcccggctgagtgatgtcagcgttcatgaggccggggcgattgcctggcagatgccgtttgatgatgatcagtaccaccgcttattgtcggcagcgggcctgtctgttagctggagccgaacgatgcagaaacggcgtttaagcggcaagatagaggatagttcgcggagattatgggggaaataatcccccatattaagtattcccggggatgctcccggcgcagcgccgcacagcgcaggccgggtcggcgtcaggttcgtttatacagcggcagccagattgttaaacgcagaccacccagcgggctgtcgtcggccttcacccagccgcggtgctgctgaatagcggtttcgacaatcgccagccccaggccggtgccgccggactcgcggtcgcgcgcctcgtcggtccggtagaatggccggaaaatctgttcgcgatcctccgggctgactcccgggccgtcgtcatcgacgttaaccgtaatcccgtctttatccaccgagaagctgacggaaattttcgtatgcgagtagcgcagggcgttgcgcacgatattctccagcgcgctttccagcgcattggggttaccgtacagcggccatgggcccggcggatactcaacggtgaaagatttccccatctgctcagcttcaaacgccgcattgtccaacacttcgttccatagctgattggctttcaccgtctcgctgaccagggcgtttttcgcctgattgcgcgacatcaccagcaggtcgttgatcatgctgtccagccggtgcgcttcggtttcgatacgctccagctccttgctctctccgctgcggcgacgcagcagggcggtacccaattgcaggcgcgtaagcggcgtgcgcagctcgtgcgagatatcggacagcagccgctgctggctggtcatcatccgctccagggccgtcaccatttggttaaaactggcgccagcggctaaaaactcctgcggcccggcttccagctccggatgctggcgcaggttgccctgggcgacttcatcggcggcatttttcagcttacgcgccggtttcgccaggctccacgccagccacagcagcagcggggcgctgaccagcatcgtgacgatcagcagcagcagcggccggtcaaacagcaggttgataaagtcggattgtgaggtgctggcgggacgaatcagatagagctgatagttatcctccccgtcccggacggaaaacgggcccaccatttccaggcggccatagcgttttttctgcggatgatcggcgttatcggcctggccgataaagttacgaatgatctgcatctcgttgcgttctgcgccgatcacgcggccttcgctggtcaccagcagcaggcgttgtcccggaggcgcccatttatcgatggcgcgaaacaaacgacgccaccacatcaggtcgtttggcggatcgttggccagctcggcctcgacgtgctgctcgatcatgatgccctgacgctgctcgctttccagcagctcggtcatctgccgggaatccagtttgggcaacatcagcaccagcatcaacaccagcgccagcgtgagccagaagatggcgaagatgcgtgcagtcaaacttccaatcatgaagcggaaaccatcagatacccgcggccacgcagcgttttaaaccacggatggccatctttgcgctccggcagcttacgccgcaggttggaaatatgcatatcgatggcgcggtcgaacggcgtcaggcgcttgcctaacacttcctggcttaaatgctcacgggagactacctgaccgagatgctgcgctaacagatagagcagggtgaactcggtgccggtgagctccagcgtctggccatcgaaattggcttcctggcggcccggattgaggcttaaggcatccacttccagggttggtgagccggcttcggtcgtctgctgctgctcgctccagtgggaacggcgcagaatcgcgcgtatacgggccaccagctcgcgatcgttgaatggcttaggcaaatagtcatccgcgcccagctcgaggccgagaacgcgatccagctcgcttccgcgcgctgttagcatgataaccggagtctggtgtgtctgacgcagctctttcagcgtatcgataccgtttttcttcggcatcatcacgtcgagcagcaataaatcaacgctgtcgtccagaagggccagcgcctgttccccatcatgggccaccagcacgttaaaaccttccatatcgagcagctcttttaacagggaggtgagctcccggtcatcatcaactaacaggattttattcattgtttaaatacctccgaggcagaaattacgtcatcaaggcccgctaatccatgactttacgttgttttacaccccctgacgcatgtttgcagcctgaatcgtagactgtctctcgttgaatcgcgacacaaacgttttgggagtatgtgatgcgcaatgttatcgctgccgtcatggcctcaacgctggcgctaagtgcatatagccaggccgctgaagtcgttaccagcgttaactggctccccggagacgaagggggacagcgcggtagccaaagccatatgtttgacggcataagtttaaccgagcagcaacgtcagcagttacgggatcttatgcaacgggcacgccacgacaggctccccgttaatgttagcgaaatggagacaatgcatcgccttgtcaccgcagaaaattttgatgaaaacgctgtgcgcgctcaggcagaaaagatggcgcaggaacaggttgcccgccaggtcgagatggctaaggttcgcaaccagatgtaccacctgcttacgccagagcagcaagcggttttaaatgctaagcaccagcagcgtatggatcagttgcgtgaggttgcaaggatgcagaaaggctcagcgatgatgctttcgagtagtagcaacaccctgcaaccccagtaacaaaccctgttttccttgccatagacaccatccctgtcttcccccacatgatgtgggggttttttttgccctttttacggtaaatcaactccttcgcctatcccgtgagcgtcacaagttcgggttatactaagcgcattgcaggagaaggagcctatatgaatcaatcttatggccggttggtgagccgcgccgctatcgccgcgacggctatggcctccgcgttacttttgatcaaaatttttgcgtggtggtataccggttctgtcagtattctggctgcgctggtggattcgctggtggacattgccgcctcgctgaccaacctgctggtggttcgctattcgctacagcctgctgatgaagaacatacctttggtcatggcaaagcggagtcgctggcggcgctggcgcaaagcatgtttatctccggctcggcgctgttcctgtttctcaccggcattcagcacctggtgcgtccggagccgctgcaggccgccggcgtcggggtcgtcgtcacattgatcgccctcgttagtacgctggcgctggtgactttccagcgctgggtggtgcgaaaaacccagagccaggcggtgcgggcggatatgcttcattatcagtctgatgttatgatgaacggcgccattctggtggcgctgggcctctcctggtacggctggcatcgcgccgacgcgttgtttgccctggggattggcatctatattttatatagcgcgctgcggatgggctatgaggcggttcagtcactactcgaccgcgccttgcctgacgaggagcgtcaggacattatcaccatcgtgaccgcatggcccggcatccgcggggcgcacgatctacgaacgcggcagtcagggccgacccgctttattcagattcatttggaaatggaagataacctcccgctggtgcaagctcacgtgattgcagaccaggtggagcaggcgattctgcgccgtttcccggggtccgatgtcattatccatcaggatcccagctctgtggtgccagcggcgcagcagggcttttttgagcgttaggttatagtctgtaaactcgatgtaaaaatgtggggcagatcggcattttttgtataaattaccgccgtttggtctgacctgaatcaattcagcttgaggcgtttgatatactattgtcattagcgtcgtgcactcctggtgagggagcgcttcaggcaacagaattattttttgcttcctaagttcagaggtagtcatgattaagaaaatcggtgtgttgacaagtggcggtgatgcgccgggcatgaacgcagcaattcgtggcgttgtgcgcgcggcattaacggaaggtctggaagtttttggaatctatgacggttacctcggattgtatgaagaccgtatggttcagctcgaccgttacagcgtttccgacatgatcaaccgcggcggcaccttcctgggctccgctcgcttcccggaattccgcgaagaacacatccgcgctgtggctatcgaaaacatgaagaagcgcggcctggacgcgctggtggttatcggcggtgacggttcctatatgggggcgatgcgcctgaccgagatgggcttcccatgcatcggcctgccgggcaccatcgacaacgatatcaaaggcactgactacaccatcggcttctttactgccctgagcaccgtggtggaagcgattgaccgtttgcgcgacacctcctcttcgcaccagcgtatctccgtggtggaagtgatgggccgttactgtggcgacctgaccctggcggcggcgattgccggcggctgtgagttcatcatggtgcctgaagtggaatatacccgtgacgatctggtggcagaaatcaaagccggtatcgcgaaagggaaaaaacacgctatcgtggccatcaccgagcacatgtgcgacgttgacgagctggcaagctacatcgagaaagagactggccgtgaaactcgcgccaccgtcctcggccacattcagcgcggcggttccccggttccttacgaccgcatcctggcttcccgcatgggcgcctatgcgattgagctgctgctgcagggccatggcggccgttgcgtcggcatccagaacgagaagctggtgcaccacgacatcatcgatgccatcgagaacatgaagcgtccgttcaagaacgactggctggattgcgcgaagaaactgtactaagttacgcgccggataaacaaaaggccttctcatggagaaggccttttttatggcggaaggtttattcgatatccagcgggtcttccgacaggatcatcccggtgttatcggcatacagatggtcgccggagaagaaagtcaccccgccgaaattgacgcgcacgtcgctttcgccgatgccttcgccagccgcgccgaccggaatagccgccagcgcctgaataccaatgtccagctcctcaaggtcgtcaacctggcgcaccgcgccatagaccaccaacccttcccattcattctggacggccagacgcgccaggtctgcgtcaattaacgcgcgtcgtactgagccgccgccgtcgatcaggagaatatgaccacggccattctgctcgagcagatcgtagagcaacccgttatcctcgaaacatttaaccgtaatgatctgtccaccaaacgacgaccgtcctccaaagttagagaacagcggttccacgacgttgacatcttcctggtagatgtcacaaagctcggaagtatcgtatttcataggcttaacgttcagttgctgcgagagtttttagtatatcccgcgaatcgcattgttggcaaaatcatcaattgttaattgatatttgtcagttaagccatcagcttactggcaataattccgataacaaacagcaggttggtcagtaaggcccctttgaccgtcttttcgagcattggccgcatcgccagcggatcggattcgcgcaggacgtagcgcgcctgtttcaccagcagcggcgtggcgagaataaacagccagccccaggctgaatgcagcgccagcaggttaaacagcgccagacacagcagggcgccgagcagcaggcaggcatgatagcggcgggcattgaccgggcccaggcgcacggcgagggtgttcttcccgttctgccggtcgctgtcgatatcgcgcagattattgatgttcagcacggcggtcgccagcagaccgcaggctgtcgccggcagaaaaatggccgcttccacattatgggcttgcagataccagctgccgaggacgctcagccagccgaagaaaacgagtactgagatatcacccaggccaatatatccatacggacgggtgcccaccgtgtaggtgatggcggccacgatagacaggcctcccagggcgaggaagccgatgaaatcgccgacgctctgccaggcggcgcacagcagcgccagaccaaacaggcagatgagtacgacggtgacgatcagagcgcgcttcatctgctggggggtaatcacccctttctgcatcccgcgcagcggcccgatgcgatccggtttatcgctccccttaaccgcgtcgccgtagtcattggcgaggttggaaagaatttgcagcaagccggcggtgatcagcgccagcagggcaacccagggatcaaaatggccctgctcccaggcaaggacggtgccaacaataatcgcggcaaatgccagcggtaacgttttaggacgcaggctttccagccacgcctgtgaacggctgatatcagtcatagttattctagccaataaaaatgggggcgatagcccccatcaacagtgatgaaaatgcattgcaccggattataggataaaacggctcagatcttcatctgccaccagaacatccaggtgtttactcacatattcggcatcgatagtgacggtctggccgttcatctcgctggcatcataggagatatcttccaccaggcgctccagcacggtgtgcaggcgacgcgcaccgatgttctcggtggtttcgtttacctgccatgcggcctgggcgatgcgcttgatgccgtcttcggtgaattcgatgttcaccccttcggtcgccatcagcgccttgtactgcacggtgatggaggcattcggctcggtcaggatgcgctcgaagtcgtgggtggtcagcgccttcagctcaacgcggatcggcagacgcccctgcagttccgggatcagatcggatgggctggccacctggaatgcgccggaggcgataaacaggatgtggtcggtcttgaccatcccatgtttggtggagacggtgcagccttccaccagcggcagcaggtcgcgctgtacgccttcgcgggagacgtccgggccggaggtgttgccgccgcgcttacagattttgtcgatttcgtcgataaagacgataccgtgctgctctacagcgtcgatggcttcctgcttcagctcttccggattgaccagtttggccgcttcttcttcaatcagcagcttcatcgcgtctttgattttcagcttacgcggtttctgcttctggccgccgaggttctggaacatagactgcagctggctggtcatctcttccatgcccggaggggacatgatttcaacgcccatcggcgccgcagcgagatcgatttcaatctctttatcgtccagctggccttcacgcagttttttacggaacgcctggcgcgctgcagacggttcctgcgacggctcagtctggccccagttgttcttcgccggtgggatcagcacgtcgagcacgcgctcttccgccagctcttccgcgcggtaacggttcttatcgatggactgcatgcgaaccattttgatcgccgcatcggtcaaatcgcggatgatggagtccacttctttaccgacatagcccacttcggtgaacttcgtcgcttcaactttgataaacggcgcgttggccagttttgccagacgacgggcgatttcggttttaccgacgccggttgggccgatcatcagaatgtttttcggcgtgacttcatgacgcagctcttcgttaagctgcatccgacgccagcggttacgcagggcgatagcaacagaacgcttggcggcgtcctgaccgataatgtgtttgtccagttcgctgacaatttcgcgtggggtcatttcagacatgggagatccttacgctttagaaggtaattcttcgatggtgtggaaatggttggtgtagatgcagatatcacctgcaatatccaacgctttctcggcgatgtcgcgcgcgcccatatcggtattttccaacagcgcgcgggccgcggcctgggcgtaaggaccgccggagccgatagcaatcaaatcgttttccggctgtaccacgtcaccgttaccggtgatgataagcgacgcgttttcgtccgcgacggccagcagcgcttccagtttgcgcaacatccggtcagttcgccagtctttggccagctcaacggcggccttcaccagatggccctggtgcatttccagtttacgttcaaacagttcgaacagcgtgaaggcgtcggcggtgccgccagcgaaaccggcaatcactttgtcgttgtacagacgacgcactttcttcacattgcccttcatcacggtgttgcccagcgtggcctggccatcaccggcaataacaacatggccgttacggcgaacacttacaattgtagtcacgagcagaccccttggttgcaaaagcggaacaggggccccgcgctgtccgcggggccgaatgcaattatagatgggggggattttgagggtttcaacccctggcggcgagacgaatgcagttcgcgtgtccagccatcttcaggcgggtgatcatctcgttggcgctttctttgcctttcaacgggccaataaccacgcggttccagccattgttagtggtaatgtgcgaagcaaacccttcgaaagccagctgagcgcggacggtttcggcctgctcggcgcctttaaaagagccgcactggatcatccagctacgatcgtctttcttctcggcggtggttttcggcgcttcttccacccgagttaccggcgccgcggcctgggtacgcggctgcgtggtattggtatgcgctggcgtctgcagcagatcctggtacggctgctggtttgacgcggtctgcttcggctgttgctgctgaaccggcttcggctgctgaacgcgcggcggctgctgttggacggtctgcgcctgagtctgcgcccactgttgctgctgcgcctgctgctgttgctgcgctaaacgctgacgctgaagcgtctgctggcgctgcgccggcgtttgttcgttccacggcacttcggtcagctgggtcggctgctggcgcatatcggcctgcatctgggcgagcagctggcgctgctcgtcggtcagctgttccggtttcatgacttcgccaccggcggtcggttcggtcggcgcgcggacgccaggctggcggctttccagctctttaatatagcgccagcgctcttccggtttgggcggcaagccgttgccggcggcctggcgattttgcatcgcttccgcttcttctttcttatgatgcgtaatgaaatagaggccaccgataaaggccaccagcacagccgccgcgatcgccaccatcgccggtgaaatcgccggaaggctgctttgcttattccttgagcttcgggtcgtgctctttttgcgccgcgaagaagccggttggctgcggcgtacataatctcgttgtgccactatcgtttcgctgtcttatattcgttcgtcagcccgccatgttacttaagcggcgggcctttgaccagaagagcaggcccgaaagcctgatggttatcgtctgattttttgcgtactgccgcgaacaatcagttcgcaatcgagcagacgcgagccgctgttcacgttatgcccctgcatttgctccagtaatagcagcattccttcacggccgatatcaaaccgtggctgtgaaaccgtggtcaacggcggatcgcaaaattcagacaacgcgatgttatcgaagccgacaattgacaggtcgtccggcactttcagaccgcgacgttttgccagcgataaggcgcccagcgccatcacatcgctatggcaaaagactgccgtgggcggcaccggctgcgccaggagctgctccagcgcattggcgccggcttcgaaggtaaagttgccgcgagcaatatagtgcggatcgacggtgataccgctgcggcgcagcgcctgcacataaccctgcaggcgataatggcacaacggcatatcttccgggccggcgatacagccgatacgctgatgtcccagctcgtggagataatttaccgcgttaaaggccgccgtcaggttatcgatatggacggtgggcagctccagctccggcgcaaactcattcgacatgaccattggcggcaaattgcgctgctcttccacgctggcgtcaaacggcaagcgcgagctgagcagcaccatgccgtcgatctgcttggtgatgataaggtcgataaaggttttttctttctgattctggtgggcgcaatcgccgattaacaccagatagccgtgctcggcggcagtgacttcaataccgcggatcacttcactaaagaagggatcgcagatatccgggacgatcacgaggatcgttcgcgattcgttgcgcttcatattgcgtccgagcgactgcggtaaatagccgacttccagcgccgcctgctcgacccggttacgggtggcttgcgacaccttatcagggttcatcaacgctcgggacacggttgccgtggaaacgtttgccttgagggcgacgtctttcatggtggcggcaaccacttgttttttgggcttcacctggtttctcctcgctgaatggcgctggcatttcccttgggcgctaactgctgcatcatttttatcagatagtcgcggcagtgagttacagaattttcatgaaaaacgtgatgcttgttaaatttttcgatccggctcgcaagagaagccttatccttcaatcggatcgacatccagcacccacttcacttttctcgcctccggaagcgtattgatcagcgccagcgtaccgctaacgatatgttgcagacgcacccgcgaaggatgctgcagcaatatttgccagcgccagcggccgccgcgctttggcgccagcgccggaaccggaccgagcacccatagcttttcgtcggccagcgggctggcctgcagcagattgcgcagctgttgtaaaaacagcggcgcctgctggttgttatggtcttccgcacgaatcagcacatggctggtccacggcggcagctgcatcgtctgccgctctgccagcgcctgttcggcaaaggcgtcgtagcctttatacagcagggtctgcagtagagggtgttccggatggtgggtttgaagaatgacctcgccctgttttcctgcccggcccgctcgtccggagacctgggtataaagctgagcgaaacgctctgcggagcggaaatcagcggaaaacagcgccccgtcgacatccagcagggagacgagggtgacgtccgggaagtggtgccctttggccagcatttgggtgccaatcagaatacgcgccccgccgcgatggacggcggcgagatgctcctccagcgctcctttgcggctggtggtatcgcggtcgatacgcgagataggcacctcagggaacagcggcgccagggcctgctccagctgctcggtgccgatccctaccggcaccagatgcgtggagccgcaggaaggacactggcgcgggattgggcgctggctgtcgcaatggtggcagcgcagatggtgctgcgcctggtgcaacgtatagtaactgtcgcagcgcgggcattccgctatccagccgcaatcgtggcacagcagcgctggcgcaaagccgcggcggttaagaaacaggatcacctggttatccgcttgcaggtgctggcgcatacggctaatcagcgcgggagacaggcccgcctgcagcggttgccctttgagatcgagcacgtgctgctgggccgggcgcgcattgcccgcgcgtttgcttaaggttaactggcggtatttaccctggcggacgttatgcagagtctccagcgccggcgtcgccgagccgagaattatcgggatctgctcgctgtgggcgcgccataccgccaggtcgcgggcatggtagcgccagccttcctgctgcttgtaggagctgtcatgctcttcgtcgatgacgatgacgccgagatctttaaatggggtaaacagcgaggagcgggtgccgatcacgatggccgcttcgccatttttcgccttcagccaggccgagagacgttcgctgtcattgagcccggagtgcagcacttccaccggcgcgttaaagcgctggcgaaatcgggcgatggtttgcggcgtcaggccgatctccggcaccatcaccagcgcctggcgcccctgcgccagcacattctccagcacgctcaaatagacttccgttttcccggagccggtaatacccgccagcagccaggcggagaaacgatcggcggcgctgtggatcgccccgacggcggtggcctgctcggtattcaggcgcaggcgttcgccggcaaccgaatacgcgctgcgccagtcggtgagggcgggcgcttcgcaggccagctccgccagccctttaccgcgcagcgcctgcagcgccgcttcattgaattccagttcgccaacctgatgacgccagattttaccctggcgcagcgccgccagcgcctgctgctgcttccgggagcgtttcaggccgttaaggtcgacaacctgcccctgctcggtggcgaaccagtaccacagcggcgtggcgctggcgggtttgccctggcgcagcataacgggtaatgcatggaacagcacatcgccgatcgggtgatggtaatactcagccgcccacatcagcagtcgccagacagtcgtggagaagaccggctcgtcgtccagcgcttcggcgaccggttttagctcatccagcggcagttcgctgcgctcgctcaccgccgcgacaatgccgatccgctcctgtttgccgaacggcacccgcacccgacagcccgctttgaccgccatgccttcaggcagcaggtagtcaaaagtgcgcggtagcggaacgggtagggcaacgtgggcgacggacatgtcatcttcctgacttgaaatctggcgggatagtatacacattacgataaggcggcgcggatcagtttgcatatgctggtcaaattctgtatgattcgccgcctttgatgcgctttatatcgcattgaagattgaccattaccgcgtgcttcacgctgtcagcagcgtagaaggcgacgggaaattactaatatcgcgtggtgtctggcgttagggctggaagagcgacgcggccttaactgaggttctcccatgaaaaaaggtattcacccaaattacgacgaaattactgctacctgttcttgcggtaatgtcatgaaaatccgctccaccgttggtcacgacctgaacctcgacgtgtgcggcaaatgccacccgttcttcaccggcaaacagcgtgatgttgctaccggtggccgtgttgaccgcttcaacaagcgcttcagcatcccgggcagcaagtaagttgccagaagaagccgcctcagggcggcttttttgtctctcccgcctgcctgggcgggaaagaaaaaagggcggaagattattccgccctttttatcgtctcagtattcccacgtatccgggtcgattcccagttcacgcataatcgctttcgccgcttccgggatctcatcgctgcgctctttacgcaggtcttcatcgttaggcaacggttgtccggtaaaggcatgcagaaacgcttcgcacagcagctcgctgttggtcgcgtgacgcaggttattcacctgacgacgcgtgcgttcatcggtgaggatttttaacaccttcagaggaatggaaaccgtaattttctttacttgttcactcttcttaccgtgctcagcgtatgggctgatatattcgccgctccattcagccatgagataccttaatcctctgtttattagtgaagggccagaatattccgcccgggctataattgcgcgtagtttaccgtatgcgcgggctttctgacatgagataagccgccgacgacgtgcgctaatgcatataattttaacggctatttgcactttgctcaatctatacgcaaagaagtttagatgtccagatgtattgacgtctattgtgacaatgattactctggagcctgacttttcaccgattcagcccaggaacttcccaacatgacgcgtaaacaggccaccatcgcagtgcgtagcggtttaaatgacgacgagcagtacggttgcgttgtcccgccgattcacctctccagtacctataacttcaccggctttaatgaaccgcgcgcccacgactactcccgtcgtggcaatccgacgcgcgatgtggtgcagcgcgccttagcggagctggagggcggcgccggcgcggtgctgaccaataccggaatgtcggcgatcctgctggtgacgacagtgttccttaaaccgggcgatctgctggtggcgccgcacgactgctacggcggcagctaccgtctgttcgacagcctggcgaagcgcggctgctatcgcgtccagtttgtcgatcaaagcgatgagcaggcgctgcgggcggcgctggcggaaaaaccgaagctggtgttggtggaaagcccaagtaatccattgctgcgggtggtggatattgcgaaaatctgtggtctggcgcgtgaggccggggcaattagcgtggtggacaacaccttcctgagcccggcgttgcaaaacccgctggcgctgggcgccgatctggtgctgcattcctgtaccaaatacctcaatggtcactccgatgtggtggccggggtggtgattgccaaagatccggcaactgtcaccgaactggcatggtgggcgaataatattggcgtcaccggcagcgccttcgacagctatctgctgttgcgcgggctgcggacgctgtctccacggatggaagtggcgcagcgaaatgccctggcgatcgttgagtatctgaaaacccagccgctggtgaaaaagctgtatcatccatcgctgccggaaaaccaggggcatgaaattgcggcgcgtcagcaaaaaggttttggcgcaatgttaagcttcgagcttgacggtgacgagcagacgctgcgccgttttctgagcgggctgtcgctgtttacactggcggaatcgctggggggcgttgaaagcctgatttcccatgcggcaacgatgacgcatgccggcatggcgcctgaagcgcgtgccgccgccggaatttcagaaacgctcctgcgtatatcgaccggtattgaagatggtgaagatttaattgccgacctggaaaatggcttccgggcagcaaacgaggaataaagatgagtgtgattgcgcaggcaggggcgaagggtcgtcagctgcacaaatttggtgggagtagtttagcggatgcgaaatgttacctgcgcgtcgcggggatcatgaaggagtattcgcaggcgggggatatgatggtcgtctccgccgctggcagcaccaccaaccagctgatcagctggcttaagcttagccagagcgatcgccttgctgcgcatcaggttcagcagtcgcttcgccgctatcacaccgagctgattggcggtctgctggagcctgcggcggcggatacgttgatagccgcctttatccacgaccttgagcgtctggctggtctgctggacggcggggtttccgaagcggtctatgcggaagtagtcggccatggggaagtgtggtccgcgcgcctgatggcggcggttctcaatcagctgggtatggaagccgcctggctggacgcgcgcgcgttcctgcgcgcggaacgcgccgcgcagccgcaggtggatgaaggattatcctatccgctgctgcagcagctgatggcgcagcatcctaacaaacgtctggtggtgaccggctttatctcccgtaaccaggccggcgaaaccgtcctgctgggccgtaacgggtctgactactctgccacccagatcggcgcgctggcgggtgcctcccgggtcactatctggagcgacgttgccggggtgtacagcgcggatcctcgcaaggtgaaagacgcctgcctgctgccgctgctgcgtctggacgaagccagcgagctggcgcgcctggccgcgccggtgctccatgcccgcacgctacagccggtttccgccagtgatatcgatctgcagttacgctgcagctacacgccggaacagggttccacgcgcattgagcgcgtgctggcctccggtaccggcgcacggattgtcaccagccatgacgacgtctgcctggtggagttccaggtgccggccggtcacgatttcaaactggcgcataaagagctggacgctctgctcaaacgcgcccagctgcgcccgttagccgttggcgtccatgccgaccgtaagctgctgcagttctgctatacctccgaggtggccgacagcgcgctgaaattgctcgatgaagccggtctgccgggcgagctgcgtctgcgtcagaagctggcgctggtggcgatggtgggcgcgggagtcacccgtaacccgctgcactgccaccgtttctggcagcagctcaaagggcagccggtggagttcacctggcagtctgaagaggggatcagcctggtggcggtgctacgcgccgggccgacggaaagcctgatccaggggctgcatcagtccttgtttcgcgccgaaaagcgtattggcctgatgctgttcggcaaagggaacattggttcccgctggctggagcttttcgcccgtgaacaaactacgctctcggcgcgtaccggtttcgagtttattctcgccggcgtagtcgacagtaaacgcagcctgctgaattacgacgggctggatgccagtcgggcgctggctttcttcaacgatgaagcggtggagcaggatgaagagtcgctgttcctgtggatgcgcgcgcacccgtatgatgatttagtggtgctggacgtcaccgccagcgaacaactggccgaccagtatcttgattttgccagccatggcttccacgtcattagcgccaacaagctggcgggcgccagcagcagtgataaatatcgtcagatccacgacgcgtttgagaagacggggcgccactggctatataacgccaccgtgggcgccggcttgccggtgaaccatacggtgcgcgacctgatcgacagcggcgatactattctcggcctgagcggtatcttctcgggaacgctatcctggctgttcctgcagttcgatggcaccgtgccgttcaccgacctggtggatcaggcgtggcagcaggggctgaccgagccggatccgcgcgtcgatctgtccggtaaggatgtgatgcgtaagctggtgatcctcgcgcgggaagcgggctatgacatcgaaccggatcaggtgcgtgtggaatcactggtgccggcgcactgtgaagaggggtcggtcgatcacttctttgagaatggcgaagagctgaacgagcagatgctgcagcgtctggaagcggcccgcgagatggggctggtgctccgctacgtggcgcgctttgatgccaacggcaaagcacgcgtcggtgtggaagcggtacgcgaagagcacccgctggcggcgctgctgccgtgcgataacgtgtttgccatcgaaagccgctggtatcgcgataacccgctggtgatccgcgggcccggcgccgggcgcgatgtgaccgccggggcgatccagtcggatattaaccgcctggcgcagctgctgtaagcgtcgcgttatactcttgaaccagtgaggccactatttgcgttacgcgccctgcggaatacagggcgctctgcgcaaacgcgggtctgtttttcagccatattgtaaaccgtcggctggccgcaaggtctggtagaaaggcgttctcttctacagtgccggcaagccggcagaccattttctgattctcttcctgcgtccaacgctgccatgaattttgccaccagccatgatgggttttcccctgtagctgccacggagccgggctggctgggttccttatctcttcttccacataccatagatcgccttgccgctgacgaaaaagcggcgcccaggcaacgatcgccgcgccgcgtaaaaagcattcatgcgcaataacgtgcgttttcacctctggaaaccgctggctgagcagtttgaaatgaccgtgcgcggcgataaccgggcgcaatatattgccgcgggcatggcgcttttgcattgcgctgccgtactggatttcatcgaactgactgcgttgtaaaaagcgcatttcagtgagagaaatacgttgaataatatcgtcagtctcctccctgtcggcttgtccgccgcgccagtgatagcgtaatgattcgcctaccgcgaaaggagtgaaattagaggtaaaatgaataacattaccgcgcacggcatcaaagcttaataaaaaatagagcttttgcccggcggcattaccctggaatggcgctatcaacggtacgctgcaaatacgtcgtggggcttcaattggggcgatgtgtgggaattttggcgtccagacctttttacagtggcggcactgaaggcgttgcgtaccctgcggattgcggccgtagcgaataatatcccgctgatagcataccgggcaaaaatagccgtagcggcgggcatgatccgtcagataagccgccagccaggggcggaattcccgttcgttaaacagggggggatagctgccgcaggctgcgcagtagagcgccgggtagcccagccgaaaattcgggaaatgatactcagccgcagacggtaaacctaaattgcggcagccaaaagttttacaggcgttaatggtaaagagagtatccactggcaggtcaataccaacgatttttacaggtcgttaattttgtcctgctcaggttgcatacaactgtgaatgctctcacataaaaaagtctttcagaacgtaacttagcggttctttatcactctgaaaggaactccgatgaaactaaaaacaatgagcgcagcacttctgttgactttgcctttctgggcctgcgccaaagatgtcaccataatttataccaacgatcttcatgcccatgtcgaaccttataaagtgccatggatagcggatggtaaacgagatattggtggttgggcgaatatcacgacgatggtgaaacaggaaaaagcgaaaaataacgcgacctggttttttgatgccggggattattttaccgggccttacatcagtagcctgacgaagggcaaagcgataatcgatattatgaatacgatgtcctacgatgcggtgactatcggtaatcatgagttcgatcacggctgggataatacgttgcttcagcttagccaggcgacattcccgattgttcagggcaatattttttatcagaacagcgataaatcgttctgggataagccctataccattatcgaaaaagatggcgtgaaaattggcgtgattggcctgcacggcgtgtttgcttttaatgacaccgtttctgccgcgacgcgagtgggtatcgaagcgcgcgatgaggtgaaatggctacagcattatatcgatgaacttaacggtaaagtggatctgaccgtggccctgatccatgaaggcgtcccggcgcgtcagtcgagccaggggggaaccgatgtgcgtcgtgcgctggataaagatattcagactgcgggtcaggtgaaaggcctggacgttttaattaccggccatgctcacgttggcacaccggagcccattaaagtgggtaatacgttgattctttctaccgatagcggcggcatcgatgtgggtaaactggtgctggattatcaggagaaaccgcaccaattcacggtgaagcactttgagctgaagacgctttatgccgatgagtggaagcctgatccgcagacaaaacaggtcatcgacggctggaataagcaacttgatcaactggtgcagcaggtcattacacaatcgcccgttgaactgacccgtgcgtatggcatctcttcgccgttgggcaatcttgccgctgacgccttgctgttggcagcaggtaggagtacgcagatggcgttaaccaactcgggcgggatccggaatgagatccccgccggggcggtgagcatgggcgccgttatcagcaccttcccgtttcccaacgagctggtcaccatggatctaaccgggaagcagttgcgtagcctgatggagcatggcgccgggttgagcaacggcgtgctgcaggtctcccggggactggaaatgaagtatgacagcagcaaacctgtgggccagcgcgttgtgttattcaggctaaacggtaaaccgattgacgatacgacggtttaccatattgccaccaacagcttccttgcagatggcggcgatggttttgtcgcgtttaccgaggggcaggcgcgtaatacctccggcggctattacgtttcaaatgcggtcgtagactatttcaaagccgggcaaaagataacggatgagcagcttaacgggcagcgcgttgtcgatgtgaagaaataagtttttaaggccgggcagtcagcccggccttaagcgatcagtgggccgcaaataccgccctggcggcaaacaggccgttgagggccgccgggaatccggcatagactgccatctgcatgatcgcttccgtaatctcctcttgcgtcaggccgacgtttaatcccgcggcaatgtgtactttcagctgtggctcggcgttacccaacgccgtgagcgcggcgatggtggcgatttcccggctgcgtaaatcgagccctggcctggcgtaaatatcgccgaaggggaactcaatcagatagcgggcgaaatcgggggcgatatcccgcaggctgtcgacgacggcttccccgcccttaccatccacccgctgaagcatttcctgaccgatgatataacgttcgctggacatcgttttttcctctctgtgatggtgcgttaagaggaagggtagggaagtgtgccggacttgagtaatacccttttcgtgataccttttcagtatgacaacttcaagattacattctctggatattcgcctgctgcgcgcctttgccgtggtagcggaggaaaataacatcagccgggcggcgcagcggttatttatctcgcagccgccgctgacccgccatatccgccatctggaagcgcagctgggggtgacgctgtttcagcgccatagcaaaggcctgatcctgaccgacgcgggtaaagaggtgctggagatgattcaacctctgctggcgctccaggaacgcacgctggcggcattgagtgagctcgccgcccactcgccgcaggctctacgtctgggcgtgacgacggccttcgaacagggcattttcgccgccgttgaggctgcgctgagcgaacatacccgcgcgttgcatatcacccgccacgcctcaccggcgctggctcagcaggtacgcaaaggcaaactcgatgcggcgctggtcgcgttgccgctcaatactgaagggctgcacctgcacccattgccgtatcatgagccgctcattgcggcattacctgcctcctggccggaagccgccaggccagggctgacgttaagcgcgctcaatcatcggccgctgttctggtttaaacgcgagcgtaatcctggtttctttgactacacgcgccgtattttcgaccgggctggctatgccccgacgtatgtggaagagccggccgagcatgatgtgctgctggcgcgtattgcgcgcggggaaggcatgatcctgctgccggcgtccttttccgcgattcagcgtcagggggtggcgttctgcccggtggctgagggcgacgcgatgccgttaagccttggggtgatttatccgcctcaccaggcagagtccgtgcagcaatggctttctctgctggatggcattctggcgactggctagtctcaggctgactcgcgagccaccttatattgcccaccgagccgcttcctgagcgtggccaggtgatcggaagatgaacttttttcaagtaggtgacctattcctcactctttacgcagatttttctattgacgcccgcgcgcttttccgtcatttttacatctggacgtctaaacgtatagaagttcgcaatataacagccattacatgcgattgatgaggtaaggtatgagcttttttcacgccaatcagcgggaagccctgaatcagagcctggcggaagtccagggccagattaatgtgtcttttgaattctttccgccgcgcaccagtgaaatggagcaaaccctgtggaaatccatcgatcgcctgagcagtctgaaaccgaagtttgtttcggtaacctatggcgcgaactctggcgagcgcgatcgcacccacagcatcatcaaaggcattaaagagcgaaccggtctggaagcagcgccgcacctgacctgtatcgatgccagccgcgatgagttgcgcactatcgctcaggattactggaacaacggtatccgccatatcgtcgccctgcgcggcgacctgccgccgggcagcggtaaaccggatatgtacgccgccgatctggtgacgttgctgaaagaggtaggcgattttgatatctctgtcgccgcgtatccggaagtgcatccggaggcgaaaagcgcgcaggcggatttactgaacctgaaacgcaaagtagaagcaggggccaaccgcgcgatcacccagttcttcttcgatgtggaaagctacctgcgttttcgcgatcgctgcgtctcggcaggcatcgacgtggaaatcattcccggtatcctgccggtctccaactttaaacaggcgaaaaagtttgcggatatgaccaacgtccgtatcccggtgtggatgtcaaaaatgttcgaagggctggataacgacgccgaaacccgtcaactggtgggggcgaatatcgccatggacatggtgaagatcttaagccgggaaggggtcaaggatttccacttctacaccctgaaccgcgccgagatgagctacgccatctgccatacgctgggcgtacgcccggcctgagttttcattaacgtttagtgcgatggcgaagccggtattcgccatcgcttttttttgcccaaaacgctgatacaggtcaggggagagcagaagataaagcgcgtatagtgccagcctgataattgacagggatgggttatgcaatggcaaggaagagcgatccactggcgtttggtgggttggcgttattaacgctgatctggagctttagctggatcgcgatgaagcaagtgacgagctatatcggcgcttttgacttcacggcgctgcgctgtatttttggcgccgtggtgctatggatagtgatgttgatccgcggtaaagcgctcaagccgacgcctttcggctacaccctggcaatcgcgttattgcaaacctgtggcatggtcggtctggcacagtgggcgctaatgagcggtggcgccggtaaagtggcgatcctgagttataccatgccattctgggttgtggtgatggccgcgttattcttaggtgagcgcatgcggcgatggcagtatatcgccatcggggtggcatgcgtgggcctgatactcgtacttcagccttggcaactcgactttacctccctgaaaagcgccttgctggcgatcctctccggcgtgagctggggggcaggtgcgatcgtcgcgaagcgtatgtatacccggtatccgcaggttgatttgctggcgctaacgacatggcagatgctatatgccgccgtagtaatgagcgtagtggcctggctcgtcccgcaacgggcggtagactggcagcccgacgttttctgggccctggcttacagcgcaatccttgcaacggcgctggcctggagtctgtggctttttgtactgcgtaatttaccggcaagtatagccggcctgagtacgctggccgtaccggtctgtggcgtgctattttcctggtggctactacatgaaaatccaggaaaggtggaaggttgtggcattgcgttgatagtactggcgttggcgatgatcagtatcaagagacgaggggcatagcctgctccggcctgcagagatgcataaaaaacacccggcatcagccgggtgttttgctctggtttattcccattcctgcaggaagcgctgaccatactggtcggccaccagcagcgcggcgtagacctggtcggaatcaacgccgcccggcatattgtgaatggtttcgccttcagcgcaggcggcttccgccaccagacgcattttggtcgggatatcacctttgatatccagctgcgccagggtgatcggcagcccaacgctgtggcacagcgcggcgacggtctctatttcgtccaccggcgcattttccagcaccagctgcgtcagtgttccgaacgccactttttccccgtgataatagtgatgggcgtcagggatggccgtcatgccgttatgaatcgcgtgcgccgccgcgagaccaccgctttcgaaacccacgccgctcagataggtgttggcttccaccacccgctccagcgccggggtgaccacgtgctgttcggcggccagcatcgctttttcaccctcttcgagtaaggtgttgtagcatagctcggccagcgccagcgccgcctgggtgcacttcccgcccgccatggtggtggcgccgctacgggagcaggcgcgggcttcgaaccaggtagccagcgcatcgccaatcccggcggccagcaggcgggccggcgcgccggcaacgatctgcgtatcgacaatgaccatgttggggttgcgcggcagcatcaggtagctgtcgaattccccttcgtcggtgtatatcaccgacagcgcgctgcacggcgcatcggtggaggcgatggtgggggcgatcgccaccggcacattcataaagtgggccagcgctttcgcggtatccagggttttgccaccgccgatccccagcacggcggtgcacttcgcgttgccggcgatatcgcgtagacggttgatttcattatgcgaacactcaccgccaaacggcgcgatttcggccgccaggccagcgtcggccaggcttttacgcagcatctcttccgcaaaccccaggacgaacttatcaccgaccaccagccagcgctcggccagcggtttcagatagtcgccgaggcgcttgatggcgcctgcgccctggatatatttgcctggtgattgaataatgcgatccatttcgattcctcctcgatgaccgtgacgccgcccgcaggcggctcgcggatccggttacagattcagcgtgccaaaggcgttattccagtcctgttcaaacttctctatggctgactctaccgcaggggtgccgagcatttgttgcgctacatctagtggaagggtgattgcttcgcagccagccagcagacaatccagcgcctggcgtggcgttttgaagcttgccgccagaactttgctctcgggcgcatgcatttccagcagggattgcagctcctgcaccatgcggatgccgtccccgccctgggcgtcgacgcggttaacgtaaggcgcgacgtactttgcgccggccagcgcggccagcaggccttgcgaagcgctgtagacggcggtgccaagggtcgggatgccttctttcttcagcagtttgatagcggcgagcccttcggcggtgaccgggattttgaccacaatgcccggcacggcattgctcagacgtttggcctcttccaccatgccctgcgcgtcgcggctcatggtctgcgcgaagagggtgccctccggaccgacggctttttgcaggcgcggcagcacatcccagaccgggactttaccggcggcgataatgctcgggttggtggttaccccggccagcgggtagatgcgggccaggcgttccacttcggcgacgttggcggtatccagatagagttccattgtgttttcctcaatgcttaattcggtgctgtcgttgaggtaagcatacggctttcgttcgaaggatcgccagatgacaaatttgccaaaaactggataaatgtacgcatcgtgattaaggatgatttagatcacatttatcggcgctggctgggatgggaggttactatagcgcgcacaaaagtcaggtttaacacacaaaaatctagttttttaccggggatgctttttccgtcagctggctatggtactggcggcggtattcagacggcgagcgttccgtagttttgcggaacaggcggcagaagtagttgctgtcggcgaagccgcaggcgtgggcgatgtctttcactttcatatcgtggcccttcagcagcatacgggcctgttcgagacgaatatggtttagatattcattgaagcccattggcccacatttctggaacagatgggaaagatagttgggagagaggtagaacgcctgggccaccgattcccggctcagcggttccgcataatggatgtccatatattggcggatcgcttcaaacaacgcctggctgcgcgaggaggtttgcgcctggctgccgagaagatcatggcagtggctgagcaggctgacgacgatgctgcgggcggtttgctgctcctgcggttgcatccggagttcattgagcgcctgcagcagaaatgatccgacgcgcggcccgcggcgcagcgcctgccgcttgtcgacaacagttatcgccttgccattccagtgctgcagcgagcactccagctgctgcttagcgaacaggatgcttaacagcaggcaaggcgcttgccactgcgggcagttccagctatcgccaggaatatagagcacgtcgttggcttcgaggggaggggcgttatcgccgagcgcctggtcgggcaactgcccatcgaggaggatattcagacggggaaaatccacctgcaccaccggctcagcaggcgagcgcgtctcgccggcgaaataaacccggccgaggctggtctgcttttttagcaatgcatcaataagttgattgatatcgttgtccatcattcttccgttcagcgcatcacccttttcatcataccggacattattccagcggtaaaagcgcttgcctgtcgctcttgcctcccagacaaggtatgttatatcgtaacaatttgtcgccattgatagcaaactcaggagagagtaatgaccagaaagatccccctgctggccttaggattcggcatggctttagccagcgcccaggcgttcgcccacggcaaccatagccatggcccggcgttaaccgaagtggagcgtcaggccagcgaaggcatttttgcggataaagatgtgcaggaccgcgcgctgagcgactgggaaggcgtctggcagtcggtgaacccgtatctgctcaacggcgatctcgatccggtgctggagcagaaggcgaaaaagcccggcggcaagagcgtggaggagtatcgcgcctattataagaagggctacgccaccgatgtggagcagattggcattgaagatgacgtgattgagttccacgttggccagaccgtcaatagctgcaaataccgctattcaggctataaaattctgcattacgcctccggtaagaagggcgtgcgttatctgttcgagtgccagcagggcgatgccaacgcgccgaaatttgtgcaattcagcgaccatatcattggcccgcgtaaatcacagcatttccatattttcatgggcaatgaatcacaggaggcgttgctgaaagagatggataactggccgacctattatccgtatgcgctgcataaagaacagatcgttgatgagatgctgcaccactagaacgggcggaaaacccccggccgggcggccggggagagatagattaaccggtgttacgcataccggcggcgacgccggcgatggtgaccatcagcgcttgttcaacgcgcggatccgggtccttgccctcttcttcagcctggcgtgaacggtgcagcagttccgcctgcaggacgttcagcgggtcggtatagatattacgcagctggatagactcggcgatccacggcaggtcggccatcagatgggagtcgttggcgatggccagcacgacgttgatatcggcagccagcagcttgcgcagctcggaacccagcgcccacagctccggcttcaccaggcgctgatcgtagtactccgccagccacaggtcggccttcgagtaaaccatctccagcatgccgaggcgggtagagaagaacggccagtcgcgacacatggcttccagttcactctgttttccaccttcgaccaccttctgcagcgcagcgccagcgcccagccaggctggcagcattaggcggttctgggtccaggcgaagatccacggaatggcgcgcagcgactcgacgccgccggttgggcgacgttttgccggacgcgaacccagcggcagtttgcccagctcctgctccggggtcgcagagcggaagtaagggacgaaatctttgttttcacgcacgtagccgcgatacatcttgcacgacacgtcggacagctcggccatgatgtcgcgccattctgctttcggctccggcggcggcagcaggttggcttccagaatggcgctggtatacagcgacaggctgctgatggtgacttccggcaggccgtacttaaagcggatcatctcgccctgctcggtaacgcgcaggccgcctttcaggcttcccggcggctgcgagagcagcgcggcgtgggccggcgcgccgccgcggccgatagagccgccgcgaccgtggaacagcgtcagttcaataccggctttttcgcaggttttgatcagcgcgtcctgcgcctggtactgcgcccaggaggcggccatcacgccggcatctttagcggagtcagagtagccgatcatgaccatctgcttgccctggataaagccgcggtaccagtcgatattcagcagctgggtcatgacgtcgttggcgttgttgaggtcatccagcgtttcgaacagcggggccaccggcagagcaaagccaatcccggcttctttcagcaggagatgaaccgccagcacatcggacggcgttttcgccatcgagatcacgtaggcggcgatcgatccgcgcggcgcctcggcgatcaccttgcaggtgtcgagaacttcacgcgtctcttcgcttggctcccactggcgcggcagcagcggacgtttggaattcagttcgcggatcaggaaagcctgtttgtcggcttccgaccagctttcgtagtcgccgatcccgaggtaacgggtcatttcacccagcgcttcggtatggcgggtgctttcctgacgaatatcaatacgcaccagcggtacgccgaaagacttcacgcggcgcagggtgtcgagcagctcgccgttggcgataatgcccatgccgcaggcctgcagcgatttatagcaggcgtacagcggctcccacagctgctcgttctgagtgatcagtcccgccggtttcggcagcttctggcctttcaggcgcgcttccagccaggcctgggtctccatcagctgagagcgcagttttttcatcagataacggtaaggttcctgagcgccctcggcgccagccagggcgcgcagctcgtcggtacactccaccatcgacagctcggagatcagcacctgcacgtctttgaggaacaggtcggtcgctttccagcggctgagcagcagcacgtggcgggtgatgtcggcagtcacgttcgggttgccgtcgcggtcgccgcccatccacgaggtgaaacgcaccgggacgaagtccaccggcagctgatagccaaggttggcttccagctgttcgttcagctcgcgcagatagttaggcaccccttcccacaggctgttttccaccaccgcgaagccccatttggcttcatcgaccggggaagggcggtgcttacgaatttcatcggtatgccacgactgggcgatcagctggcgcagacggcgcattagctgatggtgctcgtagtcagcgatatctttgttgtccaactgcttaaggcagttgttcacttccaccattttatggatcagcgtccggcgggtgatctcggtcgggtgggcggttaacaccagctccagagacagcgattccaccgcttgtttgatggtctcttcgttgagattgggttggtctttgagctttctcagggtacgcgcaatgacttccggattgctggccgcttcgccattggccgaaatgctgtggtactgctcagcggtgttggccagattcagaaactggctgaaggcacgggccaccggcagcagttcgtcgtttgacaaattctgcagcgtggtcagcagctcctggcggttagcttcgttgccggcgcgtgaagatttggacaacttacggatagtttcgacacgatcaagaatattttctcccaatgcatccttgatggtatcgcccagcaccttgccgagcatactgacattactacgcaatgcggaatattgttcgttcatgttaccccagacaccccatctcattttattttgttatatccgctgcgctggaacgtgagcaacggataagcaacccgtcttttataaagccacgtaaatacccccacgtcaattactgcgaaatcgcttcagcaaacgagtaaatcgccgtaatttgcgaaatttaattcagggagcgctggataagtatcgcttatggaaatgtgacgatcgtcaccgttccgccccgggagaacggggcggaaaaagagggcgattttagtgccagcagaagtgatgaaccacctggctaatcagctcccgggtcggcttgataaagcgcgtctccagatactcgtcaggctgatgggcctgattgatggagcccgggccgagaaccagcgtcggacatagcgtctggataaacggcgcttcggtgcagtagttcaccacgtcggtctgcgcgccaagcagtttctcgaccacctgcaccagcttatggtccggcgggcactcgtagccggggatcggcggatgcagctcagagaccgtcaggcggcccggccagcgttcgctgaccggggccagcgcctcgcccaacagaccattaagatcgtttagggtcatccccggcagcgggcggatatccatatgcagttcacagcaggcgcagatacggtttgaggcatcgccgccatggatagcgcccaggttgagggttgggtaagggaccgtaaacgcctcgaagtgatagcgctctttaagcagatcgcgcaactgcataatccggccgatggcgtcgtgcatcagctcaatcgcgttgaccccgcgcgccggatcgctggagtggccggactggccctgaatacggatcgcgttggacatatggcctttatgggcgcggatcggctgcagggaggtgggctcgccgatgatggcgcagtccgggcgcagccgggtggtttcggcaaagtagcgcgcgccggccatgctggtctcttcgtcggcagtggccagaatatacagcggctttttcagcgtggtgacgtcgacatcgcgcagggcgtcgagaataaaggcgaagaagcctttcatatcggccgtgccgagaccgtagagcttgttatcgtgttcggtgagggtgaacgggtcgcgcgtccagcggccatcatcgaacggcacggtatcggtatgcccggcgagcagcaggccgccggcgccgtgtccggtgctggccagcaggttgaatttatggcgcgtatccggcaccggctgtatctcaacattgaagccgagatcgcggaaccagcctgccagcaaattgattaaagactcattgctttgatcgagagcctcttcagtcgcgctgatggacggtgtggcgatcaacgcgcggtaaatctcgataaagggcggtaaattgtttttcattgttgacacaccttgggtcgtgatagtatcaatattcatgcatttattgtgaataaaaatacaatatcgttgagcgtaagaaaacccatcgaatgtaaggagatgcgcttccaatgttaaatacgctgattgtgggtgccagtggttatgccggcgcagagctggtgacctatatcaatcgtcatccgcatatgaacataaccgctttgacggtctccgcgcaaagcaatgatgcgggaaaattaatttccgacctgcatccgcagctcaaaggcattgtcgatatgccgctgcagccgatgtccgatatcagcgaattcagcgctggcgtggacgtggtgtttctcgccaccgcgcacgaagtgagtcacgatctggcgccgcagttccttgccgctggctgcgtggtgttcgatctctccggtgccttccgcgttaacgatggggcgttctacgaaaaatattacggtttcactcatcagcatcccgacctgctcaaacaggcggtgtatggtctggcggagtggagcgcggatgcgcttaaagacgcgcagttaatcgcagtgccaggctgctatccgacggcggcgcagctgtcgctgaagccgctgattgaggccaatctgctggatctcaaccagtggccggtaatcaacgctaccagcggggtgagcggcgcgggtcgtaaggccgcgatcggcaacagcttctgtgaagttagcctgcagccgtacggcatatttaaccatcgccatcagccggagattgccagccaccttggggcaaaggtaatttttaccccgcacctgggtaattttaagcgcggcatcctggaaactatcacctgccgcctgaagccgggcgtcggccatgcgcagatcgcggcggtttaccagcaggcttacgccgataaaccactggtacgtttatatgataaaggcgtgcccgctttgaaaagcgtcgaaggcctgccattctgtgatatcggttttgccgtgcaggacgatcatctcatcgtcgtcgcggcagaggataacctgctgaaaggcgccgcagcgcaggcggtgcagtgcgcgaatattcgtttcggcttcgctgagacgcagtctcttatttaaggtgtgatgatgaacccattaattatcaaacttggcggcgtattactcgatagcgaagaagcgctggagcgcctgtttaccgcgctggttaactaccgtgaagcgcaccagcgtccgctgattatcgtccacggcggcggctgcgtggtggatgagctgatgaagcagctcaacctgccggtgcagaagaaaaatggcctgcgcgttacgccggctgagcaaatcgacatcatcaccggcgcgctggcggggaccgccaacaagacgctgctggcgtgggcgaaaaaacatggtatttcctcggtaggcctgttcctcggcgatggcgatagcgtgaaggtgacgcagctggatgctgagctgggccatgtcgggctggcgcagccgggctccccgacgctgatcaacaccctgttggccggcggttacctgccggtggtgagctctatcggggtgaccgatgaaggccagctgatgaacgtcaacgctgaccaggcggcgacagcgctggcggccaccctgggggcggatctgatcctgttgtctgacgttagcggtatcctcgacggtaaagggcagcgcattgccgagatgaccgccgagaaagcggagcagctgatcgagcaggggattatcaccgacggcatgattgttaaagtgaatgcggcccttgacgccgcacgtgctctgggtcgtccggtggatatcgcctcctggcgtcacgccgagcagctgccggcgttatttaacggcacgccgatcggcacacgtattctggcttaagatttcatgcccggcggcgcgtcgtctgccgggcttacaagaccgtaggccgggcggcacaatgccgccggcggaactaacgaataaaggaagcatgttatggcactttggggcgggcgttttacacaggcagcagatcaacggttcaaacagttcaacgactcgttgcgcttcgactatcgtctggcggagcaggatatcgttggctctgtcgcctggtcgaaagcgctggtaacggtcggcgttctgagtgccgctgaacagcagcagctggaagaagtgctgaacgtgctgctggaagaggtgcgcgccaatccgcagcaaatcctcgccagcgatgccgaagatattcacagctgggtggaaggcaagctgatcgataaagtgggccagctgggcaagaaactgcacaccgggcgcagccgtaacgaccaggtcgccaccgatcttaaactgtggtgcaaagataccgttgtcgaactgctctcggcgaaccgccagctgcagagcgcgctggtggagaccgcccagcagaatcaggacgcggtaatgccggggtacacccacctgcagcgcgcccagccggtgacgttcgcgcactggtgtctggcctacgttgaaatgctggcgcgtgacgaaagccgtctgcaggacgcgctgaagcgcctcgacgtcagcccgctgggctgcggcgcgctggcggggacggcgtatgaaatcgaccgcgagcagctggccggctggctgggctttgcctccgccacccgcaacagcctcgacagcgtgtccgatcgcgatcatgtgctggagctgctttccgatgcggctatcggtatggtgcatctgtcgcgctttgcggaagatctgattttctttaactccggcgaggcgaacttcgtcgagctttccgaccgcgtgacctccggctcctcgctgatgccgcagaagaaaaacccggacgccctggagcttatccgtggcaaatgcggccgcgtgcagggtgcgctgatcggcatgatgatgacgctgaaaggactgccgctggcctacaacaaagacatgcaggaagataaagaggggcttttcgacgccctggatacctggctcgactgcctgcatatggcggccctggtgctggacggcattcaggtaaaacgcccgcgctgtgcggaagcggcgcagcagggctatgccaacgccactgagctggcggattatctggtggcgaaaggcgtaccgttccgcgaggcgcaccatattgtcggtgaagcggtagtggaagccattgcgcaagggaaaccgctggaagcgctgaccctggccgatctgcagaaattcagcccggtgattgcggacgatgtgtatccgatcctgtcgctgcagtcctgcctcgagaaacgcgcagcgaaaggcggcgtctcgccgcagcaggtagcccaggctatcaacgaggcgaaggctcgtttaagctaatccttagatatctgccctccctgacccggccaagcccagcgacgccgggttttttatgcaaaaaaaaagcggacgcaaggtccgcaaaagttcacgttggctttagttgttcgggtagagaaacagtgtgacgggtcagtgattttcacaggtagaccgtctttatgggcgtattattgaacagaaaacttgatagggataatcgttcgttgctatgctatctatcgccatggactatcgtggcgatggaggatgaataatgaatattcgcgatcttgaatacctggtagcgctcgccgaacaccgccacttccggcgggcggctgactcatgccatgtgagccaaccgacgctcagcggacagatccgcaagctggaggatgagcttggcgtcatgctgctggagcgcaccagccgtaaggttctgtttacccaggcggggctgttgctggtggatcaggcgcgtaccgtgttacgcgaagtaaaagtgctcaaggaaatggcaagccaacaaggggaaaccatgtccgggccgctgcatatcggcctgatcccgacaattggcccgtacctgctgccgcacatcattccgatgctgcatcagaccttcccgaagctggaaatgtatctgcacgaagcgcagacccatcagctgctggctcagctcgacagcggtaagctcgactgcgccatcctggcgctggtcaaagagagcgaggcctttatcgaggtgccgctgttcgatgagccgatgatgctggctatctatgaagatcatccgtgggcgaaccgcgatcgggtgccgatgtcggatctggccggtgaaaagctgctgatgctggaggatggccactgtctgcgcgatcaggcgatgggcttctgctttgaagcgggggcggatgaggatacccacttccgcgcgaccagcctggaaacgctgcgcaatatggtggcggcaggcagcggcattaccctgctgccggcgctggcggtgccgcaggagagaaaacgcgatggcgtagtgtacctgccgtgcattaagccagagccaagacgcaccatcggtctggtttatcgtccgggctccccgctgcgcagccgctatgaacatctggcggaggccatccgcggtacgatggatggccatttcgacaaggcgttaaaacaggcggtttaagccgttcagcgcggcaacccggtacgcttccgccatggtcgggtagttaaaggtggtgttgacgaagtactcaatggtgttgccaccgcctttctgctccatgatcgcctggccgatatgaataatttcggccgcgcgctcgccaaagcagtgaatgccaaggatctccttggtttcacgatggaacaggatcttcagcgtaccaacgctcataccgacgatttgcgcccgcgccaggtgtttaaactgggcgcggcccacctcatacggcactttcatcgccgtcagctgctgctcggttttcccgacggagctgatttccggaatggtatagatcccggtcggaatatcttcaatcagatgcgctgaggcttcgcctttcaccagcgcctgggcggcaatgcgtccttgatcgtaagcggcagaagccaggcttggatagccgatgacatcgccaaccgcatagatgtgcgggagggcggtctgatacatgctgttgaccttcagctgaccgcggctgtcggtctgcagaccgatattttccagcgccagggtgtcggtgttgccggtgcggccgttagcgtacagcaggcaatcggccttcagctttttgccggacttcaggtgcatgatcaccccgtcatccaccccttcaattttctcatactcctcgttgtggcgaataaccacgccgctgttccagaagtgataagagagcgagtctgacatctcctgatcgaggaaggccagcagacgatcgcgggtgttgatcagatcgaccttcacctccatgccgcggaagatcgacgcatattcacaaccgatcaccccggcgccgtaaatgatcacatggcgcggctcatgctgcaggctgagaatcgaatcgctgtcatagatgcgcgggtggtggaaatcgacatccgccggatggtagggacgcgatccgcaggcgataacgaatttctccgcggtcacagtctcgaccgtgccgtcatggcactccagcgccagagtatgctcatccacgaagtgggcattgccctgcagaatttcacagtggttgcgctcatagaatccctggcgcatatgagtctgctggttgatgacgctgtcggcatggttaaggatgtcggcgaaagaagagcgaagaaggcgggagtggtcgctgtagagggggttttggttaaactcgataatacggctgacggcatggcggagggctttcgacgggatggtgccccagtgggtgcaaccgccgccgacattatggtagcgctcgatgacggcaacgcgtgctccctgtttcaccagtcccatggcggcgccttccccgccaggaccggaaccaatcactattgcatcataatcccaagagtgtgacatggcattactcacctgttttatacataaaataaacacgatgataacattcgctgcgctttaacccaattatcgttgtgcttttttgcagcataaaagcagaaacggctcgtaaacaatcattcacaatccagggcaaaccgattagttttaatctctggtatagtgccagcagggctattggaaggattcatacatcgtgatgggcgtaagagcacaacaaaaagaaaaaacccgccgttcgctggtggaagcggcattcagtcaacttagcgctgagcggagtttcgccagcctgagcttgcgtgaagtggcccgggaagcagggatcgcgccgacgtccttttatcgtcattttcgcgacgtcgatgagctgggcctgacgatggtcgatgagagcggactgatgctgcgccagctgatgcgccaggcgcgccagcggatagccaaaggcggcagcgtgatccgcacctcggtctccacctttatggaatttatcggtaacaacccgaacgccttccgcctgctgctgcgcgagcgctcgggaacttctgcggcgtttcgcgccgccgtcgcacgcgagatccagcactttattgcggaactcgccgactatttagaactcgaaaaccatatgccgcgcgcctttaccgaagcgcaggctgaagctatggtcaccatcgtttttagcgctggcgcggaagcgctggatgtcggccctgagcagcgccggcagctggaggaacggttggtactgcagcttcgaatgatctcgaaaggcgcgtattactggtatcgccgtgaacaagaaaaaatgtcacatcattccgaataacgtgaaggacgagcaatgaaacactcagttcaagataaaggtacgctgctgctggcgctgattgccgggttatccattaatggcgcctttgcggcgctgttcagttcgatagttccgttttccgtcttccccattttatccctgctgctgacggtctactgtctgcatcagcgctatcagaatcgcagtatgcccgttgggctaccgggcctggccgccgccttttttattctcggggtgctgttgtacagcaccgtcgtgcgtgcggagtacccggatatcggttctaacttcttcccggccgttctgtccgtcgcgatggtcttctggatcggctacaagatgcgtaaccgcaaagataccgcagccgagtaagccgcaagcggtaaaaaaaccggcaatatgacgttgccggtttttttgggcctatttgcgggtcagcaggacgccgcactccatgtgatgggtatacgggaactggtcgaacagcgccagccgggtaacgttgtgcgtctggcttagcgtttccagattgcgacacagcgtttccgggttgcacgaaatgtacaaaatacgcggataggcctgcaccattttttccgtctcgctgtccagcccgctgcgcggtggatcgacgaagatggtttcgcactgatagctatgcagatcgataccctgcagccggttgaactgccgcaccccgttcatcgcctgagtaaactcttccgccgccatgcggataatctgcacgttgtcgatatggttagcggcgatgttgtactgcgccgccgccaccgacggtttggcgatttcggtggccaatacgcgatcgaaattacgtgccagcgccagcgagaagttaccgttgccgcagtacaattccagcaggtcgccagtcgcccctttggtgacatccagtgcccactccagcatctgaatgttcatggccgcgttcggttgggtaaagctgttttccacctgacggtagatcatctcccgcccgccaaccggcaggcgttcatctatataatcctgatcgagctcgattttagttttggtcgcccgcccaatcagatgcacattgagcccctgggctcgcagggcgtcacgcagcgcctccgcttgctctcgccaggcatcgtccagctttttatgatacagcagcgaaacgaccgcctggttgctgagggtggtcagatagtcaatctggaacagcttctggcgtagcacgggattgttgcgtacgccctccagcatggcggtcatcagctgattgatcagcgcgctggcggccgggaagctgtcaacgcgaatccgcgaccgggtctgctgatcgaaaataatatggtacagatcgtcgccatcgtgccacagacggaactcggcgcgcatacggtagtggctgaccggcgaacgaaacacttccggaaccggcgcggcaaaaggcgccatcatggtttgcaaacggacgactttttctgccagctgcgcttcgtattgttcggtaggaaggtgttcgggggtcatgatgtatcctgaataaaataagtacgcggggattgtagggaaagcgccggggatgtccagcctcgaatgccgcgggaaatataattagcagtctggacatctatatggttctgattgtagcattcgcctaccggtcctgtgagttaaaagggaacccagtggaaatctggggctgacgcgcagcggtaaggaaggtgagaaatgagcgcactcggtgcagacactgcggctagccgtgggaagtcattatttcttgaaacagcctccaagcccgaagacctgccggaatacgtcgcactgggttttatcgtcgcgagcaactgataaaacctgcggcatcctttttctgtttcggatgcttttacaatgattaaaaaagcttcgctgatgacggccttatccgtcacggcattttccggctgggcgcaggatagcaattcagatacgttggtggtgacagcaaaccgttttcaacagccggtcaataccgtgctggcgccgaccgacattgtgacgcgcgatgacatcgaccgctggcagtccaaagatttaaacgatgtcatgcgtcgtcttcccggggtcgatattgcccgcaacggcggcatggggcagagcgcttcgctgtatgttcgggggacggaggctcgtcacgtgctggtgctggtcgacggtgtgccgatggcgcgtccggggatctccaacggcgtagatatcagtcagatccctatctcactggtccagcgggtggaatacatccgcggcccgcgctccgcggtgtacggctccggagcgatcggcggggtggtgaacatcatcaccatgaccgacgctgagcgttcgcagatcaacgccggcgcgggtacgaacggctatcagtcctatgacggcgcctttaacaagcggtttggcgatacgttggttaccgctgctggcgcctatcagaccaccaaagggtttaacgtccagccgaattcctcttacagcggcgacagcgatcgcgacggctaccgcaataaaatgctgtggggcggggtacagcatcagttcgatgacaacttctcggggttcttccgcggctatggttattccgccaacgctgactatgaccagggtaactggggctacgcaggtggaaacgatgaagatcaatcctatacccaatcctgggataccggtctgcactaccactccggaatttactcctcccagctgattgctaactatcagcgcatcaaagattacaactacagcagcgacgctggccgctatgccgcgggcaccaccctggatgatatggaacagcgctatatccagtggggaaataatgttgtggtaggccatggggcagtgagcggcggcgttgactggaaacaagagaagctgaaatccagcggaacgaccagtaccgacgtgtataagcgtgacaccaccggtctttatctgacgggacagcagcagattgacagcgtgacgctggaagcttccggccgtgaggatcatgacgagcagtttggctggcacggtacctggcagacggccgcaggctgggaatttatcgacggttatcggacaacgctctcgtacggcacaggattcctcgccccctccctcgggcagcagtacggtgcagaacgctttggcatcgcctctaacccgaatctgaagccagaggagtcgaagcaatgggaagcgggccttgaagggttaacggggccggtcgactggcgcctctccgcatatcgctatgagattcaaaacctcatcgattacgacaacaacgcctattacaacgtcaagtcggcgacgattaaggggctggagtggacggggaatataaccaccgggccggtggagcaccatctgacgctgcagtatgttgaccctcgcgatgatgaaaccaataagatcctctatcgccgggcgaagcagcaggtgaaatacgagctgaacggccaggtctacgatctggggtgggatgtgacgtatcactacatcggcaagcgttacgattatgactacgacaactcgcgtaccgtcaatatgggtgggttgagcctctgggatgtcggtttatcgtatcccgtcacctcacacctgacagttcgtggtaaaatagccaacctgttcgataaagattacgagacagtttatggctaccaatctgcaggacgggaatacaccttgtctggcagctacaccttctgatccacgtcccaccgtgctggtgtttgattccggcgtcggtgggttgtcggtttataatgagattcggcagctgctgccgaatctgcattacatctatgctttcgataacgttgccttcccctatggcgagaagagcgaggagtttatcgttgagcgcgttgtggaaatcgtcaccgctgtccagcagcgttatcccctggcgctggcggtgatcgcctgcaataccgccagtaccgtctccctgcctgccctgcgtgaaaagttcgctttccccgtcgttggcgtggtgccggcgatcaagcccgccgcccgtttaacggcgaacggcattgttggcctgctggcgacgcgcggtaccgtaaagcgtccttatacccgtgagctgatcgaccgctttgccaatgaatgtcggattgaaatgctggggtcggcggagctggtggagctggcggaagcgaagctgcacggcgagcctgtgccgttagaagagctgcgccgtatcctgcgcccatggctgcggatgcaggagccgccggatacggtggtgctgggctgcacccactttcctcttttacaggaggagctgcagcgcgttctgccggaaggcacacggctgatcgattccggcgcggcgattgcccgacgcaccgcctggctgttagagcatgaagcgccggatgcgaagtccagcgacgagaataaagcattctgcatggcgctgacggcagaaacagaacagcttttacccgttctgcgtcgctatggcttctcgacgctggaaaaattaccgctctaagggcgttttgcacaaaaaagagacggttgaataattttttgaaaacagggcttgtcaacgtctcagaactccctataatgcgcctccactgacacggaacaacggcaagcaagccgccgggtcagcagggttttagcggtgaagttcagcgctaaaaactgacagagaaaagcaaaataagggcttgactctgaatgaggaaaacgtattatacgggacctcgcaacggtgagctgaaagccgcgttgcaactgctctttaacaatttatcagacaatctgtgtgggcactcaaagtgacatggattcttaacgtcctcggacgaaaaatgaataccaagtctcaagagtgaacacgtaattcattacgaagtttaattctttgagcatcaaacttaaattgaagagtttgatcatggctcagattgaacgctggcggcaggccta

SEQ ID NO: 72 - DNA, 96846 bp, Unknown
  source: /note="Description of Unknown: KP2-Mcoc1 Bacteria Sequence"
gctttattgtaggtgggccagttggtgattttgaacttttgctttgccacggaacggtctgcgttgtcgggaagatacgtgatctgatccttcaactcagcaaaagttcgatttattcaacaaagccattttgggactggatattcctctctcaactatctaagagaatttccatttgatgcgattaagttagacagaacattcattagtggtattgcccacgttgcacgggacttatctattgtaagaagcatagtgtctcttggaaaagctttcagtttaggtatagtcgcagaaggtgtggaaaataatgaacagtttgaattgctaaaaaatatgaattgcgatgaatttcaaggttattattattcgaagcctttgtcaggtgatcaactgattgattttttgaggggccaaaaaaaatagggctgtatgtcctattttttcatatactatcgttttccctttttaatttcatacattctttcgtctgcatcctgcatgatagcagagcattcagtatgaatttcctcatcatattcaataatccctgcagaaaaatctatgttgtattttttttgagaattaagattgtagctggtaatcccggccctcaatttatgaaggaattcttctgcttctttataggttgactcgggtaatagaacaccaaattcatcacctcctaatcttgcaacaacgctttttgaactactaagatcttccagcatatctgcaaaattgcaaagtacttcattaccttctgaatgaccgaagttatcattgattggtttaaaattatcgagatctatgatcagaacacagaatgtttttttcttttttttggcttttcttaacgattcatccgtcattagggcgaaagaacgccggttacatatacctgtcaaaggatcagtagttgcttcgtttattattctaaactcatcctctacgatttctgctaaatctttaagcaataagaagtcatctctggttaatactcttggttctgtatcaataatacatattgttccagctatctcaccatctggcagtcttacgggatgccctgcataaaaccggatataaggatcatttttaactaatttattttctttgaatcttggatcaaggcttgcatcgggcactattaatggttcactaagatctactgctattgtacaaaatgaatcacttctatctgtctcttttatcttcagcccataacatgacttaaaccattgcctgtctctatcaattaatgaaacaagtgctattggtacatcaaagagtttggtggcaatcctcgtcaatctgtcaaatcgttcttcatattttgtatcaaggatccccatagaatataatgataataacctgttctcttctttatggtttgtcataattttcatcttgagtggttattgcagggtagtgttggttatcgctatcttatcagaattgtcctggaactcaataatcccaatatctcataatcatataaaacttaacaagtttccaataaatcatgatgaatagtgaactgttacatctaatcatctgtgacctgaagcgctcattatacacttccatgtattcagaatgcataatgatttgtatattaaaaatcgccataacttacaatgacttattttttgtggcacaattaaagcgcatctgttcaaataaatgtaaagacattaatgcttgatcttcatggtttcttatgaaaaccagtggctgaagaaacgtatggcagttctgaatctgaacaagacgagacggcatgaaaggttcaagaaaattgtccaggaaggtacatagtttccttatccaatattttctactgagggtatattgtatcagcttaagacaggaactgttgatacagaacagaaaagttcaacacagcctgaatctgcgcgacgctaaattttttccttctggcgaaccaacaaacagcccgtttatagagagattctgcagacgacaaaaggattaatccctgaaattgcactgaattgtcacctgaagatgtgcaggacaagccagattactcttacaagggataccatcgtaatttagcaaaaacacctaagacctaaacgacagctaagtacatagtgccggacggatcatgattttttatttaacttacggacttcatttttcagcaattatcttttctcttctgttgtaaacttatgaaagcgttacgcgaaatcccgcaaggttacaggggtgtaccaggccggaaatcgcgtagcgctctcttctcttctgtttcctgcctaacatgtacatcctggcattactccaattctcccaaaaaccgtaaaacagccatcaacccgcgtcattactggcttcatggaggatctgagcagaaaaaggatcctttacgtatttggttttacccgcaataatgcgggataagacaacaaaaggatccgcgcgctgcgatttattgtcatggcaggatcggcccgtcaggtgcaaaatacctgtatccataaacagtgcgtgcgctacgtgaaaaataactcatgaacagcatcattcccctgcagaattcaccagaacgcgtctccctgctgccgatcgccccgggcgttgattttgcgaccgcggtggcactccggcggatggccacctcaacaggtgccacgccggcttacctcctggcgccggaagtgagcgccctcctctggtatatgcctgaccagcgtcaccacatgttgttcgccaccatgtggaataccgggatccgtatcggtgaagcccggacgctcaccccggaatcgttcgacctggatggtctgcgcccgtttgttagggtgctgtcggagaaagtgcgcgcgcggcgcgggcggccaccaaaagatgaagtgcgactggtgccgctgacggatgccagttttgtgcgtcagatggaaagctggatggtcaccacccgcccccgccggcgtgagccgttatggccggtcacggatgagacaatgcgcaactggctgaaacaggcggtgaagcgggctgaagctgacggcgtgcatttttcgatccccgtgacgccgcatactttccgtcacagctatattatgcacatgctttatcaccggcagcccaggaaggtcatccaggcactggccgggcataaggatccgcgctcgatggaagtctatacccgggtatttgcgctggacatggctgccaccctggccgttccctttaccggtgacggtcgcgatgccgcggagatccttcgctccctgcccccggccggctgagattggcacgcctggcatgacgtcctgtattccgctaatacggaatacaggagcagagcgcattcagccccctccctgctccagcacaccagtccatcatgctgatgactgaaccgccgtggtcttacccggtgacctgcaatcctgcaggcatcaacataccgcagacaagacagggcacaatgcaggcattctggccgtgcatcccacggtgcgttatttcctgaaagctcagcgaatcatcccgttaactgcgacagtcattgaccatctgtggcccacatttttctgccatccggctcccgtttcctgatcgcatttagcagcgtgaagctggcgccgggttatacaaacagctgcagtctcatcctgccgggctaaatctgcagtacacaggggaacggataccatcaggtaacatgaccgtctcagcatccgattgagatcttcgtaaggggtatagagctttactgaaaaattgactgtggcatgttatcacccatgaaatagtgaacagaccagggaatacccccgttaaacccgcatgccgtagtcaatatctgcgtatcaagacccgaaatcacatattacagtcaatattgttcgatccgggcagacatgatagagaataaatattgactgcggtatgcgtgatgcatatcacagtcaatggaatgtccttagcggcatacggcagtcatgatatgcatatcgcagtcaattttctggcttcatcgctgagagggcttcagccagtttaagaggatcgatgcccgcagccttcagcgccttaatgacttcgtcataattttgctctggcgccttctcttcttcctcattgcgcggaaccttcacagggccactgatgagtttggggttgcgataatgcacgctgaaataggtggctcggccacgtttaaactcggtgtaatccagataaccaatatcccgcagctgctccatcgccttacgcaccgtgtggttctgcgtatagacatttgaggtgagattcagccgctcacgcatccgtttcatggaaataggtgcaggattctggggaagactttcgatgtaggtataaagcgcctgggctgattccttgcgctgcagggcgtcaatggctttcagccgcagcagtacccttctgtccatgtggtaaagctcaaacagcttaggttcagccttgatctcaacgatatcctcgttgatgtcataataggctgactgcaccagatgggtggtccatcctttggtctcgctctggaacttcaacgtaaccgaggcgagtttaaacagggaattactgatgcgatcgcgcatttttttgtttgaacgacgggagtcaaatccgcacatcttaacgaattcgacgaacgacagttccagggtgtcactttttaccccatactccgacatggagcgaattatccccagccagactttaaaatccgtgtccatatcaagacgcgaaccggtgatcttaacgtcagtgtacccttcgcttttggcaatggacagctgtacaagctcctcagtcgcgtctgtaacgtttttccggttcgccttgctcttccctgttgatttcagagttgggacgaagagaccgagtctcatgagcgctactggctgcacggtactggtgctgttgacatccagcttaacaacttcgccggttgtcttatcaacttcctgaaggttcagaagtaagctgttattttcgctcgtcatcttgatcctcaacggttatccacaaaaggatgtagtaatacgtatcgcagtcaacggatatacatacctctgtaaataccgttgcatatcacagtattagattatgcatataacagtcaacattttacattccgcagtcgatccagacagacgttaaagccagttacagcgcatgctggagcgatccggggatctcttttggatctcactatgatctccttgggatcaattattggatcgagaccatgaataacccagatacaaggccggaagcgccataccagatatccagaaccctggcctgattttcctgaatacgctctggaagattgagatctacaggtacaacaatgaaacattgactgcggtatgctgagtcgtctttcctctttctcgacacagatgcggtaagcatcataccatagtcaatatattacataccgcagtcaatttcattataactggcttatccagagccatctttagcaacccgacgtacgtgcaatctgtgaattctgtgattttccgcttcctcgccgctttctcactccgtgagatcgcttactgcggcgagcggcagtgattaatattgactgcggtatgtactcttttgtaatcccctgcgttctttgcatcacccaatgcggttcactttgcactttttcgtgcactttgcgtttttattgttgctttgcaataaattccaagatttaataaaataatgcaaagtgaagattaaaggatgttcagtatgggactcatggatacactcaaccagtgcataagtgctggtcatgaaatgacgaaagcaatcgccattgcgcagtttaatgatgacagtccggaagcccggaaaataacccggcgctggaggattggtgaagcagctgatttagttggcgtgtcatctcaggctatcagggatgccgagaaagctggccggctgccgcaccctgatatggaaacccgtgggagagttgagcaacgcgttggttataccatcgagcaaatcaatcacatgcgggatgtatttggtacacgactgcgccgtgctgaagatgcgtttccgccggtgattggtgttgctgctcacaaaggtggtgtttacaaaacctcagtatccgttcacctggctcaggatcttgctctgaaaggactccgtgttctgcttgttgaaggcaatgacccacagggaactgcttctatgtatcacggatgggtgcccgatcttcatattcatgctgaggacactctcctgcccttttatcttggggaaaaggatgacgccagctacgctataaagcccacctgctggcctggccttgatatcatcccgtcctgtctggcactgcaccgcattgaaaccgagctgatggggaaatttgacgaaggcaaattacctgctgacccgcacctgatgctccgtctggccattgaaactatcgctcatgattatgacgtgatagttatcgacagtgcacccaaccttggtatcggtacgataaatgttgtatgcgctgctgatgtactgattgtccctactccggcagagcttttcgactacacctccgcactgcagtttttcgatatgctgcgtgacctgcttaagaacgtggatcttaaaggctttgagccagatgtccgtattctgcttactaaatacagtaataataacggctcgcagtccccgtggatggaagaacaaattcgggatgcctggggaagcatggtccttaaaaatgttgtgcgcgaaacggatgaagtcggtaaaggtcagatccgtatgagaaccgtttttgaacaggctattgatcaacgttcttcaactggcgcctggcgtaatgccctctctatatgggaacctgtttgcaatgagatttttgatcgtctgattaaaccacgctgggagattagataatgaagcgtgctcctgtcattccaagacataccacacatactcaatcgactgaagatacttcatcaccggcgccagccgcacctatggtggattcattaattgcgcgcgtgggtgctatggcccgaggtaatgctatctctcttccggtatgtggacgggaagtaaaatttacccttgaggtgctccggggagactctgttgagagcgcttcacgcgtatggtcaggcaatgagcgcgatcaggaactacttaccgaagatgctctggatgatctcattccttcatttttactgaccggtcagcagactccagctttcggccgccgggtttctgatgtcatagaaattgcagacggcagccgtcgccgtaaagccgcaatcctgacggaaagtgattatcgcgttctggttggtgaactggacgatgagcagatggctgcattgtcccgactgggtaacgattatcggccgacgagtgcttatgaacgtggcctgcgttatacaagccggctgcagaatgagtttgcaggaaatatttctgcgcttgccgatgcggaaaacatctctcgtaagatcattacccgctgtattaatacggccaaactgcctaaatccgttgttgccctgtttgcacatcctggagaactgtctgcccggtcaggtgaagcccttcagaaggcttttgcagataaagaagaattactgaagcagcaggctgagactctccacgatcagaagaaagcgggactaatctttgaagctgaagaggtcattagtcttttaacatccgtactgaaacaatctccctctccaagggttaatctgagctcacgtcatcagtttgctccaggggcaacagcattgtataagggcgataaaatggtgcttaatctggataggtcccgcattcctgtggagtgtatagagaaaatagaagccattcttaaggagcttgagaaaccaggagtctgatgcggacacgctttagtctacggttatctccctttacttcatttcctttctcacaggccagaaaacataactggcctaaatattctctctgagaccacggtcccacctgcatcgtcggtcaggttatctttctgggaccacggtcccacctgcgtcgtcggtcagcttagctgcctgggaccacggtcccacctgcgtcgtcggtcaggttatctttctgggaccacggtcccacctgcatcgtcggtcaggttatctttctgggaccacggtcccacctgcatcgtcggtcagcttagctgcctgggaccacggtcccacctgcatcgtcggtcaggttatctttctgggaccacggtcccacctgcgtcgtcggtcagcttagctgcctgggaccacggtcccacctgcatcattgtttaggtttccagcctgggaccacggtcccacctgcatcgttggtcaggttatcagcctgggaccatggttgcattgatgtcaatgacgaactgatttttgacatgattgcatcacgaagagcggaataatcttgcagcagaactgaaatatctggcgattgaatagtaatggatcgggattagagccgagtatactgagtacaatttgtcaaatttcgcagtgtattcggtttaatctcctccagtttttaaaggtcaattgctgccgctacgcgctgttcagaccttcgtccggcaagtaaccaatccaggctattttcacaacccagggtgaataacatcattccgtcatcagcatagccacatcatgcatttcgtcacactgtatgatctggggatttcagagacattacttatcacaggttatgcagatgaataagactcaatagattgtttatccacagtgacggggatatacatgtgggtagcttcttgaaagacttatgatgtaaatccagcctcttgactctcacattgccaatatatagctcgtgacctgctccccgttgattagtacaccccgatgttagtaatgtcttcataagccacatgaggacatccccatgaagaagcgtttttccgacgaacagatcatcagtattctccgcgaagccgaagctggggtacccgcccgtgaactctgccgcaagcatgccatttccgatgccacgttttacacctggcgtaagaagtatggcggtatggaggtgcctgaagttaagcgcctgaagtcgcttgaggaagagaacgccagactcaagaagctgcttgccgaagccatgctggataaagaggcgcttcaggtggctcttgggcgaaagtactgacgacagaccagaagcgggaagccgtgatgctgatgtgtgatgcgaccggtatgtcgcaacgtcgtgcctgcaggcttacaggtttatccctgtcgacctgccgctatgaggctcaccgtccggctgctgatgcgcatttatcagggcgcatcactgagctggcactggagcgcaggcgttttggctaccgtcgtatttggcagttgctgcgccgtgaagggcttcatgttaatcataagcgcgtgtaccggctttatcacctcagtggcctgggcgtaaaacgcagaagacgtcgtaaagtgctggcaacagaacgtctgccgctgctccgtccggcggcgcccaatctgacctggtcgatggatttcgtcatggacgcactttccaccggtcgcaggatcaagtgtcttacctgcgtcgatgatttcacaaaggaatgcctgacggtcactgttgcctttgggatttcaggcgttcaggtctcgcgtattctggacagcattgcactgtttcgaggctatccggcgacgataagaactgaccaggggccggagttcacttgccgtgcactggatcaatgggcctttgagcatggtgttgagttgcgcttaatccagccgggaagccaacgcagaacggatttattgagagctttaacggacgatttcgcgatgaatgcctgaatgagcactggttcagcgatatcgttcacgcaaggaaaatcattaatgactggcggcaggattataacgagtgtcgtccacattcagcactgaattatcagacgccatcagagtttgcagcacggtggcgaaatgtaaaatgtgaaggtaaacaaaccgaccttactaactgacggttgtatctaatcctgggggcaggtcactcgactaacttcataatggcgcgccaaaaattagtaaaaaattaccatatggctgtcattgaatttgtgaaggtgagtaccatgccgacatcggcaaaggtacaaaagagtagtattgttccaatgttagagctaaagcatgtctaaagtagcaattgctgggataatgctaaggcagcatcgtttcttgtttactcatataagtgcgtgtaaggaagtgaatatatcaagcccgggccatggcccggcaggatatatttgattacattgaagtgccctgcaatcatatctgacgccacaacttcctctatggattaagcccgaagactttctaataggcctctctgcgaggatgaaatttgtctacggatgaggggacagtacaacaagcaaacaggacctcatattactggctggaagccaagctttcttttaccgggtattgaattttgttttacagtatatgcaagcgctttaacgggatatcgtccgctttgtgaaaaaagcggaagtagctaatcacagtttgagtggagcaactgaatgaaggtcctgtttgttctgcgtaccagacacaatcactcagacagtggcttatttaaaatatgttaatgaaacctaagcaagagaactgaaatggacaaattgttaaatatgctgcgttataagagtgaggggtctgatattgacttcaaatctacccagtaccgctttaacaatggttctgagggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataaaacgccccagcgtcggcatagtgcgttcaccgaatacgtgcgcaaaccgtcttccggagcctgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggcggttgcccggcatccaacaccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcaccgaagatcgcgggcggaaacatccagatcaccgtcacctcagttcgcaatggaaacgtgaaattccagcacgttcaggtgcattatgagccgaacacgatctatggccatgcagactttactgcgaacctctctaaagcccagcaaacgacgctgcggcagctctatgacggctgcaacccgcgcccgaggcgcgacctactgcgtggtggagccgatcgcctgcaagtcggggcgatggagtttcagtgctcccctgaagagctattgtcgggattgattgaaacgatctacgctatgcgaaacgccctactacacggcgaagtagaccccgacccgagggtactgtcttgctatgagccagcttatcggatcgtaatgctgtttctaggctgcgtgagataagcaggagatgtaccctgtgttcatattttttagatatggcattagtcatggcattgatattttatttgatatttaatctaagtaaattaatatgatatataggcagttgataatagagtgggagtgaggctattatttagcctattgttttatttgatttagtgagtgccattgatgatatgactgcattatcaatggcattttttatggtttaaggccgacgctgaatcgaagatatagcaaataccatgtgaccgtatcagcaaatgccatggtatcgacaaccgggtgcattgcagcgctgtgctgatgccatcgatgctcgctttgatcagaaccgctctctcgacccttgccccagatcgttaaatatgcgccagaggagcacctcgtgatagaaattgtgaacaagacagccgccactcggaatcgaagtatccatataggtgaataaagtttgcggaaaatacgctgagaaaatagaaaagcgtcaatgaagggacataggaatggcgattaacggagagaacggtgttagtgcagtcaccgtggatgaactactcaagcaaggccttcggataccgaactatcaacgcccatacagttgggatgtatcgactgctctacaactggtggatgatatcagcgaagctcttcgagataccgaacgaaaagatattccctatgttttgggtgcaatcattcttcacgatgatggtgagtatctcaatgtagtcgacgggcagcagcgcctgctgactttgcgaatgattcttgcggccttagatccgataaatcatcaaatttcgatgtctggtaacagcgacactcctgtctccctagtttggatagagcttcaaaggcgcctgtcgcagttggaagataaaaaagagtttttggattttatctgtcacaaatgtcagttggtgcgtattgtgacggacgatattgatgaggcatttcgtgtctttgattcccagaactatcgcggcaaaccgcttgcccctcacgacttgctcaaagcacaccacctgcgcgaaatgcacgatgagtccgctgctatgaaagtggctgtcgttgaggcttgggaagccgtaaacgatgaggatctggacaggcttttttctacttttttataccggatatccaagtggtcacgaggcgaaagctcgctcgaatttactattcgggacatcggcatgttcaagggcatttcatcacgatcccacaggtcattttcgccaaatctgcgatatcaccttgcagcacaagccgctatgccacttctaagtgcatggtcggtatcctctacacatgatgcacgaaacgccgggcgcagccgctttcagcttgatgccccgataatcgcaggacgctcatttttcgagatggtgacattcatgcttgacgaattgaagatactggaacaagaggttattgacagaggtttcaaaaactttggcccatctcaaagtcgctaccgctacgtgtacgaattgttcattgccgcgctgctttgctatacaaacaagtttggcgatgaagatgtagatgaagtgcgaaataggttattcgcatgggcatatgccttgcgggtcgagttacttcgtgtgcaatttgtatctgctgacaaccgagcgcgaggtaaaaacgatgcaaataaatcgccttttgttttgctacgtaatgcgatgactggaagtgttgtccgcaaacttccaataacaagtaagccatacagcgataaccacgaaaaggaactcgttgcttttatcaaggggctgcaatgagcaagaaggagttgaaacctgaactgttaacagtaggcaagttattcactgacaattatctgattcctatttatcaacggaactatgcttggcgggccgaacagattgagcaacttattagcgatattcaagactcggtggtagggggccaggacaactattttcttgggaaccttgttgtaatcaagcggggtagagaggatgagttcgaggtcatagatggacaacaacgacttacaaccctctatctgcttcttaccttcctggagcaagacggtgagggtgagaagccgtcggttggccatgcaggccacttgcaatatgagtcgcgcgcacgggcaactgaggccctgctgcgagtagcacaggaggcggctaaggagcacgttcgaccgcagggctccacgagtaatgcagatgctggcattcatgaaggctacagcatcatcaatcagttcttcaaacaaaatgaaaaccttaatcgctcacgcgaaaaattctccgatttcttgctaacgaaggtgactgtcgtccgtgcctcgctgccacccaataccgacctcaatcgctacttcgagatcatgaacactcgtgggcagcaactcaagcaggttgatattgttaaggctcgcctgatgagcaaactgcccaatcaatatgaacgcgaatgctttgcgtgggtttgggattcctgtgctgacatggattcttatgtccagatgtctctgacccgtggtgacacaagtttgcgaaacaaagtatttggtgatgaatggtcctggctggaggtgaccagcttctcttcgctaatggaaagtcgtccgcaatccggcatcaattcatcaaggcaatcctccgaaggggtatcgttgtccttggatgaggcgttgtcaaaatacgctaaagagctcgagtcaaattccactgaagacgagggcaacgagcggtttcgttcgactattgagtttccggcctttctgctacacgttctaagaattatgaaaggcgatgaggtcgaagacgaaggcctgcttgacgacaagcgcctcatcaagtcatttgacgacgccgtaaataatgtacccgatgctaaagccgattgggtgcgtagttttgcatttatgcttctcaagtgccgcaacctcttcgatggcttcatcttgaagcgtcaattcacggcaaacatcggtgacgatggcgattggtctctccagcgactgaaaaaaggaggcggggacaagaagccaaccccgacgtacatccatgttttctcggccagcaatggaagcttagaggaggacgggagtgctgacccacatacccgagatgtattgctgcttcagtccatgcttcggattacctacacttctccgcgaacgatgcactggattaccaaagttcttcgctggctctccgttaaagcccctcgagacgtgaaacatgcggatcttgccgatttgttgaagggatatgcccgcagcaaggttaaagagacattctcctttgagaaagatcagcaaccacaagggtttggtatcagccgtatcgtcttttcgtatctcgactatcttctgttgagtgactcctcaaaacgagatttcaaatttcagttcagaacttccattgagcacttctatccacagcatcctgacaaagaacagtcgggcgcggttgtttcaggttctagccttaacctgcttggcaacctcgcgctcgtaagcgtcagcgcgaactcaaaattcagcaatagcctccccagagcaaaggccgaaaacttcaaggatacaattgaacttcaaagtcccaagctcaagagaatggcggaaatcacccgaaatacaaactgggacgatcagcagataacagcacatcatgaagcgatggtgacattgcttcgtgatgatgtaagtctggtggaggcaagcggaagatccaacccagggcgttgacttctttgaataactgcttttggatgaatatcctttgtggtgtgcaagttgtcagtctaaaagcgttttgcgtcgggcgacacgatcagtacagtctccaagttttcttaccatggtattttgtatggtatcgacatgcagatataattctattttattgattttatagtgttttaagacagcattgatcatcgagtgggtaacataggcttaatacattccttgctcctcgcaccggagcacatcacagatactgattgagatccacttcacgcagcggctggttttgacgttctgttatcatttgcactaggtctttttcgtccagctcatcgagcatttgttcatacagagccgcgggcacacaataaaaaacagggcggttgcggtcaataatcgcgaccgggtagccgccgccggcactggcggtggccaccggatcgtttttaagttcgctgatgctggcagtcacatcacacagaatgatatttgtcatggtccccccctgagacaagtcatctgtatgatcggtaaagtaagctcttgcggcaagtcccgtctgtcatttcgacggtcagaaacgggcaaccggcagctccttccagcgggtggtatatgccggtgacagcatctcccgtttcatctgccagtccggcgcaataccccgtccggcaaaccagactttcccgagtccggaatgattaatgccgtcgagtaccttcatcagcgcatcgctgtgcggccgtggctgcacgtcatcgaacagattcagctgcgcgacgccgttcggactgaaatcattgagcattatccccgcttttgcgtagcggtggccatcgagccagatcctgtccagagacctgaccgcagccgcgataatgtcccgggtgtcacgggtaggggtgtgcagtttttccgtggccacgttaccgtaatacggctcattaaccgcaaaaggggatgtcttgatgaaggtgctgatatgccggcagtactgtcgctcaccgcgcaacttttccgccgcgcgctcggcatactggcagacggcctggcgcatttcttcgtaggtggtgatccgctgcccgaagctgcgactgcagacaatctgctgtttcggcggcggcgcttcctccagtgaaatgcaactctcgccgttcagctcacgtaccgtgcgctccagcactacgttgaagtttttccggataaatgtagggttcgtcagcgacagctgtagggcggtggtgatccccataacgtgcagctttttcgctatccggttccccacgccccagatttcttccaccggctgcaggctgagtaattttgccgttctgcgtggattatcgggcgacagcgccagcacccccctgaattgtggccattcctttgacgcccactgcgccgatttggccagtgtttttgtggcgccgaagccgacaccgatcgtcagtccggttccactgagaacatgcccacgcagctgcctgccaaaatcctccagatccatacagtggccaattccccgggcatccaggaaacattcgtcaattgagtattgttcgacgcggggcgacagctcttccagcagggcgaccacacggttactcaggctcgcgtagagctcgtagttgctggaaaaaacgtacaatttttcaggaaactgcgcctctttgagctggaaccagggggttcccatctttatacccagcagtttggcttcagcactccgggcaataacgcagccatcgttgttactgagaacgacgacaggtttgccgcgcaaatccggcctgaaaaccttctcgcaactggcgtagaaggagttgacgtcagccagggcgaacatcagtctgccctccgggttttatgaatgaaggctgtcaccacgccgaaaatttgcagcgtttccggatccgggtacagggaagggaagtccgggttcatcgcctgcagggctggccgcggcgtcagaagcaggcgttttaccgtaaattcaccctcaatttccgcgataacaatatccccgtgccgcggctgttctgctttatccacgaccaacagatcgccggaatagaggccaatatcagtcattgagttgccaatcgccctgacaaaataggtggagtggcgccggtgaatgcagtactcattcagatccagttcagactcagtgtagtctgctgccggtgacggaaaacccgcagggcatcgctctgtgaacaaaggaatttttactatgctggcttctgatactgcaggaatgaacttcatcgttttttccctcgcttaaggctgtatatatatacagtgtgcgccgggagaccggtaaagatcaaggggtgaaagtccccgaccattgaaggaccagcaatccacagggtccccgagtcatgcgttgtataccgtgaggtatggggcgaagcgttgacaggggtgttgacaggccagccattgagccacgaaatgtatattaaattcccgggtgccgacgttgtactgtttacggaaggcaacatcatagggtgcgttactgcgagtgccatatggacccggcggggtctgagaccctggcatgtcaatacgatctttacgcgggaaccgggagatctcccctctgaccatctgccagtgccggagatggcccgcaccgggaaggcgaggagccgaagccggtgatgtacggagaggagaagtcggactcgctcatagtagctgcgaatctggcgaacaatccgcaaggagcggagtcagtggagcgaaggagcggggccaagggaaacgcggaacagccacacatgcgccggacgcagagccgggaaagtatgtcacagaggctgtcacgcgtgcgggaagctgcgaagcagcggaagaaagaacggtttaccgcattgttccacctcctgacagcagaggcactggagaacgcattcctctccctgagcaggaaagcggctgccggagttgatggtgtcaggtggaaggactacgccgaaaacctgaaggtcaacatagcagatctgcaccggaggcttcatcagggtagttacagggctcagcccggcaggcggcactacatcccgaaagcggatggaaaacagcgcccgctcggcatcgcctcactggaggacaaaatcgtccagtatgcgctggttaagatcctgaatgcagtctacgaaaatgactttatggggttttcatacgggttcagacccgggcgaagccagcacaatgcgctggacgcactggccacagggctggttcggaccaatgtaaactgggtactggatgccgatatcagtcagttcttcgacaaggtaagccatgaatggctaatcaggttcatagaacacagaatcggcgaccagagggtaatcaggctcatacgaaagtggctcacagccgggacctcagaggaaggagaatggcgggcatcggaggaaggagaatggcgggcatcggaggaaggcaccccacagggtgcggttatctcgccgctgctggcaaacatctacctccactatgtcttcgatctgtgggcgcatcagtggcgacgccgccatgccacaggcaatgtggtcatggtcagatacgcagatgacatagtcatcgggttcgacaagcgaatcgacgctcaatgctttcgtatagccatgcagcgcagactgaaggagttcggactcacggtacatccgaagaaaacccgactgacggagttcggccgcttcgcagccgaaaaccgcgccagcaggggaaaaggtaaaccagaaacgttcaacttcctcgggttcacgcatatcagtgggaaagatcgtagtggcaggttcatgctgatacgaaagacacgccggggcaggatgacggcgacactgaaagcgatcaaggacggactacgaaagcgctggcattactcaatccccgaacagggaaaatggctcaggagagtggttcagggatacctgaactaccactcagtcccgggcaactatcccatgatgcggaagttcaggatatacgtaacagacctctggcgacgggcgctgaggcgcaggagccagcaggatgatacgacatggacgaaagcaaacagactggcagccgtatggctgccgaaggttcgggttctgcatccatggcctgtggagcggttcaccgccagacacccaaggcaggagcccggtgcgtgaatagcgcacgccgggatctgtgcggggggtacccggtaacgggtatccctaccgcgacattattttgcggaggccgttttttttcaagtcatcttgttgccgttgtctgtaaccatttgctgttcctgcaaaaacagggaaatttcagaaggatcgctgccagtccggagaatcgttatctaataaaatgtaatatactgacgtacagtgcatttattctgagtggagtgattatgaatacgggtttaaggcaggttctgcgatatgcaggcgtcccggttgacgccgctgaaccggtgcgccggcaattcggtagccgcctgattttaatcgtgacggttgctcttcttccgctgttgattgttgacgtccctcagtggctatttgtgctctctcagattatctggggaagcggtatgtacattggtatctccgtggccagtgataaaccagatcgccgataagctcagaacgagaggtctcccgggccgcctggtgacgggcagctgataaactggcgccatgccatcaacaccggataaggacgtcgccggcttgtctttgccgccggctccgctttgtccggccccctccctccggtctgcggcctttatacgcagccatcgcgtcgcgatgccagcttctgcttttctccctgcgctcgtaaaccgcgacaggggacctcatgttgtatctcctgcatcgcttcgggtagtgccgtgccttcactttagcccggccgctgcagatgcaagggttcgctggcgccgccatcctcgcccggtcgcagtttttttaggaagctcgccgttcttcccgtcgttttctcgctcaggttcgctctaaaaccgtccagaccagcttcgtgctttatctgcgctgcggcctccggtgtcgcccttgcatcttccgctttccgccgggctgtcgtgtcggcacggcacaacccggtgccgcaatcttatgaacctgtggaggttgctatgtatcatgcccgtcaaaccatgctgaatgtagaggagtccgaccgtctctcgttcctgccggatctgtttggtaacgattttctggccggagagatgcaggtctatgcgctcgctgagaaacacatcaccgattactgcggaggcttctggcatttcatccgtattccggagggcggcggctacatgatgcctgacggtgaccgtttccatctgactaacccggataactggtttgatcggtccgtcagcgcggatgcggccggagttatcattacggcgctggcgatcaaccgccgtatctggctgcaccatgaacgcggtgatgctgccctgacacgccacctgatgctgcgggaatcgcagctgtggaatttcattgactctcatgacgaatgcgctgctatttacgcggctctggactgatactatatcggggcgcccgacgccccgtttaaggtcagagacggcacgatctgtgaggagcttacccggcttcgcagatcggtgcggccgcgcgaaaatcctggcaggcttcgcctgccagtgaggcggttcgccacacctgcggcgctgcgtactggcctcacctcaacaggtcgccagttaaggattaagagcgtaatatctgcgtaccttttcttcttttgctgattttgcgtatgtcgcagtggaatattgcctctttttcaaaggaggagcaggacaaagttgccgtcgatagggtggctgctgatgttgcctggcaggagcgcatgaacaagcccgtcatgccggaacttgttgaacgggaacagcctgaacacctgcgcgaatatttccatgaacggttccgcgtacatcgactgaacagtcagcagctgccgcgcgcaaatgcacccgaatataataaaccgggcgatgatcagcagaattgattttcttactcagtgtgtccagggagggtaatctgtgcgtatgtctctgatgtttgctgccgtgacgcttttaaccggtattaacctgttttttattccgtttcagcctgttccggctctgtggggggctatcctggccgttgcttttgttctgattaatgtcgtggcggataagctgcgcctctggagtggtattgcgtggattatcgttgccggcatcatcataacgctgatgctgaaggggaaagagccgggtgacgaatttcgtgtcctgatcaccgttttcgctttcctggcttcaatctggtatagcgttgcgcagttcaggaaggaaaataagctccgttcctgacgccccgtctggtatgccgccggtttatcatggcttctttccggcggcatgaaaaacatattctctccagcctgcatctttacgtttccggcttgctccctgctgtctgtctgctttctcttcttcttcctgctgtgatgtctctttttaacccttaaaggctttaaaagcacacccgcactggacaccttcggctcccggccagctgcgctgtccagtcgtcgagccacactccgctaaccgcgaaaagacgcggtaaactccgccgaacccgctacgcggtttcgggcctggcggctagtgtctgatgtctgaagtcaaggtcaacggcagcgcttgctgcgaccgttccggccgcgccgctttcaccgtgccggcgataaagctgccggcactctgcagggcaacgccgtttcgcgcccgcgctcttcgtcgttgcggcgggtgcctgctccttccccctggcgccgtatcacccgtttgagtccattcgccggggctgagacaagcacagtcgccatcatccgtccaggggaaatggcacgcggtaaaccgcgccctggacagctgccgtcgcccgtgctcgtttacgcccttgcggcgaacggctctcaaacgggtgaagttaataccaaggggcaggttcagcaggtccccgcacaaagtcaaaaccgcggccccggcaactcaacgggtgatgttctttaaaaatcgggaaaaagaaaaatgcaggatccttcattgcgaacgtatcggatcgcatttctgggaagcaatgccagcggcaatctgccgatgtttacccgggtgcaggccacgaccggaaaacgggcgataaaagcgtttattgaacgctgtgaacccgtcaaaggctggtttctgggcgcaccggaagacattaccgatcaggttcagaaggaggaagaagaggcgggaagcaaaccgcaggtatgaaaaaagcagggtaaaccctgcttctcccacgccgtaaaaatcgcacgaacggtttttccggcttcgttaactaccataaggagtcaactttatgatcgtttctattttttcaccttccgcaggcgctgtaaagccccgtcgtcattcgcgcattctgcgcgcagatatcaccgcaccggagattgatcccgctctcagagctttcgggcgtcatatcgccagaagtcaccgcaaagggcgcggtgtccacatccccgcgatgaaaaataccgccctcgggcaggtactccgcacgctggaactgaaacgcgcatttaactgatgaggtgagccgccccgcgaggggcggcaactgcaggaaggagaaaacacaatgacaccgactaccgcacagatcatgacggaaaataccgtcagccagacttaccgggcaacctattcacccgatgataataaattgcgactttacgcatcattacggctcgatgaagaaacgtattccctgatcaacaaagcaggctttcgctgggcgcccaaacagaaactctttgtggcgccagcctggacgccggggcgggaggatgtcctgctttcgctcgccggtgatatcgaggacgaggacagcaccctgtttgatcgccaggagcagcgcgccgggcggttcagtgactacagtgaccggcgggcggttgaatcggagcaggcgcttgcgcatgttgattcgctggcatcggctgtcccgctgggacagccgatcctggtaggccaccacagcgagcgccgcgcgcgccggcatgcgcagaaaattgagagcggcatgaaacgtgccgtgatgctgttcgagcgtgcggaatactgggaacagcgcgcgcaggcctctctgcggcacgcaaaatacaaggagcgtccggatgtgcgttaccgccgtatcaaaaaaatcgaggcggaattacgcaagtcccaaaagcacattgcccggtctgaaaagtatatgacgatgtggcgtgcgcagacgctcgatctgaaaatggcgttactggtcagtaattatgatcatattcatgcctgcttcacgctcgacaaatacccccgcccggcagagaaaagccagtatgagggctcgatgtctctccattctgccctgtcggaggagatcattacttttgaacaggcgcgtgatattgcgatccgctgtcatgagcgcacgattaaccaccaacagcgctgggttaatcattaccagaaccgcctggcctacgaacgcgcgatgctcaatgaaaacggtggcgttgtcacccgaacacaggaatttgaaccaggcgggcaggtactgagccggggagaatggttaaccattctccgggttaaccggagtaagggggaggtgagttcagtcgaaacgcccggttatcgctttctgggctacagcggcacgatgaaactcacgcccgaccgtatcacggactacaaagccccgacagcggaggaagccagcgacgcgaagaaagcggcgaagcgcccaccgatcgtcaattatccgggggaagggttccgggaaatgacaaaagccgagtgggcgaaattacccgctgattataaaggcgtgcggggtgctgcagaaaccgaaacacacggcgcctaccgcttccgccggtgcatgacgcacggttgtacgctcgtgaatgtgtatatcacagacatgaaaaccgttgaaattccgaaaaaatagcaggaaggctccccggcatcttgccggggaggtcagggagtacattcatgcatcatgaccttaaacaccgtattcaggcgatgcgggtcaaactggaagggcgcgcccctgtcgctgaaattcggggtagctcgcaactttttgtcaccccctccccggaatgtcgccggttagttgagctggctgatgtccgggaaaccgatcgcattctggaacccagtgccggaacgggcgccatactgcaggcgatcagggatgcagtcccccgggcgaagtgtgacgccgtggagctgcacgccgggttagcccgtcacctgcaggctcatttcccggaggtccggatctggtgcggagattttctcgaatatcatccggagcgccggtatacacgaattatcatgaatccgccgtttaatcgcggtgatgatatccggcatatccggcgggcattaactctgcttgagcctggcgggattctgacgggcatatgtctggacgggccgcgtcagcaaaaggcgctggagtccctggcggacgtctgggagccgttgccacggggaacattcacgtatacccaggtagcgaccgccattctcagaataaccgtctgatgacacgttaagccggcggggcacctgtccccgtctggccgcgcctcgaaagaccgcgcgcctgcggcgccgggaaaaccgggccgcgctgacgcgccgcccgcatttcctttccgcgtcttccctgtttgctgcctgctgtttgcctgcttcctctccttctccctgctgtgatgcctctttttaaaccttaaaggctttaaaagcatacccacactggacaccttcggctcccggccagctgcgctgtccggtcgtcgagccacactccgccagggcagctgcttcgcacccgccgggctccgccgaacccgctacgcgctttcgggcctgacggctagtgtctgatgtctgaggtcaaagtcaacggcagcgcttgctgcggccgttccggccgcgccgctttcaccgtgccggcgaaggactgccggcactctgcggggcaacgccgtttcgcgcccgcgctcttcgtcgttgcggcgggtgcctgctcctttcccctggtacccgtatcacccgtttgagtccattcgccggggctgagacaagcacaacccgtcttgctgtccaggggacggcagagcctttcgcaataaatttttcccggccattccgctgcgcttcattagaccgaaaaaaatttcccgctcacccccggacatctgcaccgggccgtgctcgtttacgcccttgcggcgaacggctctcaaacgggtgaaggttatatccaggggcaggttcagcaggtccccgcacaaagtcaaaaccgcggccccggcaactcaacgggtgatggttaaaaaattaaacaggtgaaggagaataatatgcgtttagcatcccgatttggacttactcattccattcgtcaggaacgcccactgactaacgatgaattggtcaaggttgtaccttctgtgttttcagaagaaaagcataattcacgtagtgatcgctatacctatattccaaccattacactgctggataaattacgtgaagaaggtttccagccattttttgcctgtcagtcacgagtaagggatgaggataaacgggggcatactaagcatatggtaagacttcgccgtgaaggggccaataaaggaacagaagtacccgaaatcattcttcttaactcgcatgatggatcgtccagttatcaaatgatcccgggtatgttccgttttgtatgcacaaatggccttgtgtgcggtacgtcgtttggtgagattcgtgtacctcataaaggtgatattgtgggaagggttatcgaaggtgcttacgaagttttgggaattttcgataaaataactgaaggcgttgatgtcatgaagtctattaccttaaccaaggaagaacagcgtctgtttggacaagctgcattaacctaccgatatgaagatgaaaataaatctccggtcagtattgaacagataattcatccgcgccgttatgaagataaaaaagatgacatctggactacatatcaaagggtccaggaaaatctgattaaaggcggtttgcctggccgaactgaaaaagggaaaagaacaacaacccggccagtaaaagcaattgatggtgatgtcaaactcaataaggcattgtggttaattgcggagaaattccgcactcttaaaggctaattataagcgccgggcagctgtccggcgttttgatggtgggaatacttatgtttgaatttaaagctgtctgtatcagtatttcacatatggaagaaggtgatatcagagttcttcaggtgctttcatcaacaaccaattatctaacttgcgatagttacttagagtggatacatgatacaccttatggttgtgttataaggatgtatgatttcaaacgccatcttctggcgctaaaaagaggtggggtgtcaaaatttttacgcaaaaatctcatactaatgcaccgggagggcgggtatctgctttttcattttgatagtgatgccgattattatccaggtatagatgccgtagatttttaagaaattcaagccttcttatatcagaaggctttttagttcatggcgattttctgatctttagaagaagttcgtttgcttgctttgatagccgtgtagtagtaatggatcttcttcgcatactcgtaacgtcttgctgcctggcgcggggtctttttgaagcctgcattgtatgccccgactgcatcccacgaaacgccccactttttaaacgcctgagccagataataggctccggtgtagatgttaagacaagcatcgctaagaagatgatccggttttattccatatcgcgacagttcgttgaaatgctgcgagtcaatttgcatcaagcctgatccataacccgtaacaggattacgaccaatcgcatcaattttaaatcgtgattcttgccatgatatagcacgcaggagatccggatcaattttgtaatccctgccagccatatcaaagcagtctgctgccattgatgacaatggtattaaagacaggatgataccaaacgctgctcccttcatgaattcccctccgtgccaaatcccggaataaccttaacccatccaagaccgagactcaacatatatgcactcctcaccacaaaatgaccacacactacgcaaaattaaaattttgcagatttcactttagcttcagtggcttaactgtagttatattacattatgttatttttctttatatatatgtgagttgccggcgagtcagtagtaagtcgtcggtaagtctatagcgactcgtttatgactcactcttttataatcatatatttaaagcgacttaactctagacttaagtcgccatgtgactcgtaatgcaactttcttagactctagacttaagtttagagttgtaaagaaggtaaactcgcgttatcttctcgccataataacttgcttgatgctgtttttaataaaggaaccgatatggccagggtacaagcttatgctagtgatgaagttgcagagaaaattaatgcaatagtggaaaagcgaagggctgaaggggcaaaggaaaaggatgtcagtttttcaagtgtcgcttcgatgctccttgaattagggcttagggtttatgaggctcaaatggaaagaaaagattcagggtttaaccaaactgagtttaataagattttgcttgagaatgtcatgaagactcagtttaccgtatccaaacttttggctattggctctctaagccctcatgttacaggtgatgaacgattcgagttccgcagcatggtgagtaacattcgagaagatgcaaaagatgttatttctcacttcttccccgagcaggaagaagagtaagaactggtgtgtgtttatggtggtttgtaattaattcagtagtaaaaaaagaataatgatctagctttaaaaagtgacatggaagaataaggaatatagaatacttacagggttgtaataaaatttgttgaagcgttgacgtccggggctagtccccccgaacgtcaactatccatagtgtcctttccaggaggcgcctatgtgtgcgaaggatcgtagtcatattgctgtgcgcagtcaaacagattccattcattctatgcgcgagatgcttaatatttcatcttgccctgcttttattcgtgattcccggggcgaagtaattcacaccagcccaacctttgacaaaattttcttaacatctggtggaactggagcatttgatacacccagagcacctggaagctggtttctggatctctccctggagatcaaactggaactgatgcagtcagaactgaaatcgttttcagaaggttctgctgtacttgttaaaaatatttggttggcaggttcactttggactgtttttattgaaacgttctcgattaatgaagatacatacagtaaatgggtttttataaatgaagatgaaccgatgcctcatccttcaatggaatacaatgacttttctataaagatgcaaagatatatcgaaagaattcagcgttcagcaaagtctgactgggctatctttaatctgtatgcggttgggttttctcatgcatctatttcgaagattacaggtgttggggtgcaaacctcaaaaaatacagttagtaaaataaaaaaggaactgagctttgataatcgtgactatatcataatgtcatcgatctatactctaagttatggaaagtttatatcgaatgtggtttcgatattaaacgatggtgttaattttttgttaaatcaatagtaccgtcggtacttttgatttgtgaaaataatttactcaagatttctccttagtttgtttacttttaaatcctccaatgtaagatttattaaaggttggtaatcttactttggaggtcgattggaaagagcgattaggagcaacgcacgacctgcgcctggaaaaaatgtgcttttaaaattagatgaagaaactaatcgtcgactcatcaaagcaaaagacagaagcagaagaagtaaaacagctgaagcttatttgagactgaaagatcatctagaacgttttccggacttttataactcggaactagccgtaccaggaggtgaaaaggaagagtgatttaacatcatagtcaaaaatctgttttatatatcaacctttctttttaaaggaaataaatatgaatgctgtattaagtgttcagggctctgctgtctctgaaaaaaccaaaccgtcttttatgtcccgcgttttcaataaaaagaaagccctgaaagtcgctaaagttgcgctgccggttgctgctgtggcggcgttcttcccggatgctgcgatggccaccaccacggcaaccgacctgatgaagtccggggatgcgaccgttaaaggcacgtttggtaagcaatccagcgtagtcaaatgggttgttctggcagaagtcgtcgccggtggcatcatgtacatgatgaccaaaaacgtgaagttcctgtttggcttcgcgattatttccacctttatcaccatcggtatgtcggtcgccggttactgacaggaaacacgtgatgacgggagacgaattaaagcgataccgtttcccggaaacactgactaaccagtcccgctggtttggtttatatctcgatgaacttatcccggccgtgatttgtctcggctggggtttctggaccagcaagttcatttttggcatagcttcagcggtactggttttctggggtatcaagaaactgaaaaaagggcggggcagttcctggctacgcgacctgatttactggtatctgccaacctcccttcttaaaggtttctttcatgatgttccggactcctgtttccggcagtggattaaataaatcaacggggaaataacatatggaacatggtgccagacaaaataccacccgcgttatcgctgtgggatttatcagtctggggacactcctgaccctcagtcttgcaaccaatattatccaaggcataaataattaccgtctgcagacggaacagaaagtggcggtgacaccgatgttattccgtgcaccctttgcggtgtctcagaaccaggctgacgcctcttatattgagcagctgggcctgtcctttgttgccctgcgtctgaatgtcacgccggaaacggttgatgcccagcatcagcagctactccggtatgtattacctgcctcgcagaacagcctcaaggtccatctggctgaagatgcgaaacgcattaaagacaataacgttaattccaccttttatatgacgtcgatgcgtgcctggccggcagagaaccgcgtggatatccggggtgagctgaaaacgtggattggggattccaaaccctacagtgaaattaaaagttatgtcattcagttcagtcgtgtcgatggtgtcagctggctggcgcgttttggagaaataaataatgaaaaaaattaacccgttatttatttcaggctgtctgctgttggtcgcccctgcgatgtccgcgaccctcagcggtacgctggagccgacagtggttcccctgaccaatggcggtcaggcaaatattgccgtgagtaacaccgatccgaatctgttcacagtacctggcgatcgcatcacggcgataaacagcctggacggcggcctgacaaatcaggagcagaccgacagcggcggcgccattctggcgaccgtcagtaaaaaaccattcaccttcattgtggaaaccgaacgcgggctgaacttctccattcgtgccgtgccccgtgcgggctcaggccggacaattcagctggtcagcgagctggcgggtacccccggtccggcaaaagcctgggaagagtcgaacccctatgaatcgttactggtttcgctgaatcgcgccgtgcgtcagggcagcgtacccggtgagtatcagtctgtccccgtcacttctgaagtactgcaggtgccggctggtctgcgcgccactgccgatcgggtctgggtcggtcatcacctgaaagttgtccgttacagtctggacaatgtctccctgtcggcccgtatggtgcgtgaaagcgatttctggcagcccggaacacgtgccgtcatgttcagtaccccggcgggcctgctgactgccggtggtcgcatgcagatctgggtcacgacgtcagatgaaggagtgaagcgctgatggccaacttcaacacgctgatcaaacgtaagcaatatatctggctgggactcattctggcgggcggcgcggcagccgtcggaggcgggctgtatctgtcagatctgaacatgagctctgatgaggaagccccggctcagggcgaacccgcaccggatatgaccggggtggtcgacagcagcttcaacagtaaggtggagcagcacgcgacaacagaaatgcaggcgactgccgctgatctcaacaagcgttttgactccctgcagggggaagtggacctactgagtaaggcgcgaaccgctgaccagatacgtatcgacaagctcagcagtgacaatgaagccatgcagaatcagctgaaggcgctgggcgtgaaaccggctgtctctggtggcgagcccgcgccgactcctccgtcaccgccacccggtccggaaggggagccgcagccagccagttatccgccgcaaaccggcgccgcggtaccgcctccgacggcattctatccggggaatggtatgacaccgccgccgcaggtcagctaccagtctgtaccggtaccaaaccagatacagcgtaaaacgttcagttacgacaaaggaaaaaaaacgaagtcattgccgtacattccgtcggggagctttgcaaaaagtatgcttatcgagggggcagatgccaacgcgtctgttaccgggaatgaatcaactgtaccgatgcagttgcgtatcaccggtcgcgtggaaatgccaaacagcaaaacctacgacctgacagggtgttttgtgggccttgaggcctggggagatgtctccagcgaacgcgccattgtccgtacccgcaatatcagctgtatcaaaggtgataaaaccatcgatcagcccattaacggccacgtttcctttatggggaaaaacggggttaagggagaggtggtgatgcgtaacggaaaaatcctcggctgggcatggggggccggttttgttgacgggattggtcagggcatggaacgggcttcacagccggctgttggcctgggggcaaccgcaactgttggcgccggtgacgttctgaaaatgggggtcggcggtggtgcatctaaagctgcgcagacgctgagcgagtactacatcaaaagggccgagcagtatcacccgatcattccgattggtgccggcaacgaagtgaccgtcgtgttccaggatggattccagctgaaaacgattgaagaactggaagcggaaaagaacgggcaacagcaggctcagaatcaggaggcggagccggcaccgcaggctgatgcacatcatcagtcaggcggcggtatgaacggattcaatactgacgagatgctgaagaagctgggcaaacttgatccgcgtgagttctctccgggcgcagcgccgcagggggaaaataatggctaagtctctcattactgctgttctgtcagcactgcgctgggctcactggctggttaagtgtgcggtggtgtatccgctggccatgatgatgttactggttgttctggtgttcctgacgggaccgtacacgttcggccagacgctggtgaaaaccgtagagtctgtgcagcagtagggatatgtcattcaggactgcacggggccgaaagaacttaatggtgatgcggtgaacgctccactgcctccggttttacaggaagactgcaccaccgtcagtacggatgcggcagggtatgcagcatatatcgaccagagctatacgcataatattctctggctctggctgctgatggcggtggtgtttaccgggatcgctgtggttttccgtcggactcctgtccgcagggtgatcatacggaaaaacggtgttgtcgtcggagaggctggttcgggttcttcagggctgattctagcccgatctgatgtcagccagattaagcgtgtttactatgaaatgagtccggatgaaggggataaatttgttcgggcgattaaggaaaatacccaaatcaggatgaacctgaagaaataaccgataaatagcgagaaatatcatgaaggaattaatgctgttaattcctctgggcagcgctttgctcttaaccgggtgtgcgggcacagagaccgaatttcaatgtaatgccacgacgtcggatacctgtatgacgatggagcaggcaaatgaaaaagcgaagctgaaggaggtacgcagtgatgcaaagccggctgcggccgggttgccacaactggctgagggtaatttcagaaccacgtcagttaattcgttcccgttgccgcctcaacccaacctgaaccgggccagagtggcagcggagagagaacgagcacgtgcagtgtacctaaataatccaacggcaaagaatgaggcaatatatttcgaaaccgagaaaaggctccagtctttgccggtagtgaaaatgtctttaccagtagtggcgtcaacgtttacgtcaccgtcaacaccgccaggtaattatccccggccattaagaaaaggggaggagacaacgtcattgtggatagcgccgtatgtggattcagatgatgtatatcaccagccggcaacggttctttttgtcgtaaaaccatcggcgtggggacagcctcgccttaattgattcacagcgccattgctggcgctgcagtagtgttccatttctgaattataacgagtgccctctgcgttgaaagggatgggcggtagcgtgtgaaatgaacgtcgataacgaaaaatgaaagaatttgaaaaatgactgactcaatgaaatatctatggctgcttttgcgcgaagattcgtcatatatttttatgttgattcttattgttggttctgccgtaatcgtgtcttccttttttcagagagtaatcacatcctggtggggtaaaaccctcagtgtgatactgtgtatggtgagtatgattactacagcaacaggagttcttgatcctgagtcaacatataaacaaattataaacaggaaagaaaatatcatttatacgcttagaaattgcagagtctccgcatttgaagcgcagcaggcagggtttctggctaaagcaaaagatgcctggtcttgcccggatggcgtaacacggtatatggatgtgagatacagagataaggcagagattaataaacttagtacggaaggtaagtaacgttatggatgaattattcaaatggacgatggcgctggtgtttttattgacaggttatcgcctgcttttttctagtgacagtaatacagtgcccgaagttctttctcatcactggaaaaatgactgccggttgcttgagactaatattgataaagggttttctctccagcgcaaaatagacttcagtgtggtgatgttattgaaaatgtcagcaaggctgattatgacagagcgataaggggcgataagcaaacaactatcgcagaggcaatgaaagaaatattcattcgttaatatataaacagaggcaataaagtatgcatgcctttatttttctggtgctgatgacgccgagtagtggtggtggaatttgggatattactcccatgcctaatacagatgtctgcataaaaatgctacgggtactcgaagcacgtggtggcagaggttacggaagtaatacaggagagtgcattgaaattaaaacccgcgagcctttgagcagcgtgatagaaacattgagtgagggtgggtaaatggctgaataccagttaagttttgatggttttgttcgacttttttttgcaatggcaatcattatctgcggttacggctatgtaattattggtgtttttataagagatgcgcttgcctatattttaatgttgtttgggcttacaggtctcagtgctttattttctttaatggtattcatggataaaaatatgtgggccggttctcctgatttgacgctatcagtaataacgggatttttttcagccacagtgatcttttatatgttttatgtcttgatttattactttgatcggatgggggcgggtgaatagtaagaccggtggtcagtgttaacaatctcacgttatttgaaagtatgcagcataaggaataagaaagtgaaagcgtactatatacttggacataacgttgcatggcttaacggtatatgcctgattctttttgttattggtttggtcggtgcgctggcaatggttgccatccctgaaaaattcaatcttcgagttaacagaggcgatacattcatatactgtgcgcttatagcggtggttgggttttccgggatgttcgttatctccattcactcattttcgatggatgaacttgaagcaggtagacactggaaagatgactgccggacacttgaggtaaacatgccgacaggcgcttttaccagccctgttaataaactggactgtgatggcatcatcattaatgtgcctggtgggcagtattattcctatatccatcagtgggaattatataaagctaactcaaaatgaaatgctgattaataaactggattgaccggtagggatggaacaatggaaagacaacaagaaattgaagagcgctctcgggatttaataagaaaggccgatgaaaaagaaaggcaagaattgaaacgttttgatctgctatatggtattttttgggttcttcttttttttgcttcagctggatgtttttttgttcagtatgaagattttcgcgatatgcagcccgccactccagaacaactgcaaagtattattcatgatgcgccttgtgcgggtgaggcttttcggatggctcttcaaactaataatgtgacttcgtcagcgacattaacttttggtgacgcaaaaaagatggcatcagaatgcaaggataaaaaagagattaaagcagtacgtgaaaaacaacttaacgcactgaacgatatgagcaaataatcaggggatggatatgatgctgtttcttcgaaagtatggatttttgtttacccctccagtctactggctcatctatctgggagccagactgacttacaatggactggcaggagacttttctgctgatttccttcagggtattcgacatgaaggcgtctatattatctgtagtttgtgtgtattttattttttctgcttagaggtggaagttggtgatggcgaattctcagcgaacattctgttcctgattgttttctttcatgtggttttattatttatcactctgcttatttgtttgtggcaaggggaggtgttgttggattcgatctttatgggtcagattatcgcctccatgtgtttattgtttttcattcctgtgctttccattataaggaggagtttctagtgcggctgtgaatattcttcttgccatttattacccttgttattttgaaatgctcttaaaggaacgcctgcatgagtaataacatcatcgatgccgtcacccagactgtgaattcactggtatcagcactgaagctgcccgacgaatctgcaaaagccaatgacacgctgggcagcatgaatttcccccagttcagccgtattctgccctataaggattatgattccgcgaccggtctgtttattaataacaaaaccgtcggttttatgtttgaggcgcgtcctttacccggtgcggataaaagtatcgtcgccacactggagcatttactgcgcagcaaacttccccggggcgtcccggtcagttttcatctggtctccagcaaactggtcggcaatgatatcgactacggtctgcgtgaattccgctggagtggtaaacaggctaaaaagtttaacgccattacccgcgcctactatctccgggcggcggaaacacaatttcccctgccggacaatctggatttgcccctgacgctgcgtaactaccgcgtgtacatctcctgctgcgtgccccggaagaagaactccgccacgcaaattgtggagatggagaaccagataaaaatcctgcgggcgtcactgggcggggcttacattccgacgcgtatccttgatgcggccgggctggtcgaactgatgcgtgagctgattaacccggacccgcacgagatgtaccgcgtaccgtataagctggacccctatcaggatctgaactatcagtgtgtcgatgacagctttgatatgaaggtcacggccggtcatctgaaaattggccgcctggggcgcgacgggaaagagtgcgtgacccgggtgacgagctaccatctggagaaagatccggaaatggccttcctctggtccaatgcggacaactacgccaacctgctgaacccggagctctccatctcctgcccctttgtcatcacgctgacgctgatggtggaggaccaggtgaagacccagaacgaagccaacctgaaattcatggacgtggagaagaaaagcaaaacctcctacgcgaagtactttccgaacgtgataaaggaaatgcaggagtggggcgatatccgccagcgactggcgaccaaccagacctccctggtgtcctacttctttaatatcaccacgtataccgccgataacgcagaggcctctctcgctaccgagcagcaggtgctcaacagttaccgtaagggtggcttccagcttatcccggcccgctaccatcacctgcgtaattttctggccatgatgccgttcaaatgcggcgaaggcctgttcaaagagctgcaggcggcaggcgtggtgaagcgggctgagacgttccaggtggccaacctcctgccgatcgtcgctgacagcccgctggcgccggcgggactcctggcccccacctaccgaaatcagctggcgttcatcgacctgttctacgagggaatgaacaataccaatttcaacatggcagtctgcgggacgtccggggcgggtaaaaccggtctgattcagcccctcattcgcagtgtgctcgactccggcgggtttgcctgggtgttcgacatgggcgatggctataagtccctgtgtgaaaacatggggggcgtatacctcaatggcgataccctcaagtttaacccgttcgccaacgtgctggatgatgctcactttgacatgtcagcagaacgtatacgcgatcagatgtcggtgatggccagtccgaacggcaacctcgatgaagtccatgaaggtctgcttctgcaggcagttcaggcggcctggttaagcaagcgtaatcatgcacgcgttgatgacgtagtgcagtttttacaggacgcgaaggacagcgatgaatatgctgattccccgacaatccggggccgtctggacgagatgataatcctgctcgatcagtacacggtgaatgggatctacggggactatttcaactcagataaaccaacacttcacgatgacgcccggatggtggtactggagctcggtggtctggagtcgaggccctctctgcttatcgcggtgatgttctcattgattatttacatcgagaacaggatgtatcagtcaccgcgtggcctgaaaaaactgaacgtcatcgatgagggctggaagctccttgatttcaagaatggaaaagtggggcagtttatcgagaaaggctaccgtaccgcgcgtcgacataccggcgcatacatcaccatcacgcaaaatatcgtcgacttcgactccccgaccgcctccagcgccgcacgtgcagcgtgggggaactcatcgtacaaggccattctgaaacagtcagcgaaggaatttgccaagtataaccagctgtacccggatcagttcagcaagctggagaaagacatgattaacggcttcggctcggcaaaagagcagtggttctcctcctttatgctgcaggtggaagcgaactgctcctggcaccgcctgttcgttgacccgctcagccgggcgatgtactcctccaaaggcccggattttgagtacatgcaagcgcgccggcaggagggggtcgatatccacgatgcggtatacggactggcgtgccgcaactttaaagacgaaatggcagagcttgaatcccgaataccggtgaatgacatggaggataaacagtgatgaaaaacaacaccgaacaaccggtcagtacgacctctcatacctttcgccggatacctgtcatcgttgctctcgtgcttttcgccctggcaaccagcgcgtttctctcacgcgtggttctggagtactccacgccgcgggtggtggcttttgatatgaagaagacgctcgacagctttatggacagtgtgagtcagaagcagctgacagaggcgcagtccaaagcgctctctgatcggtttaacgacgcgctggagaagagtctggcggagtatcagcagcagcatcatgtggtcattctggtttcacctgccgtggttcagggcgcgcctgatgtgacccgcaacatccagcacgacattgcccgccggatgaaaggagaacagtaatgatacgactgaaagactgtctgctcgccgcctgcctgttatcgccgctgactcaggcggctgatctcggtacctggggggatttatggcccctccgtgagcaggacatgctgcagctcatcacgcagcgtctgcagtcgctgcaatcctctggccagtgggaccagacgatggacgcgtttaagcagcgggttatcgagaacagtcagcgtccggcgccggtggaaggcattaagcgtgcggagaaatacgagcagcgctggtttgatcccagcatccgactgaccgaagacctgaaggacaatgaggggcgggtgtttgcccgcaagggcgaagtggtaaacccgcttaaaaccgtaccgtttgtccagaccctgtacttcatcaatggtgacgatgccgaccagctggcctggatgaagcgtcaggtgccggaaaccctgatgagcaaaattatcctggtgcgtggcagtatcccggacacctccgcagcgctggacagccggatctatttcgaccagaacggtgtactgagcaagcgatttggcctgacggcggtcccggcgcggatcacgccggcgccctccggtgaacggctgaatattgagaccttcccgcccgtcccgcacccctgatctggggctgcgttttattcaaaagaggtaaccgatgccgatgatactggccttaataatcctgctcacgatgctcttgctgacgctaatgtggtccaccatccgtaagcaggagaatgtcatacgggaactcagtacaagagaaagctggctggagagagaggttgagcgtctcaggaccgataacgagaagctgtaccgctggctgagatacaacagtgaaaaggttatcgatgaaatgacttgtgaactcgatgcactgtccgccgttcgccagacgaacagggattcataccgtcgccagctttacctcttcgactgcctgtccctgatggtgtgggccgggatggagggcgccgaagactctacacgggaaaaggtccgcaataaaatcgatgccctccgtcttgttctcagggagaaaactgacgaatgaaagccatgttttttttaatctgcatcgcgttctcaacgttcagtggccgcgccgccgcagacccctcctgtgagggccggtttgttaacccgatcaccgatgtgtgctggcgctgcatcttccctctgtcgctcggcagcgtgcaggttggtaaaggcgacctgcctgataccagcaatcccggcagtcccctgcagctgtgtccggctccgccaccgctttttgttcgtcccggactggccatcgggtactgggagccgatggccatgacggacgttagccgttcgcctggctgtatggtcaatctggggggcttcagtatcaatctcggcaagaccggcatggggaccgcgagaaaggacgacaagcaggtgaacggcgccttctatcacgttcattggtacaagtacccgctgacgtactggctgaacatcatcacttcggcaggctgtctggaaggcggagacatggatatagcctatctgtccgagattgacccgacctgggtggacagcagcctcaccaccattctgaatccggaagcgatcctgtttgccaaccccatcgcgcagggcgcctgcgcagcggatgcgctggccagtgcattccatatgcctctggatgtcctcttctggtgtggtggaagccatggctcactttacccgtttaacggccaggtcagtaatgagtccagcccgctgcagtcgtcggtactggtcagtgagcgtatggccttcaagctccaccggcagggacaaattatggagagtatcgggaaggacaaggcagtctgttacgaatatccctccccgatcatcccgaaagaacgctggcgctatcagatggtgaacatgtatccggacagtggtcagtgccatccgcttggacgcagcgtgatgcgctgggaggccggcaaaaatccgcccaacacccgcaagaactatggctacctgatgtggcgtaaacgtaactgcgtatttttgtaagtcagacaggaaaaggataaatgatggaaaaagaacagaatcaatgttgccagcaacccctcctgcatcaggatgtatctcccactacatcccgggtcactttcagcacggataaaaaggtactaacggcagagcaatacagagactggcaatacattggcgcaaccctcagagaaaaaatgcagtcgaataactgaatatgtgatgcagggctatgcatttgtcatgacctgtagcaatagccaggcacataactctctctaattgaggtaattatgaataaaggaatcaccgggctggcctgggggctgagtctgctctgcactacggcgtcagccgctgacaatattaatactcccggggaccagcagtggctgaaacagcaggagaacctcagcgaacagctgcgccagcatccggataaacagctgcagcaggagcttgaggcgcaaatcagccgcaatcctctgcccaaatcagaccgccagtttatcgataatctggtcagccagcagaaagcggcgaatcaggaaaagccggcagaaggagcgctgtactttgtctccttctcgatacctgaagaggggctgaagcggatgctgcacgaaacccggcagtacggcattccggcgacactgcgtgggctcgtcaataacgacatgaggaccaccactgacgcggtgctgcagctggtgaaggatggcgtgaccgacggcgtgcagattgacccgacactatacacacagtacggcatccggagtgtgccgtctctggtggtacggtgtcaggccgggtatgacgtggtacgtggtaacattcacgtcaaacaggcgctggagaaagtggcacagaccggtgactgcgcacagctggcccggcaaatacttgatgcgcactcgaatgccgccgggagccagccatgaaagacagaccgtacttcatagcgttaccggaaatggtgagggatgagggagggtggaaatgaagacggttatttccgtgctgaccgcgcattttttagtcctgagcgcctttatctggctggcatctcccgcctgcgctgacagtggaagtgactataaagctggttcggattttgcgaaacaggtgcagggcaatggtctgaactcactgaaaaatttcagtggtgagcaaaacctgccggggtataccgccaacccgaatcagacaaaatactacggcggcgtcactgccagcggagacagctctctgaaaagcgattcagccctggagttcagccagggggacacaggcaaagcggttacggagtcgttcacaaaccggccaccggatcagatatctcaggatgcgccgtttattcaggccgcaaaggatacagaatcccgtgccgacagcattgtcggcgataccggacagtcctgtaccgcccaggttgtgaaccgcagcgagttcacaaaccatacctgcgaacgtgatctgcaggtggaaaatttttgcacacgggaagcgaccctgaaggataacgccaccacgcagaaagttaaccgaacctatcagcaggtggtgacgctgaattatgcccggagtacccggcaatggagtggcaacctgacgatcccgaccaatggtcgtctgctgaatgcctcggtggatggtgagcctctggtgatcccctggattgaagaatgcgattccgaagggaaggtgcgggatagctgcaagagtgcagtgagtgaaagcctgaccctctttgaacgaacgttccccattgatgtgatcagctggccacgttcagaatcgatgtgttcaggcggtcagaacacgcattgtacgaaatatacctatgacgggaaggggaagattcatcagtcgtttggtgtggacaaagcggccactgctgggcagaacttttcagtaagcaaaacatcacggaccgtatcatcggccagccagaaacccgtacaggtcacggtcaccctggtgatggaagaaaccgaaaccgtctatgcacctgaagtcgtctgggttgaaagctgtccgttcagtaaggatgaaggaaaaaaaacgggcgaggaatgtatcagcccgggaggaacgcgaaccatcaccctcggaggcagggattactcgttcacggaggcctgctggaaatataaggatacctggctcacgcaaccggcggacaacggctcctgtgaaagcctgatgaaaaatacggcttgtactctgtcatcccgccagtgcgccttctccagcgaggaaggcacgtgcctgcatgaatatgcaacgtattcctgcgaaaccaggacgagtggcaaacaaatgatctgcggcggtgatgtcttctgccttgatggtgaatgtgacaaagccacgtccgggaagagcaacgactttgggcaggcggtgtctgagctggcggcactggctgccgcggggaaggacatcgcggcactgaacggggtggatgtccgggccttcaccggaaaagcgaagttctgtaagaagtttgctgcgggcttcagtaactgctgcaaagacagcggctggggccaggatgtggggctggcacgctgcagcagcgaggaaaaggcgctggcaaaagcgaaaaaagacaagctgacggtcagtatcggggaattctgctctaaaaaggttctggggatttgcctggagaaaaaaaggagctattgccagttcgactcaaaactggcgcagatcgttcagcagcagggaagaaacggtcagctgcatatcggttttggcggagccagcagtcctgactgtcgggggattacggttgaagagctccagaggatcgactttaacatgcttgatttcaccaactttatggacgacctgatgaaaaatcaaaaaataccggaaaacgatgttctcaccaataagaccaaagaacgaattaaggaaatcatgagtcagcaatccgcgcaataaaccatgctgcctaataaagagaccgataatcatgaaaattaattttcacaaacagcctgccattgattttgtcctgagattaacactgacagtaatcattatttctccggtgatttatttctcctgggatgcagtcaaagggacgtcgggaagtgattatgtcgaaagtgtggtctttattcttatggctgggtttgccatgtctgtgtgttatttgtttttctcagccctggagaaagttataaatgcaaggaaaagcaaagatgaatcgatatatcacgattgagaaatttatagacattctgaatgaagagaatttaccccaggagcatcatgttatggtgctggctgttcttgcggatatctctctgcatacagacaggttcctgattaactcgtccgaactggttcagatggccgctcagtactcacctgctttccagaaactgccagcggaccggcaggcttttatatcttcagtactgagcatgccgctattccttattatgtgaccaggagagtcaatggaagagaaaaaagcatacgggctggtcatggtgtttgtcggggtgtttgtctttctcctggtcagcattatgtcgtacagcctgtggcgggacaggcaggttaacgcatttatgacaaccaaccgggcctgggggatccagtgcgacactgtttctcagaccgcgtgggtggtcagggacggggagcgggtggaccttcagataaatcatctgcctctgtactgcagcggttaccgctttgaagcccgtgatgatgcaggaaaggtacagcgccagctcgataaatacagtgtctatcagcatctgtcacgccagtcgcaataattcataaaagggtatttgtcatgcgaacaatacatgccgccatgctggcggggtgcctttactgcgccctgatgccggctttcgccaaagatgcgggctggcagtggtacaacgagaaactgaagccccgtgatgaggaaaggccagccgcaccagcggcaccaccgccgcaaatggatattctggagaaactcgccacactccaggcggccaccaaacggtcgctgtacgaagccattctgtatccatcgtctgaaaacttcgtgaagtacttccggctgcagaactactggacgcagcaggcaagtttgttctcgatgagtgcgaagaaagcgatgctggaaaacccggaactcgattacaacctgcagtacagccactacaacggcacggtaaaaaaccagctcgccgccgactatgccgaacagcgtcaggctatctccaccctcgcacagcactacggcgtgatgttcttctaccgggggcgcgaagcgatcgatggccagctggtccaggtgattaaaaacttccgcgaaacctatggcctgagcgtcataccggtgtcggttgacggcgtgattaaccccatgctgcccgacagccggacggaccagggccaggctgagcagcttggcgtgaagttcttccccgcgatgatgctggttaacccgaaaagtggccaggtgaagcctctcagttacggctttatcagtcaggacgacctggcgaaacagttcctctatgtctccagcgactttaaaccgaatttctaaggagtgtgtcatgcgaaagattcgttttccggatttagatatcaccgggatgtgggtgctggccgtgggcgtgtttttccacctgatagcccggcttgtcagaaagcagcctgagctggccgtccaggccggggaaatcttcgggctgggaatggtggtgttcgggggataccgcattcttaacgccctcattgctgaagccgaaaaagaggagaaagcctgtgaaaagcatcctgaagaacatcgctaagacgccgctggcggcgctggctctttcccttgctctggccggactggcacaggcgggaacgttcgatgaggtgaagtcgctctgggatccgcggggaatctccggtactgaaacggcttccccgcagagcgacactccccaggtggagagcggggcatctcagccacgctggttacgactcagcaacggaaagcaggtggacctgcgcgactggaaagtggtgctgttcatgcagggacactgtccatactgtcataaatttgacccggtgctgaagcagctggccggacagtatggcttctccgtgttctcttacaccattgacggacagggtgatgacgcgtttcctgaagcgctgccggcgcctcctgacgtgatgcagacctttttccccaatatcccggtggccaccccgaccacgtttctggtcaacgtgaacacgctggcagcgtacccgatcctgcagggcgccacggatgcacagggctttatggccagagtggatacggtatttcagatgatgcactgagtctctgttatatccggtcttagcaagtgattaaggaaaatagccatgaacaaatatatacgttcgacgggactgtatgcgtttttatttccagccagtttaaaagcacccgggcagacagcagcagaaaaaatagaacaactgaagccggaatttgtccaccgggaaaggcgtatggaaatctatctggaattattcattgtgtttctgactgcaggtgccctgctgttatggataatgagatttttatttaatctctgcgtggctgactggatagccagcggtgacctgcgagtaaaagacctgtggaatattatgatgtacgccatcccttatgcgctgatggctgtcgggatggggttctttgttgccggagtgacattagcaatcctcaattttttcagtcatcacctgaaaatcctttttattctgagaaataacagagttaaaaataatgctgtgcgtaatggaggacaggatgcgaattaaacttctgtcactcttctgcggtgccgcgcttggcctgtcatttagtgccgccgccgacgtgaatggcgacatgaaccaattcttcaataagcttggctttgcgtccaataccagccagccgcaggtctggcagggacaggcggcgggttacgcctccggcggttcgctgtatgccagaacgcaggtgaaaacgatccagctggtcagcatgaccctgccggatattaacgccggctgcggcggcatcgatgcgtacctggggtcgttctcatttatcaacagcgagcagctgcagcgcttcggcaaacaaattatgtccaacgccgcgggctacttctttgaccttgccctgcagaccacggttccggagatcaaaactgccaaagacttcctgcagaagatggccagcgacatcaacagcatgaacctcagctcctgccaggccgctcagggcattgtgggcggtctgttcccccgcaaccaggtggcgcagcaaaaggtctgccaggacatcgccggtgagagcaacatttttgcggactgggcggcttcccgtcagggctgttcggtgggggggcagatggacaaagtgcaggataaagccagcgataaggacaaggagcgtgtaatgaagaacatcaacattatgtgggatgccctgtccaaaaaccggctctttgacggcaataaggagctgaaagagtttgtgatgaccctgaccgggacgctgatttttggtgagaacagtgagatcaccccgttgccggcacgcaccactgaccaggatctgattaaagccatgatggagggcggcacggctaaaatctatcactgcaatgattcggataagtgtcttaaggtcgttgctgatgccaccgtgaccatcacctccagtaaggcgctgaaaagccagatttccgctttgttaagcagtatccagaataaagcggtggctgatgaaaaactgacggatcaggagaaagggtttatctccagcaccaccattccggtgttcaaatacctggtcgacccgcagatgctcggtgtgtctaactcacttatttaccagctgacggactatatcggctacgacatcctgctgcagtacattcaggaacttatccagcaggcccgggcgatgatctcaaccggtaattatccccagtcgacaatggatatgatcatggaaaacctcaaccaggcgagtgtccagattgccgctttccagtcccgcgttcaggttcagcaggacgccttgctcgtggtggacagacaaatgagttacatgcgccagcaggtctctgcccgcatgatgacccgctaccagaataactatcattttggggggaatcagtaatgcttgaggtatatgccattgcaggcggtgactggttacggggcaacctgaacgcgattgcggcgtttatggagaccggcacatggtcgaccatagaaaagatgtgtatcgccatctcggtactcattgtggcggggaactgggtaaaaaaacacaacgtgatggaccttttgggctgggtcttttccctcaccctggtctctatgctggttgtcattcgcacccctgtgcagatcatcgattacagtaacgttgcgcaggtctatgaagtcgataatgtacctattggtctggccattccggcgtcgctgacaacgcgggtaggaaacgcgcttatccagagttatgagatggtcttcgcgctgccggacagtgtcacgtacagtaaaacggggatgttatttggcagtaatctggtcgcgaaaagtacggattttttgtcacaaaatcctcagattacgacgctgttttccgattacgtacaaaactgtgtgatgggcgatattttcctcaatcataagtactcttttgaggaattactgaattcacctgatccgtataccctgatttttgcaaacccgagtccactgcgtggcgtgtttgacaaaaacaaccagttccagacatgcgaggaggcctcacgggatctgaaatcggctctcgcgctggatactcagacaggcggtaaaacctggaactactatgttcgtcagctgtttggcggcaaacctaatcccgatctgcttttcagccagatgattggcgacagctacaattacttctacagctcgggacagagcgccgggcagattatccgccagaacgtcacgatgaacgccctgcgcagtgggatccagagttatgcggcccgcagcggggacaccgccagtctggtcaatatggctaacacatcatcccttgaaaagcagcggctggcacaggccacaatggggcaccaggcgcttcgcacacttccgctgatgcagaccgttatcatggggataatgattgggatgttcccgatcatggtgatggccgccatgtttaatatgatgactctgcaggtgctaaaggggtatgtgtttgcgcttatctggctgcagacgtggccattactgttcgccatcctgaacagcgcaatggcctactatgcgaagcaaaatggcgtcccagtcgttctctctgagttgtcgcaggttcagctcaaaaactcggatattgcgaccaccgcgggctatattgccgtgatgataccgcctttgtcgtgggggatcgtgaagagcatgggagcagccttctccagtgcctacagccatttttcttcatcggggctcagtgcaacatcgcaggctgcctccggcgtggtggacggcaattactctttcgccaacatgcagatggagaacgtcagcggctacagctggggtaccaacagtacaaccagtttcggacagatgtcacggcagctggcgaatgggggcatgagcacgcagacgagggatggatcgatggtctgggacagtggtggtgcaatgtcaaaactgccggtggatatcaacgtcggtcgtcagatagccagtgcgcagcaacagatggcccgtgaggctgatgtccaggccgaaagcgcgctgcatggctataacagcagcgtgacaagtgcctggaatagtctgcagcaatttggcaccaataaagggaacagcgcctcaacaacgaccggagctgatactaccgattcttcgcaggactcgatggccagaagcaagatgtggaatgcggttgttgctaatgcgaaagccaacaacatcagtaatgaggagtctttccagcagttgatggatgattcagctaaaagtacgcagggagttgatttatacggatctggtaagtggagttcaggggatcagctgtttggtaagctaggtaaatggggaactgggttatctgctgaggccggagttaaaggcagtgcgggttggacccacagctcgggtaacacagataatgttggcacttccggtcgtgaatcgaatgacagccgacatgataccagtagtcaggcggccaaagactttaaggaagcatccgattactttaccagccgcaaaaccaccacatcgggcaacattaccgataataatgccagctcgcgtgttgaccagtttgccgcgtcactctccagtgccaaaaacagctatgaccagtatacaagcagccggacacgcagccatgagtacagtgagatggcgtcacgcacagagagcatgactggccagatgaacgaaaacctgactcagcagtttgcgaactttgttcagcatcgtgctccacaggatgccgaggccattctgaccaataccagttctcctgaaattgcggcgcagcgtgaagccctggcgcgtgaattcgtcaaagagcaggtagaacccagggttgatgctgcgtatcaacagggtcgtgaaagcattggacagaatatggctggggtgtcaggtggtggtgacaatggatcggtaatggccgactaccgacaaaattctggtcgtatcgatgctatgacgcaagatgcgggtattaaggataatgtggatcagaaagttggtgggatgattacagagaataaacaacagcagcaggaaacccgcgaaaacatacaacggcaaggcgcagaggtgaaaaatgagaatactgaaatggaaaaggaccataaaacaaaagcaaatgagtttaaaggtgattataatgaaagaaagagtaaggtgaaatctttaccaggagctgactcgcctactgagttagaggcaaaagcggcgaaaattcaaaaggattatcttgatggtaaaaggtaaaaatgatgattacgaacaaactacttattgaggaagtggaggagctgaaaaatctactttcacaagggaaggctgaaattccatctttttgggagtgcctttggcctggcgtagtgttagttgcatggaatatgctttgcgctgtaattagtgtggatgctgtttatttgaccggaaagtatatatttcatgttttggtttttcctgtcggggtcagtatcattatgctcctaggtattgccagttcacgctctctctttttgtcagtccctaaaaactttagagaaaaatcgaatatatatcgctttttttctaagaaggtttcgatttatgctgttgtgtacatggcagtgattatgttattagctatttgtaatagagtggtttatgacacgccattttcttttgcatttatggttattttaacgtctgttttttttggttttgtcatgaatctggattttggacgctatcagctatcattgctcacctctgcaataaactctttccgagcggaaaagttgggggggtaatcatccagaagcgacctatcaattatggtggtttattaacagactaaaaatttcttttggttattattatctgtctaggttgttattggtttttacatctcgcttaaaattcgtatatagtgaatgcgcattccgaaatcataagagaatgtgtatttactcgtattgattatgtcacaaggattcaggatgaagcttaataaagtcatggctgtgatggtcgtcagctctgcgctggtgttatctggatgtagtgcaatgggaaccgccattaaaaagagaaatctggaagtaaaaacccagatgagcgaaacaatctggctggaaccttcaaataataagacggtttatctgcaaatcaaaaatacctccgataaggatatgagtggcctgcaggcaaaaattgccagcgccgtcacttcaaagggatatcaggtcgtcagtaacccggatacggcgggctactggatccaggcgaacgtgcttaaggccgataaaatggaccttcgtgagtctcagggctggttaagccggggttatgagggcgctgtgactggcgccgctttaggggcagggattaccgcttacaactccagttctgcgggagcaaccctgggggtaggacttgcagccggtctggtggggatggcggctgatgcgatggtggaagatgtgaactacaccatgatcaccgatgttcagatcgcggaaagaaccaaaactcaggttcagactgataacgtggccgtattacgtcagggaacatccggcgcaaaagtgcagacaagtactgaaacgggtaatcagcacaaataccagactcgcgtcgtctctaacgctaataaagttaacctcaagttccctgaagcccagcctgttcttgaagaccagctggcaaaatcgatcgctaatattctgtaagctttctattccacggcccggtccccgggccatactggcatcacctttctggtgtgtcagaattcattcgtcaaataatctatgaattccagatctgaacggtgaacagttgcgcaatttatttgtgcatctgtgaggcgttgccgccttcggcggaatattttcgtctttatttgatcagaggttatttatggcaatatctgaacctgtcatgtctcttgaaacacataaactgatgcctggcgatatttatccacaccctgctatggggggcttattccctgcaaccccgtgaggtctgttttcgctgattaatttgtccttccgaccctaataatttactgacggattagtgccatgagtttcaatgccaaagatatgacgcagggcggtcagatcgccaatatgcgctttcgcatgtttggtcagattgccaatattattttctacgtgctgtttattttattctgggtactgtgcgggctgatgctgatgtataggcttagctggcaaacctttgtgaacggctgcgtatactggtggtgtacgacgctgggtccgatgcgcgatattattcgttcccagccggtatacaccattcagtattacggccagtcgctggaatatacctcagaacaaatcctggccgataaatatactatctggtgcggagagcagctgtggaccagtttcgtctttgctgccgtggtttctcttgttatctgtatcgtgacgttcttcatcgccagctgggtgctgggccgccaggggaaacagcagagtgaggatgagaataccggcgggcgccagctttccgataagcccaaagaagtggcccgccagatgaagcgtgatggtatggcctccgatattaaaattggcgatctgcctattcttaaaaactccgaaatccagaacttctgcctccacggtaccgtaggctccggtaaatcagaagtgatccgccggctactgaactacgtgcgtgcacgtggcgatatggccatcatttatgatcgctcctgtgagttcgtcaaaagctattacgacccgtcactggataaaatcctcaacccgctggactcgcgctgcgcggcctgggatttgtggaaagagtgcctgacgctgccggacttcgacaacatctccaacacccttatcccgatgggtaccaaagaagacccgttctggcagggctccggtcgcactatctttgccgaaggcgcgtatctgatgcgcgaagacgacgatcgcagctacgagaagctggtcgataccatgctgtccattaaaatcgacaagctgcgcgcctatctgcagaacacgccggcagcgaatctggttgaagagaaaattgagaaaaccgccatctccattcgtgccgtgctgaccaactacgttaaggctattcgctacctgcagggcatcgagaagaacggggagccgttcactattcgggactggatgcgcggtgtccgtgaggacagacccaatggctggctgtttatctcctccaacgttgacacccatgcttccctgaagccggttatctcgatgtggctgtcaattgccatccgcggcctgctggcgatgggtgagaaccgtaaccggcgcgtgtggatattcgccgacgagctccccacgctgcacaagctgcctgacctggtcgaaatcctccctgaggcgcgtaaatttggtggttgttatgtgttcggtattcagtcctatgcccagctggaagatatctatggcgtcaagcctgccgccacgctctttgacgtaatgaatacccgggccttcttccgttcacccagcagggagatcgcggagtttgctgccggtgaaattggcgagaaggaaatcctcaaagccagcgagcagtactcttacggtgctgacccggtgcgtgatggtgtatcgaccgggaaagaaaaagagcgggaaaccctggtcagttactccgatattcagacgctgccggacctgtcctgttacgtcacgctgcccggaccgtatccggccgtgaagctggccctcaaatacaagccgcgtccgaaaattgccgagggatttattcagcgccgactcgatacgcgtgttgacgcccgcctcagtgcgctgcttgaagcgcgtgaatctgaaggcagtcttgccaggacgctttttatgccggatgcgccggcatccgggcccgcggatacaaacagtcacgccggtgaacaacctgagccgatcagtcagcctgcgccagcagacatgacagtatctccggcaccggtaaaagcgccgccgacaacaaagagtccggcagcggaaccttccgtcagagcaacggagcctcccgtcctgcgggtcacgaccgtaccgttgatcaaaccaaaagcagccgcagcggccactgctgcctcaacagcatcctctgccggtgcccctgcagcagctgcaggcgggacagaacaggaactggcgcagcagtccgcagagcaggggcaggacatgcttccggccggcatgaacgaggacggtgtgattgaagatatgcaggcgtatgacgcctgggcagatgagcagacacagcgggatatgcagcggcgtgaggaagtcaatatcaaccacagccaccgccacgatgagcaggatgatgtcgagattggggggaacttctgatgcttagtttcagccaggttaaatcagctggcagtgccggtaattactatacggacaaggataattactacgttatcgggagtatggacgagcgctggcagggtaaaggcgcggaagcgcttggtcttgaaggaaaggtggacaagcaggtcttcacggagcttctgcagggaaaactacctgatggcagcgacctgacccggatacaggatggcgtgaataaacaccggcccggttacgatctgaccttctcggcccccaaaagtgtatcgatgctggctatgctgggcggcgataagcgtcttatcgatgctcataatcgcgcggtgacagtggctcttaaccaggtggagtcccttgcctccacacgggtaaagagagatggcgtttctgaaacggtcctgaccgggaatctgattattgcccgctttaaccacgatacatcgcgcgctcaggacccacagatacacacgcacagcgtggttatcaatgcgacacagaacggcgataaatggcagacgctggccagcgataccgtcggtaaaaccgggttttccgaaaccatactggccaaccgcatcgcattcggaaagatataccagaactctctcagggccgatgttgagtctatgggttacaagacagtggatgcgggtaagaatggcatgtgggagatggagggcgtgccggttgagtggttttccacgcgcagtcaggagctccgggaggctgcaggacccgatgcctccctgaagtcccgggatgtggccgcgctcgatacccgcaagtcgaaagaagccatcgatccggcagagaagatggtggagtggatgaacacgctgaaggagaccgggtttgacatccgggggtaccgtgaggccgccgatgcgcgggccgcagagctggcccgtgcacctgccgcgccggtgaacactgacggtccggatatcacggatgtggtgacgaaagcgattgccggtctcagcgaccgcaaggtgcagttcacgtatgccgacctgctggcacgcacggtcggccagctggaggcgaaggacggtgtctttgagctggcgagaaagggcatcgatgccgccattgaacgggagcagcttatccctctcgatcgcgagaaaggcctgttcacctcaaacatccacgttctcgatgaactcgccgtcaaagccctgagtcaggaggtgcagcgccagaatcatgtctctgtcacgcccgatgcgtctgtggtgcgccaggtccctttcagcgatgccgtcagcgtgctggcgcaggatcgcccggtcataggtatcgtttccggtcagggcggtgcaaccggccagcgggagcgggtggccgagttaaccctgatggcccgggagcaggggcgtgacgtccatatcctggcggccgataaccgttcacgagattttctcgccggtgatgtgcgtctggccggggaaacggtgaccggtaaatccgccctgcaggacgggacggcgtttattccgggcggaacactcatcgtggatcaggcggagaagctgagcctgaaggaaacgatttccctgcttgatggcgcgatgcgccataacgtgcaggtcctgctctccgacagcgggaagcgcagcgggaccggcagcgcgctgacggtgctgaaggacagcggcgtgaatacgtatcgctggcagggtggccatcagaccaccgccgacatcatcagtgaaccggataaaggagcacgctacagccggctggcacaggagtttgccgtcagcgtgcgtgaagggcaggaaagcgtggcccaaatcagcgggacgcgtgaacagagcgtactcaacggcctcatccgagactccctcagacaggagggggtgctgggtgagaaagacacgaccattacagccctgacgccggtgtggctggacagcaaaagccggggcgtgcgggattattaccgggaggggatggtgatggaacgctgggatccggagacccggacgcacgatcgctttgtcattgaccgggtgaccgcgagcagcaatatgctgaccctgaaagaccgggaaggggaccgtcttgatctgaaggtttccgcggtcgacagccagtggacgctgttccgggcagatacactgccggtggcagagggggaacgtctggcggtgctcgggaagataccggacacacgccttaagggcggggagagcgtcacagtgatgaacgtggaggacgggcagctgacggtacagcggccggggcagaaaaccacgcagaccctggccgtgggtgcgggcgtgtttgacggtattaaagtcggccacggctgggtggaaagtcccggcaggtcggttagcgagacggcaacggtctttgcgtcggtgacgcagcgtgagctggataacgccaccctcaaccagctggcacagagcggaagtcacctccggttgtactcggcgcaggatgcggcgcgcacgacggagaagctgtcgcggcataccgcgtttagcgtggtctcagagcagctgaagtcccgatccggcgagacggatctggatgcggccattgcgcagcagaaggccgggctgcataccccggcagaacaggccattcacctggccatcccgctgcttgagagccaggacctgaccttctcccggccccagctgctggcgacggcaatggaaaccgggggcgggaaggtttcgatggcggacatcgacacgaccatccaggcacaaatcaggtcggggcagttgctgaatgtaccggtggcacccgggcgtggcaatgacctgctgatatcccgtcaggcctgggacgccgagaaaagcatcctgacccgggtgctggaaggtaaagacgcggtggcccccctgatggaccgcgtgccggacagtctgatgacggaactgaccgccggacagcgggcggcgacccggatgattctggagagcacggaccggttcacggtggttcaggggtatgccggggtggggaaaaccacccagttccgggcagtcatgagtgccatcagtctgctgccggaagagacccgcccgcgcgtcatcggtctggcgccgacgcatcgcgcggtcggggaaatgcagagtgccggcgtggatgcgcgcacgacggcgtcgttcctccacgacacgcagctgctgcagcgcaatgggcagacacccgatttcagcaacaccctgttcctgctcgacgagagctcgatggtggggctggccgatatggcaaaagcccactccctcatcgccgccggcggtggacgggcggtgcccagcggggataccgaccagctgccgcccatcgcgtcgggccagccgttcaggctgacgcagcagcgcagcgccgccgacgttgccatcatgaaagagattgtgcgccaggtacctgagctgcgaccggcggtctacagcctgattgagcgggatgtgcaccgcgccctgaccaccattgagcaggtcacgccggagcaggtgccgagaaaagaaggcgcctgggcgccgggcagttctgtggtggaattcacacagaagcaggaaaaggagatagaaaaggcactgagcgaggggaaaaccctgccggaaggtcagcccgcgacgctctacgaggcgctggtgaaggactataccggacggaccccggaggcacagtcgcagactctggtgatcacccatctgaataaggaccggcgggcgctgaacagtctgatccatgacgcacggcgggagaacggggaaaccggcaaagaggaaatcaccctgccggtgctggtcacgagtaacatccgtgacggtgaactgcgcaaactgtcgacctggacggctcacaaggaggcggtggcgctggttgataacgtataccaccgtatcagcaaagtggataaggataatcagctgatcaccctgacagacagtgaaggaaaggagcgatttatctcaccccgggaggcatcggcagaaggcgtcacgctctatcgtcaggaaaagatcaccgtgtctcagggggaccgaatgcgcttcagcaaaagtgacccggagcgcggctatgtggccaacagtatctgggaagtgcagtctgtttcgggtgacagtgtcacgctgtctgatggcaaaatcacccgtacgctgaccccgaaggcggagcaggcacagcagcatatcgacctcgcctacgccatcaccgcccacggcgcccagggggccagcgagccgtatgccatcgcgctggaaggggtggccggtggccgggaacagatggccagctttgagtctgcctatgtggctttatcccgcatgaaacagcatgttcaggtctacaccgacaaccgtgagggctggataaaggccatcaagaattcacctgagaaagcgacggcgcacgatattcttgaaccccgtaacgaccgggcggtgaaaacagccgatctgctgttcgggcgggcaaggccactggatgaaaccgccgcgggccgggcagccctgcagcagtccggtctggcacagggaagttcaccaggaaaattcatttctccggggaaaaagtaccctcagccgcatgtggcgctgccggcatttgataaaaacgggaaagccgccggtatctggctcagcccgctgaccgatcgggacggacggctggaggctaacggcggagagggacgaattatgggcaatgaagacgcccggttcgtggcgctgcagaacagccgcaacggagaaagcctgctggccgggaatatgggggagggcgtcagaatggcccgcgacaatcccgataccggggtggtggtgcggctggccggtgatgaccgcccctggaaccccggggccatgaccggcgggcgggtatgggctgatccggcgccggtgggtccggtaccgcaggccggggctgacattatcctcccgccagaggttctggcgcagcgggcggcagaagaacagcagcgccgcgaaatggaaaaacaggcggaacagactgcccgggaagtggccggggaggcgcgtaaagccggcgagccggcggaccgggtgaaagaggttatcggggacgtcattcgcggactggagcgtgaccggccgggtacggagaaaacgacgctaccggatgatcctcagttccggcgccaggaggcggcgattcagcaggtggcctcagaaactctgcagcgtgagcgtttgcaggctgtggagcgggacatggtgcgtgacctgaaccgcgagaaaaccctcgggggcgactgacgcgcctgcggcttgtctgccccggcagggcctccggttaacaccggacaccctgccggggtgcggaaaaaagagagaaggatacagagatgacagcacacacaatgggtttcagagccgctgaccgctggctgcaggcattactgacctggacaccgggtcagacggatatgattaaaacggtggccctggtcctgatggtcaccgaccatgccgggttactgctggcacacaataacgagataatgcggcttctgggacggggctgttttccgctgttcggtctggcatggggaatgaatctggcacggcacgcggaaatacgccagtcgcagctcaacagcctgtgggtctgggcgctggttgcccaggtgtcgtttatgctcatcgggtacccgtggtataccgggaatattctgtttgcctttgccgtcacgggccaggtcctgcggtgggtcagccagccgtcctggtattacaccctcccggcggctggactgctggtcgcctggatacccctgtcaaccgccagctacggcatggccggagtgggtatgctcaccgccagctggctgctttgtcgcgcacagcatgcaccggaacggctgggatacggtgtgctgtgggccctcatggtgttgctgatgaatatgaatgacgtgagtgaatcagtggccgggctggcgattgcgctgctgacgctgatggtgtgctcatctgccggagagcgtgtgaaacgcttctggccgcggcagttcttcgtgatgttctatgcggtgcacctggcggtactgggtattgtcgtctcaatgtgaaaccaagagcaggaaagggcgatgtcgttcaggtatagtagctcttattagctgaacgataggcaattgttatggcagaagaaaaacgccctgtactgagcctgaaacgaaaaccggcggagaacagtacgacccccgcagaggcgacccctgctcctggtgtggtgcgccgtaagaaggtcgtggtggtctcgtccccgccggcctggaaggcaaagaaagcgaaacttgagaaggttaaacaagtggccgaagccgccgcgcgcaacactgcgccggcgccggttaaagcggtaaagacgccacctccggtgcgttatcttcgcctgctgccgccggaacaggccattatgacgctgaaggctttctggccacagctgttcgacggaaactccccccgtctgctggtaacgggcatgcgcgaacagctgtttgccgatattgtgaagcgcgacctgccgctgtcgcataaacaggtgatcaagtgcctgaagagtctgacccggtctgcgggctatctgtcccggatgaaggtgggggcctcccgctatgatctgcaggggaatgccgtcgcgaccgtcaccgcagaggaagcgcagtacgccagtgagcgcatgatgaaagaactcctgcgaacggagcgtatgcggagccagtctgctgactgaatacaatcggggagaggaaatggattttgaagcgcggaaacaaaaggcgctggcgataatggccagccgtaagatgtggaaaagcaattatgcaccgcttctgatacgcctgctgtggcggctggggataaagattccccctctgccgtttgctccgctctggcaggtttttggcgtgatgacagcctctttctccgtcggatacgggctgtggatgtactggatggtgtggcgggcccaggggatgtcccccctgttcgcttgtaaaatcagtcttatcgccggcgtgttatttggcctgacgatggcgttgtttcatctgtggcgccgaaaggtgaataaattacctgactggaaagatttataacggaatcagaagaacgccggaaacaggacttaccctggctgaatggcatgaattttcgcgctatgcacttgcgtgcatactcatgcatgccgtaaaaacagagcctgcgcgtttctggcgggttttcgggtggtttgttgcctgttttaccggttttccgtcagaaacgccctgaggccgttttagcggtgcgtacaattaagggattatggtaaatggtgacttggttaatcataaacatcctgggggatggcatacaccagctggatatccggtgcatcgttgagccatcgacctgattttttcatcaggtagccaccaatttcttcggtagtcagccgagcatgaaacaatgcttcatcattgaaccagcagtcagggtgatagatgagatccagtgggtttgccctgaaattaatctccagtaactggagtgcatagctgtggtcagatgcactaccttctgctttgcgtataaagttgataacgtcgttcagttctgtccatgtaaagtcatcaaggtatttttcctgattaagcgccatcctggtgaaatctagtgcacttgtccaggatgaaaaatcacgaaaatcagagaacccgcagggcatgacgacctgtgcattccagtctgccatcatctgttttagttcttcattgttttcgtccatcccgttatcgatgtgatcgagaatgccattcagctgactgaccagttctttcatctgtttacgggtgacccgtgcgggtttcattcgctcaggtaatggcatcagaaatactctcttttttatcgtgcactcgggggaactaagtaatctatcgggctatgaatcagagctcaaatcgtttttttttctttctgatgatccgcattcagcgcttttgtggctgtaggcccatcagaagcagaaaaagctgcacgagcggagaaggtagctaaggaaaaacagcaagcagaagaggctgcaaaagcattcgcagcgaaaacagcagcggcatccgccgctgcggaaaaagaacgtcagaatgcgatttctgctgcggctgctgcaggtcaacatcaaactgttcctgatgcgcgtaataatctgaatcaggcgactgctgaagcatcacgcctgaaaacagtggcagataatgcccttaatacagcgaagaataagcgaaaggaagctatcgatgccgtaccagtagcaactcaggctgagaaaaaatatcaggatctgcagcaaagcattaaaggcctcacgctgaataataacggccaatacggtacccaaaaatgggaggttatcagttcgaataaagagcatgaccactggggataccggttctatccatctgggatcacaaaagctcaggttgatgcagcgcagaatgatgcggtgaacaaacgaaatgctgcctccagtcttgccagccaggcaacggccgctgagcaggccagtctgcaggcatcagctgcctataatgctgcagaaacgcgccgtcaggctgcccaggttgcattagcgtccgcagaacaagccgccgctgcggcagaaaaaaacgacaggctgatgcagcagcgaaagccgctgaggaggccagaaccattgccgaaaaagcaaaagcgctgctggcccgtcgtacagccgcagataaactgaaatcttcagagattcaggctgtcaggggtatcccggctacagcggcaccttttgctattcctctgacctggtcaactgcgtcacgtggaggttttactctgtcggctgatgctgcggccagcctgggagctttcatcagcgaggctctggcgacgttacgtgtcgctgtggtggctaacccggtagcattaaccattgccggtcttgtgttatcgaaatcagttggcgtcggtagtgatatggtgcccggtcgggatatcagttcgatgatgcctggcgatgcgtttagtctgcctgataccgcggcattgaataaagcagcagatcagaaaacatctgtcagtatgccggttcgtggccgtctggttatgaatgatagcggcattctggatgttcagctggtcaaaaccaatactgccggtgccgtgaaggtcgctcgtgctgtactggataaggaaaccggctactggggctatactcttcccgttgtcgcagatgttccggcgcaaactatttttgtcagcccggctgacgcacctggtgcaaacggaccactgacgctaagcgggccggtaccactaccggagcgtattctgcataccggtgatcagatttcggcgccacaggctacagataaaaccgtgacgccggtagcggatgacctcgattttgaagatattattctggtgtttccaccggagtccggcctaaaaccgctgtatatgatgtaccgtagccctcgtaacatgcccggtacagtaagcggcaaagggcagaacgttggcaataactggatggggggggccagtaccggggatggtgctcctgttccttcccagattgcggataaattacgcgggaagactttcggtagttttgattctttccgtcgggcgttctggaaagcggttgctgacgattctgcactaagcaagcaatttagtgaagctgatattaatcagatgaaagctggaagggcacctactgcggactttttagaatcagtagggaaacgtgttaaaattgaattacaccacgaaaaagaaatatctcaaggaggggctgttatggatgtcgataacattaaggcgctaacacctaaaaatcatattgagacacataaaggaaaataaaatggctggtaataaaatttcagattttacggaagaagaatttactgcttttgttagtaaaataatcgctgctgattttcaaactgacaaagagaacgatgatgctatttattcgttcgcccaactaacagagcatcctgctggttggaacctcatcttcaagcctaaggtaggcgaagattcttcggcgaaaggaattgttaaaaccgtaaaggaatggcgagctgctaacggtaagccaggttttaaaaaatcgtgattgaatgtgcgggttcaggtgatgaatccgcacatttttaactctggatttgaagaataattactagatatccattattttttcctgtctccaaactgaccccatgatggatggtttatggctctgtccaagataccggcgacggacccgtctgctactggtttcggcataccacaaaatcctgacgcctccgcatggcgtcgttgtccaaccccgggaacggggaaaagccagtttcccccgctcccggcgtttcttaaacacccgttaaggaaatactgtgaaaaaaatgaaccgtacgctccgcagatgttgtctgtccgggcttatcagcctgtctttgtttgcaccttttccggttgtgtatgccgacagcatcgagacgggatattcgccggaaggaacggctctgcagctggtcctgaagactattaattctgcacagcaggaaatccggctgatgggctattcctttacctcacccgaagtcgccggcgcgcttgtcagggcaaagcggcgtggcgtcgatgtgaaagtggttctggactggaaagccaataccggcaagcaaaaccaggcgagtctggcggccatgaatcttctggtcaatgccggcatcccggttcgcacagtgtcgcagtacaaaattatgcatgacaaagtcatcattgctgatggccgcaatattgaagtcgggtcttttaactacacccgctccgccgatcgggtcaattcagagaacgtgctagtcgtgtgggatgttccagtcgttgctcaacgctatctgcagcactggtcgacccgctggtcgcagggaacggactggaaacgggcttattaacgcacctcagccataaaacgagcatcaatacggttcacttacgtccatgctaaagcgcctgaaccacccgtcgctcgtatcttacctcttaagtcttgcccctgaaggtactcatttttagttcaggatggggctactctccatctctcttacaagaggacatgggcatctcatttagttgaaatttgtacgccaatacaaatgacaatcttagaaaggatctcttgcaaattgaaagtaagttattgatttgcaggatctgagagttctgtagtatcctccgttccgaagacatttctgaggtgtcaggagagcgataaatgtcacgtccagcagataaaacaacttcctctgcgaatgcaaaacgtgcataccggaaaggtaagccaatgtctgccagtgagagacagcttgccgcgattgcgcggaaacgcgaaacgcataaagaagttaaggtttttgttaaaaacccactaaaggacgtgatgatagcggtttgtgaagaagaaggtctgacacaagcccagtttatcgagaggctccttgagcgagagcttacagaacgcggtcttttagatgtaaagacttcacattcttgatcatgtttatattgagtgctagattgttgatggtctgaataattttgggtgtgccacgccgtaaggtggcagggaactggttctgatgaggtatctacccgggaccagaaaagcaaaaaccccgataatcttcttcaatcttggcggaacgaaaagattaacggggccttcataaactgcatagaacgtgttgctctatgcagggagtatatgtacatgctcagaaaacttcaagatcagtttctgtgtcattcgctccttccgtgcaacataagcgcaggaagcggtgactgatatccttcaaaaccactattcacaagttaaaaacccgaacccggttttcacgccgcgagaagggaaaaagaccctgccgttctgccgtaagctgatggcgaaagccgaaggcttcacgtcccgttttgatttttccattcatgtggcgtttttgcgttcgctgggtaagcggcacaggatgccaccactgttgcgccggcgtgcaattgacgcgctactgcaggcaatgtgttttcactatgatccactggccaatcgcgtgcagcgctcgattaccaatatggccatcgagtgtggactggccaccgagtccaggagcggcaacctgtcagtcagccgtgccacccgggcgctgaagtttctggcggagctggggctcatcacctatcagacggaatatgacccgcagatcggctgtaacatcccgaccgatatcaccttcaccccggctctgttttccgcgcttgacgtttctgaggtggctgtggtggccgcgcgccgcagccgtgtggagtgggaaaacctgcagcgcaaaaagcagaaactgaaaccgctggagatggacgagctgatcgcaaaagcgtggcggttcgtgcgtgagcgttttcgctgctatcaggctgagcgtaaatctcacggccggaagcgggatactgcacggcgggatgcatcacggcagcgtcatgacatcgagacgcgcgtgcgtcagcaactgacccgcgaatacgccaccggacgcttcaggggagataaagaagcgctgaagcgtgaggttgagcgccgtgtgcaggagcgcatgctgctgtcgcgcgggaacaactacacgcgactggccactgtgcccatataacattaccttccttaaaaaatccggccggcgccggaggctttcgctcgcctgttgcccggctactacgtattatcttatcttcaggcctgcattcctcaccataattccggtcttcctggcgtcaacgtggccttaaatgttatcgccggcgtcacttctgacggccgatttctgttatccacatataactgcaagggagtatttcattaggctacaaccgtgatacgcacaaagcacatgccgtcggactttcaaggcgcgtggttccttttaaacaccagctctgtacctcttttaaagatcctttaataaatcctgtaaacacataacctgttcatcgcctgccctgtggacaggctcctgagaatggccgcccttgcagcgacctgacggtcgcgccggttcggtaacaccagtgagagctcccatcgcttcgcgacgggccccggccggagaattaaattagttacagcattcaaaaggaaatccatcataaaaccggcgccggtttgccagccaggagcccctccccaccactgaaaagcgccgccgcccccggccgaaggccgggagtagtgtcgcttttaatgatgggtgttgtaactactcttcttcatcgctgtaggtggagctgcggtcagttgtctggtacacgctcgtaagcggccctccggcccgctaacgcggagatacgccccgactgcggctaacgccttgccgggaccactccgaccgcgtacagaggctcctgagacgttttgagcgggtatggctttgcagctaccgtgttaagtttcctggtgtcgctgaaatagttgatgaacatccccctaagcgtcagcagcaagctgccgccgctaaggccccggaaatcacgccctttacgtcgtaaacgccgtaaagcccgctcaccggggttaaaagggattactttgacttcttcattgctgttagatggttaaggctaatcagggcagggggtagggtggcagaatttatagcccggtaaccggctacgccgggctttcggcgccatttgacgccacagacacatgtaacctcatctggcgcctccatgccgctgacgcggcatccagaagtttcccgatgctgtaagtcttaacgtctgctttgtgccaaaggcggaagtaactaacagcagtctgtgtgaaaatacggggagcaggtcagtcagagtgtaccgcagaagtctacttttcaaacgtacattttaataagtagaaaagttattgagtccagtctctgttgcctatatctttaacaaagataaaacatttgaattatctgttaaatgatatggctatcagacatgatgatctgagggcggtagcattccaaaaacaagagcagaagaggcggaagttcaagttgagcatgggcaaaacgatttcaagaaaaaaacgtctatctcagtactatacaaaccgggatgtggcagagttgcttatctcatcattaccatcagacgaagcaagtacaatcattgacttaagtgctggtgaaggctcgttgttgatgacagctgcgctcaaatacgacaacgcaaagctctacggaattgatattgatgatgaaaactgcagaaagttagacctattacaaaacacgacgagtatatgtttagatgcaacccattcagccagttttgataaaataaaggcacaaaacagtacatatggcatagtcattggcaatcctcctttttatacagctgaacatactgcctatacaaggttcttatttaaggagtgggcactaaatcataaaacaaaatattacagagctgaggttttgttcttaatgttatcgcttaagttgcttgatcgagacagttgttgtggaattgttgtacctgatacgatattttcaagcgagaaatataaaccactcagagaaaaaataacctcattatttaaatatatagatgttatagaattagataataaggcatttttgggaactgaagcaaggactcatattctcactgtcagtaacaaaaaatcaataagcccatcaataacaacaagaagttcaaaaaaaaataaagcgataaggcttaaaaaagaagagtttattgaaagggccgaccatcaatataactcttttaaatataacaataacgaaaaaacgattgaaacttcaggtataaaagttatgagagggaatatcagcaaaacgaaaaaaactcaactgcatgatgcgataatccattcatcttctttttataatgatttttctttatttgaaaataacaatgacagtgcagaaaatggttcagccgtacaggcggtgaaaggagatgttgttgtaccccgtgtaggaacaagatgtttggggaaagttgggatcatacgaaacggttctttttccattacagattgtgtttttgttatcaaagcttctgagtacgaatgtggtgaaatggttgccgcggcattaaaatcgaaatttggagtcgactggattaaaagtatttcgaaaggcattggagcgcagtacataacattaaatgacataaaaaaactacccctgcgataataacatcatgaaaatagatcatattacagcaagagatactgaagcgattattgaacaatccaaaaaattaatcaagattggttactgggataatgtaaaagtatcagtactgcaacgctggttagataatttcaaggatgaaaaggaaaaatatcttgcagcctctgtgttaagcgagttgatatatcgtaacagagaaactgttacatctatgggctataatatattctcaattattctcccacagatcttagaggagttagatatttaccatattgaggatattgaaaaatggatgaatgacatcaactcgccaaaacatgcaaggaatcttccgtttcgaacgtccgtaataaataatgtggatagtaaagtcactaaaagtggtgatgtaatacacacattcctacaaagagattttttcgataaaaacttaggggtaaaagttgaaaatatagaaaaattgccaccaagaatcaaagcgatagttttttttgatgatatgcttggttctggcactcaaattgacactttcatgaaagaaacaaatcttgatgaacttggaaagaaaataatattcattccatttgcggctctacgcgattcaacaataaggatacaatctaaatataaaaacctaattattaggcctgttgagtacttggatgaaaatcatagtttctttagagcatccaacaggagaataaatagagaatatttctatacacataatgatttcttaagattgtacattgatatatgtaataagaactcaataagcaatccattagggttcggtaatttggggcttagttatgtcttggcaaactcaactccaaataataatctttcattcctctggtttgaaaatgaaggatggaataggttattcaaaaggtaaaatatgaaatttaacgagattttttcgaaaaaccgtgccgaagaattacctgatgatctctatggtaaatatgttcttcccttagggtacgaagatgtaaatctaaaaaaaacgacaaaagcaagtatagttattggggggagaggatatggaaaaacgatgttcttaaagtatcattgccaccagacagctctaagtgtgaataaagatacgattggtattgaggatctttccaatctgggtatatattggcgcccggatacatcctttagccagttattaaccgaagcttggctcggaaaattttggtcaacagctttcaaaacgtacatgagtctatcgctgattattgagtttgttaaactaaccaataatttattgtccgaaaaatctcctgttttttcgttgaaagagaagattaataatctgaaattgccagatacaatttctgaaggtttgggcattgataaaaatgcgaaacttgttgatgttagcgatcttttacatgaaagactgtttactctttgcaattggataaatgccccagttactgaaacaccaccgttttctcttgatacaaaattttcattacagaatatcattagcaaactacatgcaataactggatgcattataaagcctaattttcaagtttacattgacgagttcgagaacttgacatcagaccagcaggcaataatcaatactttaatgaagcacggatccatgccgttactgttcagtgttgcctataagaaaaatgctaatatttcacataaaacgttaggcaacgaaagcattgttgagcagcatgatttcagatatatagacttagaagaactgtatctcaatgactttgatacatttgctggtgagatattagccctgcgcttttcagattatatagaaaacactgatcatgaaaaactccgttccatatttacgtcagaacatcaaatcccgcacagacaaacgaaggagtatcaggattcaattaaaaatctggccagtaagtttcttcctgaaaaatcgacaaaagagatatcacatgaaatattcagtgatgacgcattaactaaaaaattacattcaatgattgaaaccggtttgtctaaatcaaagtcaaaattgcaagttcaatattttatagatgataaatttcctgaggcaagcctgataaatggtgcattgctgaataggaaaagtattaccccagacgaggtgttagaacaatatttgcaatataaagcaggacatacaacaaaatataaatcatggatacctaacaatctcgtcggtgtaattctctatctttataataaattaccaaccagaatctgcccactgtacgctggctataaacagtttgtatatttatcaagagggaacatcagacattttctggagttatgtcaccagtcggtaacaaaaacaaatatcacgtctccactgccgccaaaaacgataccatccatgacaatcgaagctcaattagaggccaccctgaagacgagtgaactcgaaattgaaaaaataggagattttggtgctcatggaatgcatctaaaaagagtggctaaaagacttggtgcgattttcaactattgccaatctcgacgttctcagagcgaatcagaagtaaaccatttcactttagatttaactgatataaatcttcttgcttataatgttaaggaaatcctaaatgaatcattggtgtggtccgtgctgattgaacagaaaggaacgaagagtaaatcaactgacaacctggaactcaatgattacgtcttacatccagttcttgcaccatattttggaataagccacagaaaaaagaaaaaaataaaatttagcaaaggtgaggttgaaaccatttttgtaggtagtgatgaagatttttcatccttgttaaagaaatatggagcccggtgggatatcgatgactcatcttttgatgtttctagttcagtcacatcataccagttgggcctgttatgataaaattcaaacgtatcagaactcacaacaacttagattttactaatcgccatcatgacatttttttctatggtgaagagttagatgagagaactggcctggcgataaaaaaagtaaacgcaagcaatgcatttcaggttaaatatgtaaaagatgaatatgcattaaaactcaatggtaataaatacaaattgttagcattgaaggatgcattaatctctatgtcgcctaaaaaagtaataatagactctacttctcttgatttccctgaaatattgtatcttttttactccattaatatgattgaaggtatagaatcatttactgttctctacattgaaccgaaagaatacagtaagtcgccttcgactgagggcggggatgaggagtatcaattaagcgatggccgacagccattttcttctcttcccgtattttcactgaatacaatcacatctggcttacaaaaaaccagcctggtttcattcttaggatttgaaaactctcgtctaggccagattttaagtaatgatgatggggcaagcttcaataaattactggcttgtatatcagtcccagcttatatcccaggctgggagaacaaatcactcagaaagcatttattacatttcgacagcatggagacagatctaagaacctgtcctggtgcaaacccttacgccgtatatcagaccttattagatatatatgcagaaaacccaagactggtgctgacatccttaggtacaaagcctacggctatcggtatctgcgttttcttaattaacaatcatccaaataatagcgttgaaaaacaattgggagcaatatatgactatcctataaaatccatcaaccgtacaattggaattggtgagatttactcctacgaactatcaataagctaacgtcccgcctacgttcatacgtttgaagtgttcggtaccaccggctctgtgacagttcaagctcatcatcaaaatcttcggctacaggcctagttttattgtggagagtaattacggtgattgaataagtcgtgaaaattggcaacctccattcggcttgttccaactgatgcagagccgggctattgatccactcaaagagatggctcatgcatcagttgtattgttgtaaagccacaccgtcatattgtatttgaaaagaaaacgctttagtcaatcccagccttaataactgtttgatgttcaatataacgttctatacttgaaaagactatttagatgattaaaactgttataaatactggtatgtataacacgaagtcgaatgagtaaggtattttttgtgtgggatttattcattaagataatgctgctgttaccgattcccttgataactgtttttcccaacattattccttttctgacttatagacaaaatggtgataaaaacaaatccgccctgatggatacactagcccgagagatggataaacaacaaccctgtgcgtatcttgtggagtcatgcgtttctcgaccgcataacatccggccaataccttgggcgtttctgcgggtggtactacattacagtaattcgatggaaatcattcagctagtatcatctgggaggagaatactggcactgttgcaaatataggcttggagggagatggtaaatgttggcttcaccgggagcgaaacgacggtcagggatgttgtggctaagtggcgtaagcaggttaacagtcccgttatcgccccagttcgactcccctcagcatccagggtaagccgctggttaatgccctggcgaatgatcagaggagaagaaaactatgcatcccgcttcatcgaatcgatgtgccagaaagaaccgcaactgaaaatggcgcaacagctgtcgctcgacttctatcgaatgctgaaaacgaagaataaatcgcagttaaatcaatcgttcactgacgtaagtcaaagtgggctcattgaccttcagcgtgttgcggccagtatggaagcggatgcaacagcaatacacgaagcgataagcagcagatggagtaatggcgttgtggaaggccatgtaaaccgcctgaagatgctgaaacgacagatgtacggtcgagctggcttcgagttacttcgacgacgagtcatgagccctctggcttaaacaactccacctaagttgcggaagacccagttttgcaccgttggtaacaatgatgatatcttggacatgatcggatggatgagccctgaccggaaaaccaattttctgagtcattctgcgaatctgcgattttatgcattgtgctctgtggaagggttgaatagctatatagccccggaaaaaattaaggcgcagataaaggtttcacgtggtggaaaaggtatcagcaggttaatcagggtgctcgggaaaaatgagttcatccgaattgtgaaagatagccagacggtactcactatcggcatggacaattccattgcgactggctaggtcaattcatcgccgttgctgtcattaattccgggtttagcacaagagttgtttattagtttaaatattaataactggatgataattagatgaataatatcgagataattgaatcaggatacaatgcgttatgtgatgcttataataattccgttatcagtcttaagcgctcctccctatatgaagatttactagtccatatggatattcctgaaaaaaacaggagccgattcacttatgctactttgaatgatcgcgacgaaataatcgcaatatgtgtgtttattgtctctcttgatgagggaacaactgatgtaggatggtttgttagagcggactttagaggtaaaggggttggtagagatacagtagaaaaggcattcaacgagtttaagaatggtctcaagggggctggagttgaggctatttttattggcgccactgttgataatggtaatactccttcaatttcattggggcagaggtttataggcggagaagaaataatagaaaaagaagacgggactaccatctactcatacctcaatcgtttcacgctttagttaatgggagagggtcaatggaaagagtgagtacctatgtcatggggtagtgaccgggtagctgcgataactgccaacttttcatccctccaccttcacgcacaaacgaacgtatatgtgacaggtacgacatgctgataggctacatgcgggtatcgaaggcggacggctcccaggctaccgatttgcagcgcgacgcgctgattgccgccggggtcgatccagtacatctttacgaggaccaggcatccggcatgcgcgaggatcggcccggcttgacgagctgcctgaaggcgttgcgaactggcgacacactggtcgtgtggaaactggatcggctcggacgcgacctgcgacatctcatcaacaccgtgcacgacctgactgggcgcggcatcggcttgaaggtattaaccgggcacggcgcggccatcgacaccacgaccgccgccggcaagctggtctttggcatcttcgccgccctggccgagttcgagcgcgagttgatcgcggagcgcacgattgccggcctagcctcggcccgcgcgcgcgggcggaaaggcggccggccgttcaagatgaccgccgccaagctgcggctggcgatggcggcaatgggtcagccagagaccaaggtcggcgacctgtgccaggaacttggcgtcacgcggcagaccctgtatcggcatgtttcacccaagggtgagctacgtccagatggcgagaagctactcagccgaatttgatgccggcatgaggcaacgtagcgacagcgtggtttgtctcaatgggaagcgctcatgatcgatctttgaaggcccgcagcagtcgtgtcacagacaggacgaacaaaccggtcagcgtgagggctgcgataccccagtactctccgatgaacgcgccggccgtcgtgccggccagcacaatggcgagaatcggcaaatggcagggacaggtgagcacggccagcgcgccccacaggtagccggtgatcggtttgtgcgtctcggacggcaagcgctcggggctgttcatggcagactctccgcgtgctgtgccggctcggtcggcatggtggccaactgcacctccagatcggccaacgcttcgcgccgacgctcgacgaactggcgcagaacggcaagctgcgcggccgcttcatcgccgtccgcagcatccagcgcccggcacagccgcgccagcgcgtccaggccgatgcccgcctcgaaggccgcccgcacgaagcacagccgttgcaaggcggcatcatcgaacaggccatagccgcccggggtgcacgccaccggacgcagcaatccgcgcagcaggtagtcgcgcacgatatgcacgctcaccccggcatcaagggccagccgggacacggtgtaggcgctcattgaaaacctcctttttttatccagcgcagcaggaaagctgcttcacgtccttgttgaaggtctgcgccgcaagcttcaacccctcgaccattgtcaggtaggggaacaactggtcggccagttcctgcaccgtcatgcggttgcggatggcgagcaccgccgtctggatcagttcgcccgcttccggggccaccgcctgcacgccgatgagccgtccgctaccttcctcgatgaccagcttgatgaagccgcgtgtgtcgaagttggcaagcgctcgcggaacgttgtcgagtgtcagcgtgcgactgtcggtctcgatgccatcgtggtgcgcttccgcctcgctgtagcccacggtggcgacttgcgggtcggtgaacaccactgccggcatcgcggtcagattgagggctgcgtcgccgccggtcatgttgatcgcggcacgggtgccggcggccgctgccacgtagacgaactgcggctggtcggtgcagtcgccggccgcgtagatgttcgggttgctcgtgcgcatgccttggtcgataacgatggccccttgcgcattgacagtgacccccgccgcgtccagcgcgaggctgcgcgtattcggtgcccgaccggtggcaaccagcaacttgtcagcgcgcaattcaccgtgtccggtggtcagcacgaattcgccgttcacatgggcgacctggctggcttgcgtgtgctccagcacctcgatgccctcggcgcggaaagcggctgtcacggcctcgccgatggccgggtcttcccggaagaacaaggtgctgcgtgccaggatcgtgacctggctgccgagccgggcaaaggcttgcgccagttccaacgccaccaccgacgaaccgatcacggccaggcgtgcgggaatggtgtcgctgacaagcgcttcggtggaagtccagtagggtgactctttcaggcccggaatcggcggcacggccggactggcaccggtggcgaccaggcagcggtcgaacgttacctcgcgctcgccaccctcgttcaaacggacgaccaggctctggtcgtccttgaaacgcgcttcaccgtgcaaaacggtgatggctggattgccgtccaggatgccttcgtatttggcgtgccgcagttcatcgacacgggcctgctgctgggccagcagtttgctgcggtcaatcgcaggcacagttgccgcaataccgccgtcgaacggactttcccggcgcagatgggcaatatgggcagcgcggatcatgatcttggacggcacacagccgatattgacgcaggtgccgccgatggtgccgcgttcgatcagcgtgaccgtcgcgccttgctcgacggccttcagcgccgccgccatcgcggccccgccgctgccaatgatggcgatatgcaaaccggcgccctcaagtgcatcacggatttttggttcatctttgaaatcaccaacccggatcgagccttgataacccaatgcggcgatggcggccagcagttggttgtggctcacggcggtgtctgccatgacttgcgcgcggctttctggataggacaccacagcggcattcacgccgggaatcttttccaaagcatctttgacatgggtggcgcaggatgtgcaggtcatgccattcacggtgatttcggtcatttttttactccattgaatttcggggtgcagcaggcatcggcttggcgttttcgttggatggcgtagatggtcaagccgatgaaaatcgccagcgcaggcagcagcacatagtccagatagccggtcagcgcggacaagccgaccacaccgagcaaaatgaccagaacaggggtgaagcaacacagcgccacgagggttgtgccaatgatgctgacccgcagcagtgtcttcgggtctttcatgatcagttcttgactgatgatgggtagcccgcatcctcggtagccttggtcagtttctgcacgctggtcttggcatcatcgaaggtgaccaccgcttcgcgcgtctcgaaggtcacgtcaactttactgacgccatcgaccttggaaatcgccttcttgacagtgatcggacaggccgagcaggtcatgcccggtacggacagcgtaacggtctgggtggcggcccacacgggggcaacaacggcagcgagggcaagggcggaaagcagctttttcatggtgaactcctgtgatcaatagaaaaatggcacgacgtagggaaatccgagcgcgaccaaaaccagcacggccacgccccagaaaatgagcttgtaagtagctcgcacttggggaatcgcgcaaacctcacccggtttgcaggcggctgacggccggtagatgcgccgccaggcgaagaacaacgccaccagcgccacgccgataaagatggggcgatagggttccaacaccgtcaagttgccgatccaagcgccgctgaaccccaaggcgatcagaaccagcggcccgaggcagcaagccgaggcgaggatggcggccagcccgccagtgaagagcgcgccgcacccgttttgaggttcagacatacgtttgtcctttcgaatctgaattggatagcttaagcttacttccgtagttatgtacggagtcaagcgatatggaaaacaatttggagaacctgaccattggcgttttcgccaggacggccggggtcaatgtggagaccatccggttctatcagcgcaagggcttgctcccggaaccggacaagccttacggcagcattcgccgctatggcgagacggatgtaacgcgggtgcgcttcgtgaaatcagcccagcggttgggcttcagcctggatgagatcgccgagctgctgcggctggaggatggcacccattgcgaggaagccagcagcctggccgagcacaagctcaaggacgtgcgcgagaggatggctgacctggcgcgcatggaggccgtgctgtctgatttggtgtgcgcctgccatgcgcggaaggggaacgtttcctgcccgctgattgcgtcactgcaagggaagaaagaaccgcgcagtgcggacgcggtgtagcccgagggaactacgccttagcgtgctttattttccgttttctgaggcgactccaacgtcagaaaagaccgtgcggtcgacttttgatatttcgtgctgtcgccttctgaaagtgacatcgggatcctcggccgacaaggtgcaacagccgacgatgccgtcgctgcaactcgcgactaggagctcggatctcaggacgaaggtctccgcgaatgtccggtcgatccgcgcgacgtcccaggcgggcgttcccttggcggacatccacgccgcagcgtcgtgcatcagccgcacaacctcgtcgatatcacccgagcaggcgacccgaacgttcggaggctcctcgctgtccattcgctcccctggcgcggtatgaaccgccgcctcatagtgcagtttgatcctgacgagcccagcatgtctgcgcccaccttcgcggaacctgaccagggtccgctagcgggcggccggaaggtgaatgctaggcatgatctaaccctcggtctctggcgtcgcgactgcgaaatttcgcgagggtttccgagaaggtgattgcgcttcgcagatctccaggcgcgtgggtgcggacgtagtcagcgccattgccgatcgcgtgaagttccgccgcaaggctcgctggacccagatcctttacaggaaggccaacggtggcgcccaagaaggatttccgcgacaccgagaccaatagcggaagccccaacgccgacttcagcttttgaaggttcgacagcacgtgcagcgatgtttccggtgcggggctcaagaaaaatcccatccccggatcgaggatgagccggtcggcagcgaccccgctccgtcgcaaggcggaaacccgcgcctcgaagaaccgcacaatctcgtcgagcgcgtcttcgggtcgaaggtgaccggtgcgggtggcgatgccatcccgctgcgctgagtgcataaccaccagcctgcagtccgcctcagcaatatcgggatagagcgcagggtcaggaaatccttggatatcgttcaggtagcccacgccgcgcttgagcgcatagcgctgggtttccggttggaagctgtcgattgaaacacggtgcatctgatcggacagggcgtctaagagcggcgcaatacgtctgatctcatcggccggcgatacaggcctcgcgtccggatggctggcggccggtccgacatccacgacgtctgatccgactcgcagcatttcgatcgccgcggtgacagcgccggcggggtctagccgccggctctcatcgaagaaggagtcctcggtgagattcagaatgccgaacaccgtcaccatggcgtcggcctccgcagcgacttccacgatggggatcgggcgagcaaaaaggcagcaattatgagccccatacctacaaagccccacgcatcaagcttttgcccatgaagcaaccaggcaatggctgtaattatgacgacgccgagtcccgaccagactgcataagcaacaccgacagggatggatttcagaaccagagaaagaaaataaaatgcgatgccataaccgattatgacaacggcggaaggggcaagcttagtaaagccctcgctagattttaatgcggatgttgcgattacttcgccaactattgcgataacaagaaaaagccagcctttcatgatatatctcccaatttgtgtagggcttattatgcacgcttaaaaataataaaagcagacttgacctgatagtttggctgtgagcaattatgtgcttagtgcatctaacgcttgagttaagccgcgccgcgaagcggcgtcggcttgaacgaattgttagacattatttgccgactaccttggtgatctcgcctttcacgtagtgaacaaattcttccaactgatctgcgcgggaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatgcccgaggcatagactgtacaaaaaaacagtcataacaagccatgaaaaccgccactgcgccgttaccaccgctgcgttcggtcaaggttctggaccagttgcgtgagcgcatacgctacttgcattacagtttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcagctgtcgcgtgcacgggcatggtggctgaaggaccaggccgagggccgcagcggcgttgcgcttcccgacgcccttgagcggaagtatccgcgcgccgggcattcctggccgtggttctgggtttttgcgcagcacacgcattcgaccgatccacggagcggtgtcgtgcgtcgccatcacatgtatgaccagacctttcagcgcgccttcaaacgtgccgtagaacaagcaggcatcacgaagcccgccacaccgcacaccctccgccactcgttcgcgacggccttgctccgcagcggttacgacattcgaaccgtgcaggatctgctcggccattccgacgtctctacgacgatgatttacacgcatgtgctgaaagttggcggtgccggagtgcgctcaccgcttgatgcgctgccgcccctcactagtgagaggtagggcagcgcaagtcaatcctggcggattcactacccctgcgcgaaggccatcggtgccgcatcgaacggccggttgcggaaagtcctccctgcgtccgctgatggccggcagcagcccgtcgttgcctgatggatccaacccctccgctgctatagtgcagtcggcttctgacgttcagtgcagccgtcttctgaaaacgacagcgcggcacgggaatcaaggcattgcgattctcgaaaatagttcttgaaattctattcttgattgcatatcatctcaacgagtttcgataagaaaggatgcgcatgcgaccgtctgttgtgcttgacatgaagcgaagcgcagtgcgtgaagcggtaggccgctttcgcgccgcgaacccgcgcgtcttcggctcggtgctgcatggcaccgaccgggatggcagcgacctcgacctgttggtcgatgcgctgcccggtgccacgttgttggacttgggcgatttggaagaagaactgaaatcgctgctcggcgttgacgtcgatctgctgactcccggcgacctgccgccgaagttccgggccaaggtgctcgcggaggcgcaaccgatatgagcgagaaccgcctgcccgattacctcgaccacattcagcaggccgcaaccgatgcgcgcagcttcgtggaagggatggccaaggacgacttcttggccgacaagcgcacccagcaggccgtcatcatgagcctgatcgtcatcggcgaggcggccacaaaggtgatggatggctacgtcgagttcacccaggcgcatgccgacgtgccgtggcgcagcatgcgcaatatgcgtaatcgcatggctcacggctatttcgacatcaacctcgatgtggtgtgggagacggtacaggaatggctgccggcgttgctccagcaattgcccgccgtgcgtcaggatgccgacgatgaagaccgtaacgacaactgtgaaagagggatctccgatgactgttgaatcgagaatattttctgtagccgagtatgttcagccgtccgaaggcgagcctattcgttccgttgtgcttgaaacccgagactcaattatcgtggtttggcatgtccatcccgggcaggaaattgcggctcacattcatcctcacggccaagacacgtggactgttttgtcgggaatggctgattactttcagggcaatgggattgttcgtgccctcagggaaggtgagatagccgtggcaagaccgggccaagtgcacggggcgcgaaatacaggtaccgagccatttgtgttcgtctcggttgtggcatcagccaatgccggtttcgtattggctgagcgatagagcccaatctctggagttggtccaatgagcggtcggggagataggtaacagacatgcagcggacacggctgctaaaccaggtcgcaaacctccttgcgtcgcagcgtgccgcaagcgacgcgatcaatcgaatggggtcggcatgagactgaacaccatccagttcccgaccgcgtagccgcctgtcctgccgatcaggtcttgaccatcgacgcctgggatcagtcctgaatgttcttggagaccactacgttatgagccgcagccgccgcaaaacacccatcgtcgggcacacgacctgcggcagcgagcgcgaggacaagaagctctggcatcagcgctggcgcacccgtgagcgcacggcgctgaccagcgcgtcgcccgaagccctgagcgcccatctgcccctgctggaaaaccaggccagcagcgtctggtcgatgggcaaggatggccgctcctactggcccgtcaagcgccaggccgccacggcggatcgcatcgccaatcacaagggacgcaacccgcaagaacgcgcctccctgaaaaagcgcctgctgcgcaagtggatgagcaaatgaagctctccttccatcagcacattgcgctgttctggatgatcggtgctccgggcgtcttcgcgcccgtgatcgagaacgccaagcggcccgatgccggcgccgtcatggcgtggggtgtcgcgatcgtggcggtgatgatcctcttcacccctttgctgctgcgctgtccaccattccggcgctggtatggccggacggatgcgctgtcggagcggcagcgccaggcgcttgccgagcgcggcctgcgccgctactaccagaccgctttcgatgacggctacgtgccccgcgtgatgccctacgtgtggcgcctcatctggacggtcggcgggttgatggctgtgaccgccgtactgcctaccaacaccggacggccagccttcgatgccttggtggtcttctcgacctggtatccgataggcgtgatgctgctggttttcgcgtcgaggccccttggccggttgattcgccaaagagcacaggagcggcggaaatgagcacgtcaaccatcgaggcgctggccagcgcctgggcaaggattgccgaggaagcggaattccccgctgactacgaggggactgccacaccacaagcgcatcgggctagcgaagctattcaggagcagattcgggagcgcatcgtcgccaccaacgacatgcggctgttcagcctgctgcacctgctgggtcaggcgtcgctgcgcatggagcaagcgctgtggccggaggattacgagcggatgacgcgcgaggttgaggaagccctgcggcaagccaccgacgccaacgccagatcgtacacccacgaagaagtgatgcaggcgatgcaggaacgcatcgaccgggcgcgagacaagccatgttgattggctatgcgcgcgtctcgacgcaggatcagaacctggagctgcaacgcgaagccttgagcaaggccggatgtaaaaaggtcttcgaggacaaggtgagtggcacgcgggcagaccggcctggcttggccaagacgctcgaaatgctgcgcgaaggcgatactttggtcgtctggaagctcgaccggctgggccggtcggtcaagcaactggtcgatctggtcggcgatctgcacaagcacggtgtccagttcaggagcctcaccgactccatcgacaccggcacaccatccgggcggttcttcttccacgtcatggcgagccttgccgaaatggagcgcgagctgaccgtcgagcgcacccgcgccgggctggaagtcgccaagcagctcggccgcaaaggcggccgcaagccgaagatgaccgacagcaagatcgagtcggccaagaagctgctggccagcggggtgccgcccaaggacgtggccaagaacctcggcgtgtccattccgacgctgtaccgctgggtgccagcctccacgcacgcttagcgtgctttattttccgttttctgagacgacccccgtcacagggaaaaaccctggccgtcatgcaggtcagcggcggctcacagtcgttcaacgctgtaaatcagatgcgtattcttggacgctggatgcggatgatcaccatcccgaatcagtcatccgtggcaaaagcctgggccgagtttgatgaggatggccgcatgaagccttcttcgtattatgaccgcatagtggacgtcatggaggaactgatgaagttcaccctgctgacgcgcggtcgcagtgattatctcaccgaccgctacagcgaaaggaaagagagtgccgcgcagctttctgagcgggtcaaccagcgcagcatataaaaaagccggcagatgccggctttttccacactgttatgcccgcagcctggtaaaaaatcagtggctgacgcggttcccgtgctcatcaatgacggcttcgccgtcctctttggtaaacgcgccctgctgcgggtccggcagtatgtccagaaccacttcggagggacggcacagcttcgtgccgagcggtgtcactaccaccgggcgattaatgaggatcggatgagccagcatggcatcgagcagttcgtcattgctgaagcggtcttctgccaggccgagctgttcgtacggttcggtatttttgcgcagcaggtcgcgcacgccgatgcccatatccgcaatcagcttcttcagctcatcgcgtgacggcggcgtttccagatacagaataaccgtgggttcggcgccgctgttacggataagcgccagggtattgcgggatgtcccgcaggccgggttgtggtaaatggtaatgtcagtcataagcggtactccgtaaaggggctgcacgggcgcagccccggggttaaagttaaacagacaggcgcagggccagcgcggccagcgtgacaaaaagcaccggcagggtcatcacgatgcccacgcggaagtaatagccccagctgatggtgatgtttttctgtgccagcacgtgcagccacagcagggttgcgaggctgccgataggggttattttcgggccgaggtcacagccgatgacgttggcgtaaatcatcgcctgcttcaccacgccctgtgcgctactaccgtcaatcgacaacgcgccaaccagcacggtgggcatgttgttcatgacggacgagagtgccgccgtcaggaagccggtgccgagcgttgcgccccatacgccgtgctctgcaaaccggttcagggcggcggaaaggtaatcagtcagtccggcgttacgcagtccgtataccaccagatacatgcccagcgaaaagataacgatctgccagggcgcgcctttcagcaccctgccggcgtcaatcacgtgtcctttgcgggcaaccagccagagaataaacgccgccaccgccgccaccaggctgaccggcacgccgagcggctccagagcaaaaaagccaaccagcagaagaaccaaaaccacccagccagccttaaaggttcgtgcatcccggatggcttcccgcggtgccttcagcttcgccaggtcataggtgaccgggatgtccctgcggaaaaagagatgaagcatcaccagcgtggccgcaatggaggcaatgttcaccggcaccatgacggatgcgtactcgctgaagcccagcgtaaagaagtcagccgttacgatgttcaccaggttcgatacgatgagcggcaggctggaggtgtcagcgataaagcccgctgccatcacaaacgccagcgtggagccgggagtgaatcccagcgccagcagcatggcaataacgatcggcgtcagaattagcgcggctccgtcattggcaaacagcgccgccactgcggcacccagcagaacgatatacgtgaacagcagccggcccctgccgcctccccagcgggaaacgtgcagcgcggcccactcaaaaaagccggactcatcgagcagcaggctgataatgatgaccgcaatgaacgtgcccgtggcgttccagacaatctgccagaccaccggaatatcaccgatgtgcaccacgccggtcagcagcgccagcgccgcaccgatgacggcactccagccaatgctcagccccttcggctgccagatgaccagtaccagcgtcaggatgaaaatcgcacctgccagaaacatacccgctcctattgaatacaaatgcctgttaaaccggactgataaattttcgatgcgtaatatattcgataatccagatatataccggtaaatttttaaatgcagacaggcttgccgttggtggtggcgttatcgcgttcagcctgccggctgagctggcggatatcatcccgctggcagagataagcctgttcgataaccgccgctgcccacgccggcatatgaggcgacagacgatagtggatccattttccgtcccgccggtcggtaagcagcccgttttctctcagcagagccagatgccgtgagattttgggctgagtttctttcagcacggacgtaagttcacagacgcagagctcccctttttcgcgtagcagcagcacgaggctgagtcgggtttcgtcggaaaggcttttaaaaagctgcaggggggacacgggtggcatggtgactccttattgtgactgacctgagtgtacctgtgaaactttctccgtcaaatttatattcacttaatcatatgtatgtgcgaacgccggacgagcctgagcatgcagaaggactttccgtccggatgcgcctgaccggcattccatgaacagcgtttttgccctgcgcgttgaccccgttaacaattcgtgtagagtaaaaagcgctttttgccgtggttcatctgcccggcgggcatttgtggccggtactgaacgtctgttcatccggtctttctgattacccgcgctgctctgtcagccgtgaaggagtgataaacaccaccatgcgtcttacgccaccctgagtcgtacccctcctctgtcgcactgaataaacttcggcgcgcactcaaaaacatcccgtctgcggatgtgctttttcgtacgtaaaatttttgccctcacgggctgaccgtaatcaaaaactgagaaatgactatgctgctgtcctcgacgcgtaaggactggctgggtaacgtccgtggtgacgtccttgccggtattgtggtcgcgctcgcgcttattcccgaagcgatcgccttttccatcatcgccggagtcgacccgcaggtcgggctctactctgcgttctgtattcccctggttatggccttcctcggcggccgtccggcaatgatatcgtccgccaccggtgcgatggcgctgctgctgatcacgcttgtaaaagaccacggcctgcagtatctgctggcggcctcggcgctgaccggcgtactgcagctggcggccggctacctgaagctgggcagcctgatgcgctacgtctcccgctcggtggtcaccggtttcgtgaacgcgctggccatcctgatatttatggcgcagctgccggagctgaccaacgtcacctggcacgtttatgccctgaccgctgcgggcctgggcatcatttatctcttcccgtatctgaacaaaaccattccctcgccgctggtctgcatcatcgtgctgaccgccatttccatgtggctgcacctggacgtgcgcaccgtgggtgacatgggcaaactgccggacagcctgccggtgtttctgatcccggatatcccgcttaacctcgacacgctgatgattattctgccgtactcggcaggacttgccgtggtggggctgctggagtcgatgatgaccgccaccatcgtggacgacatgaccgacacgccgagcgataaaaaccgcgagtgcaaggcgcagggcgtggccaacatctgcacctcctttatcggcggcatggcgggctgcgcgatgattggccagtcggtgatcaacgtcaaatcgggcgggcgcgggcggctttccacgctcaccgccggcgtggtgctgctgctgatggtggtgttcctgcgcgactgggtgtcccggatacccatggcggctctggtggcggtgatgatcatggtctccatcggcaccttctcctggcgctccatcagcaacctgcgcagccatccgctgtcaaccagcgtggtgatgctggccaccgtggtggtggtggtggcgaccgataacctggcgtttggcgtgctcaccggcgtgctgattgcctcgctgaacttcgccaccaaggtcgcccgctttatggcggtctcctctgagctgaaggacgacacccgcacctataccgtagccggccaggtattctttgcctcatccgatcgctttatgagccacttcgacttccgtgaagcggtggagcgcgtggtgattgacgtaacgcacgcccacttctgggatatcacctccgtgagcgcgctggaccgggtggttatcaagttccgtcgcgaaggcacggaagtggagatcaagggtatgaatgacgcgacccgcaccctcgttgaccgcttcggagtgcatgacaagcctgaagaagtggaaaagctgatgggtggccattaatttactggagaaagcatcatgaataacaccgttattgcctgcgttgacggctcgccgtcaacccggccggtctgtgagtatgctgcctgggcagccggtaaacttggcgcgccgctggcgctgctgcacgtgctcgaaaagagtgagactcccgccgtgtctgacctgaccgggagcattggtattgacagccgggagcagctgaccgaagcgctggtccgcgtcgagggtgagcgcagccggctgctgatggcgcagggcaaggccgtgctggccggctgtgcggagctcctgaagcagaccggacagccggacgcacagctgctgcaaaagcacggcgcactggacgaaatcctggcggagctgggcgaagtccggctgatggtgctggggcgccgcgggacgcagaatcaggtaggcagccatctggaaagcgtcattcgcctgcagaaaaacccggtgctgattgtgccggagacgtttacgccgccggcgcgggtgatgtttgcgtacgacggcagcagtgagagccgtaaaaacctgacgcgcctgacggtcagcccgctgctgcacggcctgagctgtcatatcgtgatggtcaacggtgacatgtcagccctgcaggatgcgcaggctgttcttcaggaagccggtatcacgaccgagacacgcctgctggaagacgagtccgtaaccggggcgctgtgccgctacgcggacgcccatgatatcgacctcacggtaatgggggcctgcgggcactcccggttacggcgattctttattggcagccacaccacggaaatgctgtctgaaagccgtcagcccctgctgatgctgcgatgaaacaggcgggcctgatatcaggcccgccttcacaggggaaagaggatgacgggtatgaaggtaaaggcgcgttattgcggcgcatccgtcctgataccggtggccagcaggctggcgccaagaatgtagaccaggcagaacagggcctgaagatgcagggtgacatggttatctatcagcacgcccatgattaccggggatgccccgctggcaatcaccgtccctgcctcaaccgccgagcgcaccctggccagctgcgccggaccaaacagctgtacccagagcgcggtggcaagcgttgaggcaatggccgacgatacgccggtcataatcaggtaaaaaggcgtcacccactgaccgttgctgagccatagcgccagcatggccagggcctgtggcatcagaaaccacggcagcagcctgcgtggtgagagccggtcaatcagcgggccaaacgacagcagcgataccgcctgggtaatggcataggcaataaaccataccgccacccacgacagctcccagcctttctcctgtgccagcctcgcctggtggaagaagaagccggtggtgataaagggggaggccagcacgacaggcagcgccagcagcaggttgcggtttcgccataccggcgcctctttttctttctcctcaccccgctttctgaacgtacgcagcggcttctctttcccgcggggcaaaaacatcagcgcgacccccacgccggcaacaagcattccggcattgatgccccaggcagcgcgccatcccgtcagcgcgcttatctgcaccgcaatcacaggaaaaacggcctgcgccagcgagagccccagcgcgatggcgccgagcgccttgcctgcatcaagggggaactggcgcgccgttgcggtcagcgcagtatgcaccatcagtccctggccgccgaggcgcagaaagtaaaacccgatgcacagcatccacgccgcctgtgcgccggaaaccagcaggcaggccgtgagcagcaaaagggtgaccgccagcgtgaagcggcgggtcgtggtgtagtcaatcagccgtccggcccaggtcagcgtgatggcgctcatcaccgttccgattgcgtacaggccgcccagtccgccgtcggtgagcccaaaggcctcacgaaaatcctgcccgtaaagtgagacaaaataggtctgtccaaagctggacatggccatcagcatcgcaccgaacgtaaggtgagaggcgtgatgaaacataaaccgaaaaagctgacgcatgaatatccctgaaggcgggctgcagcccgccgattaatcacgacgtgtccgtaccggctgctgcggacacggcgcctgcgtccctgaagcaggtacacgcgggttcaccgtgaaaggtggcagtcccgtaacggatatgagagaacggtacccggcgcggactggctgtcgcggcaggctctctgataaaggacgggcgaagagaaactcagggtggcgtaatgtgcatgactcacagtcagatataaaatgctgccgaaacgataatttttaatgctcttcaggtcaagcctgaaaacgggctcctcatgcccgccgcagggggagtcgcacaaaaacagtggatagccgcttgattaacgcccgtgaccgggccagaattgcggcgaggtgatggcgttccaccttacccaaccgcttcccctgagaagctgatgacgcctgatattactcccctttaaccgggagtaggctttgttgaataaatcagatttcgggtaagtctcccccgtagcgggttgtgttttcaggcaatacgcacgctttcaggcatacctgctttcgtcattttgttcagcgctcgtaccagggccat
